United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 34

SEQ ID NO: 191124 - protein, 93 aa, Triticum aestivum
  unsure (1)..(93): unsure at all Xaa locations
  Clone ID: PAT_TA_85542.pep
MSAYCGKYKDELIKNAAYIGTPGKGILAADESTGTIGKRFASINVENVEDNRRALRELLFCTPGALQYLSGVILFEETLYRAXRVASLRGKGG

SEQ ID NO: 191125 - protein, 127 aa, Triticum aestivum
  unsure (1)..(127): unsure at all Xaa locations
  Clone ID: PAT_TA_85543.pep
MANPRVFFDMTVGGAPAGRIVMELYKDAVPRTVENFRALCTGEKGVGKSGKPLHYKGSAFHRVIPDFMCQGXXFTRGNGTGGESIYGEXFADXXFVXAHKPGILSXXNAGPNXXGPLSDVPARQWSS

SEQ ID NO: 191126 - protein, 119 aa, Triticum aestivum
  unsure (1)..(119): unsure at all Xaa locations
  Clone ID: PAT_TA_85544.pep
XVGGXSLPKXRQXXXASAALXLTAITRLLRXHLLNRGAPPRPAVDADASSVRRTSPRTRRSPGHHHRSCCSQMAVPQPPPPRRYGRVTTSQSKLTRLSPSYEGADVAARQQTHAAARIG

SEQ ID NO: 191127 - protein, 81 aa, Triticum aestivum
  unsure (1)..(81): unsure at all Xaa locations
  Clone ID: PAT_TA_85545.pep
XTGXHVQHMAKVHKDQVLFXGCYCTESYEDHSSIAKPNQLPYEQNVSSMFPIKAITRTSSISQWTCYFLPFVPNVSTFLMP

SEQ ID NO: 191128 - protein, 44 aa, Triticum aestivum
  Clone ID: PAT_TA_85546.pep
WSLHVRRCHTSLSVMDNELPSWRGQDRGDCSNRAAVGEVSRSAC

SEQ ID NO: 191129 - protein, 57 aa, Triticum aestivum
  unsure (1)..(57): unsure at all Xaa locations
  Clone ID: PAT_TA_85547.pep
GRASLNYSSEEEKAAAVEAWVACHGKEPKSVIGLQASEISWDHXGXHHYYKAGVPWW

SEQ ID NO: 191130 - protein, 60 aa, Triticum aestivum
  unsure (1)..(60): unsure at all Xaa locations
  Clone ID: PAT_TA_85548.pep
VSVCXCXHXXTXRTHCVXIYXYATCMHXXVCVXEXSTXCCTIXYPMCXCDVLDVLVQAIN

SEQ ID NO: 191131 - protein, 74 aa, Triticum aestivum
  Clone ID: PAT_TA_85549.pep
PCIRNHNVIILTCIHLYIHGTIGKKPHRSVLQKYVREKKMEGEKRKKLPDLRFSGAVHRELLVKSAVWLHHSAW

SEQ ID NO: 191132 - protein, 143 aa, Triticum aestivum
  unsure (1)..(143): unsure at all Xaa locations
  Clone ID: PAT_TA_85550.pep
SRSSLCSHPVLRLFSPRILQFLIQINALRHTTWPQVLIAAGGRGERDQAARMNLFGGSGIGSGDMPPPQHQQLEEVMGHGDPMLVAMRNNYRQRILEHAXRVVXARLHKGLRVLLTGXGGCRTCKAGXXILFEKHQXXGSTTX

SEQ ID NO: 191133 - protein, 91 aa, Triticum aestivum
  unsure (1)..(91): unsure at all Xaa locations
  Clone ID: PAT_TA_85551.pep
PXRHHSSSRSXFLNPPLXQSPRFAXSSSXEPEXXFXNEXXRHGKLRXGMXTXFLXXLGXAPRNTGSFXXGXWGXSGXXXTXXNTSXNRGHC

SEQ ID NO: 191134 - protein, 119 aa, Triticum aestivum
  unsure (1)..(119): unsure at all Xaa locations
  Clone ID: PAT_TA_85552.pep
RSFPFLAAAAASYPLEADPTMADVDVDTEVAAGAQPKKRTFRKFSYRGVDLDALLDMSTDDLVXMFPARARRRFKRGLKRKPMALVKKLRKXKKDAPAGXKPEPVRXHLRNMILDWLIG

SEQ ID NO: 191135 - protein, 53 aa, Triticum aestivum
  unsure (1)..(53): unsure at all Xaa locations
  Clone ID: PAT_TA_85553.pep
FVXPWLIPRXGKXNTPXXLSWXXXLNMCTCSSTLGHRAVNYLVLLSXVYMWLD

SEQ ID NO: 191136 - protein, 88 aa, Triticum aestivum
  unsure (1)..(88): unsure at all Xaa locations
  Clone ID: PAT_TA_85554.pep
PPLXQXFGGXFXXFGXRFXXPWGXSPCXXGNRXXXEAXXQDXXEGXDIXREGNEIIRAACKWSPELAAACEVWKAIKFEFEPVDTIDK

SEQ ID NO: 191137 - protein, 89 aa, Triticum aestivum
  unsure (1)..(89): unsure at all Xaa locations
  Clone ID: PAT_TA_85555.pep
RHTAPXPXPSLSXRXXLXAXSXSXPRRSRTRTETAERSWWVSRRRGWDDEGGVMGGGGAWRWRGGAVVVVALSMGERRDFVWRGCDRGD

SEQ ID NO: 191138 - protein, 60 aa, Triticum aestivum
  unsure (1)..(60): unsure at all Xaa locations
  Clone ID: PAT_TA_85556.pep
LEXLTYXXXLIFXXVXSTWLCCQXVNKXFXXNALHKLKIGAECCEYRFLSKPEGTXYHXX

SEQ ID NO: 191139 - protein, 77 aa, Triticum aestivum
  unsure (1)..(77): unsure at all Xaa locations
  Clone ID: PAT_TA_85557.pep
MREEEEPXWFARFDEDLPAPDELMPLSQSLITRDLAAXFDIPXXHGGGGPLSGGADAGGAGGQMNGASSVAGSSGGN

SEQ ID NO: 191140 - protein, 75 aa, Triticum aestivum
  Clone ID: PAT_TA_85558.pep
SMSSSAIHSSTLTRRDITKFEMAEKLLISGTDGELMHCWIVHWTDLVILVLFTRMRRACMRCKDWVYRREIYWRS

SEQ ID NO: 191141 - protein, 64 aa, Triticum aestivum
  unsure (1)..(64): unsure at all Xaa locations
  Clone ID: PAT_TA_85559.pep
DEQSWCLCLCVGRAIRPTICILLSSCLGQCVFSLEKGWWCLYLFTYSPSINTCXDCTCSPIRRE

SEQ ID NO: 191142 - protein, 95 aa, Triticum aestivum
  Clone ID: PAT_TA_85560.pep
FTREIEMASTGENVPVQSKAIFQSCFSTIRWAKAVSKMSVSKMSVLQRSFIPEQFKHLLNVREHVILPMDLLQWLAKHIRYGQVVFLSRDSIHIT

SEQ ID NO: 191143 - protein, 87 aa, Triticum aestivum
  Clone ID: PAT_TA_85561.pep
NLTVGGILHRVEIKLLLKKRSMCMASINSGVVHLLPPDRCRGGSTSARQDLLFPTRSEGMVIFLYRVGAPSEEHLASSYLTSLFYSW

SEQ ID NO: 191144 - protein, 88 aa, Triticum aestivum
  unsure (1)..(88): unsure at all Xaa locations
  Clone ID: PAT_TA_85562.pep
ATKTKIWTASTSYTACLLGSSIPVKTIPMKRKNVYAKRWHLAGGCKHIMSPPLGAHGSGLGKANHGLSLPWHQNKRDLNACADPTXVH

SEQ ID NO: 191145 - protein, 144 aa, Triticum aestivum
  unsure (1)..(144): unsure at all Xaa locations
  Clone ID: PAT_TA_85563.pep
MAALSSAAVSVPSFAAGAKVAAPRSSRMVVRASLGKKAASAAVAMAXSAMLLGGSAMAQDVLLGANGGVLVFEPNDFSVKAGETITFKNNAGYRXNVVFDEDAVPSGVDXQDLQEEYSTPRGDFSVXSRPGTTXHCNPPGPDGK

SEQ ID NO: 191146 - protein, 50 aa, Triticum aestivum
  Clone ID: PAT_TA_85564.pep
PDFISISSTYPLVLYTQSSVASGCSSLCVKEYHVFLICLNSRGFVKALSF

SEQ ID NO: 191147 - protein, 56 aa, Triticum aestivum
  unsure (1)..(56): unsure at all Xaa locations
  Clone ID: PAT_TA_85565.pep
MAXPRTLVLGXLLAXAVANAEAASVVIGQXKCADCTKXNIXAXEAFKGLQVAXKCX

SEQ ID NO: 191148 - protein, 65 aa, Triticum aestivum
  unsure (1)..(65): unsure at all Xaa locations
  Clone ID: PAT_TA_85566.pep
AERRIPSPPRADRGQPMAARPPPSPATTPXPPPPGPQPPPPGGKARPPXPXAXPLXXGAFPKPTP

SEQ ID NO: 191149 - protein, 111 aa, Triticum aestivum
  unsure (1)..(111): unsure at all Xaa locations
  Clone ID: PAT_TA_85567.pep
MSDTDEHHFESKADSGASKTYPQQAGAIRKGGHIVIKARPCKVVEVSTSKTGKHGHAKCHFVAIDIFNGKXLEDXVPSSHNCDSPXLTAKISVIDITDDGIQLLTEMEHEG

SEQ ID NO: 191150 - protein, 109 aa, Triticum aestivum
  unsure (1)..(109): unsure at all Xaa locations
  Clone ID: PAT_TA_85568.pep
RTKAVRKGSRRRLRRRRLVRPQIFTELPLRXXPXEETRRKEWTIXTEXPALNPLXTLXLLSVVPLGTSNSSFNNMDGLRHSSSIGQAKSYNLLPXXSATEDPPSGTVPT

SEQ ID NO: 191151 - protein, 89 aa, Triticum aestivum
  unsure (1)..(89): unsure at all Xaa locations
  Clone ID: PAT_TA_85569.pep
LXYHGLHYPLQXRXPEMLXSSMFXPAGSLTKQLYYYXGRKPDEYCSXTCXSALHILGDEXXQDGKFERSSLIGVDXWVVSXXFRAXIGT

SEQ ID NO: 191152 - protein, 88 aa, Triticum aestivum
  unsure (1)..(88): unsure at all Xaa locations
  Clone ID: PAT_TA_85570.pep
MGKIKIGINGFGRIGRLVARVALQSDDVELVAVNDPFITTEYMTYMFXYDTVXGHWKHSDINSXXHKTLLFGREXVTSXRXEPXEXXX

SEQ ID NO: 191153 - protein, 130 aa, Triticum aestivum
  unsure (1)..(130): unsure at all Xaa locations
  Clone ID: PAT_TA_85571.pep
MKFIAAYLLAYLSGNASPSAEDLTSILESVGCEIDNEKMELMLSQVKGKDITELLAAGRENLLRFHLGGGGVAVSAAAPAAGGAAAPAADQRKXRXXGEGRDDDDMASSVDLWALCLKYPGQETDHEFTL

SEQ ID NO: 191154 - protein, 156 aa, Triticum aestivum
  unsure (1)..(156): unsure at all Xaa locations
  Clone ID: PAT_TA_85572.pep
FFLTGAIGDRPTSTSPPPTFYRGAAPWVPPQSPPHPCAGPWAAGSSPPRRLAAGSGTAPPLAARPHVAPWPAFFQRPDDAPPQQASPPPPSLSSSAGRRHGGRCSVSARSPPIPTDXPLFSFVXPAXXMSPHNYASGXPWCRHIXKSXXTCXSXTP

SEQ ID NO: 191155 - protein, 123 aa, Triticum aestivum
  unsure (1)..(123): unsure at all Xaa locations
  Clone ID: PAT_TA_85573.pep
MANPRVFFDMTVGGAPAGRIVMELYKDAVPRTVENFRALCTGEKGVGKSGKPLHYKGSAFHRVIPDFMCHGGDFTRGNXPEAIARIRRNSSQATNRILSWVGPHKPFLSDPEWKTLVSAVVKH

SEQ ID NO: 191156 - protein, 77 aa, Triticum aestivum
  unsure (1)..(77): unsure at all Xaa locations
  Clone ID: PAT_TA_85574.pep
PSSSFWTACLRTTTICPSGIYLSSISSQEQATKYELKNVGQRKRQHCTNVYSHYHMIKTKXCQXLGAXEXKGAKXXF

SEQ ID NO: 191157 - protein, 50 aa, Triticum aestivum
  unsure (1)..(50): unsure at all Xaa locations
  Clone ID: PAT_TA_85575.pep
FFFFLSRIITMHNNWLAYTFLNLQSSNKFLWIMFXEKLESRPKSXXNFAP

SEQ ID NO: 191158 - protein, 63 aa, Triticum aestivum
  unsure (1)..(63): unsure at all Xaa locations
  Clone ID: PAT_TA_85576.pep
LKQPGFKGSAVNYKSGERQKLQDAGFVIVGNIGDQWSDILGAPEGARTFKLPDXIYKIGRVFQ

SEQ ID NO: 191159 - protein, 75 aa, Triticum aestivum
  unsure (1)..(75): unsure at all Xaa locations
  Clone ID: PAT_TA_85577.pep
FXVAASFSXARRLAACIVDRDAASTAWSSCCCVARRTSSAWAMSTTTSYAGAGTSSSSAASSTTYTSRRSCIALK

SEQ ID NO: 191160 - protein, 52 aa, Triticum aestivum
  unsure (1)..(52): unsure at all Xaa locations
  Clone ID: PAT_TA_85578.pep
YKVEASHSLYNQTRNTGTRLCFQLNWETLLAFVSKLKHIPXHXKHAXPGDTP

SEQ ID NO: 191161 - protein, 55 aa, Triticum aestivum
  Clone ID: PAT_TA_85579.pep
PGHQIKCSYSLPPPARLLKSPFSVPPLTSPHLTSSHSGATPRTRSHNSIYYLSYH

SEQ ID NO: 191162 - protein, 92 aa, Triticum aestivum
  Clone ID: PAT_TA_85580.pep
MTGPDQVQTLCLFELRHHESSRARRPVGFTELTHGCCGSGLIEVTMLCDTRYMGVCDDVDKHVFFDSYHPTQRAYEIIVDHIFKNYVPLMHL

SEQ ID NO: 191163 - protein, 62 aa, Triticum aestivum
  Clone ID: PAT_TA_85581.pep
CVCVCCSSPYRQVLVSFFCFSLVFARHCGFGLVFLINQVTLYFFFYLNVIGRAPGLHREFFS

SEQ ID NO: 191164 - protein, 112 aa, Triticum aestivum
  Clone ID: PAT_TA_85582.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDDIQPLLRVHEDD

SEQ ID NO: 191165 - protein, 123 aa, Triticum aestivum
  unsure (1)..(123): unsure at all Xaa locations
  Clone ID: PAT_TA_85583.pep
KGKLKSHQVLLHRRNSYFTAGSPSHRRQNNRTPLPPACPARRAATSTLLLAPPHICAPPRRSPGPCLRIAAQPCSLVPGERERTAARQCSVGKLTPKGXLLRMAVAGHHRCSDXDAEGDXSPR

SEQ ID NO: 191166 - protein, 111 aa, Triticum aestivum
  Clone ID: PAT_TA_85584.pep
LIRRYFSSVKQFALIFQIAITFYSFIQIRRNQRQYFRLDSTYLVNLSNKLFATFKFRNLFRFILKLLLIISFYLYLRFRGNQRLNLRNDPFCPVNQLEHVFDNLKFEFSSN

SEQ ID NO: 191167 - protein, 101 aa, Triticum aestivum
  unsure (1)..(101): unsure at all Xaa locations
  Clone ID: PAT_TA_85585.pep
MAAKEPMRVLVTGAAGQIGYALVPMIARGVMLGADQPVILHMLDIEFAAEXLKGVKMELIDAAFPLLKGXVATTDVVEACTGVNVAVWWWFPRKKNGKKML

SEQ ID NO: 191168 - protein, 53 aa, Triticum aestivum
  unsure (1)..(53): unsure at all Xaa locations
  Clone ID: PAT_TA_85586.pep
RLXYGIXXSXIXASDXQAVFRHQSLAQTRKHVNSSPXLSXIWGPKKRTWFDRE

SEQ ID NO: 191169 - protein, 63 aa, Triticum aestivum
  unsure (1)..(63): unsure at all Xaa locations
  Clone ID: PAT_TA_85587.pep
KGFLGTYMTCTTSQHIQIITFLPHQHDTSSVRNKLDNVSPGKXDRTIHNETTIMVHTLRSLVV

SEQ ID NO: 191170 - protein, 53 aa, Triticum aestivum
  unsure (1)..(53): unsure at all Xaa locations
  Clone ID: PAT_TA_85588.pep
AAVIYNKKAAWDNHWIFWVGPFVGALAAAAYHQYILRAAAIKALGXFRSXRXN

SEQ ID NO: 191171 - protein, 75 aa, Triticum aestivum
  unsure (1)..(75): unsure at all Xaa locations
  Clone ID: PAT_TA_85589.pep
MGSKLCRRMLHFXNLPIKLMLPPAPLSSVXKFXVXXVPXAXXVNIRRXLXSXYXFSIADVRXLNMEGKKHXRRPP

SEQ ID NO: 191172 - protein, 131 aa, Triticum aestivum
  unsure (1)..(131): unsure at all Xaa locations
  Clone ID: PAT_TA_85590.pep
VTSQYPIPRQAKDPGGRGPSTAGATRVVVPSPGERRQLRFFLVSRPVESPLGQPTCLLARQDGGFGLGGFINSSRVGAVVMPNHKRVEYHCIHPWNXDGHRLSHPFRLNLGNKSPRHPRRRXHLRXGIVNT

SEQ ID NO: 191173 - protein, 57 aa, Triticum aestivum
  Clone ID: PAT_TA_85591.pep
FFFFRTGNTFSIVVFTSEDREEARIIGGGGGKERRENSSSSLLRGLLHYALELRPPH

SEQ ID NO: 191174 - protein, 122 aa, Triticum aestivum
  unsure (1)..(122): unsure at all Xaa locations
  Clone ID: PAT_TA_85592.pep
MARTKQTARKSTGGKAPRKQLATKAARKSAPATGGVKKPHRFXPGTVXLREIRNTRRXTELLIXKCPXERLVREIXAXLXTDXRFQTPRVRLHEAPXLLVXCXRTQLCAIHTLTSCDISAPG

SEQ ID NO: 191175 - protein, 121 aa, Triticum aestivum
  unsure (1)..(121): unsure at all Xaa locations
  Clone ID: PAT_TA_85593.pep
VRCTVYHSSICSHLLFLFNRTSRLKLLQHMVLSFPVVMHISDNNGVLLSPPYVRPSWRRSSRRSXTXRTNLPVXCARQVXSSXNSXXELGALXEXSFPRXIXMAFLQVCXPNNXSYKYPPG

SEQ ID NO: 191176 - protein, 87 aa, Triticum aestivum
  Clone ID: PAT_TA_85594.pep
EGFTGDHGGAGEWERKKRLHYYMPVVGSEFVVRPPLHAGRTEPPVAPSIVAGRCNSAFTDMTFSFFFRGACVRAPESRGGRRGCVVL

SEQ ID NO: 191177 - protein, 72 aa, Triticum aestivum
  unsure (1)..(72): unsure at all Xaa locations
  Clone ID: PAT_TA_85595.pep
QDSALAEQLLVYFAIFSRWHVCTQRWRDLILLSAVSIALSTICSPICTHLIHGLGXXFALKKRGGPDXFXXX

SEQ ID NO: 191178 - protein, 94 aa, Triticum aestivum
  Clone ID: PAT_TA_85596.pep
AWWSTARHHAQIKAARETRKSDAGSLVDRGAAPARRRGVPSEPDDRECLPHPSCHRQRVSHRRRRTGWRRVLKLSPSTTPQPICVLGRNKIGPV

SEQ ID NO: 191179 - protein, 88 aa, Triticum aestivum
  unsure (1)..(88): unsure at all Xaa locations
  Clone ID: PAT_TA_85597.pep
MAFNPNPPGLGFPFPFFPPPNTYAPPNPFGPRPPPSPFGPRPPPRPQAPPPPRQPAPPXNPRXASSPPPQRKPXQPFDPAASRRAPPT

SEQ ID NO: 191180 - protein, 112 aa, Triticum aestivum
  unsure (1)..(112): unsure at all Xaa locations
  Clone ID: PAT_TA_85598.pep
MSAYCGKYXDXLIRNAAYIGTPGKGILAADXSXGXIGXXFXSINVDNXXDNRRALXELLFCTLXALXYXTGVILFEDTLYHXTKGGXPXXXPQXGSPPRIKVTRSIQLAGTT

SEQ ID NO: 191181 - protein, 61 aa, Triticum aestivum
  Clone ID: PAT_TA_85599.pep
SNQSVQNHPAKATCSTPTKINHMKLSLALQHNSKNKRLFQHHNKLAEKPMNLTASFWAQPR

SEQ ID NO: 191182 - protein, 111 aa, Triticum aestivum
  unsure (1)..(111): unsure at all Xaa locations
  Clone ID: PAT_TA_85600.pep
ESPRAPSLLLSPTQPPRVGAWLGLPPPPHRPIPAHPTPVTGEGAFLFSPNLLFSAFHPSSSWLXKGXGKGCHRLLFKRQLQPEGPGKKVLXKVLRKCXSSXLLDWPNTDXG

SEQ ID NO: 191183 - protein, 71 aa, Triticum aestivum
  Clone ID: PAT_TA_85601.pep
HPHGPLVAPPTYFFRLYILLYPENIHGSHETTFPSPQPSVPVRSHLGAFSGDLPEGDSIIEGFYINTIPLR

SEQ ID NO: 191184 - protein, 101 aa, Triticum aestivum
  unsure (1)..(101): unsure at all Xaa locations
  Clone ID: PAT_TA_85602.pep
MKLIAAYLLAYLGGNSSPSAADVKNILDSVGAEADEEKLEFLLAELKGKDITEVIASGKGEFAAVPSGGGAIAVGVXSAASGWWRXPAADQRRGEVEEKEI

SEQ ID NO: 191185 - protein, 107 aa, Triticum aestivum
  unsure (1)..(107): unsure at all Xaa locations
  Clone ID: PAT_TA_85603.pep
RGAGPPESISTSSASLNPGRPRDPTELISPTPSRTSSSKIHGVFPSITPPAERPCRRLPHCGAVSSCCLHSTVFNLLLGRGMSNLRLGGYDSAXMAVNGIGSTTLCI

SEQ ID NO: 191186 - protein, 105 aa, Triticum aestivum
  unsure (1)..(105): unsure at all Xaa locations
  Clone ID: PAT_TA_85604.pep
NTMSVTKFNAMISGLFQLGSAYEWVVTKKSGRSSEGDLVALVENEKQSKQLRVGSAPNLDSLAAKEECTPKAEPKPKKKKHNXLYRKDYMSFLLLTAALPLALGQ

SEQ ID NO: 191187 - protein, 105 aa, Triticum aestivum
  unsure (1)..(105): unsure at all Xaa locations
  Clone ID: PAT_TA_85605.pep
ELTYSLAPSFLLIPNAAASVKPPKSLAPPRSTGARRRRRISSPPPPPLCVSRSYFSSRVXLNXINMHEGDXNQXPXAKILXXXPXFPXXPGETXXGPPXKGGSPG

SEQ ID NO: 191188 - protein, 75 aa, Triticum aestivum
  unsure (1)..(75): unsure at all Xaa locations
  Clone ID: PAT_TA_85606.pep
ALXSXXPXPXEKXXNFKWSXPAIDEAEXDSATASTRRSSTRLLTPAMARRRRGVAGENECAWGRGAHSEALAGAV

SEQ ID NO: 191189 - protein, 135 aa, Triticum aestivum
  unsure (1)..(135): unsure at all Xaa locations
  Clone ID: PAT_TA_85607.pep
EARRRRAAAAARARDSTYAPQATRSVRRQRERFSSGLGSAASHATRPPCHDMCPAGRAASXRVSALPKLALPLSRTSKAKXHGXWPXRRXNYFVATERLXPPHRAXXRXQXRPXXXITALXKWLNSSXXLILALL

SEQ ID NO: 191190 - protein, 105 aa, Triticum aestivum
  unsure (1)..(105): unsure at all Xaa locations
  Clone ID: PAT_TA_85608.pep
PSGSGRTPDPAPPTLATTTPPPPAXLDATERPSTPSASPSPAPPRRRPSPSPPRPSFVACRSPEASASPSPTRCRPSSPTPHPRRRPSLAVPDSSSRTFLHIYRA

SEQ ID NO: 191191 - protein, 117 aa, Triticum aestivum
  unsure (1)..(117): unsure at all Xaa locations
  Clone ID: PAT_TA_85609.pep
GGXKXSGXFLXXXFPXKXXXPHKXXFKXFXGGFLKXGKXYWXNFXXPLNXFXTSXRFLGKLYGNPDPERARLFRFRPQEFPSPNTDLEPSRRVLLSLFFSYLAAVVTAARRRGWEEF

SEQ ID NO: 191192 - protein, 59 aa, Triticum aestivum
  unsure (1)..(59): unsure at all Xaa locations
  Clone ID: PAT_TA_85610.pep
XXVXAXGGXPAXXXLXAGGGXPAGGAXGVGGGCTGXCCAAQETMRTARTSGXSAIFDLV

SEQ ID NO: 191193 - protein, 112 aa, Triticum aestivum
  unsure (1)..(112): unsure at all Xaa locations
  Clone ID: PAT_TA_85611.pep
GXSCQPXKRCSNFXPPLGGFXXPTXIXPSNLXKAQLXCVPWAXXPPXPPXEGGXHGXVDGDGGGGDGETRRRGLVLAAAAGIAGEERVGHQQRQQARRREGPGRHCCRLASR

SEQ ID NO: 191194 - protein, 107 aa, Triticum aestivum
  unsure (1)..(107): unsure at all Xaa locations
  Clone ID: PAT_TA_85612.pep
GFPSEFKRAVAXYRXIXGNGTGPPFFVSXGGRGRGGAXXLXCVLVYLLTCSSSYKCSNISHRSKIXXPIYINXXQSWCKMXHLFWGGGVVFIHKAYPSRLQQYALYL

SEQ ID NO: 191195 - protein, 79 aa, Triticum aestivum
  Clone ID: PAT_TA_85613.pep
FTVLPVSVFPVRTVPFVCGVGYVYPAVIIVTRLSRDRPRNMQARTGRSGSWEIYTLLVVPPGKRRRRKYATRGLYKYII

SEQ ID NO: 191196 - protein, 53 aa, Triticum aestivum
  Clone ID: PAT_TA_85614.pep
LLPMMLKLVCSSYCIWDATASVCHCSHVFIMSCDVDSPRVELKAHNHSQNWFT

SEQ ID NO: 191197 - protein, 146 aa, Triticum aestivum
  unsure (1)..(146): unsure at all Xaa locations
  Clone ID: PAT_TA_85615.pep
RIPLPTYPYPSEPRHQDGGADDLLRRGVGGAAPGGRARRAPHPQPHPPXXRSSSSSPTSSPPPTSSSPPRSSPRPSRPPSPPSPPSSSISPRPPPRPPPTPSXPAASXLRVVXLADPERPPSRPARAQGGHCPTINFSAGVWRNLR

SEQ ID NO: 191198 - protein, 79 aa, Triticum aestivum
  unsure (1)..(79): unsure at all Xaa locations
  Clone ID: PAT_TA_85616.pep
AXIXXXSXXXSSSRGGXXGXVXGFLQXAXAEQQASQPGXGRGXEELGNRAPWVDPMMWWPARSGQGHRQDVDQIGSKER

SEQ ID NO: 191199 - protein, 121 aa, Triticum aestivum
  unsure (1)..(121): unsure at all Xaa locations
  Clone ID: PAT_TA_85617.pep
MSSSEVACTLAALILHDDGIPITSEKIATVVKAAGIKVEAYWPALFAKLLEKRSVDDLILSVXXGXGGAXXXAAAAPXAGGAAAAEEKKEXKKEEAKEESDDDMGFSFLTNIHSWNKDTRG

SEQ ID NO: 191200 - protein, 57 aa, Triticum aestivum
  unsure (1)..(57): unsure at all Xaa locations
  Clone ID: PAT_TA_85618.pep
MAPKVAVAKKGDAKAQAAKVAKAVKSGSIKKTAKKXRTXVTFXXPKTVXSXGPNYPX

SEQ ID NO: 191201 - protein, 47 aa, Triticum aestivum
  unsure (1)..(47): unsure at all Xaa locations
  Clone ID: PAT_TA_85619.pep
QLIHHFLQVQTSQAAKAKXPCQSPXXXPKWXWSXXXLXNTRGVXNPP

SEQ ID NO: 191202 - protein, 101 aa, Triticum aestivum
  unsure (1)..(101): unsure at all Xaa locations
  Clone ID: PAT_TA_85620.pep
PPLAGRPPGIPRPSAPRPCAPTSSPPCAPASAPAAMLPRCSPAGLPSALYRPLHEPLPQQPRCGRKYMFFYRQMLQXPLLSXEXAXXKXGGCLXDQQKISP

SEQ ID NO: 191203 - protein, 68 aa, Triticum aestivum
  unsure (1)..(68): unsure at all Xaa locations
  Clone ID: PAT_TA_85621.pep
XWELEARXXPXARXELEAPSPTGGALGAGGGLXAXGXLGXGGGCTXGCXAAQETTRXARTSGXSAXLI

SEQ ID NO: 191204 - protein, 71 aa, Triticum aestivum
  unsure (1)..(71): unsure at all Xaa locations
  Clone ID: PAT_TA_85622.pep
PPPSAAAAASSTLARPQRRGLLPPILPTGSHGDGAGLRAAXEFGKXRFXGHTXXATXXXHXLLXXVINXXK

SEQ ID NO: 191205 - protein, 40 aa, Triticum aestivum
  unsure (1)..(40): unsure at all Xaa locations
  Clone ID: PAT_TA_85623.pep
GGRKACPPSPPTPTPSPPTPAPTPPTPXPSPTPSSDXCPD

SEQ ID NO: 191206 - protein, 121 aa, Triticum aestivum
  Clone ID: PAT_TA_85624.pep
TFLLSFHGNQSHDLFQKNASTAMSQASAPALVSLSNVQIAEKLTRDNFLPWKAQVLPPVRGALLMGYLDGSQAAPPKEIEEARADKTVVQVQNPAYVAWMTQDQNVLGFLLGSLSREYFSR

SEQ ID NO: 191207 - protein, 56 aa, Triticum aestivum
  Clone ID: PAT_TA_85625.pep
ISLSHYAFSFVSSGGGDSMPGTSQQMAYALTTHVDSLFADCDKIFQKWVYQLVAHV

SEQ ID NO: 191208 - protein, 50 aa, Triticum aestivum
  unsure (1)..(50): unsure at all Xaa locations
  Clone ID: PAT_TA_85626.pep
MATAVAAFRSFIHPTAIAAAIPLPPSHFNLNXFSXXASGANSPSGGNQFC

SEQ ID NO: 191209 - protein, 83 aa, Triticum aestivum
  Clone ID: PAT_TA_85627.pep
LSEDDKMTVARARKIQKFLSQPFHVAEVFTGAPGKYVDLKEGVQSFQGVLDGKYDDISEHAFYMVGGIDEVIAKAEKIASENA

SEQ ID NO: 191210 - protein, 75 aa, Triticum aestivum
  unsure (1)..(75): unsure at all Xaa locations
  Clone ID: PAT_TA_85628.pep
LLSPGQLLPXPAFRFLGTTXLNFFRFXCCLALNIVXXFSTVCALTXKLIXINXXPSXXXXYTVWXXXNXXCHFRF

SEQ ID NO: 191211 - protein, 137 aa, Triticum aestivum
  unsure (1)..(137): unsure at all Xaa locations
  Clone ID: PAT_TA_85629.pep
IILSTLSTTFGAEPQWFAAPCDVPLPSRSAANPEXAAEXDGGRSGRSRRRSPARCRGRRRPPHRRLRRRSKSPASPKSSSMSPSPYAAEMSRCRRPCLRGRRRGAGVVRRERERECAGESLEVEVGFRVLESREGNG

SEQ ID NO: 191212 - protein, 71 aa, Triticum aestivum
  unsure (1)..(71): unsure at all Xaa locations
  Clone ID: PAT_TA_85630.pep
RDMRAEFVRRGRSXGSRGPGPAVGATFGKEESGRRRSRDHRLLGEACPGGAAAQRSLGMAEAAAESMGVVA

SEQ ID NO: 191213 - protein, 77 aa, Triticum aestivum
  unsure (1)..(77): unsure at all Xaa locations
  Clone ID: PAT_TA_85631.pep
SXXXGXXYTSFRLGXHRSGRLXGGXEDXPVAGHXRGDGERGACGEEGGGVEEWGSRGEEAERERGGGHGRGAGRWLG

SEQ ID NO: 191214 - protein, 89 aa, Triticum aestivum
  unsure (1)..(89): unsure at all Xaa locations
  Clone ID: PAT_TA_85632.pep
LHPSSAASSPAGHGKCLPPVLPPPAPPFFPQQHDPRXLPSRAPQAHRQHHHQRQQQHFIQALRQXLLLSDXNXKLXGFXFXVXSXGXKT

SEQ ID NO: 191215 - protein, 89 aa, Triticum aestivum
  unsure (1)..(89): unsure at all Xaa locations
  Clone ID: PAT_TA_85633.pep
PQSLLPRASRTSPSPWLRRLRSHRALLASLICPGDPPSSASSSSPTSSSPEPPHRPDRHHLLPRSSSXFXIDRSXGXLSXKGAXXPPNF

SEQ ID NO: 191216 - protein, 52 aa, Triticum aestivum
  unsure (1)..(52): unsure at all Xaa locations
  Clone ID: PAT_TA_85634.pep
MREILHIQCXQCGNQXIXXKFXEXICDXHGIXHXTGXXAGDSXLQLERXNXY

SEQ ID NO: 191217 - protein, 42 aa, Triticum aestivum
  Clone ID: PAT_TA_85635.pep
VELVVYIGWLCYMVAIVGKFELPVLFTLHTLATIYVGLMYYR

SEQ ID NO: 191218 - protein, 81 aa, Triticum aestivum
  unsure (1)..(81): unsure at all Xaa locations
  Clone ID: PAT_TA_85636.pep
QGIGWHLEILVHCLNKIVQIFCHGTNLLSKLTASAILDLHPPRLNHLYXFLISDYSLMLTSKVXIXLSXSXVNVSXIIFVX

SEQ ID NO: 191219 - protein, 93 aa, Triticum aestivum
  unsure (1)..(93): unsure at all Xaa locations
  Clone ID: PAT_TA_85637.pep
VKWAVWLQGIASHSLCPVPHLSTAPHPAAAPSLVAGLLRFDPLSPRRSSVEXEAWQVRDEDGDEPREQXAQAVQFXPRILSQQPSWVVGGKLN

SEQ ID NO: 191220 - protein, 89 aa, Triticum aestivum
  unsure (1)..(89): unsure at all Xaa locations
  Clone ID: PAT_TA_85638.pep
MAKLLPAGVAFLLALAAAAALAPSPASALKGAGGLGLGGAAAAVVMRRGGRTCRGTVGECMEYFGVDGEGESEVAAMAGKRRVLXDGSG

SEQ ID NO: 191221 - protein, 91 aa, Triticum aestivum
  Clone ID: PAT_TA_85639.pep
HKDVCSGASVAAAPAAAAQPMPLSQPLLSRFALHSSWHLLGVHVQVEAELVGGCGYAAQMSSSKHVTTGSCHGGHCPLCPIVGAGWKELVR

SEQ ID NO: 191222 - protein, 111 aa, Triticum aestivum
  Clone ID: PAT_TA_85640.pep
LRHGLSRSGVDMMTRRGGGGGDGCAGSAGGRWRAHSSWRSADHHDATGPKMDPLDLYEQPRKPFQIRSPCSQGRRRRRRRRRRRRRQMVRGCRGRQGRKEGSAEGEEEEEE

SEQ ID NO: 191223 - protein, 136 aa, Triticum aestivum
  unsure (1)..(136): unsure at all Xaa locations
  Clone ID: PAT_TA_85641.pep
PSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKSXEKEESDDDMGFICSTNCGDLF

SEQ ID NO: 191224 - protein, 68 aa, Triticum aestivum
  unsure (1)..(68): unsure at all Xaa locations
  Clone ID: PAT_TA_85642.pep
GXXLLGERKLAAVXEGXVALWWPXWXRVVVGGSPAWRLGSMKAAEARRWWLQAKGYGVATRAEEAGSK

SEQ ID NO: 191225 - protein, 75 aa, Triticum aestivum
  unsure (1)..(75): unsure at all Xaa locations
  Clone ID: PAT_TA_85643.pep
MALPTAVVAGVAASVALLVLLAVAAALCWWRLGARRXRTSDTASDEXPPTLADWGSAGFGAGGPRVKPGIPTPKI

SEQ ID NO: 191226 - protein, 76 aa, Triticum aestivum
  unsure (1)..(76): unsure at all Xaa locations
  Clone ID: PAT_TA_85644.pep
MGSDNIGPRDVCVVGVARTPMGGFLGALSSLPATKLGSIAIEAALKRANVVHPCAXVFFGNVLSANLGPTPASNCL

SEQ ID NO: 191227 - protein, 71 aa, Triticum aestivum
  unsure (1)..(71): unsure at all Xaa locations
  Clone ID: PAT_TA_85645.pep
FFFFFLCSPVIAFCTVSSTIVQTKAGTQNSLPQMLAQVRIFQKFVSASWLXPKVAPLQXXXVPHXXRPTXQ

SEQ ID NO: 191228 - protein, 60 aa, Triticum aestivum
  unsure (1)..(60): unsure at all Xaa locations
  Clone ID: PAT_TA_85646.pep
SSFFFFFFGQTATHFIPEEPHKTKPFKNCPLNASQSCRSLKLRLYSSKIVHTXLKMQTPT

SEQ ID NO: 191229 - protein, 46 aa, Triticum aestivum
  unsure (1)..(46): unsure at all Xaa locations
  Clone ID: PAT_TA_85647.pep
STERMFXFGTXXLLMNVSYRYGCFMRSYVHVSYLLPLVLENKPCTA

SEQ ID NO: 191230 - protein, 101 aa, Triticum aestivum
  unsure (1)..(101): unsure at all Xaa locations
  Clone ID: PAT_TA_85648.pep
PPXXIFFXGDPEXRTRXGXDSGWTDESPARRLVGQPQPDGAAACRSARGAARKEMGGEDCSLLHGARRMGMGARRTGHGTDTGHGGRAASGGWIRFDGRAR

SEQ ID NO: 191231 - protein, 57 aa, Triticum aestivum
  Clone ID: PAT_TA_85649.pep
NGLARSSPDRKIACRCLKSLATSIKSINMDKVSGVPGKCGVSVPFPISMSTNCNNVN

SEQ ID NO: 191232 - protein, 89 aa, Triticum aestivum
  unsure (1)..(89): unsure at all Xaa locations
  Clone ID: PAT_TA_85650.pep
XSSILELCMDRLDGECTGAVEEQIGPSTDTPLAYARSRTSWPSKLVLEASTKEQRASVFRRHTRATHCREVPKNTIVCASFNTMTFYGT

SEQ ID NO: 191233 - protein, 60 aa, Triticum aestivum
  unsure (1)..(60): unsure at all Xaa locations
  Clone ID: PAT_TA_85651.pep
FFFFXQIFRFGITXIILIFXIHDXXNNXLKXTXXNSIHXXEGXYANXDXSSTXFGNXXLV

SEQ ID NO: 191234 - protein, 129 aa, Triticum aestivum
  unsure (1)..(129): unsure at all Xaa locations
  Clone ID: PAT_TA_85652.pep
LPSLATTHSQGGCLAAAATAGAAPAASAAXAAAGARCSPTWRPPPARPPWSCPPPPTRGAPXGXRWPXAGRPAAATAPRASAAPRXAAPAATATEPAPXEPAGKSNTXMRRRSXIXSHHTPXNTIRIVA

SEQ ID NO: 191235 - protein, 137 aa, Triticum aestivum
  unsure (1)..(137): unsure at all Xaa locations
  Clone ID: PAT_TA_85653.pep
LAIKNQCMCFLNQCMWPSIRVGYSTADPTLCQILHDLYRNSSRTLCHFNSTGYRRCLSVAGVLYFAEPLLPVEGSXPWNXLAFPAYCLHGVCLCEXSSPWAAPRXRVQRXSDSYXGXTERXVSLXPXWXLQPXWPLR

SEQ ID NO: 191236 - protein, 98 aa, Triticum aestivum
  unsure (1)..(98): unsure at all Xaa locations
  Clone ID: PAT_TA_85654.pep
TXTRRAWVCAXAVPVLPXGWPXLPSLRVPVTGLRHPSXRGFTXGSLRPXSSSRRTGLTPHSAQVGRRMXXQVSIELVPSTCLTAFFVCHPNELAECKP

SEQ ID NO: 191237 - protein, 123 aa, Triticum aestivum
  unsure (1)..(123): unsure at all Xaa locations
  Clone ID: PAT_TA_85655.pep
TTLQSLSMAATASRPPRKVLDPDQIEATTEPLGRLLLRLRPRARRPTPTGAPVPPRGTSFSLSSSPTSQSFLLPLXNEQRKHAGSLAPATTTTFVGPXHSESSAWRXSXXPTRDLCSPPXMLG

SEQ ID NO: 191238 - protein, 83 aa, Triticum aestivum
  unsure (1)..(83): unsure at all Xaa locations
  Clone ID: PAT_TA_85656.pep
QTFMAATTPQSSQFDAKAMAAGSSTVTXWYQLCHAIDAASRVGIRGGASRCRTSRTWLQGNNTGEENEKELHAAVVVLVVVLL

SEQ ID NO: 191239 - protein, 97 aa, Triticum aestivum
  unsure (1)..(97): unsure at all Xaa locations
  Clone ID: PAT_TA_85657.pep
TTQPPPPTPAPHNLLSHAAPPPHPPGRCLPASSSSRPVLPRLLLLLPSGAASPPTPVPRRPAARSXSCRPPATPNHQATLALWRLPAYQGRGAESRL

SEQ ID NO: 191240 - protein, 119 aa, Triticum aestivum
  unsure (1)..(119): unsure at all Xaa locations
  Clone ID: PAT_TA_85658.pep
XRCYRSPPXSKPPHPKPWSRXVXPSSCSCPSSSPXXSPSPPPSSRTSCSSXTTTSSRAXGSPPPPLLGRPRLQPVXSSRXRSADAXXAAGASESNTVXFTSNMXXXRXMVRXRLVFTAV

SEQ ID NO: 191241 - protein, 132 aa, Triticum aestivum
  Clone ID: PAT_TA_85659.pep
MAAAGDAGEKKMITLKSSDGEEFEVEEAVAMESQTIRHMIEDDCADNGIPLPNVNSKILSKVIEYCNKHVQAKPADGAAAGAGAGASDAAPPPPPRTQEWDPIRQVDKHLFYLAAILKSRAAGLTAVLNKAP

SEQ ID NO: 191242 - protein, 102 aa, Triticum aestivum
  unsure (1)..(102): unsure at all Xaa locations
  Clone ID: PAT_TA_85660.pep
PPGSTRTPLVCPSPLPSPSHTSRPSSAVTASPSLTCTGASPSYKKVPRSLVTSSPSSSPPSHRAVFPATATATPPLDPPPSAHPXIPEHSTNTATPRLRLPL

SEQ ID NO: 191243 - protein, 84 aa, Triticum aestivum
  unsure (1)..(84): unsure at all Xaa locations
  Clone ID: PAT_TA_85661.pep
QGRXSQXEIIXAFTAPRTNAPQXDSSTGRPIDPGMDGFIQSKLKRLMVMARKETMTXRDRXSHGWTAELACKLGCLVVGGGEXL

SEQ ID NO: 191244 - protein, 122 aa, Triticum aestivum
  unsure (1)..(122): unsure at all Xaa locations
  Clone ID: PAT_TA_85662.pep
MVKRAVQYAMVDAFTGEPFKGNPAAVCLLEDDDADDRWLQSIAAEFNVSQTAFLSRCDASSNSXPRFRLRWFXPPXSXLCGHGHLRXRHFLXTRLADNLIENRVLPEVPRCTGTKARKHIPR

SEQ ID NO: 191245 - protein, 152 aa, Triticum aestivum
  Clone ID: PAT_TA_85663.pep
MLPPHNPLSSLSPPRSRPGSDPGAPCIPRRRCSPTPFVVSGAAPPSLPRPRRPPPRPHPSPRSRTGSGHDLDAVRRRLPEPPRRSLSASTTSSPSSSSPDCLSSPHPRILIAPRRRFPDRQPEMRRPNSTRLMTSCREQGPQNAEIHTRGAI

SEQ ID NO: 191246 - protein, 103 aa, Triticum aestivum
  unsure (1)..(103): unsure at all Xaa locations
  Clone ID: PAT_TA_85664.pep
MARTKQTARKSTGGKAPRKQLATKAARKSAPATGGVKKPHRFRPGTVALREIRKYQXSTXLANRQAPLQAPRXXIXQXLKXDSXFXXXXVSAXQEAXXXTLGS

SEQ ID NO: 191247 - protein, 86 aa, Triticum aestivum
  unsure (1)..(86): unsure at all Xaa locations
  Clone ID: PAT_TA_85665.pep
LPPHEGHTDTGXDHVPTGTPHHXHGATSHPCRLSATPTSRCHGMPPPPTCATQATTTATRRTSHFVRFGCRHRGLLLCSQECHCMI

SEQ ID NO: 191248 - protein, 73 aa, Triticum aestivum
  unsure (1)..(73): unsure at all Xaa locations
  Clone ID: PAT_TA_85666.pep
MVGASXVXNVYPLXXXXFXXKEPKXXKDTSVXDRLXRMKVIYMKXGXXTSVXAILLVQEHTHXHTVMQIGNTF

SEQ ID NO: 191249 - protein, 103 aa, Triticum aestivum
  unsure (1)..(103): unsure at all Xaa locations
  Clone ID: PAT_TA_85667.pep
DRWQPPLHGAPSPSPSSQLLPAPPLPYLTASPYPAPPLPPGDGXSPAAPTPTPRSPAASITTPGSPAVPTPTAKAPDASIPAPKVPDASRQILRSTRVSSCVP

SEQ ID NO: 191250 - protein, 60 aa, Triticum aestivum
  unsure (1)..(60): unsure at all Xaa locations
  Clone ID: PAT_TA_85668.pep
FFFSXTMTCIFFIXLXLXQSXDIPTSXPNPRXKGIAASXXDXPTDRLIVXXHMXXSSXRI

SEQ ID NO: 191251 - protein, 176 aa, Triticum aestivum
  unsure (1)..(176): unsure at all Xaa locations
  Clone ID: PAT_TA_85669.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLXLVRKWXTLIEAHVDVKTTDNYMLRISHWLTRDPDQVKRTAMPTISTVRPRCYGNNSAVLKDTVTW

SEQ ID NO: 191252 - protein, 79 aa, Triticum aestivum
  unsure (1)..(79): unsure at all Xaa locations
  Clone ID: PAT_TA_85670.pep
PSRMTLHRFGNTSSSSLWYELAYIEXKGRMRKGDRVWMVGFGSGFKCNSAVWECIRSPSDVTTLGAPWADSIHQYPVKI

SEQ ID NO: 191253 - protein, 102 aa, Triticum aestivum
  Clone ID: PAT_TA_85671.pep
PTGISGQTGNMTSESQSPVGKISSAATSGTAAIPYSESVPSAESSKTFPIGISKELSSSSSLSSNVECPPGNDSTMNAVFTDPGCCAVRCWSGADREEPTGF

SEQ ID NO: 191254 - protein, 68 aa, Triticum aestivum
  unsure (1)..(68): unsure at all Xaa locations
  Clone ID: PAT_TA_85672.pep
AXAQGDLRSXTAXXRRAPNXAAXLPHGETRVPLATXCXXAIAAXXQERGKHRRRSREGRNAKRGEERR

SEQ ID NO: 191255 - protein, 137 aa, Triticum aestivum
  Clone ID: PAT_TA_85673.pep
QIGSREMALKVFNWLNRKMHSNAEYCTIDDNKAMEKEDSVHGSVAEQDTEALLLRDVLLNGILAIGTLGHNVNSLCPEARHEQDDSSSWMKKRWTKKSVKRKSVRTKKRIRYSTNAPEPAIEPAKSITSMKDTLTFL

SEQ ID NO: 191256 - protein, 146 aa, Triticum aestivum
  unsure (1)..(146): unsure at all Xaa locations
  Clone ID: PAT_TA_85674.pep
MAPAVMASSATTVAPFQGLKSTAGLPVSRRSGSAGLSSVSNGGRIRCMQVWPIEGIKKFETLSYLPPLSTEALLKQVDYLIRSKWVPCLDSXVGFVFREHNXSPGYYDGRYWKCGTAYFGCTDATSAQQVEEXRRYLTLFVRSTHR

SEQ ID NO: 191257 - protein, 158 aa, Triticum aestivum
  unsure (1)..(158): unsure at all Xaa locations
  Clone ID: PAT_TA_85675.pep
LVPERASPTHXFVIMDSTYKFLSQAVCRSXRRVPDKQKYPELYAMVVKHMMHGPCGALNPKNVCMQDNECKCRYPRPFNENTIQGKDSYPVYRRRNDGRRAKVRGKMLDNRWVVPYNPYLLRMFNCHINVEVCSSIKAVKYIYKYIYKGHDKASFSKK

SEQ ID NO: 191258 - protein, 100 aa, Triticum aestivum
  unsure (1)..(100): unsure at all Xaa locations
  Clone ID: PAT_TA_85676.pep
SLTARCSIAGLLSSALSRTAQFCSTHWLIKNCTDSIAIRKPMVGGSFDGAVVDPLTEDPDVYISWXLLLLAKDLDCYVVLHSRCPFPLQEHMQDFDTTYA

SEQ ID NO: 191259 - protein, 147 aa, Triticum aestivum
  unsure (1)..(147): unsure at all Xaa locations
  Clone ID: PAT_TA_85677.pep
RPRPDPPLPAPAGPPCHAVLLPRAPPRRSSSSTEPPASSSGSFLPDHGHTATLAGEPSSVAALLFLPSISFLFALLSHSQLHVSSALAGFKPPSELVXGRXRRPSPRALTGLLPPPRPSAPWRQTLLPWSTWDASCRIASLMPXCLK

SEQ ID NO: 191260 - protein, 166 aa, Triticum aestivum
  unsure (1)..(166): unsure at all Xaa locations
  Clone ID: PAT_TA_85678.pep
RTWVSPHQIDHAHAYLPQYATARSDSAAGQNDLTSPHRRRKPAINSGVQRSHLQAPVVYKQGRTHRLNATLHSASRLTLQHHTSLATAARKLEPTAVARKKDGTVLPLLVLAVSLAWPVRATSSXCSFRSXGPATSSTHPFTRRRLVVDTPAARLVTCNAALPASP

SEQ ID NO: 191261 - protein, 130 aa, Triticum aestivum
  unsure (1)..(130): unsure at all Xaa locations
  Clone ID: PAT_TA_85679.pep
SRPSTGSRPSGSLLLNAPHRAPNPGKQPRRAAAPHLPASSQDGRAGHHPGGRACAFHGSQLLHPDPSLQGRRGHCFVITDRDDHAQSNWEKTDDRGEKKIKKIVHRNWASVIDIXCRRFMRHLRLXLFPA

SEQ ID NO: 191262 - protein, 133 aa, Triticum aestivum
  unsure (1)..(133): unsure at all Xaa locations
  Clone ID: PAT_TA_85680.pep
CNPAPQSNVRTRTPSPSPPRRPARPPPPXRRPRLLHRRSCRSRRPRSRRARGRPRPRRRSRAWPPAAAAVPPPCRASKEPRTTPAGRRKGRAAMPLLQVREASFFLPRPYAMERGGGRAAGCGGFPVGRWEGR

SEQ ID NO: 191263 - protein, 128 aa, Triticum aestivum
  unsure (1)..(128): unsure at all Xaa locations
  Clone ID: PAT_TA_85681.pep
PDEGRHDCLIHRVTSTPGXCYSSSSPRPSCCSSSSPLPCRFLSSSPISAARPHRLWCFSLADLPAAILLQARLLSESLLLHFLILYCCCFFFSTLLLTLSNPIVVFVLSLSRQMMLFRKQKRYMLFLP

SEQ ID NO: 191264 - protein, 146 aa, Triticum aestivum
  unsure (1)..(146): unsure at all Xaa locations
  Clone ID: PAT_TA_85682.pep
MQIFVKTLTGKTITLEVESSDTIDNVKAKIQDKEGIPPDQQRLIFAGKQLEDGXTLADYNIQKESTLHLVLRLRGGAKKRKKKTYTKPKKQKHKHKKVKLAVLQFYKSTTHRQVTAKKECPTPMRAGTSWQHSRTTGNAANYLNRG

SEQ ID NO: 191265 - protein, 156 aa, Triticum aestivum
  unsure (1)..(156): unsure at all Xaa locations
  Clone ID: PAT_TA_85683.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEXFVHKHTKPGISHGNAGPNXNAPFFICTVPAAHATLVFASLKAWTLKKSEVVPCQQVSSRCAV

SEQ ID NO: 191266 - protein, 147 aa, Triticum aestivum
  unsure (1)..(147): unsure at all Xaa locations
  Clone ID: PAT_TA_85684.pep
SRSVEPSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGXAAAPAAESKKEEKSXEKEESDDDMGSVVHLWTCEVSWQETDQ

SEQ ID NO: 191267 - protein, 122 aa, Triticum aestivum
  unsure (1)..(122): unsure at all Xaa locations
  Clone ID: PAT_TA_85685.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKXGFIFREHNASPGYYDGXYWTMWXLPMFX

SEQ ID NO: 191268 - protein, 104 aa, Triticum aestivum
  unsure (1)..(104): unsure at all Xaa locations
  Clone ID: PAT_TA_85686.pep
DQRWLWSCXRHWXSAEWEEGVVVDVVDHSGSGLGVEREVGEVLVTARVARWCRSMARCCGRGGETARSRAYGAAWLGFFSGAEGDEHGEASGHLGAARGGRRPR

SEQ ID NO: 191269 - protein, 56 aa, Triticum aestivum
  Clone ID: PAT_TA_85687.pep
CMLLHEIGTKACNLNNTNVQSTINIETVQRPLKGSGHKSSRNKWCYNIQVRAKCYW

SEQ ID NO: 191270 - protein, 133 aa, Triticum aestivum
  unsure (1)..(133): unsure at all Xaa locations
  Clone ID: PAT_TA_85688.pep
ILGHPINXVHLPIHRIFTCMIGPRRCFVVYAFNPCQLLLDGRSGAAXRSLXLVADDGDSSTTASRGTCGQSASVMSWAPGRRRLDGLSSLPPPSSPQACPAPGPAAAAGCCCCCWSLSPASSAIGLGWAGLPS

SEQ ID NO: 191271 - protein, 117 aa, Triticum aestivum
  unsure (1)..(117): unsure at all Xaa locations
  Clone ID: PAT_TA_85689.pep
RQXRXVAXXGCDXQXDGTTALXQAKEEEATXNIRGIRKQGSRPXGRGSRXQEDXTGLTHAGHGVRHRKAAGGARQRARSRQQERSGGCVAGRRSAAEGRCPERGTAWRPASQEEARR

SEQ ID NO: 191272 - protein, 139 aa, Triticum aestivum
  unsure (1)..(139): unsure at all Xaa locations
  Clone ID: PAT_TA_85690.pep
TAFVAVNXGKGSTXXWYISXDELDSLSTXYXPGRLTLAKVNISXXEVAXXAXANAHLXACPNEKXIRRHMGKTLELXDITAXXALNGKHFFLXADIKGPELXLDHTGXXIXTVLXHLGRVHETXWDHRSHTSKNALLHS

SEQ ID NO: 191273 - protein, 132 aa, Triticum aestivum
  Clone ID: PAT_TA_85691.pep
GKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKLTRPLSCISSCVLPVPV

SEQ ID NO: 191274 - protein, 132 aa, Triticum aestivum
  unsure (1)..(132): unsure at all Xaa locations
  Clone ID: PAT_TA_85692.pep
MAPKVAVAKKGDAKAQAAKVAKAVKSGSIKKTAKKIRTSVTFHRPKTLSKARDPKYPRISTPGRNKLDQYQILKYPLTTESAMKKIEDNNTLVFIVDLKADKKKIKAAVKKMYXIQAKKVTPHQADGRRGYS

SEQ ID NO: 191275 - protein, 163 aa, Triticum aestivum
  unsure (1)..(163): unsure at all Xaa locations
  Clone ID: PAT_TA_85693.pep
MANPRVFFDMTVGGAPAGRIVMELYKDAVPRTVENFRALCTGEKGVGKSGKPLHYKGSAFHRVIPDFMCQGGDFTRGNGTGGXSIYGENSPTRIRPQHTKPGISPWQPGPNTTLHSHCTSLQVDATLVSQQGWTLKKSVVRTCSTVYMGTQSPPRSLPFPVFY

SEQ ID NO: 191276 - protein, 130 aa, Triticum aestivum
  Clone ID: PAT_TA_85694.pep
AAARLLLKTPPPGSSTRCRPTPRRRRTSSAVLAFSPVVFFGYGTEPEKKQLANLPKGHVLTLGLHMYGCLVIHKVEKWNKAEEEWDVCRIPRNCVSAIVVGMLKCTHVLCILSVLKCTHVFLGLVNAENV

SEQ ID NO: 191277 - protein, 126 aa, Triticum aestivum
  Clone ID: PAT_TA_85695.pep
TTAGKKPKAEKRAPASKEAGGEGKTRGRKKGSKAKKSVETYKIYIFKVLKQVHPDVGISSKAMSIMNSFINDIFEKLAGESAKLARYNKKPTITSREIQTSVRLVLPGELANTLSEGTKPSPINSS

SEQ ID NO: 191278 - protein, 137 aa, Triticum aestivum
  unsure (1)..(137): unsure at all Xaa locations
  Clone ID: PAT_TA_85696.pep
XRNYLRAAALLRRXRPDRYQRXLSTXXDVCKDVSSFVAFPRFLLDDASRRASGIVSAVDGGISCWNHXDRLAPVAHSGTPRGAIVHGAHDAEHPIMGVRPDALVHPADAHAELPSQRLASTPSPGRTAWWMATGGHP

SEQ ID NO: 191279 - protein, 56 aa, Triticum aestivum
  unsure (1)..(56): unsure at all Xaa locations
  Clone ID: PAT_TA_85697.pep
QHNACIALPQPRFHGLGCSHFARRYYGNRFCFLFLWLLRCFIXASCLLPAHGSAGI

SEQ ID NO: 191280 - protein, 69 aa, Triticum aestivum
  Clone ID: PAT_TA_85698.pep
EKKQELQLVSVCALLIACKYEEIWAPEVNDFILFSDNTYTREQILRMEKAILNMLEWNLTVPTPYVFLV

SEQ ID NO: 191281 - protein, 66 aa, Triticum aestivum
  unsure (1)..(66): unsure at all Xaa locations
  Clone ID: PAT_TA_85699.pep
PSAPTSLLISLPENHQQDHSLQKSRSGTSMELLLMLTVLLFAHTVGLPDLXGRLXGPAVXXGTSRX

SEQ ID NO: 191282 - protein, 78 aa, Triticum aestivum
  unsure (1)..(78): unsure at all Xaa locations
  Clone ID: PAT_TA_85700.pep
STIVIFNLQTCKETPLGLTWVITDQGYLGXCHRPPLTLSYSAHSSSYITSCPQVXAHLSPQVSRHKASAANVLSSQLW

SEQ ID NO: 191283 - protein, 78 aa, Triticum aestivum
  Clone ID: PAT_TA_85701.pep
SKQTGEANLRPISQSLHVYNIHFLRYINYIIHAFALFLPFFWGGVSNLLVSTYKRNTNHSRSHLPRCLNRCHGDDWII

SEQ ID NO: 191284 - protein, 54 aa, Triticum aestivum
  Clone ID: PAT_TA_85702.pep
SSFNPHPTVQITQGERLSTLSSFQHSFCIDDYSTLTLIAVAFGHYALQPFNIKF

SEQ ID NO: 191285 - protein, 62 aa, Triticum aestivum
  unsure (1)..(62): unsure at all Xaa locations
  Clone ID: PAT_TA_85703.pep
KPLTRPPTLRRRASPPSWDKVHGXLALAGKVLGXXPKVXXQEMXNQPXGRXHXXIQXNRLFV

SEQ ID NO: 191286 - protein, 42 aa, Triticum aestivum
  Clone ID: PAT_TA_85704.pep
YTHSTRKKKEKNIHTELKVASLTDRESSGYVREHTTRLLVDV

SEQ ID NO: 191287 - protein, 124 aa, Triticum aestivum
  unsure (1)..(124): unsure at all Xaa locations
  Clone ID: PAT_TA_85705.pep
TSHWGRRRLISRAPPTAAAFPLVPTAATPIPLLPFFFFESRCCCLLLSSPAAAHPSPPSLLLLLSSLPLPNCCYSLSTPPAALLTPALSFHPAVVLFFSLKFVTQKCXTIHVCQIXMYTTLVVQ

SEQ ID NO: 191288 - protein, 110 aa, Triticum aestivum
  unsure (1)..(110): unsure at all Xaa locations
  Clone ID: PAT_TA_85706.pep
MPRCTSSVNYQTETATMSQLICNGCFSLXLYNRTAANVRCSRCNMLNSTRSASQYAHLKCGGCRTTSLPAGGSTVGCPLPHSTRQTQGPRSSGCHRGSDILVEIDMNTKW

SEQ ID NO: 191289 - protein, 136 aa, Triticum aestivum
  unsure (1)..(136): unsure at all Xaa locations
  Clone ID: PAT_TA_85707.pep
CLSSFPTDASTDRPPPPTAPPLLAAAPWGRVQIDVAAVRSSSAAARTRNTGLNRHCPLLLYCHKDVSTGRRLPLAALLCGLIDASEVSGTTVRPPLLPHRRXXGRRXRLPLSSADHGCERICRSPLESRTTTEFVK

SEQ ID NO: 191290 - protein, 101 aa, Triticum aestivum
  unsure (1)..(101): unsure at all Xaa locations
  Clone ID: PAT_TA_85708.pep
TTSPCNASTASEVHCPLGFRVQFLHHLPPANNTLRQLFPTSGTQNVFLQRAQATPSTSDHINNYICKAQSHCXXFXGHSHISPTNKLXVTQQQWTXIALSG

SEQ ID NO: 191291 - protein, 60 aa, Triticum aestivum
  Clone ID: PAT_TA_85709.pep
TRAATRWPASTCSPSPTASRTTALQTPFKSYLSDMLALVKKEAAERKALGALPLYERTLP

SEQ ID NO: 191292 - protein, 105 aa, Triticum aestivum
  unsure (1)..(105): unsure at all Xaa locations
  Clone ID: PAT_TA_85710.pep
ACKGRRRRPCSFFGSLISSPADLNPLASSLSMRLLATFSFTSAQSRHTFQFCSRYPAHILTSXGNILKFDLKPIFLSDLYYPFLSFLWCAVNIYVTTNDLVEKKK

SEQ ID NO: 191293 - protein, 157 aa, Triticum aestivum
  unsure (1)..(157): unsure at all Xaa locations
  Clone ID: PAT_TA_85711.pep
XDMHCILPFCHVHTPIPKSLHGHFFVIVMPDQYTSNGNSSPKSTHNPKKFNGQHKASIDARSSKPRSMAVWYNRAHRRERREPRSPEGVVAEDERHHHPGSSRSKRWPAEEAQGRGQQQEQLRDMRRGAIRAHCLSTTAPSAWETSGGGLQAHIIDL

SEQ ID NO: 191294 - protein, 104 aa, Triticum aestivum
  unsure (1)..(104): unsure at all Xaa locations
  Clone ID: PAT_TA_85712.pep
VNAPAVPXPTTTPAAPXXSXKAPXTPAPAAXPPTTPVATTAPVKAPATPAPAAAPITAPVTPAPVTAPAXAPXXPAXKPKAXAPAASXLAXAIAPAPAXLPPTV

SEQ ID NO: 191295 - protein, 161 aa, Triticum aestivum
  unsure (1)..(161): unsure at all Xaa locations
  Clone ID: PAT_TA_85713.pep
PAVMASSATTVAPFQGLKSTAGLPVSRRSGSAGLSSVSNGGRIRCMQVWPIEGIKKFETLSYLPPLSTEALLKQVDYLIRSKWXPCLDSASWFRLREHNXPPXYYDGRYWDMWNCXYFXCTDQPSAQQVEEXRRXLTLAVQFDKQMLTHASGTARASKSIE

SEQ ID NO: 191296 - protein, 135 aa, Triticum aestivum
  unsure (1)..(135): unsure at all Xaa locations
  Clone ID: PAT_TA_85714.pep
NSPAPKRTPLGIIITHXQRRSSQQLSSSVPMASLTMMXSLSAXVXVDRXAAAPLRGLVVARAAXVXGQXEPAXNMAXVXPATDXRRXVVFAAAAAALSAIGXXAFADSDXKNGSXEAXKKYXPSAXXCHRXXLXX

SEQ ID NO: 191297 - protein, 100 aa, Triticum aestivum
  Clone ID: PAT_TA_85715.pep
PTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 191298 - protein, 58 aa, Triticum aestivum
  unsure (1)..(58): unsure at all Xaa locations
  Clone ID: PAT_TA_85716.pep
TXGRNNMCXYLSXXRSXXQXGXASXPLLCMDWDVLXGIXYCXNXFKWMKKKEKKKLEX

SEQ ID NO: 191299 - protein, 140 aa, Triticum aestivum
  unsure (1)..(140): unsure at all Xaa locations
  Clone ID: PAT_TA_85717.pep
MARTKQTARKSTGGKAPRKQLATKAARKSAPATGGVKKPHRFRPGTVALREIRKYQKSTELLIRKLPFQRLVREIAQDFKTDLRFQSSAVSALXEAAEAYLVGSSRTQLCAIHAKRVTXMPRTSLARRIRGRGLTLFVSS

SEQ ID NO: 191300 - protein, 72 aa, Triticum aestivum
  Clone ID: PAT_TA_85718.pep
MGVAGFISIVKHHKKNKTRVTPTFIGEEMKTEKRRKSCSDSLGLSVLGFCGITLLSVGALHVGGPEGEVVSE

SEQ ID NO: 191301 - protein, 84 aa, Triticum aestivum
  unsure (1)..(84): unsure at all Xaa locations
  Clone ID: PAT_TA_85719.pep
PSXIPILTSSPRTXQXXXFASXPSPPLDSSTYPYPASPPPXSXTSKASXELMSXXXSVAXXTXEATVXHIMLIXVTLGWXAXEA

SEQ ID NO: 191302 - protein, 142 aa, Triticum aestivum
  unsure (1)..(142): unsure at all Xaa locations
  Clone ID: PAT_TA_85720.pep
SRLRPEQLVELLTCTKDCHPRIIHRDIKSSNILLDNNFEAQVSDFGLARLAADSNTHVTTRVMGTFGYLAPEYALSGKLTXKSDLYSFGXVLLXELITGRKPVDPPSRLGDEXLSNXSAFLSQAXDTNSGSPDPRMEKNPRK

SEQ ID NO: 191303 - protein, 144 aa, Triticum aestivum
  unsure (1)..(144): unsure at all Xaa locations
  Clone ID: PAT_TA_85721.pep
MRECISIHIGQAGIQVGNACWELYCLEHGIQPDGQMPGDKTVGGGDDAFNTFFSETGAGKHVPRAVFVDLXPTVIDEVRTGRLPPVFHLSSYHGQGGCTNNSPWHYTIGKNVXSPSRTRTSTALVSRILSQLEWTVGWSSLSSS

SEQ ID NO: 191304 - protein, 51 aa, Triticum aestivum
  Clone ID: PAT_TA_85722.pep
TSCQLCHLLDLLGLSHLNKQTAYQEHKTKIKLYSTACAIKQNYKIKKIEES

SEQ ID NO: 191305 - protein, 65 aa, Triticum aestivum
  Clone ID: PAT_TA_85723.pep
SIKHTHVILNSHHQTKLICISSEIRTNRGQPSDEQRPPYSEEIGADGDGSGHPELEDPEGLKFYY

SEQ ID NO: 191306 - protein, 62 aa, Triticum aestivum
  unsure (1)..(62): unsure at all Xaa locations
  Clone ID: PAT_TA_85724.pep
PPWISSMLYKVXGCXTLXVXYLNXFSNMDXSGGGLISCRRWYLLEVVFSLDGSNDVRCVIAG

SEQ ID NO: 191307 - protein, 45 aa, Triticum aestivum
  Clone ID: PAT_TA_85725.pep
VFFFFFWLQNVFPYENAKCVGNKDGCYIISQLNKHCVKYLNISDL

SEQ ID NO: 191308 - protein, 74 aa, Triticum aestivum
  unsure (1)..(74): unsure at all Xaa locations
  Clone ID: PAT_TA_85726.pep
GSVYVGSVCSHLYXRKXQVCMLVQLFFSFRKGGLPPASASQCWFSCVXIICRRHXVXYLQGXLTVISRFFTCLS

SEQ ID NO: 191309 - protein, 160 aa, Triticum aestivum
  unsure (1)..(160): unsure at all Xaa locations
  Clone ID: PAT_TA_85727.pep
APPPLPPKNPPPQSPGSPRAAPMARTKQTARKSTGGKAPRKQLATKAARKSAPATGGVKKPHRFRPGTVALREIRKYQXKSTELLIRKLPFQRLXVREIAQDFKTDLRFQSSAVSALQEAAEAYLGGAVRGHNLCAIHAKRVTXMPKDIQLARRIRGERA

SEQ ID NO: 191310 - protein, 100 aa, Triticum aestivum
  unsure (1)..(100): unsure at all Xaa locations
  Clone ID: PAT_TA_85728.pep
MMASTALSSAFTLLHAKPAATSLPRPQPFFVPMHGRRPSVAVACTSTAXASPKVLXLGDAIXGLTLXXARXLVDHLXERLGXVSAAAFAPAAAVXGXGRT

SEQ ID NO: 191311 - protein, 130 aa, Triticum aestivum
  unsure (1)..(130): unsure at all Xaa locations
  Clone ID: PAT_TA_85729.pep
RRPGRSRSHLQANGSARTYPAGHDHPVPFFNACSSATAVTIIEDAWCTYHPRLCLPPTQVSSGSSGQNLCRTTASNALCVAVLCVRTVPPHALVNKLHCGGDIFGRATNEMVLXXCXVVLXSVXLSGSNG

SEQ ID NO: 191312 - protein, 111 aa, Triticum aestivum
  unsure (1)..(111): unsure at all Xaa locations
  Clone ID: PAT_TA_85730.pep
MSSSEVACTLAALILHDDGIPITSEKIATVVKAAGIKVEAYWPALFAKLLXEKRSVDDLILSVGSGGGGAPAAAAAAPAAGGAAAAEEKKEEKKEEXKEESDDDMGFNLFD

SEQ ID NO: 191313 - protein, 193 aa, Triticum aestivum
  unsure (1)..(193): unsure at all Xaa locations
  Clone ID: PAT_TA_85731.pep
SPPTHHRTQPIPTTHPIISITDLAPPPHPGQEAPPPPXPPLPPPETRLHTQSAPPPXPSSRIAPPAPSLAPDRAASIAPCPSLLPPSLVPPGSGRLHRASLRIAPPSPSLAPDQVTSMEHKLAPPAAATFLQTVTMTFFPPAKMPLAQGPHNLQTLLRPPQHPLCFSPTSQQTTHGSIRTEIYRAPPAIMSKG

SEQ ID NO: 191314 - protein, 154 aa, Triticum aestivum
  unsure (1)..(154): unsure at all Xaa locations
  Clone ID: PAT_TA_85732.pep
MQIFVKTLTGKTITLEVESSDTIDNVKAKIQDKEGIPPDQQRLIFAGKQLEDGRTLADYNIQKESTLHLVLRLRGGHAVFXVRPSLGKTITLEVETLTPSDNVKAKXKDKEGIPRDQQRLIFAGKXLEDGRTXADYNIQKESTLXWVLRLRGGQ

SEQ ID NO: 191315 - protein, 130 aa, Triticum aestivum
  unsure (1)..(130): unsure at all Xaa locations
  Clone ID: PAT_TA_85733.pep
CPAAVASSMINLEPSAQHIKLINPLRPPSPGRFRFPGALPPLDYSIGFASLKHSSNTSSTALPSDARCYAATIHCSYRSDGYLQCSQAFWGTASLPTNPMSRXQLHCHRHREEQPWAQPVXAIRHVTHXG

SEQ ID NO: 191316 - protein, 137 aa, Triticum aestivum
  Clone ID: PAT_TA_85734.pep
SPSRRSLLPNANPTPSSSWPPSPSRPLSSPTPRSLSFCFIYVSYFAYEEQIDRSRTSASRSTSTSSSATRAPPCRSTPLPLLSFHLAVVCLRDLETDDAPVIDYVTDDRSFAAKLPRSQMPPLMPTTTWRPPTTRRI

SEQ ID NO: 191317 - protein, 169 aa, Triticum aestivum
  unsure (1)..(169): unsure at all Xaa locations
  Clone ID: PAT_TA_85735.pep
MAPKAEKKPAAKKPAEEEPAAEKAEKAPAGKKPRAEKRVPAGKTASKEGGEKRGRKKGKKSVETYKIYIFKVLKQVHPDIGXISSKAMSIMNSFINDIFEXLAGEAAKLARYNKXPTITSKEXRLRTLVLPGESPSTRLRHKAVTSLLLLVPVSTNVVPAVGLMLVDGL

SEQ ID NO: 191318 - protein, 96 aa, Triticum aestivum
  Clone ID: PAT_TA_85736.pep
KIHPVFHVSQLKKHLGKKSIPSPDLPMVNEDGSIKTEPAMVLEVRQVPRHNLHVVQWLIQWENMAPEDATWEDAEFIKHTFPAFFRSTTQAWRSVS

SEQ ID NO: 191319 - protein, 128 aa, Triticum aestivum
  unsure (1)..(128): unsure at all Xaa locations
  Clone ID: PAT_TA_85737.pep
RQKPAXRIQDCCFXXPIPNNXWXARQRRKLFCSCLILLKIWSSXSXIVGXGESGYRXNXREEXXTSIHTWSLXRQAAGSPGQAXXRRRLPXQAGRSRFKARTEPVASGVDEAPERGEEREREGEEGGR

SEQ ID NO: 191320 - protein, 65 aa, Triticum aestivum
  Clone ID: PAT_TA_85738.pep
TLNYTSGTTSAPKGVVYSHRGAYLSTTSLLMSWEVGTEPAMVLLLCFQMYTTPVSIILFFVSKGG

SEQ ID NO: 191321 - protein, 72 aa, Triticum aestivum
  unsure (1)..(72): unsure at all Xaa locations
  Clone ID: PAT_TA_85739.pep
RTRXXWPFGDLALDSPXVRAPGQRGWSCTTRLGHERCIFSTTEFHLGDVLDQLANCLPXSSGVPMSFDASEC

SEQ ID NO: 191322 - protein, 100 aa, Triticum aestivum
  unsure (1)..(100): unsure at all Xaa locations
  Clone ID: PAT_TA_85740.pep
CAHRGLPSEAPVALGFFASSSLLGSRSARVFYPSLTASQCGFLSPFPTGPNLHAVNTTVHFPGSDLSQHKKLDEREALELEARLQLSLCTIXLAKLMHFK

SEQ ID NO: 191323 - protein, 92 aa, Triticum aestivum
  Clone ID: PAT_TA_85741.pep
TKYFFFQFPSTSCSSSTSVARPAPLTSPALADPSITNHAFFTCIASSSSSYSYLQYFLVSACTYIFSRNYNMVVYVSRVHAWAPSQVHACFS

SEQ ID NO: 191324 - protein, 158 aa, Triticum aestivum
  unsure (1)..(158): unsure at all Xaa locations
  Clone ID: PAT_TA_85742.pep
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDKPPLRLILAXNYLNIKGCWTDCKLFYMIKXRPXEIARLKXEDLPERESR

SEQ ID NO: 191325 - protein, 126 aa, Triticum aestivum
  Clone ID: PAT_TA_85743.pep
PLFPSELHRPQQAAAAHPAAAAGRRRAYEELLLLPHRLPVVLVSDSPSPSAPLTQQPRPLVKLDPGGSSSVEVGTTTNMAPPAEPTNLRAPLWSHVTIIEKSPAEVVMARIALAQNKTKNVSLPSD

SEQ ID NO: 191326 - protein, 80 aa, Triticum aestivum
  Clone ID: PAT_TA_85744.pep
TESSNLHLVLCVRIPCFGRPHCLCHVLHSHPAGVLRSSDRRRHRELVISVCPNLSPCRRSTRSTEVLQISGTDGVLGGWS

SEQ ID NO: 191327 - protein, 164 aa, Triticum aestivum
  unsure (1)..(164): unsure at all Xaa locations
  Clone ID: PAT_TA_85745.pep
MLVHNFVTYXFKAFVMQTHCICGSTLSTIWLTYAGSNHVHPLLRALYMFFSVVCMEQATRGMVAAFALGAYVVLSPVSERIAIVVCMSTIATLLLRNPSNWQLGFLFMPIKRRLGWRGAFKAHLPQQTRSRLTVGIGSNFACLILRRMLGMLFTYSFIFLLALL

SEQ ID NO: 191328 - protein, 94 aa, Triticum aestivum
  unsure (1)..(94): unsure at all Xaa locations
  Clone ID: PAT_TA_85746.pep
RTTXTCXTTCASXWXAASXWGXGPXCPPPPXYPGSGRGRTXSXPSLCXXSSIDRXQTWXLXTEPRAAGXRGXWRAXIVXXXAVCWYDQXXEEEE

SEQ ID NO: 191329 - protein, 154 aa, Triticum aestivum
  unsure (1)..(154): unsure at all Xaa locations
  Clone ID: PAT_TA_85747.pep
QIVSKLGSSFSIAPFIIVVASCTILAMIALLPIAQLLFFHILLIKKGISTYDYIIALREQEQEEVSGEQSPQMSHVSSYGGLSSTSSFGALRRGSWCTPPRLFLEDQFDVIPSEAGSSHNSATKRKDEEVRRKKTSXAVKISPWALARXNAEEV

SEQ ID NO: 191330 - protein, 187 aa, Triticum aestivum
  unsure (1)..(187): unsure at all Xaa locations
  Clone ID: PAT_TA_85748.pep
LPSLATTHSQGGCLAAAATAGAAPAASAATAAAGARCSPTWRPPPARPPWSCPPPPTRGAPAGSRWPAGRPAAATAPRASAAPRAAAPAAAATEPAPKRPAGXRGEHXDEEEKQAIIITINNTKRINTLTAASLARALNKIKRHCSLLYASRVVFDNVLLMPQLQVNIWRSTLKKKKPGGAVPFMSL

SEQ ID NO: 191331 - protein, 152 aa, Triticum aestivum
  unsure (1)..(152): unsure at all Xaa locations
  Clone ID: PAT_TA_85749.pep
MAPKVAVAKKGDAKAQAAKVAKAVKSGSIKKTAKKIRTSVTFHRPKTLSKARDPKYPRISTPGRNKLDQYQILKYPLTTESAMKKIEDNNTLRLHPSDLKADKKKIRPLSKKMFDIQGQEVNTXIKPDGKKKRYXKLTQDYDLLIGQQXXII

SEQ ID NO: 191332 - protein, 166 aa, Triticum aestivum
  unsure (1)..(166): unsure at all Xaa locations
  Clone ID: PAT_TA_85750.pep
GSGFPFVFIFSNLHQIPLHNNYFVDSVALTIWYLSPGRLRFGKVSDGEDVPPCNEIHRQSSQPCLRLPQRRGPHPGRSAPLGGCHCADIDSGHYRRLPCRPVSGASTEGREAPGGSGQPISVPLNFPTSHSLGLAWDGRSSRLLXHGSGTSRPGSLQTGGTFNXRP

SEQ ID NO: 191333 - protein, 137 aa, Triticum aestivum
  Clone ID: PAT_TA_85751.pep
HQNHLTPRYKHKGNGAFGFGAHRDAAVSGEAEQRVLGHASEQGCWPGVEPDESAERGGGTGGGEAHGEAGVGLHRGGLPTARNGALSVLPTDCSTSSAAAARSTGGESGTCGWVTRELKATAGSGSWRGRGRRGTTR

SEQ ID NO: 191334 - protein, 94 aa, Triticum aestivum
  unsure (1)..(94): unsure at all Xaa locations
  Clone ID: PAT_TA_85752.pep
GGIYXGSFNXDSLSRKLTATISDLEKVLGTPSYGKHSCSCXEVWSGRIFGLLXGRVSAAVNPHGCVVFGTHVLRFAQDFLTGGIILGAYYNPMI

SEQ ID NO: 191335 - protein, 86 aa, Triticum aestivum
  unsure (1)..(86): unsure at all Xaa locations
  Clone ID: PAT_TA_85753.pep
CTSLSSPTLTLTLPAHTQXXPAGQXXLXMAPRAATVLLCTALICLSATHSLAQAPXPAGNXPPKXPNAXPXPAXAXVXXIXSPXVP

SEQ ID NO: 191336 - protein, 89 aa, Triticum aestivum
  Clone ID: PAT_TA_85754.pep
AKLWPCSIQWGQKGGNRINKKQKSYILSIHHLRPAGNIYRYCTYTTTFVRLSVYVSLHLLPTSFRKTGETNNSAAAAAAATRSPFYLFR

SEQ ID NO: 191337 - protein, 98 aa, Triticum aestivum
  unsure (1)..(98): unsure at all Xaa locations
  Clone ID: PAT_TA_85755.pep
LCVCVWAPVVLFCWLAAACMIVVTGLXVVRCWALXGMRPASKKRKKQHFLIEQNXEKKSNXNRAKFXKGKXLKNLXSCXVLNYKNSXSKKLXQPXRNI

SEQ ID NO: 191338 - protein, 98 aa, Triticum aestivum
  unsure (1)..(98): unsure at all Xaa locations
  Clone ID: PAT_TA_85756.pep
MATPPPAPTTPPPAPPTQPPPAPTTPPPSPPATXPPAPXTPPPSPPMSPPPATPPXTXXPXXXWXPRHPRPSPXRXXPPRRXXCLRPSPXPPPKLTFS

SEQ ID NO: 191339 - protein, 198 aa, Triticum aestivum
  unsure (1)..(198): unsure at all Xaa locations
  Clone ID: PAT_TA_85757.pep
LADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQXKXGIPPDQQRLIFAGKQLEDXRTLAXDYNIQKESNPHLVLRLRGGMQDFVKTSTXRHHPEVETPTHRQP

SEQ ID NO: 191340 - protein, 197 aa, Triticum aestivum
  unsure (1)..(197): unsure at all Xaa locations
  Clone ID: PAT_TA_85758.pep
IDXPXXNXRPGGQTHVACTYSLMFGSMEREXXFERAFFGKLAPXDWRQPRSRWRXECQQAHTRGRRPLRDGAAQPRGSGGGWGISARTTAGGHVSIGARRANLARCVDDNTTHLAAAGCGDHPAVQNGRGSHRDGAVDRRPPDPSAGHRGGSDPSPGRRGAGGGPATRGLKVVRWRGAGGGVAVGAGGGVAAGGRRC

SEQ ID NO: 191341 - protein, 138 aa, Triticum aestivum
  Clone ID: PAT_TA_85759.pep
LPSLATTHSQGGCLAAAATAGAAPAASAATAAAGARCSPTWRPPPARPPWSCPPPPTRGAPAGSRWPAGRPAAATAPRASAAPRAAAPAAAATEPAPRRPAGRGEHEDEEENKQSSSPSPPPSVSVPLAAACARARAK

SEQ ID NO: 191342 - protein, 87 aa, Triticum aestivum
  unsure (1)..(87): unsure at all Xaa locations
  Clone ID: PAT_TA_85760.pep
GTSAAGXASRXPRRXAXXVVTGAGVSGPAXAXXTGAXSEXRVEATVPERXXEGXDGERXGERRRXCSXGRMCAXXIHGXXCXLXAPG

SEQ ID NO: 191343 - protein, 77 aa, Triticum aestivum
  Clone ID: PAT_TA_85761.pep
FFFYTVTTKVRSFRTKPDVTTTIETETDIARFTSTSRLKAIAPFSIISSGSAENVISQIEGKEKKKERECAIAVIII

SEQ ID NO: 191344 - protein, 170 aa, Triticum aestivum
  unsure (1)..(170): unsure at all Xaa locations
  Clone ID: PAT_TA_85762.pep
PSPIPLLSEHLISEHTLAYFARCPGRAFRRPPPAQARASHHRTSAELAVAGSVRRARLAATAAALKATRQSAGSSRSRPRRHATRRGPSSRRPPPAPTAGGTRTTRRPPPPAPSTGTHNAHSSAVRSGATPPPMCWFPPLVANPQVALEYXLVSGCRXRQHGAADKFSRR

SEQ ID NO: 191345 - protein, 152 aa, Triticum aestivum
  Clone ID: PAT_TA_85763.pep
QRSEGRTQGKGKGSGAFFFLSFSSLLTFLTRSKQEKTRGSTRSKEERGWGAGGTVYRTAGRRAVWCSTRGLLVVLCSGQGAWVADPPRRPPRFFPKGPPLLIFTKFFTTLQFYPKDPPLLLFFNVHAEDLQAFPATDRLQLVPALLPLRLLI

SEQ ID NO: 191346 - protein, 76 aa, Triticum aestivum
  unsure (1)..(76): unsure at all Xaa locations
  Clone ID: PAT_TA_85764.pep
PAQTELASRAMAPNGDNTVANVHSGIDSTNKTLLKSDALYTLXXQNNVFPPXNKCXCDHAXHHHRQPXVGLHAFFL

SEQ ID NO: 191347 - protein, 131 aa, Triticum aestivum
  Clone ID: PAT_TA_85765.pep
AKRISPRAPPFAGDFRHRKSQCRRISCPLRSISPRPTFFTKSCGQKPSRERGTSSTTVCRSTPEFATPPSVEDAPVAVLTTTASAAQRRTHPSLHPRRRVAGAAPPQPPTAAAVFLRTRLSGVRRKPLSGV

SEQ ID NO: 191348 - protein, 141 aa, Triticum aestivum
  unsure (1)..(141): unsure at all Xaa locations
  Clone ID: PAT_TA_85766.pep
LRRSPAALRPPPLVTAAGATSAARPPGLLRCSPRRPSSAPLLPCSAARAAQLTASPALLVPALRHAQPSSPPRPLCQLLLSAAQGLVLGLLPRLIKLWKTLMKQAIDLVFXYXTYCSSFCHLFXXLLCXXSXNLKFXIFGC

SEQ ID NO: 191349 - protein, 99 aa, Triticum aestivum
  unsure (1)..(99): unsure at all Xaa locations
  Clone ID: PAT_TA_85767.pep
SVIAVASSPSQKPSNHVVSEPPISIPPPHSSLEKNRKKKRXEKEGGWQLELARVGVDGGRRRLGGGDPNLSGAGEXGXAGAAVPGARVDSCRXSEXMPR

SEQ ID NO: 191350 - protein, 91 aa, Triticum aestivum
  unsure (1)..(91): unsure at all Xaa locations
  Clone ID: PAT_TA_85768.pep
GXERGXDTLRAEXHPGGLRPGXSRAXPXXWYAAXAEERVDWVASXDEERCRCGAXRCGXVGXPRLAXXQPQVFSPRGAXVSVWGKDRGRQE

SEQ ID NO: 191351 - protein, 156 aa, Triticum aestivum
  unsure (1)..(156): unsure at all Xaa locations
  Clone ID: PAT_TA_85769.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKXVTKLKEGVPNADCGAGTSWANNXNGHYCRKCGLTXXYNKKA

SEQ ID NO: 191352 - protein, 206 aa, Triticum aestivum
  unsure (1)..(206): unsure at all Xaa locations
  Clone ID: PAT_TA_85770.pep
LLPLDHPHPKPLSSILTLPLPLPCQSVPPPPRTCELAALDPARPRRTFAGALPPPLPASMRAPASFAISLLAMTAVAKLPVSAKPLLQSGAPASSTSLASAAPSPCLVCGAGGNNSSGTEAPTLLXHVAAPPGIGVXLVTNRNMVSSSPSRCSLIPPXASWMPICRIQKSRGASXFRSSRTAASPSSATVASTEVXXIRTLXGSGR

SEQ ID NO: 191353 - protein, 59 aa, Triticum aestivum
  unsure (1)..(59): unsure at all Xaa locations
  Clone ID: PAT_TA_85771.pep
PPFFXSSCSXRKSYFMVRSNVRIASXTWVFLPVVQEIICRREANFFNQLDNKRRYLSCP

SEQ ID NO: 191354 - protein, 166 aa, Triticum aestivum
  unsure (1)..(166): unsure at all Xaa locations
  Clone ID: PAT_TA_85772.pep
MAPKADKKPAAENKVEKAAEKTPAGKKPKAEKRLPAGKTASKEAGGEGKTRGRKKGSKAKKGVETYKIYIFKVLKXVHPDIGISSKAMSIMNSFINDIFEKLAGESGQARPXQXEPTSPPGXXDSVRLVLPGELPSTRLRRQGVTTPPRKMCANWLSMYLLPGLLQ

SEQ ID NO: 191355 - protein, 65 aa, Triticum aestivum
  unsure (1)..(65): unsure at all Xaa locations
  Clone ID: PAT_TA_85773.pep
HTIEPTSKSIXDDVPSFLHXPAVVKSCVLLNTHTLLHKPRTPPCXSILNSSNHXKGAXFEXTQGS

SEQ ID NO: 191356 - protein, 116 aa, Triticum aestivum
  unsure (1)..(116): unsure at all Xaa locations
  Clone ID: PAT_TA_85774.pep
IALLLXXXXAXHGXXVXIXPTPIXNTICSALXHSPNVTMHVHYXFCVXSLSADXASSXATDTRXLTAXXAXLTVXNLTSXEHIISDXLHNLGXCLXDYXQINRXVXAFAXITSEAG

SEQ ID NO: 191357 - protein, 127 aa, Triticum aestivum
  Clone ID: PAT_TA_85775.pep
LPQNLPDLTTLPLVCASRRDRRSLLPTLFLPRKGALGLAGHPSRARHLPLRGRRRQRTLARAPRLWQRSSPPRRRIARRRPAASCTSVFVVDGGNTSHPPVTRGRSSGNPPLFPTTQHADAVSSPLP

SEQ ID NO: 191358 - protein, 89 aa, Triticum aestivum
  unsure (1)..(89): unsure at all Xaa locations
  Clone ID: PAT_TA_85776.pep
LEMHHSPDXEXXDACRCRRVLFPRXMRRSRVTQGHGMGSGGCLRXLHGLPPRWWGHCINGRADVAAGMEWRRHPSTYCALKCHTKVSHD

SEQ ID NO: 191359 - protein, 50 aa, Triticum aestivum
  unsure (1)..(50): unsure at all Xaa locations
  Clone ID: PAT_TA_85777.pep
GRRGRGCXSVESXATXPGGHRDXVGXXGTXLPRXKRSXXDGSRCQMTGRX

SEQ ID NO: 191360 - protein, 154 aa, Triticum aestivum
  unsure (1)..(154): unsure at all Xaa locations
  Clone ID: PAT_TA_85778.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLKKECPNADCGAGTFMXNHFERHYCXXCGSLLYNQKA

SEQ ID NO: 191361 - protein, 114 aa, Triticum aestivum
  unsure (1)..(114): unsure at all Xaa locations
  Clone ID: PAT_TA_85779.pep
WXXIWWNLPEALFRSQXGXVLGTVVAGMSVGLMCVVRPAGSMVVVRCVSWGSAAVPLASQGGHLSPPHEGVLSLLLCMIKALPWLPMCCGELHAFGDVSVHLCSLMAQDASPTC

SEQ ID NO: 191362 - protein, 151 aa, Triticum aestivum
  Clone ID: PAT_TA_85780.pep
HTAATTHAQEGLIARSPWPPLAVANQRGHRPPFAAPTCPSVAPTSSSTSSPMRSSPGPLPRRIDHVSPLCPAPRRRSTATSPDSVEPRRRTPASGTLRLSATPSTTMVSTTSPLQQSFQMTEPRSQAATTVDGYLYSDSGYFYVHDADGQE

SEQ ID NO: 191363 - protein, 131 aa, Triticum aestivum
  Clone ID: PAT_TA_85781.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPLMMFCLADDWIC

SEQ ID NO: 191364 - protein, 92 aa, Triticum aestivum
  Clone ID: PAT_TA_85782.pep
GTSAAWCLGSRTSLFSLSGSCYVPLDPYSAPEVRIPLLERSIQPQRTTLADNVSVPHQLPVRPPVTKNSLLPKYIYLSIYLVYCLLHVDSRV

SEQ ID NO: 191365 - protein, 145 aa, Triticum aestivum
  unsure (1)..(145): unsure at all Xaa locations
  Clone ID: PAT_TA_85783.pep
IPPPPPRLAPPHPIWCLTPIPPLPPHASSAVSIPWRAAPLPCRPATPTPPPSRRGTPPSPSSAAPSLSSGSSAASIPIDRRLPRRPATPSAASLPVDWVLPRRPYLLPLPSRSDPHDGQAASPFCLPPSPAPPTAESSXGELQPT

SEQ ID NO: 191366 - protein, 142 aa, Triticum aestivum
  unsure (1)..(142): unsure at all Xaa locations
  Clone ID: PAT_TA_85784.pep
MARLNSKAVAAAVVLAAVVLMMAGREASAALSCGQVDSKLAPCVAYVTGRASSIXSKECCSGVQGLNGLARSSPDRKXIACRCLKDLRHQASIHQHGQVSGVPGNXASACPSPSSMSTXNCNNVNYSIYNPSYVHAWTACGA

SEQ ID NO: 191367 - protein, 146 aa, Triticum aestivum
  unsure (1)..(146): unsure at all Xaa locations
  Clone ID: PAT_TA_85785.pep
AAMGRKECISLAILALVLLAGPGAKATAFAGGAASMDAAVAVRQVMPTSSIKLEDGVAPELAVVLEMHRRVLMDSFGNSVYNSDTQRCLKAPCIAGGPYSXGSGEXTTLRVRPYVTEWTAYIXASMQLXPALPLLIXXLHFXXTVA

SEQ ID NO: 191368 - protein, 141 aa, Triticum aestivum
  unsure (1)..(141): unsure at all Xaa locations
  Clone ID: PAT_TA_85786.pep
MADAEDIQPLVCDNGTGMVKAGFAGDDAPRAVFPXSIVGRPRHTGCHXSGMGQKDAYVGDXAQSKXGILTLKYPXEHGIVSNWDDMEKXWXHQNFYNELRVPQEEQPVLLNXKAPLXNPKGNXKKMTQIXMFENFXTPWLS

SEQ ID NO: 191369 - protein, 61 aa, Triticum aestivum
  unsure (1)..(61): unsure at all Xaa locations
  Clone ID: PAT_TA_85787.pep
SVTTVAHTDDFSSAVMFRCMTTQPAFPXRSICIYAWLRLRLLICMLNLPSLVXMAASFSLS

SEQ ID NO: 191370 - protein, 61 aa, Triticum aestivum
  unsure (1)..(61): unsure at all Xaa locations
  Clone ID: PAT_TA_85788.pep
NFAFGXAIAXXKXPVSFXXTGLDXTPVLIXDTXYXPXAQLLICVWMWQLEKLXSXSSVFAL

SEQ ID NO: 191371 - protein, 117 aa, Triticum aestivum
  unsure (1)..(117): unsure at all Xaa locations
  Clone ID: PAT_TA_85789.pep
DPLRVRRPRLFEPLSASPRSSSPRASPPDLRHASRGRDLRLLVASYRHRPWSPPQLTLVAGRTVFCKVQAPSLAPPSVNQVLRXPSSFXXLXFXFLXALRPRLHYXSLIKXLRSXGN

SEQ ID NO: 191372 - protein, 154 aa, Triticum aestivum
  unsure (1)..(154): unsure at all Xaa locations
  Clone ID: PAT_TA_85790.pep
LLIPFPRSATEAMPAPTRPRGLAAAGRAALALLVLLAVAAPRCRVARAQQQYEANKQLNCYGTKXSSVLGYTWQTPTAAGPPLAPPKFVFRLLPGPXXSPXNISYLXXANXGGLAXAKPXPTFXVAAPARSRXVKCXCRRRYTTKKRSIHPKEN

SEQ ID NO: 191373 - protein, 194 aa, Triticum aestivum
  unsure (1)..(194): unsure at all Xaa locations
  Clone ID: PAT_TA_85791.pep
CRGLEPQPRQEPLPWRNPAILLLALLLLLASPAISSTKRTQQPKFPAIFYFGDSIFDTGNNNHIPTLGLANHPPYGRDFPGSRPTGRFSNGRLVPDLLNEEAAXQGXXPPFLDRSLSDKDIMTGVNFXSAGSGFDDRTSHLXNTMPLXXASGXSSXDEYLXLALRSIAGEQGGXXIIXXSLKFXHXGNNDLNTT

SEQ ID NO: 191374 - protein, 89 aa, Triticum aestivum
  unsure (1)..(89): unsure at all Xaa locations
  Clone ID: PAT_TA_85792.pep
KDFXXNTEPXXFRLITNXELXKEXWPXNHFLTHLRGVXQDLETPFTRYVDAGMNNWEIDSHPGRMDLLQHTYRRWISTFIDMRIRCALS

SEQ ID NO: 191375 - protein, 174 aa, Triticum aestivum
  unsure (1)..(174): unsure at all Xaa locations
  Clone ID: PAT_TA_85793.pep
PDSSPPSTVGRRPPQLRRPPSPGSGCLPPQLRPPPFPVSXPPPSPAXPPPQRAAGRPPSQRGASRPLPSAPPADLASSAPPRRPSPPPPXXTATTTTTSHRNHHHLLILXSPRPSIXHXTPPPPSLLHXXRPYSPTTAAFLGQPAFGGLLPSSSRTPSGLRVSILRFPNPRVLY

SEQ ID NO: 191376 - protein, 165 aa, Triticum aestivum
  unsure (1)..(165): unsure at all Xaa locations
  Clone ID: PAT_TA_85794.pep
MSKDRHEHHLRRCCGGLAACLLFLVVAVAVTALVVYLVLRPAKPSFYLQDLQLRSVSLGDPSLSATAQVTLASRNPNDRVRVLLPGASKSSVTYRDXPVTVPVSLPPALQGQXGDXTIWAPXXSRGFXALGGFVXDAMKQGIAAXXYLXXQVKVNGAPVEGRWRQ

SEQ ID NO: 191377 - protein, 131 aa, Triticum aestivum
  unsure (1)..(131): unsure at all Xaa locations
  Clone ID: PAT_TA_85795.pep
MEGCDRIRGPWSPEEDAALRRLVECHGARNWTAIGRGVPGRSGKSCRLRWCNQLSPGVERRPFTAEEDAAIARAHAKXGNRWAVIARLLHRRXDNAVKNHWXCSSASSNVGVHKMRNLKRARARATGLGSG

SEQ ID NO: 191378 - protein, 87 aa, Triticum aestivum
  unsure (1)..(87): unsure at all Xaa locations
  Clone ID: PAT_TA_85796.pep
IQLGLLPLWNPVTCMSFXIHIFIFQQRYFLSPKVQSVANTXYKGNGXYFQLPXETXKPLXXXTXRRFCTXSXSXTXSICTMXKXENH

SEQ ID NO: 191379 - protein, 97 aa, Triticum aestivum
  unsure (1)..(97): unsure at all Xaa locations
  Clone ID: PAT_TA_85797.pep
MGAQKGPAGVSVIMVSLIIVIMSTAAMSCSKKAATDEKTSWPEVVGLSVEKAKEIILKDKPDADIVVLPVGXPVTKDYRSQRVRIFVDIVXETPHTG

SEQ ID NO: 191380 - protein, 79 aa, Triticum aestivum
  Clone ID: PAT_TA_85798.pep
LSICPDIKKHKTVNLVAHQTKYRKSIKGLHIKIKYLKNFRINQHCRQQMYSVNNIFRSNIMRIAHPDIYIYARRSNIRS

SEQ ID NO: 191381 - protein, 55 aa, Triticum aestivum
  unsure (1)..(55): unsure at all Xaa locations
  Clone ID: PAT_TA_85799.pep
TLLXFGVLAPRLTSTLCTLSFCDIWELLKLFHNFSLSLXITRSSKPIYLTNGFIF

SEQ ID NO: 191382 - protein, 132 aa, Triticum aestivum
  unsure (1)..(132): unsure at all Xaa locations
  Clone ID: PAT_TA_85800.pep
MAAAKPACSAPANSADAAKPAAAPEPEQQLLEVAEEEVVVDXKPNAKCRVDLRLRSLXXXLPVAFKVXTSSXLKFSSSPPRXAXQPLSMXPXAXVLXPXPHXPPSXPRXXXDRFLXXLPLRANSAVAAAPSA

SEQ ID NO: 191383 - protein, 89 aa, Triticum aestivum
  unsure (1)..(89): unsure at all Xaa locations
  Clone ID: PAT_TA_85801.pep
XVXLKHYWGAKLSPALXAIQHYASLTVRNARSMWHNLTTXXCPSTTGECALRRXSHIKSXLCRSKSPEXXXHLXLRHXLXKSGVMXTRG

SEQ ID NO: 191384 - protein, 51 aa, Triticum aestivum
  Clone ID: PAT_TA_85802.pep
CTNWVLLHKCFLTICTYIYEYEMCTRMLLPIFSKSVAWECKMVTGYRSART

SEQ ID NO: 191385 - protein, 127 aa, Triticum aestivum
  unsure (1)..(127): unsure at all Xaa locations
  Clone ID: PAT_TA_85803.pep
AAQPADTRSQLTSXTGXXAMXVEQRGXRRHGRXGHRHPHGGAGXXQGHPRHLRXALHXLLLXPXSAPLPXXAGXRRLPGXHXXHGXXSXGXARYFXXLXGRYXPSEWXTAVXLYRXPXTQVSGRXIR

SEQ ID NO: 191386 - protein, 98 aa, Triticum aestivum
  unsure (1)..(98): unsure at all Xaa locations
  Clone ID: PAT_TA_85804.pep
INQLGTIRLGNTLAVCXQRNNSKRRNLSSQWNNEEVVELHSAGTLAGHDXARTNGSHNKQSRNHGITCNLGWKKSPGESVRNLRNESPKIVLSSKGGD

SEQ ID NO: 191387 - protein, 153 aa, Triticum aestivum
  unsure (1)..(153): unsure at all Xaa locations
  Clone ID: PAT_TA_85805.pep
KPPPSLSRRPAHTPSPDHPHHCAPAPSRTRRARDRAPTPGARRCPGPPRLTPSXRPLRPPNCRPTPSIAGAPPRRPASTSPPECLPCDVSSPSSSPSPAASNPTAPTTRPTLLLPSSTTELTTPPSCPSNXXDGAQEPRSNRSMTTTTPGGAY

SEQ ID NO: 191388 - protein, 58 aa, Triticum aestivum
  unsure (1)..(58): unsure at all Xaa locations
  Clone ID: PAT_TA_85806.pep
WSCRARAXWRSRRXCXWWPWXSXXXPXWPRQRPSXLLLAWXSIRPRKGXGDRDXTSSS

SEQ ID NO: 191389 - protein, 80 aa, Triticum aestivum
  unsure (1)..(80): unsure at all Xaa locations
  Clone ID: PAT_TA_85807.pep
MARTKQTXXKSTGGKAPRKXLATKAARKSAPATGGVKKPHRFRPGIVALREIRKYQXXTXVANRXXPLQXLRSGKFPKFK

SEQ ID NO: 191390 - protein, 74 aa, Triticum aestivum
  unsure (1)..(74): unsure at all Xaa locations
  Clone ID: PAT_TA_85808.pep
AISPNPIPIRRGRSDQALARMIYRNWSLLSSTVVIWGSVGAAGLAGIFLFGGXGYLSREGERLRQQDRAMMGKN

SEQ ID NO: 191391 - protein, 53 aa, Triticum aestivum
  unsure (1)..(53): unsure at all Xaa locations
  Clone ID: PAT_TA_85809.pep
EXTSILXXMHXLXYKIXIQXLCXVCSLFHASPECTALSVXHQPXXKRXXHCXT

SEQ ID NO: 191392 - protein, 87 aa, Triticum aestivum
  unsure (1)..(87): unsure at all Xaa locations
  Clone ID: PAT_TA_85810.pep
WASMLLAMARFEMSVACLQSLNLNPTPNKAIKXKLXXNNLIFQXSSXXXFXXKPXPSTGNPXRXXRGATXRXSQIIMGVLIKFKKKK

SEQ ID NO: 191393 - protein, 163 aa, Triticum aestivum
  unsure (1)..(163): unsure at all Xaa locations
  Clone ID: PAT_TA_85811.pep
FEVPAXAKTLGRRQQQKKRKALPLPLFDLGVAAFLHHDSQHRRLVVVAFLHLLTGGVEHRCSISWPRFQLFPRPVSTNFTTVEAFQQLPVPGRSSTVAASRDCGSSLLAPGSSNFTTETRPFPRGRSSTPSTPPRQSSGRRGGFASQGVAIAGKRGGEVVHRS

SEQ ID NO: 191394 - protein, 58 aa, Triticum aestivum
  Clone ID: PAT_TA_85812.pep
VFDFYFSLGSQKLCILVPNKSIENDYWICVDCFLFQNTICCYYFIMFEIISAFRLKKK

SEQ ID NO: 191395 - protein, 137 aa, Triticum aestivum
  Clone ID: PAT_TA_85813.pep
VRLYSALLTDSCPVRAPRRRRRASECRGSSAPRIADDGRAGGHEEAPAAAGPPQVDALAAARAAAPLAPDPLRRARAGAHAAAALPAAARGEAAAAAALPPPRLAYLISGGPATAAVSPPPAGALHPGTTTRPGGRR

SEQ ID NO: 191396 - protein, 176 aa, Triticum aestivum
  unsure (1)..(176): unsure at all Xaa locations
  Clone ID: PAT_TA_85814.pep
MARTKQTARKSTGGKAPRKQLATKAARKSAPATGGVKKPHRFRPGTVALREIRKYQKSTELLIRKLPFQRLVREIAQXDFKTDLRFPESAVSALQEAAEAYLVGLFXDTNLCAIHAQARHIMPKGHPTRPAASRGEPPKFSHRRVICVITVPVWCLVGVYMACLLSKPDAGMKCEN

SEQ ID NO: 191397 - protein, 167 aa, Triticum aestivum
  unsure (1)..(167): unsure at all Xaa locations
  Clone ID: PAT_TA_85815.pep
MANPRVFFDMTVGGAPAGRIVMELYKDAVPRTVENFRALCTGEKGVGKSGKPLHYKGSAFHRVIPDFMCQGGDFTRGNGTGGESIYGEXFADEXFVHKHTKPGILSXWXNAGPNTNGSXFLIXTVPCNWAXXNNLVXGEXLXGNDXVXTXTRWLRXGTXSKQWSTLA

SEQ ID NO: 191398 - protein, 83 aa, Triticum aestivum
  Clone ID: PAT_TA_85816.pep
RRRRPRWRRPSPPRRPRRRRRSPRRRRPRSRRLSPSRLRRPRRRRRQPLRRRRPRTRASSCRRAGGRAQRPEQPSSQRPRGLC

SEQ ID NO: 191399 - protein, 169 aa, Triticum aestivum
  unsure (1)..(169): unsure at all Xaa locations
  Clone ID: PAT_TA_85817.pep
MASLVAVQPVAVRGLAGSSISGRKLAVRPASAAVSRSTRRYLTRLTNTRTIXATDRDQLRHVNAGLXGAAVVAKYGEKSVYFDLXDDIANTTGQWDLYGSDAASPYNGLQSXFFNTFAAPFXTKRGLLLKVLLLGGGSLLAYVSAXASPELLPIKKGPSCRPXGDTGKX

SEQ ID NO: 191400 - protein, 98 aa, Triticum aestivum
  unsure (1)..(98): unsure at all Xaa locations
  Clone ID: PAT_TA_85818.pep
APFRLSSLLCYRVVGASLGHLPAGNTLGSWTNCIVAVIEMDLTNYYSRRVGCHRFHCRLPARLHRPQLPRLRQRQLWHLIWLGRHRPRATQPDXSSQA

SEQ ID NO: 191401 - protein, 53 aa, Triticum aestivum
  Clone ID: PAT_TA_85819.pep
LKNIFHARICSRSRVSSSQTQCARKETTSSNIPKGLHTKRLNSNPSSLAVSER

SEQ ID NO: 191402 - protein, 128 aa, Triticum aestivum
  unsure (1)..(128): unsure at all Xaa locations
  Clone ID: PAT_TA_85820.pep
LPSLATTHSQGGCLAAAATAGAAPAASAATAAAGARCSPTWRPPPARPPWSCPPPPTRGAPAGSRWPAGRPAAATAPRASAAPRAAAPAAAATEPAPKXPAGRGEHEDEGGEAKQSSSPSTPPSVSVH

SEQ ID NO: 191403 - protein, 76 aa, Triticum aestivum
  Clone ID: PAT_TA_85821.pep
SAVNCSKKSAMNYKKHHMINVHNLGGKVHVHIFSVNYVFFFGDANFFKNKSKLTYTSWEYEQKNTIVTKLPILTQI

SEQ ID NO: 191404 - protein, 132 aa, Triticum aestivum
  unsure (1)..(132): unsure at all Xaa locations
  Clone ID: PAT_TA_85822.pep
VKQGXFRRXAQXQHDRRGNPPXWDXLTTLGRRRPPRSSIRRRWHLGPRIHHQRSTWRLGVCLGAVERRQSSEKLVRAEGEEEIAVLAAGGPSMIQWARRMEQSTAVPSDSVLWRGDDGGRGIDEGDDDGGVG

SEQ ID NO: 191405 - protein, 89 aa, Triticum aestivum
  Clone ID: PAT_TA_85823.pep
QTNTSSLPSVERSLLVRKRSTKCLMASSKSFTTGKWVRGALLNMLNLSTENKFQQKKTRINISNPSDADFSVPTKNVEWRRSEEHLRRK

SEQ ID NO: 191406 - protein, 92 aa, Triticum aestivum
  Clone ID: PAT_TA_85824.pep
LSCGQVDSKLAPCVAYVTGRASSISKECCSGVQGLNGMARSSSDRKIACRCLKSLATSIKSINMGKVSGVPGKCGVSVPFPISMSTNCDTVN

SEQ ID NO: 191407 - protein, 126 aa, Triticum aestivum
  unsure (1)..(126): unsure at all Xaa locations
  Clone ID: PAT_TA_85825.pep
LQEETKSCEAPPADGRAGSYKLXGVSPRGGKGXIXXXREKRPXDXXKWDFSGXGXXXEFGGPAQXXRPXLPTXVTXPXRGQTPAQKPRGPXXGXXNLKXNPVXPXXARXXENXXXXFXKXKKKGPP

SEQ ID NO: 191408 - protein, 124 aa, Triticum aestivum
  Clone ID: PAT_TA_85826.pep
PIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 191409 - protein, 134 aa, Triticum aestivum
  unsure (1)..(134): unsure at all Xaa locations
  Clone ID: PAT_TA_85827.pep
RSVEPSAAAPPSALSFLLRSKMKFIAAYLLAYLSGNASPSAEDLTSILESVGCEIDNEKMELMLSQVKGKDITELLAAGREKFAAVPSGGGGVAVXAAAPAAGGAAAPAAESKKEEKVVEKEESDDDMGFSLFD

SEQ ID NO: 191410 - protein, 178 aa, Triticum aestivum
  unsure (1)..(178): unsure at all Xaa locations
  Clone ID: PAT_TA_85828.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCXTDATXVINEVEEVKEGLPGRLTSASSGFDNIPKVQCVSFNRLQATGCXESGKG

SEQ ID NO: 191411 - protein, 86 aa, Triticum aestivum
  unsure (1)..(86): unsure at all Xaa locations
  Clone ID: PAT_TA_85829.pep
KRSNLLSGALHCPPPPPQPPPRHFHSTPPPPQPRRXFPYYSSSSAAPRTCYSLQPPPTVTPGFKLRLAPPPPATRRPFATPGFSEL

SEQ ID NO: 191412 - protein, 67 aa, Triticum aestivum
  unsure (1)..(67): unsure at all Xaa locations
  Clone ID: PAT_TA_85830.pep
SXSGARCHAFFPPGVPIPIFXXXXELCXLLKELDLDWVPAXRAPLXXXSRFVEAPXERGFXLASGGA

SEQ ID NO: 191413 - protein, 176 aa, Triticum aestivum
  unsure (1)..(176): unsure at all Xaa locations
  Clone ID: PAT_TA_85831.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXKVGFIFREHNASPGYYDGRYWTMWKLPMFGCTDATXVINXVEEVKXEXPXPYVASXGFDNMRQVXCVXXXIXSSQRGCQXSGKA

SEQ ID NO: 191414 - protein, 70 aa, Triticum aestivum
  unsure (1)..(70): unsure at all Xaa locations
  Clone ID: PAT_TA_85832.pep
LRGQXXAEPNPPTHTHRSSXXPLTSRDHGQLTGGRXSSPSATRPSXSTAGAAAGPPPXGAXTWRTTWTSA

SEQ ID NO: 191415 - protein, 106 aa, Triticum aestivum
  unsure (1)..(106): unsure at all Xaa locations
  Clone ID: PAT_TA_85833.pep
GRDGXKETPMWRAAPXRGARSPARXGVXXEGVPALGXXALGDGEVPGELLVSVSRQEKEDGGEKATGREGRGDGRNGTRRGRGFYRRSREALGWKDEGDREGGDSC

SEQ ID NO: 191416 - protein, 77 aa, Triticum aestivum
  unsure (1)..(77): unsure at all Xaa locations
  Clone ID: PAT_TA_85834.pep
GWXYXNKXSTQASCSLPARWTXFEKAXGWSWYQLALGLRIGFILNQKEHTDPTIVWPXLDTIRTATNGYTSGFLGGE

SEQ ID NO: 191417 - protein, 170 aa, Triticum aestivum
  unsure (1)..(170): unsure at all Xaa locations
  Clone ID: PAT_TA_85835.pep
EXQRSSGGXAGDNGGGXWQXAGREXERFRRGLETDLAPLGASXIRAMGSSGVPMKWRRPCRGSGDEIGGNRSRDSRSTGSGPRWGTPASRSSRREVAGAPAGCSCEGQRGEVRSRGESRRRQVKEGEMGRAWWSYWPAPTGGEDVAEGSRCSGRGRHGRSTRGARGRRRA

SEQ ID NO: 191418 - protein, 59 aa, Triticum aestivum
  unsure (1)..(59): unsure at all Xaa locations
  Clone ID: PAT_TA_85836.pep
GKWISGKRGIEEVQKTDLSIYKRXDFWSFIKKRRYIKRFGLCIKLMVGDVMADYHDSRR

SEQ ID NO: 191419 - protein, 59 aa, Triticum aestivum
  unsure (1)..(59): unsure at all Xaa locations
  Clone ID: PAT_TA_85837.pep
SVALXAGXXMSELDTRFATXLKDXTXKXXXXPXIXVRXLAIADXVTICRXLXKAGRSGP

SEQ ID NO: 191420 - protein, 117 aa, Triticum aestivum
  unsure (1)..(117): unsure at all Xaa locations
  Clone ID: PAT_TA_85838.pep
MGAPAYGAVLLFALALAAGAAAAETARPEEPTLPAVAAAGGGDGVVVAAAAAVVNASGAGVNSNSVLVALLDSHYTELAELVEXALLLQTLXDXVGRHNVNIFAPRNXAXERDSTRS

SEQ ID NO: 191421 - protein, 112 aa, Triticum aestivum
  unsure (1)..(112): unsure at all Xaa locations
  Clone ID: PAT_TA_85839.pep
SRRSAXTVXHRQLAGFVGRWSDFGSSSFILVMLFREAPGVRLERWQSLGSLVRCSTRWPLHCRWVVMLFCEWTLPLFSFSYLPSLCTHIRCTRKPSTCHPCTDSPASSASIT

SEQ ID NO: 191422 - protein, 164 aa, Triticum aestivum
  unsure (1)..(164): unsure at all Xaa locations
  Clone ID: PAT_TA_85840.pep
MSDTDEHHFESKADSGASKTYPQQAGAIRKGGHIVIXARPCKVVEVSTSKTGKXHGHAKCHFVAXDIFXNGRXXKDIVPLSXNCDVPXVEPPXFIXLIDITDEWICXALLLKIVTLXMNLKLPTXRMFWLGKLKTGFAXGKDLIPXVKVXQWGEKXIXPCRKGN

SEQ ID NO: 191423 - protein, 67 aa, Triticum aestivum
  unsure (1)..(67): unsure at all Xaa locations
  Clone ID: PAT_TA_85841.pep
KKKILTLDRILVXFSYYFIPSYYIVRWFWYPPPSALVLSMIRMWYILSFYNYLIHLLFMTNIPTSVT

SEQ ID NO: 191424 - protein, 87 aa, Triticum aestivum
  unsure (1)..(87): unsure at all Xaa locations
  Clone ID: PAT_TA_85842.pep
PXTCCQXGQQXGKXKHXLRVXMSNKPGSAXAXXXNXGSXQGFXXQEGYXISXXVXHXDTAIFHITFXXEKEXFXRXXHGEXLXNSDV

SEQ ID NO: 191425 - protein, 185 aa, Triticum aestivum
  unsure (1)..(185): unsure at all Xaa locations
  Clone ID: PAT_TA_85843.pep
SHNHKPESLLLACLGAVFAARLAAVAGAPAQPSSDCQSKCGDIDVPFPFGIGPECAMPGFNLTCNDVGGRRALFHGNVEIVGLPLERGQARMMNVISSACYNAASGGMEYNDWXLNLTNTPYRLSDTDNKFTAVGCKTLAYISDERNTGKYMSGCVAKCRRSEQGALRNGXCSGIXCCQTAIRGS

SEQ ID NO: 191426 - protein, 154 aa, Triticum aestivum
  unsure (1)..(154): unsure at all Xaa locations
  Clone ID: PAT_TA_85844.pep
LSYHGQKGVHLPCNHRACSACWPARECFRLRRRCRCQHGRGAGCAAADANAVVDEAGGRRVAGAGGGPRGAPPHPLGHPPANREPRWASLPEEWVSGGRRSVYRPRMPQEVRLLVNATTVHSELXGTTYGRQCNLLPAPVRSWAHSRSIIHPMF

SEQ ID NO: 191427 - protein, 60 aa, Triticum aestivum
  Clone ID: PAT_TA_85845.pep
FKRKYLSVQGSEEHCTSLVIHFNWSTLIKLFFFLTFGVIDFVSHFCPLKCCRIYALFQLR

SEQ ID NO: 191428 - protein, 162 aa, Triticum aestivum
  unsure (1)..(162): unsure at all Xaa locations
  Clone ID: PAT_TA_85846.pep
MEANQEKAPETATGGDAPRPVRAVCVFCGSRPGNRPSFSAAALDLGKQLVERQLDLVYGGGSGGLMGLXVSKAVHDGGRHVLGVIPSALLPEEVSXETXGEVKVVXDMHERXSEXAKHXDAFNALPXGYWXXKSSGXITWAXLGIHNKPVGXLNVDXNTTAA

SEQ ID NO: 191429 - protein, 175 aa, Triticum aestivum
  unsure (1)..(175): unsure at all Xaa locations
  Clone ID: PAT_TA_85847.pep
ITLEVESSDTVDNVKAKIQDKEGIPPDQQRLIFAGKQLEDGRTLADYNIQKESTLHLVLRLRGGMQIFVKTLTGKTITLEVESSDTIXDNVKAKIQXDKEGIPPDQXQRLIFAGKQLXEDGRTXLLDYNIQEGXNLHLXVLRLRXWVNNCPELGTWLLSCALFRVKTVSGWFDHS

SEQ ID NO: 191430 - protein, 157 aa, Triticum aestivum
  unsure (1)..(157): unsure at all Xaa locations
  Clone ID: PAT_TA_85848.pep
MDASATVAAGKAKKGAAGRKAGGPRKKSVARSVKAGLQFPVGRIGRFLKKGRYAQRVGSGAPVYLAAVLEXYLAAELLELAGNAAKDNKKSRIIPRHLLLARQEXDKELGRLLAXVTISXGGVXXNINPVLLPNXDAENPPKEPXRPKKTANPPKKA

SEQ ID NO: 191431 - protein, 59 aa, Triticum aestivum
  Clone ID: PAT_TA_85849.pep
GVVHLRFSQERGYTRLSFLPVRLCCTLKKNCYCQRSDLRYSWVLTETIVQICNSHWVLM

SEQ ID NO: 191432 - protein, 136 aa, Triticum aestivum
  unsure (1)..(136): unsure at all Xaa locations
  Clone ID: PAT_TA_85850.pep
SFLLPLPSVLPAQSVPSSVVPFRFGPVQSPHPRRTRTRPAVPCSLDLRGGGDRPSPSGGRSPAVKTQSWRLAARLLLPPACCRGRQGKEXEXDKLVRDGARGKGYXSDXDHGQLPRPSCSTGSTPXATARPARRPG

SEQ ID NO: 191433 - protein, 105 aa, Triticum aestivum
  Clone ID: PAT_TA_85851.pep
SGGYSRSAMSGPGNIPQLKHVVQIIEVLGHSHQRLHLSFVAEPFVTSLGILLSHLIAQHTNLDMFVFFVRLIFYQVEDQQSRICSYTGIYTSVCFVTQMSTLHRP

SEQ ID NO: 191434 - protein, 124 aa, Triticum aestivum
  Clone ID: PAT_TA_85852.pep
HAPAPPRPARRHPGDAPRRPLPPRQPARARAPRSRRHGPLLFDQGRLLCLVDLLPPVLPEPPRARHRLTLDYETDAAAGALTDYVVDDPYLLEQPRCRSLGAKTPPPTTTPTTLGGAYYYVVGR

SEQ ID NO: 191435 - protein, 130 aa, Triticum aestivum
  unsure (1)..(130): unsure at all Xaa locations
  Clone ID: PAT_TA_85853.pep
VKKTNHDQFEKEPASPLPPSRHRGAQAVHRRQHSPFTGDTEVIQRRNGEVWPFPFLFLCRLRVEIHLHVLRRPHTRQASWLRSTPDWVGCPYPGWASWVGDLXSXMLGLGCXVCLVIRPRLSSAPSIKLG

SEQ ID NO: 191436 - protein, 98 aa, Triticum aestivum
  Clone ID: PAT_TA_85854.pep
KKSTKICPQDLSTFLKLLSWCRAHLSLNMMKSLTTSPSVWPFTQRWHKSKDLQVKHTTYLKQHFVYSAICTNHTWSSTVTVLAFICRCNTAQFIKYLG

SEQ ID NO: 191437 - protein, 126 aa, Triticum aestivum
  unsure (1)..(126): unsure at all Xaa locations
  Clone ID: PAT_TA_85855.pep
YSSSSKEDVSDKTTSQKCAHESCCSXSXSPPSYQHLALPMVTPQLAGGSKKKKKKLTVLRSHRRRSLKRDAVHHLQLPPDAGCSSSRCRLQLPAIHDWSSSFDRSSHGRRLQLLLSSFRTSFEKRM

SEQ ID NO: 191438 - protein, 107 aa, Triticum aestivum
  unsure (1)..(107): unsure at all Xaa locations
  Clone ID: PAT_TA_85856.pep
YPSSPSRIRYPKDTFQGCTEMKFSSDTLPLTLSFALTDLPNHIFVYELPNLVAHRQLFRQLISAYPSWCLTNKNILGSNDXFPMFWDTKLHLGYKQLVSRMHTGHMT

SEQ ID NO: 191439 - protein, 85 aa, Triticum aestivum
  unsure (1)..(85): unsure at all Xaa locations
  Clone ID: PAT_TA_85857.pep
PIRWLPVHTFSPPGAASSLXFPPAVRRHGSPQRRRKVFPPCSTCCSSEKPTSAKPXKLXQLPTTKNNRXXXMNXIWFNNXQXXGF

SEQ ID NO: 191440 - protein, 146 aa, Triticum aestivum
  unsure (1)..(146): unsure at all Xaa locations
  Clone ID: PAT_TA_85858.pep
AAXRARGFPGEELHGLLSMMVGVLXPDGHDGGAXLPGGRPLIVLTATSPCRGWVXHRHRGVVLGIPGSTGDGSRNIVVHKVIGISHPVPWHASQVIYQSYNLDPYVVVTHSCIPQGDYGYWVQPIAELACAIFSRFGWRANNRLGV

SEQ ID NO: 191441 - protein, 61 aa, Triticum aestivum
  Clone ID: PAT_TA_85859.pep
PGYHTILNISFIPPLIFNRLTKEIKNSPSILLQSRHVEHECTNVQKEKRQPGQYQELHIYP

SEQ ID NO: 191442 - protein, 100 aa, Triticum aestivum
  Clone ID: PAT_TA_85860.pep
CAAADDGSGSVLSVVHKSMDTIAFRLFILRAIVLKKGYFVRLGCAHAVHRRAATGCSSTGELSSFLLLFLVEKVLFLCVVGFACHAGRRSLHCPMAFNTW

SEQ ID NO: 191443 - protein, 139 aa, Triticum aestivum
  Clone ID: PAT_TA_85861.pep
HWSYKHLIINTSGSGALAQFNLPTSATSSVAIFHILISSPTAVLRPLSDPQPKEETELSPAGDREEEMEPGGGVFQRDRGRRDSSGVEQGGVTGACGLEEASGTLPGGGKGRAAGGSAHRRQHSRKEARGGAIVTEQLV

SEQ ID NO: 191444 - protein, 177 aa, Triticum aestivum
  unsure (1)..(177): unsure at all Xaa locations
  Clone ID: PAT_TA_85862.pep
MAPTVMASSATSXVAPFQGLKSTAGLPVSRRSNGASLGSVSNGGRIRCMQVWPIEGIKKFETLSYLPPLSTEALLKQVDYLIRSKWVPCLEFSKXGFIFREHNASPGYYDGRYWXTMWKLPXFGCTDXTQVINEVEESKKEYXDRYFRIIGFDNMRKCKCVSFIAFKQXGCQESGKG

SEQ ID NO: 191445 - protein, 208 aa, Triticum aestivum
  unsure (1)..(208): unsure at all Xaa locations
  Clone ID: PAT_TA_85863.pep
DGKVRTDKTYPAGFMDIISIXPKTGENYRLLYDTKGRFRLHSVRDEDAKFKLCKVRSVQFGQKGIPYLNTYDGRTIRYPDPLIKANDTIKLDLXETNKIVDFIXFDVGNVVMVTGRAQHWGVLGVIXKNREKHKGTFXETIHVEDAQGHHSPTRXGNVSPLGKGHKPWVNLPXGXGIKLTTXKEQRKRIRCQAAARPDSKAFAPFTRI

SEQ ID NO: 191446 - protein, 97 aa, Triticum aestivum
  unsure (1)..(97): unsure at all Xaa locations
  Clone ID: PAT_TA_85864.pep
CPSRSXXXGPCXSXAAXXRGYRGCCSASAGXPPSSXAAALLVAALLVLLXTRWRRSTMXXWGRGRDGRVGLEXGAGAVXXGCXXTRWXXGWCXGAVR

SEQ ID NO: 191447 - protein, 100 aa, Triticum aestivum
  unsure (1)..(100): unsure at all Xaa locations
  Clone ID: PAT_TA_85865.pep
EXCNGKDPHXPNXRXLSXXAXXRDGXXKXSXRGRYXYXQXXTTVXERVMAPSAXNXSHSPQKCXYLLSLSXSXTGRKTDGRTXGRXXKAAGXGWGRRNVK

SEQ ID NO: 191448 - protein, 109 aa, Triticum aestivum
  unsure (1)..(109): unsure at all Xaa locations
  Clone ID: PAT_TA_85866.pep
XLCPPDLSMXTAXXAAAATGTLLPHAXXESSLASXAAXPCXVLLLPPPLLIXLPSXDHPFXSXXQXPEXLSRXPCLSLXLXARPVXXXXDSXEGXXEGXCXIXGRRXRS

SEQ ID NO: 191449 - protein, 114 aa, Triticum aestivum
  unsure (1)..(114): unsure at all Xaa locations
  Clone ID: PAT_TA_85867.pep
VSTAAYVARRAAQKERVRILYRRALKDTLNWAVHRHLFYQDASELREKFDANKHVEDLDTIDRLTDQAEATYNNFRHPDPYIVPWAPGGSKFCRNPTPPQGIEIVXNYGREDND

SEQ ID NO: 191450 - protein, 126 aa, Triticum aestivum
  unsure (1)..(126): unsure at all Xaa locations
  Clone ID: PAT_TA_85868.pep
EXXQXPTAGGALXPXXPHXFSXCSXGTDXSVFRSXPQEHGGGGDPSRRHPGRHQRRLRQRARAAKAARVRRSGRASGGGCVEEGTAAAAAACGGGGWPWRGGARGGGCHAHAHGHRIYLSLFIIAS

SEQ ID NO: 191451 - protein, 139 aa, Triticum aestivum
  Clone ID: PAT_TA_85869.pep
FLGDYFPAELPEAAAKKVLKINTKGAEEQSAPASPRVCSVEAYAPDKFCSGKLARERQAPAEPQVLAVEADFPTAADVPLVLVVEPQAPAWAQQIVRFLQTGELPEEQEEAKRVARQSSMYQFVDNKLYRRRLNGVKLK

SEQ ID NO: 191452 - protein, 36 aa, Triticum aestivum
  unsure (1)..(36): unsure at all Xaa locations
  Clone ID: PAT_TA_85870.pep
YPDAYVRVIGFDNLRQVQCVSFIAFRPXGCXESGKX

SEQ ID NO: 191453 - protein, 60 aa, Triticum aestivum
  Clone ID: PAT_TA_85871.pep
VNLPDAFLECHFNILNSRNQFMNHASAEEMMDRQAEALRKQCLGLGSIRCKGILKENLQE

SEQ ID NO: 191454 - protein, 79 aa, Triticum aestivum
  Clone ID: PAT_TA_85872.pep
YTCRQQRRCYTKSPYRSGFPKPRSGPRRTDHKINLLILIYHSRHAVQIYRNFKHSTGYLDGFQNDQTNVHTTHFNIGVT

SEQ ID NO: 191455 - protein, 132 aa, Triticum aestivum
  unsure (1)..(132): unsure at all Xaa locations
  Clone ID: PAT_TA_85873.pep
SACSAPIDVSXSVLXPXPXSVEHLRXXXAGSRMPVXGLPXLCAGPFVDVRFGHRXPXLISPPAAPPGVAPFPPPAEVPXQXELEHVAPPSSRRTARGSWADGRLRRLRRCPWSIRPCYIHTQLSLRVYALAG

SEQ ID NO: 191456 - protein, 129 aa, Triticum aestivum
  unsure (1)..(129): unsure at all Xaa locations
  Clone ID: PAT_TA_85874.pep
MARVALVAVFAVLAALAVAEMASGAVTCGDVTSAVAPCMSYARGQASAPSGACCSGVRTLNAKASTPADREXACNCLKEPGGVRASSMGNAANIPGKCGXSVSFPIKHQKPTATTFNKLSTNIIITQGY

SEQ ID NO: 191457 - protein, 68 aa, Triticum aestivum
  Clone ID: PAT_TA_85875.pep
LTSTLLISQYGIVTKRATIATSYTAKELSFPLPSKRNTHLLGSSSNSSDAKFSRTRPASVVSDRGRGG

SEQ ID NO: 191458 - protein, 170 aa, Triticum aestivum
  unsure (1)..(170): unsure at all Xaa locations
  Clone ID: PAT_TA_85876.pep
MRECISIHIGQAGIQVGNACWELYCLEHGIQPDGQMPGDKTVGGGDDAFNTFFSETGAGKHVPRAVFRRSPXPTVIDEVRTGAYRQXFHPEQLIXSGKEDAXKQLRPVGHYTIGKEMVDLCLDRIRNFQDNCTGLQGXLVXNAVGXXTGXGLXXXPXERLXVDNGKNQXX

SEQ ID NO: 191459 - protein, 171 aa, Triticum aestivum
  unsure (1)..(171): unsure at all Xaa locations
  Clone ID: PAT_TA_85877.pep
FSTSGRRHSQAVVVVRLLAILPYPSVHNTNSLQHPIRRNIHPSRPPSPRLQPSPYCCYSFLTADVPPPSTCWCSPSNLARCFFLLQRPLAALPPLFFTQTLLHALCLLLELNLHLPTAASLLSTLRCTYLKRCCSCCSLLXCCPLPHPCWLLLLSPKHGCSLNXWRNFSPC

SEQ ID NO: 191460 - protein, 196 aa, Triticum aestivum
  unsure (1)..(196): unsure at all Xaa locations
  Clone ID: PAT_TA_85878.pep
MALPLVRLLLSSLHACQPPLRHPEYSAPPRHSHVSFAVPAAARSSGNRLAFAVCAASASVAPAPAETQADAEDEQPVGPKTRLIAMNIPWDFTPDDIRVLFEKQGTVVDVELSMHSSKKNRGLAFVTMGSEDEALSALKNLNLXTLEXRTIKVDFAKPKKEATCCAVSSCGEKFVLSGKLTWRVRSVNLRELFPQP

SEQ ID NO: 191461 - protein, 65 aa, Triticum aestivum
  Clone ID: PAT_TA_85879.pep
SDSHATTMSSKLKHNQTALKYLKHTSYSSPRLLLSNYDGLIRFTCHDHTQQSHSMLLGPSYLKQF

SEQ ID NO: 191462 - protein, 88 aa, Triticum aestivum
  Clone ID: PAT_TA_85880.pep
LDLSEIMVSSGSRPSSRRPHIDQEDNAVFLQEHHRSKPSSKLTHTSRESNQAENNEREGHETIIRPRSELVEAACGIQAKGLLATTIR

SEQ ID NO: 191463 - protein, 99 aa, Triticum aestivum
  unsure (1)..(99): unsure at all Xaa locations
  Clone ID: PAT_TA_85881.pep
TRXAIHIVXSXNAGGGHCITHPRTSHXPSXHLFASVXXSSFLXGXEGSXQPXXXASMAXHXHXXPCSSPPRSPXGRXLRRHXRPXPRVXVXXASXLRRL

SEQ ID NO: 191464 - protein, 64 aa, Triticum aestivum
  unsure (1)..(64): unsure at all Xaa locations
  Clone ID: PAT_TA_85882.pep
LGLLECHPWRMXAWSXWXLSFXGPLAALXXVXSLGLPXKTXWLXGLXGCHXYMLLCSGXGRLRT

SEQ ID NO: 191465 - protein, 105 aa, Triticum aestivum
  Clone ID: PAT_TA_85883.pep
PRNSFGIGVSFFAVFIFLIGKCEAKLWNFSQVPGLHRPLLLVCGYGHMRGVLLIFLCEMFVSHFSGHSSVSYVYPQRVIECGNFYYTLSRPFTGLHKKKKKKKLD

SEQ ID NO: 191466 - protein, 119 aa, Triticum aestivum
  unsure (1)..(119): unsure at all Xaa locations
  Clone ID: PAT_TA_85884.pep
PSSAPLARSPSPPPWRPSPPPPPRRRSPPRPGAWTPSAPRSRRSAPPRRRPSGLAGRRPPPPRSXGAPSSPRXPPRPPSPXXPCPXRXRXXSPSSXPPRSPWNRTLLTDCLGLMVEGYW

SEQ ID NO: 191467 - protein, 184 aa, Triticum aestivum
  unsure (1)..(184): unsure at all Xaa locations
  Clone ID: PAT_TA_85885.pep
MQIFVKTLTGKTITLEVESSDTIDNVKAKIQDKEGIPPDQQRLIFAGKQLEDGRTLADYNIQKESTLHLXVLRLRGGMQIFVKTLTGKTITLEVESSXDTIDNVKAKIQGQGGIPPDQQRLIFAGKQLQGWPQPCXTTTSRRINLHWCSRLRGGHXIFVKTSTXKTXTLEVNPGHIDNSRXKSQ

SEQ ID NO: 191468 - protein, 150 aa, Triticum aestivum
  unsure (1)..(150): unsure at all Xaa locations
  Clone ID: PAT_TA_85886.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKXPXDDVLLGRXKTGFADGXDLICXXVAMGEEQR

SEQ ID NO: 191469 - protein, 152 aa, Triticum aestivum
  unsure (1)..(152): unsure at all Xaa locations
  Clone ID: PAT_TA_85887.pep
MARTKXTARKSTGGKAPWKQLATKAARKSAPATGGVKKPHRFRPGTVALREXRKYQXKSTELLIRKLPFQRLVREXXQDFXTDLRFQELRRLCPARAKPTSSASSRTQSAPSKPKRVTINAQGISPAAAGEPPLPRLSFKCFKFVPSFKCGV

SEQ ID NO: 191470 - protein, 190 aa, Triticum aestivum
  unsure (1)..(190): unsure at all Xaa locations
  Clone ID: PAT_TA_85888.pep
VGELGRLXRIVLCVXPRRRGSPTGSLTFLTRHAMTKTPPSSCCCSSXXPXXASPGFSHQLRRLGDLAPPSPGHAATAPVRQHRCRQDVAARHALQVPGSHARGHGSAHSTAAPVKQETADASSRRAFRGVRKRPRGSVAPERRQCSGILGRQPRRHHGGSGESERCGIGGSSGKVEGGSWIGGGVLFFRL

SEQ ID NO: 191471 - protein, 123 aa, Triticum aestivum
  unsure (1)..(123): unsure at all Xaa locations
  Clone ID: PAT_TA_85889.pep
MARLNSKAVAAAVVLAAVVLMMAGREASAALSCGQVDSKLAPCVAYVTGRASSISKECCSGVQGLNGLARSSPDRKIACRCLKSLATXSIKSINMGKVSGVPGKCGVSVPFPSACXNNCNNVN

SEQ ID NO: 191472 - protein, 55 aa, Triticum aestivum
  Clone ID: PAT_TA_85890.pep
AIVILGCTCNAFGFRLKLSHYIYSAYCNSPFLFLHDAHARGILSRNKEELKQEYL

SEQ ID NO: 191473 - protein, 71 aa, Triticum aestivum
  Clone ID: PAT_TA_85891.pep
FFFLDQSAVLAPIPFIWSTPMCSFGSWKWFPVSHTFTNVYRLIVGACRRQQRLGPHLSMDTMTALQRPARR

SEQ ID NO: 191474 - protein, 180 aa, Triticum aestivum
  unsure (1)..(180): unsure at all Xaa locations
  Clone ID: PAT_TA_85892.pep
TNGTNKSPSRSRLRSTPAPPPPVLPHRPKMQIFVKTLTGKTITLEVESSDTIDNVKAKIQDKEGIPPDQQRLIFAGKQLEDGRTLADYNIQXKESTLHLVLRLRGRHAVFVKTXTGKTITLXVESSDTIDNVXAKXQDKEGIPPGQXRLIFAGNNXKDGRTLXDYNIQKDQPQXVSGGEA

SEQ ID NO: 191475 - protein, 72 aa, Triticum aestivum
  unsure (1)..(72): unsure at all Xaa locations
  Clone ID: PAT_TA_85893.pep
SQRRXFFNXLDXLXXVDXGACPAKTPPGGEAVTSVGWMRREERKRERVEPDAGRAIAAADSRLAASLSLSSR

SEQ ID NO: 191476 - protein, 89 aa, Triticum aestivum
  unsure (1)..(89): unsure at all Xaa locations
  Clone ID: PAT_TA_85894.pep
NVPSPLLSPFNHPPTPTPYDRSKLPPTFLSPSPISISGQSLATYISKIRRHLSLKKXSXXEXXRRGVRXGIXXXTCMEMDVXVPVXXPI

SEQ ID NO: 191477 - protein, 149 aa, Triticum aestivum
  Clone ID: PAT_TA_85895.pep
PDPLSSRSLSLRCPRPEPHDHGRPPLKPRPPTARAPPSSPGAPSRPTTSPTSSTRPDPPGSRVHRRHRVVFFPSTPPLPRCRPATPTPPRPHRPCSATPRLLLDAPVDSTTSTTTFLPFIGSFQMVGPWEPDATARWDATTKTADSNEY

SEQ ID NO: 191478 - protein, 168 aa, Triticum aestivum
  unsure (1)..(168): unsure at all Xaa locations
  Clone ID: PAT_TA_85896.pep
MAAATMALSSPAMAGTPVKASRAAPFGEGRITMRKTAGKPKVAASSSPWYGSDRVLYLGPLSGDPPSYLTGEFPGDYGWDTAGLSADPETFAXNRELEVIHCRWAMLGALGCVFPEXLLARNGVKFGEAVWLKGGSXFXXGGLDYLXNPSWCKRKSILXIWACXXVLM

SEQ ID NO: 191479 - protein, 126 aa, Triticum aestivum
  unsure (1)..(126): unsure at all Xaa locations
  Clone ID: PAT_TA_85897.pep
LSLISLYSRSDPRLAGALXPXSPXTXSSDPPRAPCSRAPLLRARALXGWLAARPKLAXGSRRPGQPHLPGCCSAGARWXNPATRPATXXRXRSHPXXLXXLXHPHXAXPVSSRASXXPTXLXDXRP

SEQ ID NO: 191480 - protein, 132 aa, Triticum aestivum
  Clone ID: PAT_TA_85898.pep
RHGQSEPSRFPRCNPLIPAFSDRRHLSGRTSATPLRLLRPTRPWADDEQDLSCLGVSMEAEPSTGDGGKSSGWGSSSRGFEGGGIRRRWCGRFSAARPTSACGMWRRGVVEQRRERWRRGGCVRGGRKGNAC

SEQ ID NO: 191481 - protein, 52 aa, Triticum aestivum
  Clone ID: PAT_TA_85899.pep
RVLCMIKEFVFIVFDIAYHSCGVVRSFCVRVTNICVPMQCMGVCAPCLVCTQ

SEQ ID NO: 191482 - protein, 69 aa, Triticum aestivum
  unsure (1)..(69): unsure at all Xaa locations
  Clone ID: PAT_TA_85900.pep
NCYLPXLKNADKFSIGVRRCMHXXDXPGAGXVXDXAXLRSFSLSSQTLRXFFGVAGLLREXXXEGXRXL

SEQ ID NO: 191483 - protein, 193 aa, Triticum aestivum
  unsure (1)..(193): unsure at all Xaa locations
  Clone ID: PAT_TA_85901.pep
PEANEIEYGGDGTIVSDMFSLLSLCGSYLNKESKQNSNQKCKLSNPHALVVHCCLALATIAACLKSEGKSSASIILTSSHKKQRSRLSVLAHLSSADDTVKSCLQPHCAAATLALSTLISLENGGQTRSSLCETALALFPRMATLHTLLKLWLXDGSEELAXXCRVTESFGLXNGSIGXWXXXKWGGQXVSTT

SEQ ID NO: 191484 - protein, 161 aa, Triticum aestivum
  Clone ID: PAT_TA_85902.pep
PFSPPNLRVVANPNPPPTPAPPHQITRAGGTGTGSGAAAEAGDGDDARRGPVGRRRGGGGAGAAGSGGRKPAAGGAEAGGGPGREALLRTRASPRAPPPPPPRPRLGGSPTPTAPPGNPRSSRSSAAQAARKRPMNRCAAPAAPQRFVSQNSRATRICIQD

SEQ ID NO: 191485 - protein, 51 aa, Triticum aestivum
  Clone ID: PAT_TA_85903.pep
GYLQHTPHYLFQVLLLLTEKKNRRGGATISLYTRLLILRFSHMVRISTLSD

SEQ ID NO: 191486 - protein, 204 aa, Triticum aestivum
  unsure (1)..(204): unsure at all Xaa locations
  Clone ID: PAT_TA_85904.pep
LESPAGVGFSYSNTSMDLYTAGDAKTALDAYAFLVNWLERFPQYKYREFYIAGESYAGHYVPQLXAKLIFEKNNGTANPIINLQRIVVGNAVTDDYNDYLGTFXYWWXHGLISXDNTYHNXLKEXCXFDPSRHXSPESVKELNWLXPEEXTLTLIAVYKACNNSTSLKLGLGXXYXWXSXPMNPXTEXYSIYTQSAEFRVNATN

SEQ ID NO: 191487 - protein, 181 aa, Triticum aestivum
  unsure (1)..(181): unsure at all Xaa locations
  Clone ID: PAT_TA_85905.pep
MSTTATAYATSTADDDRRQALQAFDDTKAGVKGLVDAGVTAVPAIFHHPPDSLPLYAPPQLHHEHRFTIPVIDLADLGTPSGRASVVSAVRAAAETVGFFQVVNHGVPGGGMXEMLAAVRCFHEEPRTPRRRYYSPGHGRRVRYTSNFDLFNRRRQLARVYIDMTKTAGRDSPGLQSVRWA

SEQ ID NO: 191488 - protein, 119 aa, Triticum aestivum
  Clone ID: PAT_TA_85906.pep
KRLTSSTSGEETGGPCGTSCSPVAGKGHFVVYTTDGARFEVPLAFLGTTVFNELLRMSQEEFGFTGVDGGRITLPCDASMMEYAMCLLRRNASSRDGRPHSSNTMVMPCHYHAELHLRS

SEQ ID NO: 191489 - protein, 193 aa, Triticum aestivum
  unsure (1)..(193): unsure at all Xaa locations
  Clone ID: PAT_TA_85907.pep
REKDVPLDAGSFAFSQVGADLGAQILDYINSTKNPTAVILPTEDVKLFKPAPMVASFSARGPGGLTESILKPDLMAPGVSILAAAMPSTDKADVPDGNKASAFAIKSGTSMACPHVAGAAAFVKSGHXGWSPSMISXTLMTTAXTRXLGQPVAXNTGXVATGTHMGAGXIAAAGAQXGLVFDTPQRILNFAQG

SEQ ID NO: 191490 - protein, 75 aa, Triticum aestivum
  unsure (1)..(75): unsure at all Xaa locations
  Clone ID: PAT_TA_85908.pep
RVNPXVNLFVAEPSHLPPWRIPXRLAETGXGTPKNPLGELRLRSVCNATXTQGFACNNSTGCRVQIXATRXKKPG

SEQ ID NO: 191491 - protein, 176 aa, Triticum aestivum
  unsure (1)..(176): unsure at all Xaa locations
  Clone ID: PAT_TA_85909.pep
MANPRVFFDMTVGGAPAGRIVMELYKDAVPRTVENFRALCTGEKGVGKSGKPLHYKGSAFHRVIPDFMCQGGDFTRGNGTGGESIYGEXFADEXFVHKHTKPGILSMANAGPNTKRLQFFICNXPCXWLDGKHWSSASLXGMDVXKNIEKWAPNXTAQAGLIADCGSSPARRSPSL

SEQ ID NO: 191492 - protein, 132 aa, Triticum aestivum
  unsure (1)..(132): unsure at all Xaa locations
  Clone ID: PAT_TA_85910.pep
MAPKAEKKPVAEKAEKTTAAKKTKAEKRPPASKEGGEKKGKKKSKKSVETYKIYIFKVLKQVHPDIGISSKAMSIMNSFINDIFEXLAGRSAKLARYNKNPPSRPGXPDSVRLVLPGELAKHXVSEGTRCHN

SEQ ID NO: 191493 - protein, 177 aa, Triticum aestivum
  unsure (1)..(177): unsure at all Xaa locations
  Clone ID: PAT_TA_85911.pep
QPSSGGPLKRDVAXAAAGXXXAAAVPVRCSRCXSATAGTFGSAAGAXSSFTXSTMPVCLSHGLLGLLPRRRLAPLGSLGASASGSAAAAGSGSLVSSVSAAAGASSLVSSTSTGTSASTSASAGAGTSSVFVASSAATGVSTAGASSVSAAVGFWTSAVAIAVVDARKCPEWKRVAS

SEQ ID NO: 191494 - protein, 88 aa, Triticum aestivum
  unsure (1)..(88): unsure at all Xaa locations
  Clone ID: PAT_TA_85912.pep
MAAAAPPLCAWLVAAGAHADFGADEHRQTXCLDAGSXAKFGXRRPLGVRRRGXARSGNGVSVALXXEKGIVXKKKLMXTRXCRTGMGV

SEQ ID NO: 191495 - protein, 108 aa, Triticum aestivum
  unsure (1)..(108): unsure at all Xaa locations
  Clone ID: PAT_TA_85913.pep
QVSLXXDVSSCMCNQWMEVXXPFIRMGGAXVVEXXSCTSXTMSPGDIEXXXIXSXXFLCSXXRXICIETTYXTSKENTRNVMVRMIXSGRPQVYSQGXXPXXDKXXAL

SEQ ID NO: 191496 - protein, 105 aa, Triticum aestivum
  unsure (1)..(105): unsure at all Xaa locations
  Clone ID: PAT_TA_85914.pep
MISIGGSSSSSSSAAAAGVRMGGAXRXGKPGGAAAPGAAGPPXTXWRXGTQEXXYCRXLLDXLRXTRSGAAXPPXPRXAVKAXXXXALXLTXRXQSXWSXXILNG

SEQ ID NO: 191497 - protein, 110 aa, Triticum aestivum
  unsure (1)..(110): unsure at all Xaa locations
  Clone ID: PAT_TA_85915.pep
RENXVNTTXEXPXPPFRGERXAXHVRAPXXSTHXTXXGEARGCXATSLRPSGRHGRTDXSPRVXESSTAXEIKEARRXDAXXYAGDLLDXCXEXEREMRGAGGGGGGWIG

SEQ ID NO: 191498 - protein, 152 aa, Triticum aestivum
  unsure (1)..(152): unsure at all Xaa locations
  Clone ID: PAT_TA_85916.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYXLIDITDDGYVSLLTESGNTKDDLKLPLMMFWLGKXKXGFADXXDLILSXMSAWVEXXAC

SEQ ID NO: 191499 - protein, 171 aa, Triticum aestivum
  unsure (1)..(171): unsure at all Xaa locations
  Clone ID: PAT_TA_85917.pep
MSDTDEHHFESKADSGASKTYPQQAGAIRKGGHIVIKARPCKVVEVSTSKTGKHGHAKCHFVAIDIFNGKKLEDIVPSSHNXDVPHVDRQDYQLIDITDDGYVSLLTESGNTKDDLKLPTDDVLLGQXKXGFADGKDLILSVMSAMGEEQACENPWWQTTVCLREPMLWVF

SEQ ID NO: 191500 - protein, 164 aa, Triticum aestivum
  unsure (1)..(164): unsure at all Xaa locations
  Clone ID: PAT_TA_85918.pep
MQIFVKTLTGKTITLEVESSDTIDNVKAKIQDKEGIPPDQQRLIFAGKQLEDGRTLADYNIQXKESTLHLXVLRLRGGMQXIFVKTLTGKTITLXEVESSDTIDNVKAKIQDKEGIPPDQAASHFCWXSNSKDGRTLADYNIXKESTLHLVLXVRGGMQIFVKT

SEQ ID NO: 191501 - protein, 99 aa, Triticum aestivum
  unsure (1)..(99): unsure at all Xaa locations
  Clone ID: PAT_TA_85919.pep
FECDHSYDFIAMTRRSVRVERRAYVPDLAGVAGDGADGAHLDMAPTKSCAEAGGPAPXXAPTXAPVALXGSXAPRRQWDKAXRIXRGWSXQCSLXPGQX

SEQ ID NO: 191502 - protein, 132 aa, Triticum aestivum
  unsure (1)..(132): unsure at all Xaa locations
  Clone ID: PAT_TA_85920.pep
MQPPPPTGDXLXGVPPPPXPTSPPRPPPPRPSAATGPPSPPPSPRSPPRSPTPPSRPPRRCSPPSPPPSGPSSPSAAALPSXTSTPSRSXPRPXPRSPSSXPXGACSSXRXPPGAXVXAPDXLLPRXXCGSR

SEQ ID NO: 191503 - protein, 77 aa, Triticum aestivum
  unsure (1)..(77): unsure at all Xaa locations
  Clone ID: PAT_TA_85921.pep
HDIVVDDGSSRNMTSPQPMPQCHVISDNGFSFNVAGLCSLQIHNIASNWKHCMNSFQIHNFNGKKRGTKXTKLSIST

SEQ ID NO: 191504 - protein, 190 aa, Triticum aestivum
  unsure (1)..(190): unsure at all Xaa locations
  Clone ID: PAT_TA_85922.pep
MAATAVTLPTSAPSPFPVXAPSARRCLQLRRSPAPRRAVRVAASAAATEAPPKPPPATPSGIILVDPAEAQKVHRLKTVYDTXVIPVITXEFGYTNVHQXCPSLXXIVVNCXLGVDAGNNKGLEAAXXDLASITGQYPVXTXAKXSVANFKIRAGQHIGXXVKLXXKVXXNFLXRXINLGSLRTWACSTQ

SEQ ID NO: 191505 - protein, 114 aa, Triticum aestivum
  Clone ID: PAT_TA_85923.pep
RPRAHSLSLRSPSAHRHHHQVQPNPPTKPHPLLYQRFPPFPPLPSPPSILSRLFAGRPWQMPPSSPSSPSTTILSPAARPTTAPLPRSSSSPPTPPPTPATAFHSSLRPAVLLK

SEQ ID NO: 191506 - protein, 154 aa, Triticum aestivum
  unsure (1)..(154): unsure at all Xaa locations
  Clone ID: PAT_TA_85924.pep
QEHAMLPPTPYRTTYTNRTSYGLERMHHRASFVIVAKLEDSTDTPLELPLQRALPSHPXSXGCRTGKRQLGSPLXPKRKTPKLHMKKELGANLATQSTHSEHVLRPRLNHTERLXLSAXPTTRXXSMXHEXKXLNADXXXPHINXNXXXRPXFR

SEQ ID NO: 191507 - protein, 179 aa, Triticum aestivum
  Clone ID: PAT_TA_85925.pep
SSLSLSPLFSTSGRRRGQAGVAARHQHLPPPAAPHTPPAPPASPNTTIASSHQYPPPAPQLLLPLFPSTACCFSFNPFAAALSVLLLPPSSRCCSSFSNCCSSSPFPCFCFFFTPLPLFSSPPCCCSLHSLAATSLNQNVATPLPKLNYCCPSTSPRTTPTFNSANKLLRFPLSLSKFL

SEQ ID NO: 191508 - protein, 191 aa, Triticum aestivum
  unsure (1)..(191): unsure at all Xaa locations
  Clone ID: PAT_TA_85926.pep
PSSPSPSPSLPVVRLCLPVVRLRLHIWYVYLQDCAAQGFLVIILILYYSYCKPEVSPHHLQQRIPIARHQPVAEDPHSVGHNTNTQNRSSSIHNQWELLQSTKKKAKQRGKVTAALLGEEMLGPAEQRESRINYVLXCGVLXVGLAPXALLGGCSNGSPWXNMDVNILMLIARLTWKVLWNXRYTRWRTKE

SEQ ID NO: 191509 - protein, 59 aa, Triticum aestivum
  Clone ID: PAT_TA_85927.pep
VYFRRSKLEYTILKRFYGFLLQLEYTVDRSYKEKGSFCTLKRFPWLSRFGVNPPAVMTC

SEQ ID NO: 191510 - protein, 170 aa, Triticum aestivum
  unsure (1)..(170): unsure at all Xaa locations
  Clone ID: PAT_TA_85928.pep
CHTTCSSSSPPSSSCSAPRRPPRPPATSPSSWTGSSPRCRAPPPTPSSPPGNASTPLXPLARPPLGPRPRASRSAATPPPRGPTSPLAGDPPPPVLHPPPRPPALAGRLPPGVGVFPSSNPSTRRQSSRIRSSSTTALSSWTRRQRLSSASSGTLRTAPSSLMESSTEGF

SEQ ID NO: 191511 - protein, 65 aa, Triticum aestivum
  unsure (1)..(65): unsure at all Xaa locations
  Clone ID: PAT_TA_85929.pep
TEAHKCXNNVLMASPLSLPLPRWCMSTIASSRPFHAANEVLQLELAKWDVLLFVFSYLYSLITEI

SEQ ID NO: 191512 - protein, 54 aa, Triticum aestivum
  Clone ID: PAT_TA_85930.pep
ATHRTAATSTARGRRASSPRAASPGPSADRCRRRTRYIYRLRTVPSCMMPGTVK

SEQ ID NO: 191513 - protein, 74 aa, Triticum aestivum
  Clone ID: PAT_TA_85931.pep
RRLNEDIPDPARRWRILSEFWAEMMLYLAPSDNARAHLEALATGGEFITHLWALLTHAGVLQRDRGAGGPQAAV

SEQ ID NO: 191514 - protein, 194 aa, Triticum aestivum
  unsure (1)..(194): unsure at all Xaa locations
  Clone ID: PAT_TA_85932.pep
SCPSLPGPGSSSSLAGQPPPVDPASPSPEPSPRAFPLGLQIQRPRSPSPSHTAGLALSPQSTCAPRPPSPQPVTGPVPRRPTRHGPSSPPAPPGPTPSPFATAXPLGPDPSPSRTAGLGAVAPSPLSQPVAGPVPRSPAPPMAVLTTAQRAGPVSFATALGPAVGQQSWPTGLPTTRDRWNSGGRLTSGSKFLN

SEQ ID NO: 191515 - protein, 134 aa, Triticum aestivum
  Clone ID: PAT_TA_85933.pep
LPSLATTHSQGGCLAAAATAGAAPAASAATAAAGARCSPTWRPPPARPPWSCPPPPTRGAPAGSRWPAGRPAAATAPRASAAPRAAAPAAAATEPAPRRPAGRGEHEDEEENKHHHHHHHHQRITLPPHRSRAR

SEQ ID NO: 191516 - protein, 107 aa, Triticum aestivum
  Clone ID: PAT_TA_85934.pep
QTVHPPPPRRFPIAEGQQNRSLYPCGRELAPVALYEEKRSSRRRDPIQRKRRRRLVQARPQLHAGAWSLPRALQARGLFLSCPILTSPIGKDLRDFTKPPLESLQST

SEQ ID NO: 191517 - protein, 165 aa, Triticum aestivum
  unsure (1)..(165): unsure at all Xaa locations
  Clone ID: PAT_TA_85935.pep
QPTGRDVXEHKAXIXAAEPXNPCVRRCRTXNGLAXYRPGDHCRTTLTXRELRHRXXNSRXXWTQMGLEGPIYGPRGAAGYAXNSTSPRNQRRCRCTEEPPXQAGPPPAELHXXXQEXLRHPXCSRGKAGPXEHXXDXGRGEXGEGGWRRGGGLGFTRRPWGMRSE

SEQ ID NO: 191518 - protein, 138 aa, Triticum aestivum
  unsure (1)..(138): unsure at all Xaa locations
  Clone ID: PAT_TA_85936.pep
MQIFVKTLTGKTITLEVESSDTIDNVKAKIQDKEGIPPDQQRLIFAGKQLEDGRTLADYNIQKESTLHLXVLRLRGGAKKRKKKTYTKPKKQKHKHKKXVAVLQFYKVDDATGKVTRLKKECPTLRAGTSWQHFDAQG

SEQ ID NO: 191519 - protein, 120 aa, Triticum aestivum
  unsure (1)..(120): unsure at all Xaa locations
  Clone ID: PAT_TA_85937.pep
MASTFSGDETAPFFGFLGAAAALVFSCMGAAYGTAKXAGLGVASMGVMRPELVMKSIVPVVMAGVLGIYGXIIAVIIXTGINPKASLLLXDGXGLSSXLACXSAGSPPAWDRIVXDAXVR

SEQ ID NO: 191520 - protein, 202 aa, Triticum aestivum
  unsure (1)..(202): unsure at all Xaa locations
  Clone ID: PAT_TA_85938.pep
SAGLVSVXLARKXLQVAXAGTRVXIVSTEILSSQXYXXTERAMLXPNCLFRMGAAVMILSNSPSEARFRLRRVVRTVTAXRDAXYRCVFXEEDXKGNTXGSASPXDLATTAGYXLXXSIXVSXXLXLPXTXXXLVTLSLLKRSSSGAPKGVRRTPHCVAICIRAGVEYHEKTARLSRQLRLPDSRKLRVLNPLVRVSSANRI

SEQ ID NO: 191521 - protein, 126 aa, Triticum aestivum
  unsure (1)..(126): unsure at all Xaa locations
  Clone ID: PAT_TA_85939.pep
EXGXHXLLXPFXLAPXXENRRRXFLSXXSRSXVCRKGHXSCLDRSVSRSHSTRYSSPVTRAKVPPIDDGSSSAGGPLWCVRVHGDCEHRSARARVVEVHLSIRRTCTPHVQRGAEIRRCMREAVGD

SEQ ID NO: 191522 - protein, 95 aa, Triticum aestivum
  unsure (1)..(95): unsure at all Xaa locations
  Clone ID: PAT_TA_85940.pep
MQXDIHPLVCDNGXGMXXLVXXGXDXPSAVFPXIVXRXRYTGVMXVXIGXKDAYXVXDXXQSXRGIMXXNXHXAXNRXNWGXMXRLDXTXXNELR

SEQ ID NO: 191523 - protein, 191 aa, Triticum aestivum
  unsure (1)..(191): unsure at all Xaa locations
  Clone ID: PAT_TA_85941.pep
HPTSSSPAGRASERTAAISEASFGMARQALTNGFLGGFMYVGLALVLLAYLPVAFLCRLVYRLLIRPFAAGEDLRGKVVLITGASSGHRRAPGVRVREEKARAWRWWXGRRXRCAPWAKTAREAGRAGHAGGAXDITTXTRQXGVXETSPLRXLITGGNRRWSXCFSGDTSVXLQXLRXNSGXGTDXFXAY

SEQ ID NO: 191524 - protein, 131 aa, Triticum aestivum
  unsure (1)..(131): unsure at all Xaa locations
  Clone ID: PAT_TA_85942.pep
MADQLTDEQIAEFKEAFSLFDKDGDGCITTKELGTVMRSLGQNPTEAELQDMINEVDADGNGTIDFPDSLNLMAKKXMKDTAPEEGVKEAFRVFDKDKTVISAAELRHVMTTSGRTDGEWTNIGSDVDARQ

SEQ ID NO: 191525 - protein, 101 aa, Triticum aestivum
  unsure (1)..(101): unsure at all Xaa locations
  Clone ID: PAT_TA_85943.pep
NGXSQGQXAVAVPXMIXNDXXAIHSSMLNLPVTMIVHVYVFSITLVIYHPKLXGVLFSTWMTPDIQVFFVDVKDSSYWKLNMYVIYYSLNCRYISTIKYYV

SEQ ID NO: 191526 - protein, 83 aa, Triticum aestivum
  unsure (1)..(83): unsure at all Xaa locations
  Clone ID: PAT_TA_85944.pep
STYAEHCELRNIVLGNRLDHSTXTHSTAQHVTTSVHXXTSXFQQXPFQSNKXPCNYXYXIXDXDSNATPIXATTFNXXKLEXS

SEQ ID NO: 191527 - protein, 140 aa, Triticum aestivum
  Clone ID: PAT_TA_85945.pep
STSTPPASALIPPSPLSNHTPPANSARPSGAPVRRPPIPEQQHAVPSSREAVRPPPRPAPARPSVRRHAQRPSAHPSATSPAPREAPPLASSSSPAGHAHSRSPVAPPIPSTPRAPPLCLSSAARAAGRFTGRAPASPSS

SEQ ID NO: 191528 - protein, 69 aa, Triticum aestivum
  Clone ID: PAT_TA_85946.pep
RRYFPQIGIESQQDSPHRHIIEAKNSWELALRHPSNPSIFSIYLSLRQCFCSVLVLRIFVIAVPFKKKK

SEQ ID NO: 191529 - protein, 154 aa, Triticum aestivum
  unsure (1)..(154): unsure at all Xaa locations
  Clone ID: PAT_TA_85947.pep
RPGDRPLTLSGYRCKSPVNSICLSRXSRRXAAXVDVEAASSXSAAPALHTLTXPTASXGSSAAAAGASSAAAGASSATAGTSGSAAGAASSFTSSTTAGSASATASLVSVSTTAGSLGASASVSAAAAGSASLASSVSAAAGASSLVASTSTGA

SEQ ID NO: 191530 - protein, 184 aa, Triticum aestivum
  unsure (1)..(184): unsure at all Xaa locations
  Clone ID: PAT_TA_85948.pep
VEPEILVDGPHDIDRCAYVTEIVLAACYKALNDQHVLLEGTLLKPNMVTPGSDSKKVAPEVIAEYTVRTLQRTVPAAVPAIVFLSGGQAEKKATXNLNAMNNSRPRTLGTVLSFXRASSKTPQGWSGKTENKRKARRVLVXCKAIRTSGLQGKHLAKAPPKAHRTQYDYLRLRWLRYIQCIVVL

SEQ ID NO: 191531 - protein, 42 aa, Triticum aestivum
  unsure (1)..(42): unsure at all Xaa locations
  Clone ID: PAT_TA_85949.pep
FGMCEXRHAXFPLVLTTLIXXTLXTAYIERYLCIEITYSVXN

SEQ ID NO: 191532 - protein, 100 aa, Triticum aestivum
  unsure (1)..(100): unsure at all Xaa locations
  Clone ID: PAT_TA_85950.pep
PPKKXPKITDGGTAAERTHTSVPGTGCSSGSDSAAHPAAATQTGLVYGGTGRKEEAGKGARIPLTAKQISCAGAVPRVSPVATLLLWTDGDGDGDADGDG

SEQ ID NO: 191533 - protein, 203 aa, Triticum aestivum
  unsure (1)..(203): unsure at all Xaa locations
  Clone ID: PAT_TA_85951.pep
MARAAVSTAPLSRLHSPTPSVPCHSLSSQLRIHQQRRPLTVASALPEVADLPGLSLPAVAAAAAALAAAVSLSDPERRRKAQAEAVGGGDKEAVRAYFNSTGSSGWRRIYDPGTDDVNRVQLDIREGHRKRXGGTLAMLRDPRRALAXAXCATRVGXGPVIRWLAGARAARNRMSRGHGVCAGPVRCLVRKRATGVCPRKASP

SEQ ID NO: 191534 - protein, 233 aa, Triticum aestivum
  unsure (1)..(233): unsure at all Xaa locations
  Clone ID: PAT_TA_85952.pep
XSXFPSXRXPXKXLXXLLKVXILWXFWPXPKTVKFXSPRAHXAKRXPREXSLVXYSXGPRGEACAHPCGAELASSRRRRRRVGAKEALQLSSRRXTPPLRTPLPARRARRXRASSAPAGTSRSLLQLAPLARWRPAALLLPXGALLAVPLLLLSCSAAALGATSPRGASGERHGEKPAPASRTRATPTWLVSNLDAGRRHLLLCVPVREKEEGRGEGASWVGGGAWRVAARAG

SEQ ID NO: 191535 - protein, 81 aa, Triticum aestivum
  unsure (1)..(81): unsure at all Xaa locations
  Clone ID: PAT_TA_85953.pep
VIWDGHSGSIGWTATQAMSVGGEEXGDASNAPSXXPXPGLGRRXPRASXXFPWQKFPDFNQSXXLHXQTPQQIKXVHHILM

SEQ ID NO: 191536 - protein, 152 aa, Triticum aestivum
  unsure (1)..(152): unsure at all Xaa locations
  Clone ID: PAT_TA_85954.pep
AASSTSPAAEPRRHGRSHLRGHCPPRRLRLRREHRLLRLRRLLGRIGARDPLPRANRVVPFPESPSPERRPHPPLRLASPSLAARXPASYDXGSQGAKRLLSNDDYYYSGRCLLLRAAVSDDKESFXRIPGXXVCASFDLYHCCATFLRQTG

SEQ ID NO: 191537 - protein, 78 aa, Triticum aestivum
  unsure (1)..(78): unsure at all Xaa locations
  Clone ID: PAT_TA_85955.pep
DPXXXKXXLHXXNEDHSXTLLXNCYXXLPXHGKXVVXVECIXXVXPGATPKAHGVFHVXXIMXSQXPGGRXRYXXEFE

SEQ ID NO: 191538 - protein, 117 aa, Triticum aestivum
  unsure (1)..(117): unsure at all Xaa locations
  Clone ID: PAT_TA_85956.pep
QTPTPLALPLSCGIAVFLSPPPPPPPPPRPPSSSVHPQLXCCQILXLHPTPPFGSLDSSPAPAKNLGDEMMRXARCSSSSAFSPSPGTXGAERGAAGVWAXGVRXDXAVEVDLXAVR

SEQ ID NO: 191539 - protein, 66 aa, Triticum aestivum
  unsure (1)..(66): unsure at all Xaa locations
  Clone ID: PAT_TA_85957.pep
HIYIIXGSXCYICDXNQMLKKWXIYPRXPKXNTTXTKREREXKNXSKVXTTSXQKTLRXANSNKRI

SEQ ID NO: 191540 - protein, 107 aa, Triticum aestivum
  unsure (1)..(107): unsure at all Xaa locations
  Clone ID: PAT_TA_85958.pep
AGELSSEEMDRLMAVVHNPRQFKVPDWFLNRKKDYKDGRFSQVVSNAVDMKLRDDLERLKKIRNHRGLRHYWGVRVRGXQHTKTTGRRGKTVGCLQRSDKLLHNDPP

SEQ ID NO: 191541 - protein, 85 aa, Triticum aestivum
  Clone ID: PAT_TA_85959.pep
PPPSEARTLIEDLEETFASLGKVDLRLNPEKCVFRVPSGKLLGFLVSHRGVEANPEKVKAIGDMTPPQTLKEMQKLAGCVTSLGH

SEQ ID NO: 191542 - protein, 162 aa, Triticum aestivum
  unsure (1)..(162): unsure at all Xaa locations
  Clone ID: PAT_TA_85960.pep
TFLLKLTIPSTLPSEWNKFYICANICLCPLILLYSFSSFIPLDSRIVFLLPQIRFPLWSVVLLVSFCLALSHFRFEKESPXTXNIASTLISFVMSVFXISTXAGELLNCWQQLXVLWSPSTILGMTVXXWGNSVGDLXVMWNGKNLNRIAAVCPRSTCLITA

SEQ ID NO: 191543 - protein, 58 aa, Triticum aestivum
  unsure (1)..(58): unsure at all Xaa locations
  Clone ID: PAT_TA_85961.pep
AAPXXXVELRXVXGRGGAXRRRVRPRXXXDXXAQDGGRRRGAGXGXXHGFGGARACGW

SEQ ID NO: 191544 - protein, 130 aa, Triticum aestivum
  unsure (1)..(130): unsure at all Xaa locations
  Clone ID: PAT_TA_85962.pep
VHRRVLPSHGQKNHYDXPPGPTCXKRVAIARXEKSWTDASEFKPERFEVEKXYGGTDFRFLPGGAGRRMCPGMMFGVSXNMEIALASLLYHFDWRLPDGASPEKLDMTEAYGITARRKTNLLLEATVFVP

SEQ ID NO: 191545 - protein, 120 aa, Triticum aestivum
  unsure (1)..(120): unsure at all Xaa locations
  Clone ID: PAT_TA_85963.pep
MSDTDEHHFESKADSGASKTYPQQAGAIRKXXHIVIKARPCKVVEVSTSKXLGKHGHAKCHFXAIDIFNXKKLXDIVPSSXNCDVPHVXXXDYQLXDIXDDXYVSLLTESGNTXDDLKFH

SEQ ID NO: 191546 - protein, 170 aa, Triticum aestivum
  unsure (1)..(170): unsure at all Xaa locations
  Clone ID: PAT_TA_85964.pep
MAWSFHFVPLLLLLLLLPSTSAVATSGHSTGNATASLRPGREPLKHRRIRALLGRLNKPPLKTIKSPDGDLIDCVPSHLQPAFDHPMLKGQKXLDPPERPRXYNSTIAGAVVVQAWMHRRGVPEGTVALXRTTEKVLLRAVLRRYXRNRXPDNRRDSQEWHRGMSGIYGS

SEQ ID NO: 191547 - protein, 112 aa, Triticum aestivum
  unsure (1)..(112): unsure at all Xaa locations
  Clone ID: PAT_TA_85965.pep
FTHSSPIWVLQVHPLTXHAXKGAXVGXVXXHAXPAFLGALSVAGPXRTXXGPAPXKRCXQCXRTGRXCAKSPFPQVXXVLATXLXVKNAGPAXIRGCRGKXERRGVQXXGXA

SEQ ID NO: 191548 - protein, 79 aa, Triticum aestivum
  unsure (1)..(79): unsure at all Xaa locations
  Clone ID: PAT_TA_85966.pep
SLPRPLQCRRPWXSPSPSPSPPPPRPSPRATASPRPVASPAPPAPSPRATPRASTEARRPRPAPDATRRSGEDSSVQDG

SEQ ID NO: 191549 - protein, 104 aa, Triticum aestivum
  unsure (1)..(104): unsure at all Xaa locations
  Clone ID: PAT_TA_85967.pep
DGRTLADYNIQKESTLHLVLRLRGGAKKRKKKTYTKPKKQKHKHKKVKLAVLQFYKVDDATGKVTRLRKECPNADCGAGTFMANHFDRHYCGKCGXTYVYNQEA

SEQ ID NO: 191550 - protein, 112 aa, Triticum aestivum
  unsure (1)..(112): unsure at all Xaa locations
  Clone ID: PAT_TA_85968.pep
DVYRDEVYAARLGGAAGAFDRCATDTFKIGGPCGYGVCYLYLRRAGRTGWTPEWVRVYGSPPPXSAPSTFRYGDPLPNNVWXYGFNRCPRLASSTSTSSSSPSSGAGAAQAM

SEQ ID NO: 191551 - protein, 172 aa, Triticum aestivum
  unsure (1)..(172): unsure at all Xaa locations
  Clone ID: PAT_TA_85969.pep
AXQIXNSPYVAEXLEXLSEGNDYSXRKIASQRKPSXDTLPLIRAGGPGLSANERAAPVAGGFSASXLLARARRXEDCPAXVAVPGSSAVSRXVQHTGFAQGTRDAPVQSIHPSWGGRARAXPLLRRTAVXEAXXLAARVTPARGLGHGEDRGGPGSAMVATERRGRLGFDQI

SEQ ID NO: 191552 - protein, 152 aa, Triticum aestivum
  unsure (1)..(152): unsure at all Xaa locations
  Clone ID: PAT_TA_85970.pep
EWEEDKHFLQVSAAPVLGRYADEDYKNAKVHRGFLSVYTSSDNNSMYNKTSAREQVLEEVGRLMEEYKDEVTSITVTGHSLGASLATXTAIDLVGQRLNVPLTRSNRXCPVTTILLACPEXGTQVQVAFDHSTPAASTWNAKDSCTEPPLCC

SEQ ID NO: 191553 - protein, 48 aa, Triticum aestivum
  unsure (1)..(48): unsure at all Xaa locations
  Clone ID: PAT_TA_85971.pep
RFLLTXTPEPKXQELPXXSTTFSXXFSILSLPSSSPSPSASVXRXLTV

SEQ ID NO: 191554 - protein, 100 aa, Triticum aestivum
  unsure (1)..(100): unsure at all Xaa locations
  Clone ID: PAT_TA_85972.pep
PMSDAAVDXEAPKRAQEXQLGVRGPFFFGDYPTTMRKRVGEXLPRFTTEESALVKGTLDFVGINHYTTYYTKQNDTNIIALLLNNTLADTGTISLRESAI

SEQ ID NO: 191555 - protein, 89 aa, Triticum aestivum
  unsure (1)..(89): unsure at all Xaa locations
  Clone ID: PAT_TA_85973.pep
LLKKGGTXLNKFVHXAVVARXHIHGDGELEPWAQXXGDGGRRXGGRPDRKDXTLHLDQTRPEHPSITAKASKRAQAGICFRPSPFPKPP

SEQ ID NO: 191556 - protein, 160 aa, Triticum aestivum
  unsure (1)..(160): unsure at all Xaa locations
  Clone ID: PAT_TA_85974.pep
SLFIXKLXXKKXIPKLXXFSPXCNQVAXAXICEPNXGDXTQTXPPXENCRPXESPLQXAGLPEVHGAARIAPRAHPPRSLRRRXGXRQPLRGGRVRVGRALRVSVGGAACGEQRRKGDASLGGVRGFRLFFCPKGRSGGDGRDGREARGRADFLRRGLDF

SEQ ID NO: 191557 - protein, 102 aa, Triticum aestivum
  Clone ID: PAT_TA_85975.pep
RYPPTSWATWKSWAGLLRGCLVQTMASRVPGVDAGPPTEAVGRGRRIRRLMVSGADAGVRRLMLLLTAGFGLQPARLASSGCAPAHPLGVASEPPSEEGGSP

SEQ ID NO: 191558 - protein, 114 aa, Triticum aestivum
  unsure (1)..(114): unsure at all Xaa locations
  Clone ID: PAT_TA_85976.pep
SGVHSPVGXGGXXGAGLVLAMVLAAMLVAPPATVHAISCSTVYSTLMPCLQYVQQGGSPXRGCCTGIQNLLGRGQQXPDRRTXWGCXXXVPKGAPGGPKXPGRXAPXXVNVXSP

SEQ ID NO: 191559 - protein, 84 aa, Triticum aestivum
  unsure (1)..(84): unsure at all Xaa locations
  Clone ID: PAT_TA_85977.pep
GIILWRTHVKINPKHHCGSGALAQVTVHVPIRKNILVKLNQAKSKRHLKIVSPQELFARLMVIASLVFASLGIAXQVGSDGLLA

SEQ ID NO: 191560 - protein, 155 aa, Triticum aestivum
  unsure (1)..(155): unsure at all Xaa locations
  Clone ID: PAT_TA_85978.pep
KXXVGKDHDYRVSXTDXCRRVIDGGQQTEVVVTXTRQXEHGPXITAGQRVIXSNLTPVQAXLSSTGASGXDGDAELLVXLEXXHVLRRERELXXMPPLXXRHGTTXXLXDXFAXPLXVAIXFPXXCPXRXXRSXXAXHHXXXDXXRRDXFHXXNX

SEQ ID NO: 191561 - protein, 94 aa, Triticum aestivum
  unsure (1)..(94): unsure at all Xaa locations
  Clone ID: PAT_TA_85979.pep
LPVHTFSPPGAASSLGFPPAVRRHGSPQRRRKVFPPCSTCCSSEKPNKRQPVKLLQLXIPRIAXXXSRVELGXHCSRDGFGXWXCHXAKGLLXL

SEQ ID NO: 191562 - protein, 161 aa, Triticum aestivum
  unsure (1)..(161): unsure at all Xaa locations
  Clone ID: PAT_TA_85980.pep
MARTKQTARKSTGGKAPRKQLATKAARKSAPATGGVKKPHRFRPGTVALREIRKYQKSTELLIRKLPFQXLVREIAQDFKTDLRFKSSAVSALQEAGXGYLVGLFEDTNSVPSSQATSCQGIKSTRIRGEGLSLALMREIAASVCNEELVKGKERNGPTRA

SEQ ID NO: 191563 - protein, 75 aa, Triticum aestivum
  Clone ID: PAT_TA_85981.pep
TRKRGSPWVADNLNAAHLDYYYAFLTLLAAANCVVFAVLAHRYKYRAESTDTIDVDMDVQAQREAAKKIHSEPMA

SEQ ID NO: 191564 - protein, 89 aa, Triticum aestivum
  unsure (1)..(89): unsure at all Xaa locations
  Clone ID: PAT_TA_85982.pep
MSDLDXQVXTAFDXFAEANAEDSGAGVXSKNYVHVRVQQRNGRKSLXTVXGLKTDYSYXKILXDLKXXSAVMXTVVQXSXLXXSVQRQV

SEQ ID NO: 191565 - protein, 154 aa, Triticum aestivum
  unsure (1)..(154): unsure at all Xaa locations
  Clone ID: PAT_TA_85983.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFXKVGFVFREHNXSPGYYDXRYWTMWKLPMFGXTDATQVLXQVEKSKKXYLILFRVIFTSQVHA

SEQ ID NO: 191566 - protein, 52 aa, Triticum aestivum
  unsure (1)..(52): unsure at all Xaa locations
  Clone ID: PAT_TA_85984.pep
KCTKYCPIISVMLKLSEVEGLYKDPTLLAKGQLKEHLTKTIGXFXHFSNPWX

SEQ ID NO: 191567 - protein, 116 aa, Triticum aestivum
  unsure (1)..(116): unsure at all Xaa locations
  Clone ID: PAT_TA_85985.pep
MSGRGKGGKGLGKGGAKRHRKVLRDNIQGITKPAIRRLARRGGVKRISGLIYEETRGVLKIFLEXNVIRDAVTYTEHARRKTVTAMDVVYALXKRQGRTLYGSGGSSSQPTAVPKF

SEQ ID NO: 191568 - protein, 161 aa, Triticum aestivum
  unsure (1)..(161): unsure at all Xaa locations
  Clone ID: PAT_TA_85986.pep
EVIHCRWAMLGALGCVFPELLARNGVKFGEAVWFKAGSQIFSEGGLDYLGNPSLVHAQSILAIWACQVVLMGAVEGYRVAGGPLGEXVDPLYPGGSFDPLXLADDPXAFAELKVKEXKNGRLAMFSMFGSSXRHRHXKGPQELATTLDPXXNAGLRNFGRK

SEQ ID NO: 191569 - protein, 114 aa, Triticum aestivum
  unsure (1)..(114): unsure at all Xaa locations
  Clone ID: PAT_TA_85987.pep
PELAEALALPCAAALTRREGFQKVQFISDCLSIIXKVNSPTMDRSTIGLVADTKSLAESFWSIVXVNVNHLSNVAAHIVAPSREFSSEFILHHVTLDCIREHSALFILINKARI

SEQ ID NO: 191570 - protein, 177 aa, Triticum aestivum
  unsure (1)..(177): unsure at all Xaa locations
  Clone ID: PAT_TA_85988.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVXLLTESGNTXDXLKLPXDDVLXXQXKTGFLMXGXSVVMSHGEEFRNPCGIRVPGNSWILVGILKFCESQGFRGR

SEQ ID NO: 191571 - protein, 175 aa, Triticum aestivum
  unsure (1)..(175): unsure at all Xaa locations
  Clone ID: PAT_TA_85989.pep
RGGHPPSPAGPGRIRASPGPPLDHSANPSAPFPSLAHSPLRFSRARDTTATTSSIPRPSTSPRRAKASRSCATFPCFNYEHRPELGGRVHSPSTSSSXTXAASRIGFVVSXQPLTSKSXRDHDDEVKEQMSHRQLLLHKGATTTGXRRQPRVVRXSRQEAYFRSVLLCAASKANL

SEQ ID NO: 191572 - protein, 129 aa, Triticum aestivum
  unsure (1)..(129): unsure at all Xaa locations
  Clone ID: PAT_TA_85990.pep
LGFVAASPPAISATATRRRRRSRRGSRARFPRPVGTSAPIKRGPPLPARAPRGRGALLXARPAPPIMAACTSQQALISVKPRCASASFGPDRRAGSVRFVSATSCCPGSRKLGLVCASNSQSSVIEPVS

SEQ ID NO: 191573 - protein, 131 aa, Triticum aestivum
  unsure (1)..(131): unsure at all Xaa locations
  Clone ID: PAT_TA_85991.pep
MARTKQTARKSTGGKAPRKQLATKAARKSAPATGGVKKPHRFRPGTVALREIRKYQKSTELLIRKLPFQRLVREIAQDFKXDLRFKSSAVXALXEAAEAYLVGLFEDTTSGHQRQSASHHPKESSRRRSQG

SEQ ID NO: 191574 - protein, 120 aa, Triticum aestivum
  unsure (1)..(120): unsure at all Xaa locations
  Clone ID: PAT_TA_85992.pep
NIEYEASDMFDLHNVIVSIPLPALRDAPSVKQIDGEWRYDSRNSVLEWSVMLIDQSNRSGSMEFSVPAADPSTFFPISVGFSASNTFSNVKVTAILPLQGGSSKYSQQVRLXVTVNYQVV

SEQ ID NO: 191575 - protein, 67 aa, Triticum aestivum
  unsure (1)..(67): unsure at all Xaa locations
  Clone ID: PAT_TA_85993.pep
LLSPSRLPVSPILXTPLTAEPXRADRRWSRAXRAGSAPASPPXSSPXSSAAPASXSPPTTTXMRRRP

SEQ ID NO: 191576 - protein, 139 aa, Triticum aestivum
  unsure (1)..(139): unsure at all Xaa locations
  Clone ID: PAT_TA_85994.pep
DAPSARHQASSLCPVVXSSSRXSSLKRXPGLPSXSSRTTTPXPTPLLXSMTTVFDDASLLXEQHXFGAXEXSYRRRRLLLXXRCHYTCPLPRQEXLRGXRQXXAXLHXXQFGXPLXKLLIXXSXMCXLXISXXXSTXGR

SEQ ID NO: 191577 - protein, 89 aa, Triticum aestivum
  Clone ID: PAT_TA_85995.pep
RHLQSSDTLDEDTSWVSISSVNSMTSVVSSEDDAAWLFHRTHGMNVNDVLIAVIFERHHKADRLQIYQAASSGLGSVSASSSIAWLRLL

SEQ ID NO: 191578 - protein, 166 aa, Triticum aestivum
  unsure (1)..(166): unsure at all Xaa locations
  Clone ID: PAT_TA_85996.pep
MQIFVKTLTGKTITLEVESSDTIDNVKAKIQDKEGIPPDQQRLIFAGKQLEDGRTLADYNIQXKESXLHLVLRLRGGMQIFXVKTLTGQDINPGVXSSDTNXNVKGKIKDKEGIPPXDQXRLILLXKQLEDGRTXADYNIQXXSTSTALPGGSIFGRPHTLPGSLP

SEQ ID NO: 191579 - protein, 69 aa, Triticum aestivum
  unsure (1)..(69): unsure at all Xaa locations
  Clone ID: PAT_TA_85997.pep
XXMXSRQRTAXEEDXEWDEIEDLXEHEEKKGXXSXSXSXPKEEXRKXLSXXEXXEDLXXDIEDVDNTID

SEQ ID NO: 191580 - protein, 80 aa, Triticum aestivum
  unsure (1)..(80): unsure at all Xaa locations
  Clone ID: PAT_TA_85998.pep
GGRPPLTLCDGALGQIQGPLMEGLVEASPTRMLSGNSWTSTXAXYGPGWNAXRETCPIXVPPHGRXXXVSAXKVXMXXPK

SEQ ID NO: 191581 - protein, 57 aa, Triticum aestivum
  unsure (1)..(57): unsure at all Xaa locations
  Clone ID: PAT_TA_85999.pep
RRXLGXKRXXXGNCTGPPCPLXWQFQXYSVYXMVLRPKXRXXDLIKLMLPFLSKGLR

SEQ ID NO: 191582 - protein, 136 aa, Triticum aestivum
  unsure (1)..(136): unsure at all Xaa locations
  Clone ID: PAT_TA_86000.pep
IPPHLSSPLASRCRARATPAFGTPSPTGASRLAVCRGFPPRPGVVVHSVGSRADLPRRCVPLIHGPALSSLSSSTPSSSSHRSLSSQSTSQNTFAKYKHVSKAVLDLAKTFPRNALFLNATXLXSLLNPXTLLKLM

SEQ ID NO: 191583 - protein, 54 aa, Triticum aestivum
  unsure (1)..(54): unsure at all Xaa locations
  Clone ID: PAT_TA_86001.pep
GKPLHLLIRRSQKEPKFTCPFRFDELGXCXQFXXRLXWGXKSFLRXMXXKFPRQ

SEQ ID NO: 191584 - protein, 92 aa, Triticum aestivum
  Clone ID: PAT_TA_86002.pep
MVKEQSRARVDFSLPPFSTLRSRGKRMNVSMGIDINAFRGATENFMDSSGHLRVQQDYLSSGSACEKTEHFVLLRTPLNKNMTKDNVFLGRS

SEQ ID NO: 191585 - protein, 98 aa, Triticum aestivum
  unsure (1)..(98): unsure at all Xaa locations
  Clone ID: PAT_TA_86003.pep
LEVXYSYLIIRCSLENEICAVLSGCRAIRRFVVLFYHCRNVLLTGDSGVXIGSSLGEGISFVDRETYHGLSRDTXAGFKLSKAVPAVMGRWEFVNVRL

SEQ ID NO: 191586 - protein, 132 aa, Triticum aestivum
  unsure (1)..(132): unsure at all Xaa locations
  Clone ID: PAT_TA_86004.pep
DQNIKDMFMSKYFHTIIVGSTSTTAQLYRECIHPKIAQLAVLGYSDNYANVYTSXELRSKWLAYFXMDGGFKIXPSVXTIQEGCTLNAXKVMKQYPRDDXXHRALXLLPTWDNDSYVKDMGXNPRRKMVFSL

SEQ ID NO: 191587 - protein, 92 aa, Triticum aestivum
  unsure (1)..(92): unsure at all Xaa locations
  Clone ID: PAT_TA_86005.pep
VLCLLQGWTNRQREGLQSVVRSTRLFFHVIHMNLISFWIYLSSRFSLLPSLCLCFCLNLNWACIPNDCCFIIXXGGKTFYKKRGGXVXILPX

SEQ ID NO: 191588 - protein, 78 aa, Triticum aestivum
  unsure (1)..(78): unsure at all Xaa locations
  Clone ID: PAT_TA_86006.pep
HLXAXHPXXVPXAXPSRRTXTXRXRXXXSPQVTAPDAISATASAASTANTATSATRAIEDLVLRFACWKPWSWEGAES

SEQ ID NO: 191589 - protein, 98 aa, Triticum aestivum
  unsure (1)..(98): unsure at all Xaa locations
  Clone ID: PAT_TA_86007.pep
MMDXXXEEXXMSESTXXSTLEDVDXEXLQSSXWNXXXPLLLTPLLGRRRPLLGLGLSWLPSSXSAFSATGFFSALGAMDAAATSPGRAVGLWGAVVFR

SEQ ID NO: 191590 - protein, 138 aa, Triticum aestivum
  unsure (1)..(138): unsure at all Xaa locations
  Clone ID: PAT_TA_86008.pep
MARTKQTARKSTGGKAPRKQLATKAARKSAPATGGVKKPHRFRPGTVALREIRKYQKSTELLIRKXPFQRLVREIAQDFKTDLRFQESAVSALXEAAEAYWVGSSRNKLCAIXXKRVTIMPKDIQXARRIRGEPLRVV

SEQ ID NO: 191591 - protein, 63 aa, Triticum aestivum
  unsure (1)..(63): unsure at all Xaa locations
  Clone ID: PAT_TA_86009.pep
TCXXXCIDEGXXSGXDAGRDDGNGAGLGVRQRRNMAAGQRPAGSPARAPWPEAKVAVKGMGMG

SEQ ID NO: 191592 - protein, 153 aa, Triticum aestivum
  unsure (1)..(153): unsure at all Xaa locations
  Clone ID: PAT_TA_86010.pep
LTTTLSHSRHPIPSHPPTPPSLAAHHHHSTTPLPSGGTPTTPIHGGARHTATKSHPRTAHLIPPPSPMPDPRRPLVALPTRSLPHASTPPRELERXEDLTLGWGXXQHVCSGXNPLCLPPRTXVARXIPAXQHREXPCIPVXXLLLSXSPPSI

SEQ ID NO: 191593 - protein, 53 aa, Triticum aestivum
  unsure (1)..(53): unsure at all Xaa locations
  Clone ID: PAT_TA_86011.pep
XXSXHAARXLXXPLDIESTHLXHPYLYKSXYMXDLXIPDXFSXRSPFNXXXGE

SEQ ID NO: 191594 - protein, 119 aa, Triticum aestivum
  unsure (1)..(119): unsure at all Xaa locations
  Clone ID: PAT_TA_86012.pep
KKFETLSYLPPLSTEALLKQVDYLIRSKWVPCLDFSKVGFVFREHNSSPGYYDGRYWTMWKLPMFGCTXSTQVLNEVEEVKKEYPDAYVRVIXFDNMRXVQCVSFXAFRHKLGKAKVQF

SEQ ID NO: 191595 - protein, 51 aa, Triticum aestivum
  unsure (1)..(51): unsure at all Xaa locations
  Clone ID: PAT_TA_86013.pep
XSSYEEVVITRDSWHADGGVEFLGDEASGDFPGVEGDDRGRGKVRIGGGRC

SEQ ID NO: 191596 - protein, 109 aa, Triticum aestivum
  unsure (1)..(109): unsure at all Xaa locations
  Clone ID: PAT_TA_86014.pep
APVLSSSLPPEAAASLLSARIAMAAAADSKIDNLRDAVAKLGEISENEKAGFISLVSRYLSGEXEQXIEXXARSKTPTXXDGXPYDXLTXXPXDXXAMXXXLDKLXXLK

SEQ ID NO: 191597 - protein, 66 aa, Triticum aestivum
  Clone ID: PAT_TA_86015.pep
PYCFAATSTSIISWPLLYVQPSPADTILAQHDQITDSESEKEIFASNTIHGMEGGREGVSRATAGA

SEQ ID NO: 191598 - protein, 149 aa, Triticum aestivum
  unsure (1)..(149): unsure at all Xaa locations
  Clone ID: PAT_TA_86016.pep
MQIFVKTLTGKTITLEVESSDTIDNVKAKIQDKEGIPPDQQRLIFAGKQLEDGRTLADYNIQKESTLHLVLRLRXGGMQIFVKTLTGKTITWXFESSDTIDNVKARSRTRRDSPDQXASHFWLGKQSXDXXXLADYXSXRIQIHLGSSW

SEQ ID NO: 191599 - protein, 178 aa, Triticum aestivum
  Clone ID: PAT_TA_86017.pep
VLERILLAQVTMKPRDDDIILATQPKSGTTWLKAVAFAITNRGRYGFGDHPLLTQHPQHLVPSIELHGPGRDHTDLNALASPRLLSTHIPMSLLPPEMTPSSGRRVVYLCRDPRTLRVSGGLRQQDLPRRHGARQSYDLSAGGLALRASGRNIWRETDPEPFEYKSGNLWSGTPGLAP

SEQ ID NO: 191600 - protein, 137 aa, Triticum aestivum
  unsure (1)..(137): unsure at all Xaa locations
  Clone ID: PAT_TA_86018.pep
XKDTHSFCDPIIISETRVITHGYGGPPGTVHRTQTGISTCVDLLYLVARGWNGGRSPEKEVHPSLVQPWNRSRLALNSFLRSWLMAPTGSKLFRTRRRRAAGSLLVPGDEAGGVARRRGDRRRETASEESGSGPAAA

SEQ ID NO: 191601 - protein, 75 aa, Triticum aestivum
  Clone ID: PAT_TA_86019.pep
YEDMIRQPFLVLSIPHGVLSQVDLLVKLVPQTTSLKTRVYMKKISFFVIYLLLGNTVLCSITSWSRTLVTGCQGS

SEQ ID NO: 191602 - protein, 119 aa, Triticum aestivum
  unsure (1)..(119): unsure at all Xaa locations
  Clone ID: PAT_TA_86020.pep
MANPRVFFDMTVGGAPAGRIVMELYKDAVPRTVENXRALCTGEKGVGKSGKPLHYKGSAFHRVXIPDFMCQGGDFTKXGNGTGRRSIYGEXXEREFLHKHTSRXLSMATPGQHKGPILI

SEQ ID NO: 191603 - protein, 82 aa, Triticum aestivum
  unsure (1)..(82): unsure at all Xaa locations
  Clone ID: PAT_TA_86021.pep
SILPPKGIVIRDGHSCATKSRVXKFVVEGHRESLSKSSPHLRAGPVXIXGHSAQMXYXNVLWLTLVDMSSPFPSPCKSXHFV

SEQ ID NO: 191604 - protein, 107 aa, Triticum aestivum
  unsure (1)..(107): unsure at all Xaa locations
  Clone ID: PAT_TA_86022.pep
LPSLATTHSQGGCLAAAATAGAAPAASAATAAAGARCSPTWRPPPARPPWSCPPPPTRGAPAGSRWPAGRPAAATAPRASAAPRAAAPAAAATGARRPRKPAGRGXT

SEQ ID NO: 191605 - protein, 127 aa, Triticum aestivum
  unsure (1)..(127): unsure at all Xaa locations
  Clone ID: PAT_TA_86023.pep
MSCCGGNCGCGAGCKCGNGCGGCKMFPDVEATAGAAAMVMPTASHKGSSGGFEMAGGETGGCDCTTCKCGPRAAAPAAAAXEPAPXRPAXXRRXEMRQASIITSQQPTFKYNTAAARANKINVVLPV

SEQ ID NO: 191606 - protein, 61 aa, Triticum aestivum
  unsure (1)..(61): unsure at all Xaa locations
  Clone ID: PAT_TA_86024.pep
NSAPFLQLTRQDQTPPPPSSPPFKSLPRHTAAKPVHDDRAMACVNMYNPDGGAVAFGXGQP

SEQ ID NO: 191607 - protein, 45 aa, Triticum aestivum
  unsure (1)..(45): unsure at all Xaa locations
  Clone ID: PAT_TA_86025.pep
MLSVAMSTRPVVSRRPHLPARAANSTPSSSPATETRXARPGAEVX

SEQ ID NO: 191608 - protein, 86 aa, Triticum aestivum
  unsure (1)..(86): unsure at all Xaa locations
  Clone ID: PAT_TA_86026.pep
RWRSQVMKSGLVSSKPRGLSGASLTRRPRFVVKAVKSDKGTYQXVXPINGDPFIXSLEXPXTSXPLVXWXLSNLPAYRGRVPPLNL

SEQ ID NO: 191609 - protein, 52 aa, Triticum aestivum
  unsure (1)..(52): unsure at all Xaa locations
  Clone ID: PAT_TA_86027.pep
LXEXLXLXMSLXXWLXSXSDLAXCRREEATARXQKSAALELESICPDNPPXS

SEQ ID NO: 191610 - protein, 49 aa, Triticum aestivum
  unsure (1)..(49): unsure at all Xaa locations
  Clone ID: PAT_TA_86028.pep
NIXSXXTSDQREKPDXRTGXFXSPSVHXHRXLPMXQLAHLPXEMTXFSS

SEQ ID NO: 191611 - protein, 102 aa, Triticum aestivum
  unsure (1)..(102): unsure at all Xaa locations
  Clone ID: PAT_TA_86029.pep
MARTKQTARKSTGGKAPREAAGHQGRPQSPPRPPAXVKKPHRFRPGTFALREIRKYQXRSTELLIRKLPFQRLVREXIAQDFKXDLRFQSSSSPPCKEAPGY

SEQ ID NO: 191612 - protein, 77 aa, Triticum aestivum
  unsure (1)..(77): unsure at all Xaa locations
  Clone ID: PAT_TA_86030.pep
MGGXNAQKSKMTXGMXLEKXNGGKGSQLEANKKAMNIQXKICMXTFICTTSEAKCKEHAEAKHPXSELVQXFPHLKQ

SEQ ID NO: 191613 - protein, 40 aa, Triticum aestivum
  unsure (1)..(40): unsure at all Xaa locations
  Clone ID: PAT_TA_86031.pep
WCLQLTEKXINCLXRLDHNRGXGQISERXGVQVSDVKEWL

SEQ ID NO: 191614 - protein, 80 aa, Triticum aestivum
  unsure (1)..(80): unsure at all Xaa locations
  Clone ID: PAT_TA_86032.pep
SWLSCSAPPPAPPPPPPAPPRPSSPQPSAAAAASSRPALRXRXAPSLPAPXVEPPXRSAPRXPSPSPTAFDPFVLDIGAL

SEQ ID NO: 191615 - protein, 89 aa, Triticum aestivum
  unsure (1)..(89): unsure at all Xaa locations
  Clone ID: PAT_TA_86033.pep
RPXRPALXPXAAPIGTXRRDRSRTWRHPCLGRTDGRTXPRLAGGGRRAPVLGVVGLALALSPRPRPKQVGGGDGDGGGEWTGRDEKEEE

SEQ ID NO: 191616 - protein, 112 aa, Triticum aestivum
  unsure (1)..(112): unsure at all Xaa locations
  Clone ID: PAT_TA_86034.pep
SLLDXAREXXHAPXAPXPXQGXXRXRAAATGGXXPXGEGAVVXLXVXGRRAGAGEGGGGGELGGGVPCLLHRHGRTIWRDLRGVVVCAVYFWKGSKMSPVLGKNIDGGGSAS

SEQ ID NO: 191617 - protein, 32 aa, Triticum aestivum
  unsure (1)..(32): unsure at all Xaa locations
  Clone ID: PAT_TA_86035.pep
LSVXLKKSCYLLDMFVRLYNYICIMKLLVSVE

SEQ ID NO: 191618 - protein, 114 aa, Triticum aestivum
  unsure (1)..(114): unsure at all Xaa locations
  Clone ID: PAT_TA_86036.pep
LXXRRLVLKMVSFAYXQXPXSTLVVSFKXTMVPXPXVHACGKIXXVKVSHKSFVGKLVVGPLQEVTLKGHXTIVQVLANLEFQLLRNRGHDEIRRXXXPIQDPNAHRLNKSLYI

SEQ ID NO: 191619 - protein, 93 aa, Triticum aestivum
  unsure (1)..(93): unsure at all Xaa locations
  Clone ID: PAT_TA_86037.pep
TXWXXTARXXLXAIAXLPAGKEXFGAIXXAHXQRLXRVXPRRPSPXTAXPRCRCRRXIAXWPWLPSRRKSRKREHEHRXRGGGGLGGEERRGA

SEQ ID NO: 191620 - protein, 98 aa, Triticum aestivum
  unsure (1)..(98): unsure at all Xaa locations
  Clone ID: PAT_TA_86038.pep
FLAAAAPYPLEANPTMADVDVDTEVAAGAQXKXEDVPQSSAIAXWISIXLLDMSTXDLVQXFPXXARXXVQXLSQRGXPWCSSRXCXRRXKTLLXVXX

SEQ ID NO: 191621 - protein, 61 aa, Triticum aestivum
  unsure (1)..(61): unsure at all Xaa locations
  Clone ID: PAT_TA_86039.pep
MSRTGPIAQDWEPVVVRKKLPNAAAKKDEKAVNAARRAXXRHXTSXRSXSAXDKQKFPHST

SEQ ID NO: 191622 - protein, 78 aa, Triticum aestivum
  unsure (1)..(78): unsure at all Xaa locations
  Clone ID: PAT_TA_86040.pep
XKSGXKHFFLDARTQSLIADMXSCKLEGEDIEXRWRGGSXPAXXNIXXDVXVFEHGQAVVRAVPXRAXTXXSWXGWSQ

SEQ ID NO: 191623 - protein, 74 aa, Triticum aestivum
  unsure (1)..(74): unsure at all Xaa locations
  Clone ID: PAT_TA_86041.pep
XXRIHXRLFQNFARMHEELNNNFTTYRLLARHQSCRKFSXDPLIGPSCTRNTAASTDPSXXXLNGXQTLCWNXX

SEQ ID NO: 191624 - protein, 116 aa, Triticum aestivum
  unsure (1)..(116): unsure at all Xaa locations
  Clone ID: PAT_TA_86042.pep
QRLIFAGKQLEDGRTLADYNIQKESTLHLVLRLRGGMQIFVKTLTGKTITLEXXKSSDTIDNVKAKIQDKEGXIPPDQQRLIFAGKQXRXXRTLXRLQHPERESTLHLGAPLXXGQ

SEQ ID NO: 191625 - protein, 65 aa, Triticum aestivum
  unsure (1)..(65): unsure at all Xaa locations
  Clone ID: PAT_TA_86043.pep
VPXSDPXXXTRSRGDSAGARLGLEAVRPTGQRLLRPPVAGGGRRRDGSGSHEAVAAAVGGGVERV

SEQ ID NO: 191626 - protein, 159 aa, Triticum aestivum
  unsure (1)..(159): unsure at all Xaa locations
  Clone ID: PAT_TA_86044.pep
ASLVGYPYLPQNYYVPPPAFQQAYSSNGPFHQSDGGAAAVPGSAMKYSMPQYKSSLPVTSPPQHSSAVSGXGGFGSSSNIPNLGQNQSASPATTMXXEXXALSSQFKXGQSLHXALXQSDNSRXWXLHGAAGSXAGSAVPLXNFYGFQGQSVPGVQQPL

SEQ ID NO: 191627 - protein, 64 aa, Triticum aestivum
  unsure (1)..(64): unsure at all Xaa locations
  Clone ID: PAT_TA_86045.pep
RVKPXHPASCLQYEARTQIYRRAAGRGDTQVRSPTQTITIVAECFRRRHLCYMKFSSRPVDANS

SEQ ID NO: 191628 - protein, 84 aa, Triticum aestivum
  unsure (1)..(84): unsure at all Xaa locations
  Clone ID: PAT_TA_86046.pep
XAATPARLSLPPPMAVTLKPLAHPRAGISLXXPXRDLTDXXXSXRNPSGXPPMHHQXPSQVXNXXSQDEVRXXXRHGRAXSSXP

SEQ ID NO: 191629 - protein, 64 aa, Triticum aestivum
  unsure (1)..(64): unsure at all Xaa locations
  Clone ID: PAT_TA_86047.pep
RAHLAVXMPLLAPAAKTLFPSRLPXSXRLHLRRATATAAXGRXDGXXXVXXGVRDXXQXXGGWS

SEQ ID NO: 191630 - protein, 60 aa, Triticum aestivum
  unsure (1)..(60): unsure at all Xaa locations
  Clone ID: PAT_TA_86048.pep
KELFLYFIVRHLSLRWXGLXWSTXXSVXNXXEXXTYHHMXFPLNPWGKEXXLANHGXXKK

SEQ ID NO: 191631 - protein, 52 aa, Triticum aestivum
  unsure (1)..(52): unsure at all Xaa locations
  Clone ID: PAT_TA_86049.pep
IYLCLSAFSLXTILGGLRFYFLLSSPNIMLPSFRLGAIADHLXXXGRXSTSR

SEQ ID NO: 191632 - protein, 95 aa, Triticum aestivum
  Clone ID: PAT_TA_86050.pep
EQQLKRRAARGRIRKKEQQQVGGWGRRAAAVGIQRGRTQQVEATATRGVGDVVVTVGREEGRQHGVQRRAAAGGAGKVRSSNEIGERRRLGAAGD

SEQ ID NO: 191633 - protein, 39 aa, Triticum aestivum
  unsure (1)..(39): unsure at all Xaa locations
  Clone ID: PAT_TA_86051.pep
FFKEAHTNQELXLCXIXLLCTVTLLXQXLXXNGWTYXTX

SEQ ID NO: 191634 - protein, 73 aa, Triticum aestivum
  unsure (1)..(73): unsure at all Xaa locations
  Clone ID: PAT_TA_86052.pep
ALQISMNAPVMVXLEGXTDXLEIXMKXLKXXRFPXXIRRXLPXGSYKDWXFDELIVEXSWKRQVGGGLKLVTV

SEQ ID NO: 191635 - protein, 91 aa, Triticum aestivum
  unsure (1)..(91): unsure at all Xaa locations
  Clone ID: PAT_TA_86053.pep
MSDTDEHHFESKADSGASKTYPQQXAGAIRKXGTHPSSKARPCKVVXEVSTSKDWGKHGHAKVSLLVAIDIFNGKXXEDIXPSTHNCDSPC

SEQ ID NO: 191636 - protein, 107 aa, Triticum aestivum
  unsure (1)..(107): unsure at all Xaa locations
  Clone ID: PAT_TA_86054.pep
APPRSSSSPPARPPGPSSPPPXPPPPPPPSSQTGGXPXSPXSXTSAGTPXSQXIRPPPPXPTXHXPRATHGSPPFXPXVYMLGSRRTPPRWTHFIAIKLTASREAHF

SEQ ID NO: 191637 - protein, 169 aa, Triticum aestivum
  unsure (1)..(169): unsure at all Xaa locations
  Clone ID: PAT_TA_86055.pep
EDITLEVESSDTIDNVKXKIQDKEGIPPDQQRLIFAGKQLEDGRTLAXDYXIQKESTLHLVLRLRXWXAVFVKTLTGXTITWRLKSPDTIRQCQGKIQDKXGIXPPDKQRLIFAGKQWXMSTSXGYNIQKXSTSNWDPSXXGSXMPXFXXXLPGLRGGPVIFRTGWFFP

SEQ ID NO: 191638 - protein, 55 aa, Triticum aestivum
  unsure (1)..(55): unsure at all Xaa locations
  Clone ID: PAT_TA_86056.pep
IXLDFQPLATPXHLVISSKFKLMIELDDGVPWMEHMPTMFRQTKWSGEIGSFGRD

SEQ ID NO: 191639 - protein, 76 aa, Triticum aestivum
  unsure (1)..(76): unsure at all Xaa locations
  Clone ID: PAT_TA_86057.pep
XSRQPKDXSCKIKSTHXPSXKTDGTICPRLPALMTLQQLEAMIKSIPTLISCIYYFDKDCIFFRVIEIRASETQFD

SEQ ID NO: 191640 - protein, 123 aa, Triticum aestivum
  unsure (1)..(123): unsure at all Xaa locations
  Clone ID: PAT_TA_86058.pep
MQQPAXPKEKRSYTVACIISIRTICDGYILLGCVEWSVGMKGECFVTSVHCIRTSKMYVCVHLEQRTYLEGGVYAIVTFFRFCYCEDSSIIVLRCETAQFQENYHCFCMKSVCVFKTKDSGLL

SEQ ID NO: 191641 - protein, 108 aa, Triticum aestivum
  unsure (1)..(108): unsure at all Xaa locations
  Clone ID: PAT_TA_86059.pep
MSRGGSAGGGQSSLGYLFGDGXPAKPAAAPAAXQAPAEKPALAAXDVXKQIQVEXQGSRXEKXTNRARLARTTGNFPYGPVPSTKXVXACXGRVGSXLGXLLAGXCSL

SEQ ID NO: 191642 - protein, 153 aa, Triticum aestivum
  unsure (1)..(153): unsure at all Xaa locations
  Clone ID: PAT_TA_86060.pep
FLVLXLDXPFTXPISHLNPSWILGIQDYSXXXPSAAFENSLKTLRFRLFRCLYPSNGLHIGSRCPIAARPXRGGPASEHAAAFEVAIPEAISGSPRRTGRIPAASWSGGGGGGSPEVERAGRGDMRRWGRSLEVGRRAGEVEERRCWLLAPAA

SEQ ID NO: 191643 - protein, 109 aa, Triticum aestivum
  unsure (1)..(109): unsure at all Xaa locations
  Clone ID: PAT_TA_86061.pep
MARLNSKAVAAAVVLAAVVLMMAGREXASAALSCGQVXDSKLXPCVXAYYGKXXSSFKKGXLAPACKGLNRLARSSRTAXIACXCLKNLANKHQSPSTXGKVSXXPXKC

SEQ ID NO: 191644 - protein, 60 aa, Triticum aestivum
  unsure (1)..(60): unsure at all Xaa locations
  Clone ID: PAT_TA_86062.pep
MRECISIHIGQAGIQVGNACWELYCLEHXIXPDGQXNGDITIXXGDXXXNTFFSKXGXGN

SEQ ID NO: 191645 - protein, 78 aa, Triticum aestivum
  unsure (1)..(78): unsure at all Xaa locations
  Clone ID: PAT_TA_86063.pep
XPLXPTSQAXXXKXLXHPRXASLXXXPREISXSYRQQXXPLGPSSQHHXEXSXVAXGRSQDXVRRRXXHXRRARRLRG

SEQ ID NO: 191646 - protein, 76 aa, Triticum aestivum
  Clone ID: PAT_TA_86064.pep
KTQSSYIRWFLSYTGAQVRACLLTCISSYKQSLQNRILFSQAALQYTPTLLLSAIPNINLYIGYINSFILTAALNY

SEQ ID NO: 191647 - protein, 102 aa, Triticum aestivum
  unsure (1)..(102): unsure at all Xaa locations
  Clone ID: PAT_TA_86065.pep
DLRSEAEFDKAEKAREKLVLVLQDTCLNYRAIDLRTPANQAIFCIQCHVXRNKFKGIFVLPENFIGIQHSPXLIXGPVEXXCTCIHLEYNGTCLVSTSPHYT

SEQ ID NO: 191648 - protein, 93 aa, Triticum aestivum
  unsure (1)..(93): unsure at all Xaa locations
  Clone ID: PAT_TA_86066.pep
HRGFNLLYPLSLVDSSVVLFPAVFLLLXLPLPNPMAAAASSSASPVLLPSRAAWRELEGLSSQRRXRWQGVHQRWQQQXXMLLQGCRWRXRGS

SEQ ID NO: 191649 - protein, 71 aa, Triticum aestivum
  Clone ID: PAT_TA_86067.pep
IVIWIQVRISNSNRGDMATLVEGYCSLNIQALQFSSTTRNLVPKFMRGKWERCGYEILTCLLGLAFSSRRS

SEQ ID NO: 191650 - protein, 56 aa, Triticum aestivum
  Clone ID: PAT_TA_86068.pep
RARESATKMAMRCALTSLPARLRSPAVVASGTRRLLSDGKGARAQRRRSAPRRTST

SEQ ID NO: 191651 - protein, 94 aa, Triticum aestivum
  unsure (1)..(94): unsure at all Xaa locations
  Clone ID: PAT_TA_86069.pep
LCHRKCARVQLVENGRRSLPLCPIDGCLDXIEEXGXSXDAGFGRXGHAVGDIPGVRFQVVXKVSGVSLLALFKEKKEKPQVLGCIFVRQGWNGL

SEQ ID NO: 191652 - protein, 113 aa, Triticum aestivum
  unsure (1)..(113): unsure at all Xaa locations
  Clone ID: PAT_TA_86070.pep
XXXDRYXSSPXSPXHMILDGXICRVLVTQSFDHSQRKGGTFPGPSYIKQVVPTEFDGGHSKKRSAIQQADKAQRIFTEGKSNTVYVLIMYTMDEESVGDGANVTIVGSKANER

SEQ ID NO: 191653 - protein, 86 aa, Triticum aestivum
  unsure (1)..(86): unsure at all Xaa locations
  Clone ID: PAT_TA_86071.pep
MSCCGGNCGCGAGCKCGNGCGGCKMFPDXXKATXRRRSAMVMPTASHKGXSSXGXRRWPAGXDRXAXDCTNVQXXGPRXXAPGXXE

SEQ ID NO: 191654 - protein, 68 aa, Triticum aestivum
  unsure (1)..(68): unsure at all Xaa locations
  Clone ID: PAT_TA_86072.pep
MSSSEVACTLAALILHDDGIPITSEKIATVVKGCRXIXLKAYWPALFAKLLEKEGRXNDLILSAGSVR

SEQ ID NO: 191655 - protein, 88 aa, Triticum aestivum
  unsure (1)..(88): unsure at all Xaa locations
  Clone ID: PAT_TA_86073.pep
KFPYRANRXLIXKKEKEKLRQRLXXLIGWPSQHFKWRKYVCSKPQTPXLSLHNILXXILIXAXXGPFQVXEXXXXXQVRHXXISXEXQ

SEQ ID NO: 191656 - protein, 69 aa, Triticum aestivum
  unsure (1)..(69): unsure at all Xaa locations
  Clone ID: PAT_TA_86074.pep
LGLADDPDTAAELKVKELKNGRLAMFSMFGFFVQGIVNGKGPXXKXXXDHVADPVNNNAWGLPPTSAPS

SEQ ID NO: 191657 - protein, 138 aa, Triticum aestivum
  unsure (1)..(138): unsure at all Xaa locations
  Clone ID: PAT_TA_86075.pep
MSRGGSAGGGQSSLGYLFGDGEPAKPAAAPAAKAXAPAEKPAPAAADVAAKIPAXGIPGXRANNYYRADWPRTRATSLTDRPFNKGSCCPXXXSXSLGYLFGGKVMLMMGAWLMKRTMNWPPRYQVKMKCLGTLGVTC

SEQ ID NO: 191658 - protein, 138 aa, Triticum aestivum
  unsure (1)..(138): unsure at all Xaa locations
  Clone ID: PAT_TA_86076.pep
MAPAVMASSATTVAPFQGLKSTAGLPVSRRSSGSLGRVSNGGRIRCMQVWPIEGIKKFETLSYLPPLSTEALLKQVXDYLIRSKXXVPCLESEGWFVFREXNSXSRIYDXRYWTWXKLPMFGXNXARXVSQGXXEVKK

SEQ ID NO: 191659 - protein, 108 aa, Triticum aestivum
  unsure (1)..(108): unsure at all Xaa locations
  Clone ID: PAT_TA_86077.pep
MARTKQTARKSTGGKAPRKQLATKAARKSAPATGGVKKPHRFRPGXTVALREIRKXYRKRRELLIRKSPSKRLVREGRSRTSKTDLRLQSSXAVSXLQEAARXYSXXL

SEQ ID NO: 191660 - protein, 95 aa, Triticum aestivum
  Clone ID: PAT_TA_86078.pep
PKSEEDKKGKSAPVAQGEEFSLLKRQLEALNDESIMLRHTVEGLRAEIGVNRAISVPSKGDARRMPALSPPLQTTFPVKPDLHGNGKGWRPVWTE

SEQ ID NO: 191661 - protein, 130 aa, Triticum aestivum
  unsure (1)..(130): unsure at all Xaa locations
  Clone ID: PAT_TA_86079.pep
CPPIMRMNSENTHSKLSSCSSRINTPATIDTLVVIVNSNKIDRMACRPDLYCMXVVECDNVXQXNCTASCWSHXXNXILHLLSSXXKNTXGIQGHPRXSGKLXGFXIXQLSXYLQXXLRPLXRTLTXXXP

SEQ ID NO: 191662 - protein, 82 aa, Triticum aestivum
  unsure (1)..(82): unsure at all Xaa locations
  Clone ID: PAT_TA_86080.pep
MGHSNVWNSHPKNYGPGSRVCRVCGNSXHGLXIRKYGLMCCRQCFPQATPRTFGTTRLRMGTSKRKQRTKEITNELWCFHRG

SEQ ID NO: 191663 - protein, 161 aa, Triticum aestivum
  unsure (1)..(161): unsure at all Xaa locations
  Clone ID: PAT_TA_86081.pep
EAHAAPNCKVLVVANPANTNALILKEFAPSIPEKNISCLTRLXDHNXRALRXRFPERLGCPNFLTVXKNAIIWGNTPPIQLPWMFNHATGENFPSGEDLSVTCSKMDEWLNGXFIATVQQRGAASTKARXLPCLPXCXSTWDYIRDXXLGTAXGICSQGVC

SEQ ID NO: 191664 - protein, 140 aa, Triticum aestivum
  unsure (1)..(140): unsure at all Xaa locations
  Clone ID: PAT_TA_86082.pep
LLKCCSWFGVDGERXGDPHLPGGCWRRYPXXMPGPRQVFGGQLHAAFRVGPGVXPWRSGVLNPAASTPPEGAGRLPPRRRTCTGATADVTSPQVTAPDAISATASAASTANTATSATRAIEDLVLRFACWKPWSWEGAES

SEQ ID NO: 191665 - protein, 96 aa, Triticum aestivum
  unsure (1)..(96): unsure at all Xaa locations
  Clone ID: PAT_TA_86083.pep
LIPSLASPVXSVSPPPRTLAPSLSPSHTXAXAQLNLXXGAXAXVHLFGXKGVVGGDGEARRXRTGSASTLPSSGASAXPXGRXLQGSXVRXDMDLS

SEQ ID NO: 191666 - protein, 171 aa, Triticum aestivum
  unsure (1)..(171): unsure at all Xaa locations
  Clone ID: PAT_TA_86084.pep
QWRWEGRYGSRFWSLRSWCPSTAKAAMADAQTSTAGGSPPGHERAVRQQVRTFPTVCTTPPAGRAAMAVVSSPSPPRSCDXXPLQPAVPHRSXKGRXTQAVLHFFNAWEPAGTAPFXXRXTXAXGXFNXLLKLPPXKXGGXIXXXGWTIXGXLQVSXIKIXXRELXSXTKK

SEQ ID NO: 191667 - protein, 101 aa, Triticum aestivum
  unsure (1)..(101): unsure at all Xaa locations
  Clone ID: PAT_TA_86085.pep
EACQLXVHVXSVXEXVTPMAXVWDXGEXXXLKXWKASSWGMVPLLXGAMCACTWHFXXNSESLEIXVAIQGAXTVIGNITMCIAAYRMSKGSQESTNSDSP

SEQ ID NO: 191668 - protein, 126 aa, Triticum aestivum
  unsure (1)..(126): unsure at all Xaa locations
  Clone ID: PAT_TA_86086.pep
FXXTCXXFEAXXGXXFVSXNPXXIKXCFGXXXLSLAXFCPXTFFPEXVLXGDAGRXWGWNLCLLPEEAQGGXXGRGRVRGRXGXREVXPRXPDTKAXKEWVAPASAGEASMAHFALLCWSLGFVVS

SEQ ID NO: 191669 - protein, 81 aa, Triticum aestivum
  unsure (1)..(81): unsure at all Xaa locations
  Clone ID: PAT_TA_86087.pep
XPNFPXPSXPXFXNPTSPDLPXXXFSXLHSRIFARTSSNMXRSSYAVXXGKXRCQRXXLLXCEVELXRLHXLXKXHGXFPT

SEQ ID NO: 191670 - protein, 60 aa, Triticum aestivum
  unsure (1)..(60): unsure at all Xaa locations
  Clone ID: PAT_TA_86088.pep
LTAYSXSXTAANFAAVSXRXHXRSRFCVAXXCKXXASQAVGXVREXRVDGLGEKRSRGLR

SEQ ID NO: 191671 - protein, 95 aa, Triticum aestivum
  unsure (1)..(95): unsure at all Xaa locations
  Clone ID: PAT_TA_86089.pep
HRRVSQSKKGWQPFAFALFLVNINQRGLVLLSSLGDRALFLSKDRCLCVSATKLPSISSNSIYSSAAQFDLGVSVSPKASGTSERDTNVMXSIHD

SEQ ID NO: 191672 - protein, 143 aa, Triticum aestivum
  unsure (1)..(143): unsure at all Xaa locations
  Clone ID: PAT_TA_86090.pep
RVPQTRASPPSXGAGCIXACFTFCAXALHDGPLRCQFLAWAGLSPWRXWVLGSSSVRLREIAPYXCKCVLNLSQGESMLTXALGXGKSXQRAXASXTAXPAXXEXXPXLRFXLGXFFXTKSPGRQAPXGXXXRXLEPWGRTIP

SEQ ID NO: 191673 - protein, 111 aa, Triticum aestivum
  unsure (1)..(111): unsure at all Xaa locations
  Clone ID: PAT_TA_86091.pep
ANPSRGRGGRPSPSRRRRPVPTPSPPPRRRPPAPGLPLPLPSKSAAASSRPPRWXPNPPSPRXAMSTXAPCPPSGDLXGPPPPPTIRSNALAPTPRSPKRISSLSNGGAVD

SEQ ID NO: 191674 - protein, 74 aa, Triticum aestivum
  Clone ID: PAT_TA_86092.pep
PTTAPPAASATAGSPPTSSPPSWGSKQAPPGLPASKSPEPQPPNDLAQPASSSPPGRGPGNDPLNRATRLRHLQ

SEQ ID NO: 191675 - protein, 100 aa, Triticum aestivum
  unsure (1)..(100): unsure at all Xaa locations
  Clone ID: PAT_TA_86093.pep
PTTGGVKKPHRYRPGTVALREIRKYQKSTELLIRKLPFQRLGPRRXRARTXKTDLRFQSHARAGLXXKAARGYSVGSFQGHQPCXPSNAXXXTIIPKDIP

SEQ ID NO: 191676 - protein, 82 aa, Triticum aestivum
  unsure (1)..(82): unsure at all Xaa locations
  Clone ID: PAT_TA_86094.pep
MGGGGGTTYKGYTIPHNKRWAHXSAGKGSCATMWVLGFXTRAKXDGAVLLGVCLIPWGWHDDXAHGPWHAHEQEHRPHRLPI

SEQ ID NO: 191677 - protein, 90 aa, Triticum aestivum
  unsure (1)..(90): unsure at all Xaa locations
  Clone ID: PAT_TA_86095.pep
MALSSPSLPPHPHLLRCRPRQACRRHISLPPPLRIKSQAPKSPXPPPPXPSPPPLSRLLPLDXPPVCVXSLGRRXSAYPPPPSPLSLPPC

SEQ ID NO: 191678 - protein, 179 aa, Triticum aestivum
  unsure (1)..(179): unsure at all Xaa locations
  Clone ID: PAT_TA_86096.pep
AXYALDYLNVPHVSDTYINFPLXFAGXISPQRKXLQGITKCXXLRXAILRLXDGSGGGVFLXXRXEGSKXLLWSLDGTPETQHRRGVKACLXPRLRXFASGPPWRPGAPSPCSPCICTCYLGTHTISYGCGASGAISCKNSAQSTQFNGGGWNLWVAEWELDREEKRKQEKKQRAKQRG

SEQ ID NO: 191679 - protein, 91 aa, Triticum aestivum
  unsure (1)..(91): unsure at all Xaa locations
  Clone ID: PAT_TA_86097.pep
MSDTDEHHFESKADSGASKTYPQQAGXIRKGGHIRHQRPVPARLFEAPPPKDWGSMGHAKVSLLLHLXLLNXKEXXGYLPFHPXNCDSPHV

SEQ ID NO: 191680 - protein, 112 aa, Triticum aestivum
  unsure (1)..(112): unsure at all Xaa locations
  Clone ID: PAT_TA_86098.pep
PAGDGEDEAEAVGAGGGAVHAQPLLNQPAINNSVVRQRESYTESRGGTTSDARRKDHPSLVRDRRSNQWMSKQATRRVYRCLRRLAXASNWSWTHLATILTCSTNHFXQFYR

SEQ ID NO: 191681 - protein, 127 aa, Triticum aestivum
  unsure (1)..(127): unsure at all Xaa locations
  Clone ID: PAT_TA_86099.pep
HFQRXPAGGFIXXGPHXTLPSGVKSWPSXTSTHWWCHPKXVHLERWTLSFGAQLNFPVTVVGPISLPWLRKWCPLTPSLPVKHSQQPFTHCVCDLPQVTPGAVRCAEARRSSWGRRKASPTWVYDLG

SEQ ID NO: 191682 - protein, 188 aa, Triticum aestivum
  unsure (1)..(188): unsure at all Xaa locations
  Clone ID: PAT_TA_86100.pep
WALXGMXXVTKFCLENLLWLXSFXQPPXPFKAHGLTTGLSIXISAGXXRXAETELSRRXSPXVPSVQXVERXLKSACRASXAXGNGRXLTPTSXGLLXEGSERXAVGXGAGSGXQRGGPXRKGXAPFPEXSXTARXGAXAGGRRRSGPWRTVPSVSVRLHHHHHLRVKRVGRMLITTARSSGRRPAGG

SEQ ID NO: 191683 - protein, 118 aa, Triticum aestivum
  unsure (1)..(118): unsure at all Xaa locations
  Clone ID: PAT_TA_86101.pep
KKGSLGTIAPIAIGFIVGANILLGXGAFSGASMNPAVSFGPALVSWEWGYQWVYWVXAPSIGGGSPASXTSVXISXTHEQSXPPDYWSKRVQRSKLVAWPPPPACRPSVRSLPSLAIT

SEQ ID NO: 191684 - protein, 120 aa, Triticum aestivum
  unsure (1)..(120): unsure at all Xaa locations
  Clone ID: PAT_TA_86102.pep
RTAAEPPTPMTLLHARGKTTAAQHVAARHLDHTFEKSVAXAPVVAASPLLRCVPGHRXEPSRPRTRPPLPLXLQRRXPSXXPLFPRVFTSPFRFPMTRLRLLAVTFPERRGVSSCSIRVL

SEQ ID NO: 191685 - protein, 150 aa, Triticum aestivum
  unsure (1)..(150): unsure at all Xaa locations
  Clone ID: PAT_TA_86103.pep
RAAASPLAVRHGARRRRSRRAAAPPAPPLPPARPPPLLRRAPLVVRPRLQGXPXAPSPPSPPNDEGPGTNGERRAQAATKKKREGRRARGSGAWESPXLPSPVKAHRQGRVAGAPGGGXLMLGEEFGPMXQKEGEGIQLHXEPPRSPVSP

SEQ ID NO: 191686 - protein, 151 aa, Triticum aestivum
  unsure (1)..(151): unsure at all Xaa locations
  Clone ID: PAT_TA_86104.pep
MAPTVMASSATSVAPFQGLKSTAGLPVSRRSNGASLXAASSNGGRXXVHAGVGHPKGIXEXRALSYLPPLXTGGLPPSKSDYLXSVXKWXPCLXXXKVGSXSRGDNDPPGYYDGRYWDMLELLCSGGTDPHRGRVAKKTWVLTGNRMLSTL

SEQ ID NO: 191687 - protein, 85 aa, Triticum aestivum
  unsure (1)..(85): unsure at all Xaa locations
  Clone ID: PAT_TA_86105.pep
MTLLNGLNVLVETEHFSLVNLKFXRIFFSKENAPGPPLXIGVQPHYHHADGYKRRXXHXYVNRTAXVSCQRNLSGKDGSGLXTXT

SEQ ID NO: 191688 - protein, 103 aa, Triticum aestivum
  unsure (1)..(103): unsure at all Xaa locations
  Clone ID: PAT_TA_86106.pep
PPFFXSGXSSXSXRLGXSXPRGXTQGRRXQNPAAQKTXLNPSXPTNGISSXGPGEDTTHDSLIXXTTRHGTHGAMTTTATGGRADLELAAVGDDDLLGAGAAA

SEQ ID NO: 191689 - protein, 105 aa, Triticum aestivum
  unsure (1)..(105): unsure at all Xaa locations
  Clone ID: PAT_TA_86107.pep
ISFHXRHLDVVPSQHQESXSSXEPWQSWTNVKPTLGXPILPGXXEVRGSRPLTESWGLTSFHRARGGGRGLGCGSGDGRHPVLWPTAALSSGRRERGARRCGCEG

SEQ ID NO: 191690 - protein, 120 aa, Triticum aestivum
  unsure (1)..(120): unsure at all Xaa locations
  Clone ID: PAT_TA_86108.pep
XPNGXAKKLGXFPXKRLRPENRHQXKQTXPTXPPXXXLXSAXXMGXSXQTAPLSQVRSVSTGXRTHALPGXAGGQEXEGSIVXXGAIXKXXKFXPRLVLXLASAXFSXXXNASFLXRXDG

SEQ ID NO: 191691 - protein, 52 aa, Triticum aestivum
  Clone ID: PAT_TA_86109.pep
QPNTGAAHASYAFNSYWQQFRKTGATCYFNNLAEQTIKDPSHGSCKFSSSQG

SEQ ID NO: 191692 - protein, 98 aa, Triticum aestivum
  unsure (1)..(98): unsure at all Xaa locations
  Clone ID: PAT_TA_86110.pep
CARSSSPPSIPTPPXRTGSDDPXPSTLPLRSTTPNEIGGSPTNGSSPTKRRAWCPISYYGWVHISSKXXLXGNPMQGLLVKDWGLVLQXCLFKDPWCX

SEQ ID NO: 191693 - protein, 103 aa, Triticum aestivum
  unsure (1)..(103): unsure at all Xaa locations
  Clone ID: PAT_TA_86111.pep
CDTGIIGLEFTGVTERSATEQFNTCLHMTAMEEDLAGTLPFLQVGICQHSYNLGLPLNIMGILHIILLTLLHRXPSPISPFGCLFLPXMGKLXPLKXHHGFGC

SEQ ID NO: 191694 - protein, 134 aa, Triticum aestivum
  unsure (1)..(134): unsure at all Xaa locations
  Clone ID: PAT_TA_86112.pep
VXPSSPSXFAPCYXXXVIXLXPXWXXLSXSFPQTXIVXXLPXALPPPQNAXIIGXLQALECTFGAGVAVXTSQVFGXSKFSREPLXPRDSWEKWFPPDFGPTPSVPPXRGDERADGGSPPTSXCPXPXSCLEXN

SEQ ID NO: 191695 - protein, 118 aa, Triticum aestivum
  unsure (1)..(118): unsure at all Xaa locations
  Clone ID: PAT_TA_86113.pep
MPASIAFGRFDDSFSLASFKAYIAEFISTLIFRLPPGVXLCHPPTPKVSRGAPLGPPGXIPRWRFXQRXXAVLAVRRPAXNISXGXHVDLPSLXGSPFXRKXTSLNXTFYGXAXPXGA

SEQ ID NO: 191696 - protein, 148 aa, Triticum aestivum
  unsure (1)..(148): unsure at all Xaa locations
  Clone ID: PAT_TA_86114.pep
TXTKVVNNWNLNLSTFIFIQFVEYRAXXHLIGHXXSLXXLLXPKGGTEKASPTPVGALKVIFGGGPLCRCTXPRGXPDETPCPLPRXAFXLRPPXSXLNGVQXSHXLXCXXRXXWXTKRAXXVLPXXFATEQXTDVAGNNHGFRERRP

SEQ ID NO: 191697 - protein, 79 aa, Triticum aestivum
  unsure (1)..(79): unsure at all Xaa locations
  Clone ID: PAT_TA_86115.pep
VIRTLXFLQGXWRRTRXQLGFKLDSRQPFTTVAIFSEVMGIPSSWRMRAARVQATSLEDMATDSHRSGSAICKSKDTKK

SEQ ID NO: 191698 - protein, 147 aa, Triticum aestivum
  unsure (1)..(147): unsure at all Xaa locations
  Clone ID: PAT_TA_86116.pep
MAAVLTRPTPGTVQCFGRKKTAVAVAYCKPGRGLIKVNGAPIDSIRPEMLXLKXFLAVLLAGXPFKGHPTCVSRSRGGGKDEQFYPTRQAREXLLAYYQXYXDEAXRRVEVHLLTGPLHPRAPSPAFKILRLLSVGGGGPNTLRNCF

SEQ ID NO: 191699 - protein, 85 aa, Triticum aestivum
  unsure (1)..(85): unsure at all Xaa locations
  Clone ID: PAT_TA_86117.pep
PGXRPKGPRGGGGEXVPAEDREEEGGEPVDGGGGGAGERPAAWPFMRRRXEALRDVRGARTLKKLVGSSSFERPAYVGSWVVRGL

SEQ ID NO: 191700 - protein, 58 aa, Triticum aestivum
  unsure (1)..(58): unsure at all Xaa locations
  Clone ID: PAT_TA_86118.pep
VSVPGGGCCSGVRGLNAAAATPADRKTTCTCXKQKASGXGGIKAQLVAGTPAMRRQHP

SEQ ID NO: 191701 - protein, 94 aa, Triticum aestivum
  unsure (1)..(94): unsure at all Xaa locations
  Clone ID: PAT_TA_86119.pep
LAALPSFRSHPLPLPSPXPSXPXPXXSXSSSSTAXPQARTPRRSPSPPPSARPRCAPAPPASRRPXAGDPPPTTXPPDXPRFGEGPGIPDPFSI

SEQ ID NO: 191702 - protein, 132 aa, Triticum aestivum
  unsure (1)..(132): unsure at all Xaa locations
  Clone ID: PAT_TA_86120.pep
LTYACCFADNTLICYIMFPTSMMGRNKKLLLPSSSRKVQEVKQDKLMAETKTGHFKCCCQTFLLNLGKVGTLXTPXLPLSKXDTQXGLKYKNKEGQLLHPFGKVFSRNSXFNHKXWRDFSLGXPXDWEXXDL

SEQ ID NO: 191703 - protein, 93 aa, Triticum aestivum
  unsure (1)..(93): unsure at all Xaa locations
  Clone ID: PAT_TA_86121.pep
MKGTKLAAILILQAVLVMGVLSHVNADFFPKCCNNCRSFSGXSDVCDDAHPKCPKGCSACRVXVSTSPEMWRCAXDMKSTVXDGTCGGTLQEY

SEQ ID NO: 191704 - protein, 43 aa, Triticum aestivum
  Clone ID: PAT_TA_86122.pep
MISYSTILHPQIRQCLVCTTFELLIVLETQTWGGPGYPIPPYK

SEQ ID NO: 191705 - protein, 109 aa, Triticum aestivum
  unsure (1)..(109): unsure at all Xaa locations
  Clone ID: PAT_TA_86123.pep
MGRVIRAQRKGAGSVFKSHTHHRKGPARFKVAPTSGERNGXTSKGVLTDVIQRPRALVRRFAKVTFRXPFXVXXPKGLFFPXQXYXXRQFXQXXDXGNLXVXNFSSALS

SEQ ID NO: 191706 - protein, 66 aa, Triticum aestivum
  unsure (1)..(66): unsure at all Xaa locations
  Clone ID: PAT_TA_86124.pep
LTPVXGPXFPLKFFTLWEWNXXXXSLPGMANIXGRGSXGTLGGXGGLRLLGSVRKVDXQXGWQSYR

SEQ ID NO: 191707 - protein, 162 aa, Triticum aestivum
  unsure (1)..(162): unsure at all Xaa locations
  Clone ID: PAT_TA_86125.pep
MASTSCFLHQXSTARLAASARPAPAVGRTQLFVCKXAQKNDEAASDAAVVTSRRAALSLLAGAAAIAVKSPPPPPPTXESTNVFXKAKKEHAFLALSGKGFKLMIPGKXDPNKERDSLXKPYEEITQQLRYINPYKKHDSLRILPSSLAKSTGLEVVINLRF

SEQ ID NO: 191708 - protein, 140 aa, Triticum aestivum
  unsure (1)..(140): unsure at all Xaa locations
  Clone ID: PAT_TA_86126.pep
FGAQLPCRVGGEVHXRGGASANPDQTAAVARRSXGMPRAVGGGGRDPRALATARCXIRGRRRRSGPFQGQRRRGDRFRGQGGRRGWRKKVDAGGEGASGGRGRRRGGEGRVAARQKEAGARAARREEAAEGSGEGRGVDR

SEQ ID NO: 191709 - protein, 119 aa, Triticum aestivum
  unsure (1)..(119): unsure at all Xaa locations
  Clone ID: PAT_TA_86127.pep
WYXTPVIRXGPFLXWNXEAXSAFVYXXGRXSQXXLVPRFPVXXFKRGRXPVIXHXGRLVRAPPXXYLRFXNSXLNLRTFTCRGWKTWRXEFVXGEVEXXPRKSAIEKGNPAVRHQFSGL

SEQ ID NO: 191710 - protein, 127 aa, Triticum aestivum
  unsure (1)..(127): unsure at all Xaa locations
  Clone ID: PAT_TA_86128.pep
MGAYKFVSELWRRKQSDVMRFVQRVRCWEYRQQARHPSRITKAHPAPTRARLXGSKAKQGYLAXRTLVRLGGKKPQCPRVLFNGNXXQGITHXIPQKEPFPENLFGAVTPNGLGTHIGNNLQKVSPR

SEQ ID NO: 191711 - protein, 114 aa, Triticum aestivum
  unsure (1)..(114): unsure at all Xaa locations
  Clone ID: PAT_TA_86129.pep
LHLINSLRYCFAVNDPFVMKAWAKTYPDNKHVKFLADGAAAYTKALGLELDLKXKGLGLRSRRFALLADDLKGHRRKLXEXGQFNNLRVPKEILKGTGRTSTLRDRSDQNLCHM

SEQ ID NO: 191712 - protein, 174 aa, Triticum aestivum
  unsure (1)..(174): unsure at all Xaa locations
  Clone ID: PAT_TA_86130.pep
RARAPDTHEVSSTKRSNGDHRDGALPLRPSAGKAVKGPAVRPALFRXKARVTMRKDRRPKPSPVFVPXXRWYGSRPXALLPARLXGDPPTYSPVIPPATTGGNXGCLATPNFXQNRTWGIXAGGQLXSXVLFPXCRPXGXFGSLCXRPVQXXRGXILEPTLKXKSSLAXXXYGP

SEQ ID NO: 191713 - protein, 78 aa, Triticum aestivum
  unsure (1)..(78): unsure at all Xaa locations
  Clone ID: PAT_TA_86131.pep
DGPXGSRPSETERPGSYMSPVNCDXLPVLIMXFPHFIRLIYMKFLSVFFVVSLRQSQHDHLIFCCNKSIIAIVVKENP

SEQ ID NO: 191714 - protein, 92 aa, Triticum aestivum
  unsure (1)..(92): unsure at all Xaa locations
  Clone ID: PAT_TA_86132.pep
KSRSATLLYRGAILATRRLGGTEVQRGKSTSFSSKRSSWPEILGTTPFLPSLFSTGGKLAQLHHSPCPHSFQIYCLDXAWKNGKTHFFXKKK

SEQ ID NO: 191715 - protein, 139 aa, Triticum aestivum
  unsure (1)..(139): unsure at all Xaa locations
  Clone ID: PAT_TA_86133.pep
PAAAPITAPVTPAPVTAPAAAPPTPAPKPKAKAPAAAPPAKATAPAPAALPPTVEAPAAARQRRPPRCCRRAGPLTKPTDXXXPAPSKEEXPSKDKKKEKAPGRPGSPRPVKRWATLRGPRPNGIQRTARPGKDTGWRG

SEQ ID NO: 191716 - protein, 123 aa, Triticum aestivum
  unsure (1)..(123): unsure at all Xaa locations
  Clone ID: PAT_TA_86134.pep
MAPTVMASSATSVAPFQGLKSTAGLPVSRRSNGASLGSVSNGGRXKVHAGVGPSKGIKNXETLSYLQPLNTEASLKEVDYLIPSKXGVPCLQXNXVGFIFPXXNASPGXXHGRYWTIWNCLFR

SEQ ID NO: 191717 - protein, 55 aa, Triticum aestivum
  Clone ID: PAT_TA_86135.pep
FGCTDATQVINEVEEVKKEYPDAYVRIIGFDNMRQVQCVSFIAFKPPGCEESGKA

SEQ ID NO: 191718 - protein, 168 aa, Triticum aestivum
  unsure (1)..(168): unsure at all Xaa locations
  Clone ID: PAT_TA_86136.pep
MGAYKFVSELWRRKQSDVMRFVQXRVRCWEYRQQPAIVRIXRPTRPDRARRLRFKGQTGYVIYRXRVRRXGKKRQCPKGIVXGKPXTKVLPTPXPXGTRAFAEEKAWRKXCGFLPQSLRVNXDPTYKYXRHLVDVLXTLSXXSKXNWVCXLCKTLWPLGKNLGHHAQT

SEQ ID NO: 191719 - protein, 79 aa, Triticum aestivum
  Clone ID: PAT_TA_86137.pep
RMENVNSWRLISSNLPCEINTLHHLMFVYSCLHPYLVGGRNSASTSGATCYSKCSQKTQQECQTVFGCCHQGMIKLPTS

SEQ ID NO: 191720 - protein, 86 aa, Triticum aestivum
  unsure (1)..(86): unsure at all Xaa locations
  Clone ID: PAT_TA_86138.pep
PLXFXGLXTPFKXXPXVSKXFPLSXXNLKGXRRKXXXASXRPRTXXGNGNSXXNGENADXXKXTNGESSASALLAGNRGAGKELRA

SEQ ID NO: 191721 - protein, 76 aa, Triticum aestivum
  unsure (1)..(76): unsure at all Xaa locations
  Clone ID: PAT_TA_86139.pep
TFXXLKSXLLXLCKIKXFWXQCPXPLKXWEKEYXLXXXRXGQXEQPLXLXKKMCIXYTQGLXLKTSXXYRKXRWDX

SEQ ID NO: 191722 - protein, 56 aa, Triticum aestivum
  Clone ID: PAT_TA_86140.pep
MAFTARMKDLMRKYGKVALGVHVSVSVASVSGLYVAINNNVDVDAIFRKIDPPAPP

SEQ ID NO: 191723 - protein, 135 aa, Triticum aestivum
  unsure (1)..(135): unsure at all Xaa locations
  Clone ID: PAT_TA_86141.pep
TRWSGASRDLSLQPARLSLLFPQLLLPFAAPPPLLVPQTACCFSFYEPLLLLPLLLAPFAAAAPLLGVPADSSPSPQLLLLLLSXNWLLLPLLXIPGCCIFFLPLEPLTTGCWSLSPTNLLLSFSPLALPXLLXN

SEQ ID NO: 191724 - protein, 129 aa, Triticum aestivum
  unsure (1)..(129): unsure at all Xaa locations
  Clone ID: PAT_TA_86142.pep
WXQLLNPVXRGKGTPVXGRLCRRAVGATXRGSRDGSAGRPVSNCLGLWLGGVXSSSVRGRTGAPFVGGRHRRRTAVSPAVERLDGGSRMAAWGAGLHWLGSGFGAPIFVGMGTPHASMRRPSPAHISWA

SEQ ID NO: 191725 - protein, 144 aa, Triticum aestivum
  unsure (1)..(144): unsure at all Xaa locations
  Clone ID: PAT_TA_86143.pep
MANPRVFFDMTVGGAPAGRIVMELYKDAVPRTVEKFRALCTGKKGSGKSGXXXNYKGKAFNGXFPNSXCQGRXXTRGXRNRXXXLRXNFPQQKXSKGNPFPMAAKQGPIGPDCQTASGSSAKRGPDCQQCIQLPPSLARPLIKF

SEQ ID NO: 191726 - protein, 109 aa, Triticum aestivum
  unsure (1)..(109): unsure at all Xaa locations
  Clone ID: PAT_TA_86144.pep
RKERSRRAGKSHHPIPSPASASEGSEMADRANHPSVMQKFGGTVPPCLQASLXVFRAPQHLPFLCHPMXGASTTSSTXLQDFWTISQHVHLXQCFANAPLEKKVSKXXH

SEQ ID NO: 191727 - protein, 131 aa, Triticum aestivum
  Clone ID: PAT_TA_86145.pep
MAVSDLLPLPFPVPPYALHVAASLALAAAAHFLHVPSLLLYAVHTYIHPDAVPSTGPRAVLRPPGPAPPSGKRGAAGPRLRRSAQSTACASPRLASRPTPVPTLPVLSRGPVLLRPLPGARSGLSLSCSRK

SEQ ID NO: 191728 - protein, 147 aa, Triticum aestivum
  unsure (1)..(147): unsure at all Xaa locations
  Clone ID: PAT_TA_86146.pep
MAPKAAEKKPVATAEKTTAGKKPKAEKRAPASKEAGGEGKTRGRKKGSKAKKXLETYKIYIFXKVLEAGHPRTXGSPXKPCXSMNPFIKRHLXRTPPGSXANSPRYNKEXNHQLPGKFXTPXRSSSPGGXPXXASPXXXKALQINSP

SEQ ID NO: 191729 - protein, 187 aa, Triticum aestivum
  unsure (1)..(187): unsure at all Xaa locations
  Clone ID: PAT_TA_86147.pep
LIPSPPRRPSTPAAPFSSRWAAAPPAPNLRSCDDRAALPVLLRPCPHRPSLACIPSLLAPPVPSPTFRRPNHLRSFLLCHHDAPRHRVLPSTRLGPWQRRPFLSVVXLVSRPHLLLTSRTTCPQGDPLXNGXNSIRPKHFFCXXXTLNGNSRESTPXGLACXLCAARXEQGARSLGFAXQTXIMXXS

SEQ ID NO: 191730 - protein, 65 aa, Triticum aestivum
  unsure (1)..(65): unsure at all Xaa locations
  Clone ID: PAT_TA_86148.pep
AEKPAPAAADVAKQIPAGIPGSRANNYYRADGQNTGNFLTDRPSTKVHAAPGGGSSLGLLGLGGX

SEQ ID NO: 191731 - protein, 131 aa, Triticum aestivum
  unsure (1)..(131): unsure at all Xaa locations
  Clone ID: PAT_TA_86149.pep
LDLRSRPPPSPSTTSSFLHRLSSLWRAPLHLSSRSTQRASLLLPPRPSSRRHRHLQFSSGGQTLPCDWVPPPSASPPSCXEDNDGMGCRRPXPGPSVSLRXGAHLAHGHRSKQTASPXGNAGALAEXSDGG

SEQ ID NO: 191732 - protein, 55 aa, Triticum aestivum
  unsure (1)..(55): unsure at all Xaa locations
  Clone ID: PAT_TA_86150.pep
MGIDLVAGGRNKRTKRVAPKSDDVYLKLLXVKLYRFLVRXRTKSNFNAVILKSLS

SEQ ID NO: 191733 - protein, 115 aa, Triticum aestivum
  unsure (1)..(115): unsure at all Xaa locations
  Clone ID: PAT_TA_86151.pep
FPXHTCRQWFXYQLGSGQTPXKIRXNEKGPTMXNQGGTXRNQGXGTTHXXIKPQLHTQGCYKCSKTXHSNTXCGGWPVAQILEPSDTQRRXRXXSRGMPHTWGXAHXFXXLEHPK

SEQ ID NO: 191734 - protein, 84 aa, Triticum aestivum
  unsure (1)..(84): unsure at all Xaa locations
  Clone ID: PAT_TA_86152.pep
MRECISIHIGQAGIQVGNACWELYCLEHGIQXPDGQMPGDKTVGGGDDAFNTFFSETGXAGKHVPRAVLVDLEPTVIDXVRTGA

SEQ ID NO: 191735 - protein, 120 aa, Triticum aestivum
  Clone ID: PAT_TA_86153.pep
PTTSRYRRGPPQHMHTPKAGYIGVERSNTPLALLEHPGLHPVNTPPRRDAAAYDELWAPRRCLQEGYDTAASPPPDPRIKVSPGATRQTMRAATTPSRRERATPPPVCPKKEQVFTPANT

SEQ ID NO: 191736 - protein, 135 aa, Triticum aestivum
  unsure (1)..(135): unsure at all Xaa locations
  Clone ID: PAT_TA_86154.pep
MASPAAVSAVAVALALLVASADAWLHEEFDTEGNVRAGYDARGQQVASIVLXDRXSGGAFRSRRSYLXGQFSVQIKLVPGNSAGTVASFXCRRGDGPXADKIDMDSXXTAXVNRWXHTXVWATXTEKXPHTFNRA

SEQ ID NO: 191737 - protein, 132 aa, Triticum aestivum
  unsure (1)..(132): unsure at all Xaa locations
  Clone ID: PAT_TA_86155.pep
PTKTHSEEKKGXTGXXGKFKGFPPXFLLXCLLLLSSSPRPKKLRPRRRSPRPTCXTTTVAAAATRAXVIPGAXPGGGYYXYPXPGXGGYPGPRXRRLXPVGLLRPRLXXXFXXFPPPKIPXPIFPXXGXXHN

SEQ ID NO: 191738 - protein, 94 aa, Triticum aestivum
  unsure (1)..(94): unsure at all Xaa locations
  Clone ID: PAT_TA_86156.pep
KAGNQEKHHLIIIISALLGVSLLLAVSLCCYVLTRKANKKNSPPEDDLTKAPPPAHKLQKSRRAVXANRHRDLQSLQIMQLXXRQXEFLKXDXP

SEQ ID NO: 191739 - protein, 160 aa, Triticum aestivum
  unsure (1)..(160): unsure at all Xaa locations
  Clone ID: PAT_TA_86157.pep
XXSXRETVPFGGXRXRLVXXSGGWHRTKWRKNFPXXRAXXAGFRXRLRGGXAFRLSWREKPAXWRXAGNXXNRPSXRNFQVVVVPCSPPKGSGFPCXACPPASXNLQHGVGVDLAPGPARWPHLVRVDAGVLEAQLPPQPLRPASAARRHDSAGRLLIRR

SEQ ID NO: 191740 - protein, 72 aa, Triticum aestivum
  Clone ID: PAT_TA_86158.pep
ENELVDFENNSSLWLPPEAEDEEDDHDGAPCDDDEGEDATGEWGYLRSNSFSSGHCRNRDKSSEEHKKAMKD

SEQ ID NO: 191741 - protein, 200 aa, Triticum aestivum
  unsure (1)..(200): unsure at all Xaa locations
  Clone ID: PAT_TA_86159.pep
QREDKAPTILCHLNTPSIPKYSAYKLFRDIPQCSAYLPPQAILDETTLPPNQTASAPAHRFARLSLFLIPSSRGFSHLPRHRSATSVADPYLHCDNTVDRVASXARGPRWDGRSAAQIGKRESNAAGVVRRTEGDSNTELNGTDKSTXTGLXVSTRTRHNGQTCLTTGGNTAXPFXLXCHVRKTXSWGGKSYTNNRLSVX

SEQ ID NO: 191742 - protein, 186 aa, Triticum aestivum
  unsure (1)..(186): unsure at all Xaa locations
  Clone ID: PAT_TA_86160.pep
NDRYPLCCYHQDPRDXLERRPLPVCXVGGXXGKGTATVNGXDLDXYXVGLNXCXINLSXNCQLRXTEWXPYLLHYRQAIVFMSSFGSXVYLFDQAVVILGGDAGRGRGRSXLLPSAAGPPFPLSSLSLILIFSGTDPWGRRRRRSPRVGSNEMNEMREGETSMGGWRRRKRAWRRLGGARVADGNC

SEQ ID NO: 191743 - protein, 142 aa, Triticum aestivum
  unsure (1)..(142): unsure at all Xaa locations
  Clone ID: PAT_TA_86161.pep
ADPSPLTTTVVTVLRVRRLGPHRFHAHDQNRLQIRRPAEPLPAVGTPERDADADAASSFQERAKDILRRRLRACSSGFGCGXSPPLHVLVWSXLASTGPPALRRVYRXTQXETFRXGPRPKKAVLISTGDRRAVRAFFGRKR

SEQ ID NO: 191744 - protein, 95 aa, Triticum aestivum
  unsure (1)..(95): unsure at all Xaa locations
  Clone ID: PAT_TA_86162.pep
XFHVLNXTCSVXMDLLEPSRTLGLHAAGVGISVNREAAAEAAXVGSADAVEARRRCLLVAVRDGAVARVPDFVFAGGGGTALAAAEAEVMTMDAA

SEQ ID NO: 191745 - protein, 121 aa, Triticum aestivum
  unsure (1)..(121): unsure at all Xaa locations
  Clone ID: PAT_TA_86163.pep
MPGSIAFGRFDDSFSLASFKAYIAEFISTLIFVFAGVGSAIAYTKVSGGAPLDPSGLIAVAICHGFGLFVAVAIGANISGXHVNPXVTFGLALGXQITXLTGIFNWVAXLXVQSSGFLVXF

SEQ ID NO: 191746 - protein, 202 aa, Triticum aestivum
  unsure (1)..(202): unsure at all Xaa locations
  Clone ID: PAT_TA_86164.pep
LSSPSPPPVAAAARPAWRRATAPSPASASTHRPSIQPPAPPHHHRASATSLLHIIHPSTTPSSPPSPCALHFVAAPGASDQTGVWFPAPPAAALSLSTAPPLVSTSSVSLLLLXKPAALLLLSTLLLLLLLASLCCCCSTAVLFSRNCXLLAXSSASPFRIPNALRSSXTRCYXLPXRXLRLXVSXXXRVLXXPXIXIRXNV

SEQ ID NO: 191747 - protein, 130 aa, Triticum aestivum
  unsure (1)..(130): unsure at all Xaa locations
  Clone ID: PAT_TA_86165.pep
MPSEGGARVSAEGGGTTWVVVTLLPLADGFGTPQFVADRFYRQRGKESTKSAEVISTGERSGRDGLTVYEIEYSLDSTXRGGMKRIFSAAFVASRKLYLLNVAYSDTEEKPLGKQTRLVLEEVLHSFDSV

SEQ ID NO: 191748 - protein, 149 aa, Triticum aestivum
  unsure (1)..(149): unsure at all Xaa locations
  Clone ID: PAT_TA_86166.pep
MAPTVMASSATSVAPFQGLKSTAGLPVSRRSNGASLGSVSNGGRIRCMQVWPIEGIKXFETLSYLPPLSTEALLKQXDYLIRSKWVPCLXSTSWFIFREHNASPGYYDGRYWTMWXLPISDHRRTRCQVEEARRIPDPSRIIGQSQVML

SEQ ID NO: 191749 - protein, 141 aa, Triticum aestivum
  unsure (1)..(141): unsure at all Xaa locations
  Clone ID: PAT_TA_86167.pep
LTASSQSLASFPRRHPPRKGGCLAAAATAGAAPAASAATAAAGARCSPTWRPPPAPPPWSCPPPPTRGAPAGSRRPGRPAAATAPPASAXPLAAAPAXLQLNXGPXRPAXKGDTRIRRTNKQITTINNNRFTTNRMRSRAR

SEQ ID NO: 191750 - protein, 144 aa, Triticum aestivum
  unsure (1)..(144): unsure at all Xaa locations
  Clone ID: PAT_TA_86168.pep
RQSLRRRSSSATPAVIAGPLPPSSPHEPALPLCTLLLAAPSILLLGSPILIPDSCKSGRRGEQRTRHSRLPRRGGAPSPLLPATFTHTPPQTSTTLSFIVFSTNPPNRSCLLPSHRRHCLYPSSPSMVALRAXEAPPHTWRRIE

SEQ ID NO: 191751 - protein, 108 aa, Triticum aestivum
  unsure (1)..(108): unsure at all Xaa locations
  Clone ID: PAT_TA_86169.pep
PGSPLALARVIHLVHPPPLPHSLTRTSRPDQHQLPFCLSLSLLTISRRPPPSFASSSAAASLAAARTFAEREKGGNPTRTQPDATTKNAQKQRDIRLXXXXERAGXNP

SEQ ID NO: 191752 - protein, 166 aa, Triticum aestivum
  unsure (1)..(166): unsure at all Xaa locations
  Clone ID: PAT_TA_86170.pep
MAAKEPMRVLVTGAAGQIGYALVPMIARGVMLGADQPVILHMLDIEFAAEALKGVKMEFXFDAAFPLLKGSLLQQLMFVXACTGXVNVAVMVGGXPXKEGMEXRKDVMTKMFPILTNSXICSLELNAAPNSSFGFSNQQHNSTKICSPEKKLTPLNTTQIRKDVKF

SEQ ID NO: 191753 - protein, 106 aa, Triticum aestivum
  unsure (1)..(106): unsure at all Xaa locations
  Clone ID: PAT_TA_86171.pep
PPTASGERPHSPPPPHPSPPATSPAPAPCSASEAASSPISPLRPPPIPSPIYTASSPPPRPPSPQGPRFAXEGLPRRHLRPHPSAGPQRPPPSSPTSNPHLPLKFV

SEQ ID NO: 191754 - protein, 49 aa, Triticum aestivum
  Clone ID: PAT_TA_86172.pep
GPLEGEDETCVRVDSTLIHYSILLCKRVSSRGTLCCVWRAPFFCHGIIV

SEQ ID NO: 191755 - protein, 112 aa, Triticum aestivum
  unsure (1)..(112): unsure at all Xaa locations
  Clone ID: PAT_TA_86173.pep
SKAKKGVETYKIYIFKVLKQVHPDIGISSKAMSIMNSFINDIFEKLAGESAKLARYNKKPTITSREIQTSVRLRPPRGVAKHAVSEGTKAVTXSPPPRLDGVHWVLHLHLYC

SEQ ID NO: 191756 - protein, 178 aa, Triticum aestivum
  unsure (1)..(178): unsure at all Xaa locations
  Clone ID: PAT_TA_86174.pep
ETELXDYGVXLXSLWFXPDILGXSXXDIXXXCDTXAASLLLRCRPPAPAPADAREHPLAVEXLNMPAMQPIWRRSNSGMSSXKTLSTLLAAGIPRRFQTDQTPAQTRRPPHIHRPQQASRTLTVRQRHPVGDSKSRRRFGDQRRRRGSGVWMDAGADIEVLQALGMGVVSSEEECYYL

SEQ ID NO: 191757 - protein, 89 aa, Triticum aestivum
  unsure (1)..(89): unsure at all Xaa locations
  Clone ID: PAT_TA_86175.pep
QQTKQLQQTLAYSTKTFFPYYHGFLAFLSSNTNLNAEYANKVXRXNKQXRCLMXKSSXSLNPKXNPXQKEXXSNLIXSLKXIXPLVXXW

SEQ ID NO: 191758 - protein, 199 aa, Triticum aestivum
  unsure (1)..(199): unsure at all Xaa locations
  Clone ID: PAT_TA_86176.pep
RRALRELLFCTPGALQYLSGVILFEETLYQSTKGGKPFVDILKAGNVLPGIKVDKGTIELAGTNGETTTQGFDDLGKRCAKYYEAGXARFXKWRASLKIXAPTEPSQSPXDQEPQGLVRYPSTGKENGXVPIVXPEIXVDGLKXFTAVLTXPXFLAAXKRXQRQXFPIPEKRVNQKGARRITSNPKDSGFPNRGKGGTT

SEQ ID NO: 191759 - protein, 134 aa, Triticum aestivum
  unsure (1)..(134): unsure at all Xaa locations
  Clone ID: PAT_TA_86177.pep
CLPLPFPLPPPPPSSAGAGSATNRGRGEEKGRLLSGLAGSAHAGAGLRDGVGRXWRXWAAXXPCLXSSKWWGFNVTVIIINKWIFXKLDFXFXLXXSCVHFIXSSIXAYVTLXAQSXPXIQVSXKTMEKDFPNL

SEQ ID NO: 191760 - protein, 153 aa, Triticum aestivum
  unsure (1)..(153): unsure at all Xaa locations
  Clone ID: PAT_TA_86178.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEXKKEYPDAYVASDSQHRQ

SEQ ID NO: 191761 - protein, 93 aa, Triticum aestivum
  Clone ID: PAT_TA_86179.pep
IKHFLTIRFRLFHPYHAISFFLFPCKSCEHEQGRKRHGRTTEPARWLAASLHCSNSPSSHALLISSWFQHHPCRMQLCQTWVSSNSRRTTYTS

SEQ ID NO: 191762 - protein, 127 aa, Triticum aestivum
  Clone ID: PAT_TA_86180.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPLMMFCWAD

SEQ ID NO: 191763 - protein, 157 aa, Triticum aestivum
  unsure (1)..(157): unsure at all Xaa locations
  Clone ID: PAT_TA_86181.pep
MAAAFSSXTVGAPXSTPTNFLGKKLKKQVTSAVNYHGKSSKANRFTVMAAENIDEKRNTDKWKGLAYDISDDQQDITXRGKGIVDSLFQAPTGDGTTXPSSSSYEYVSQGLKKYDFDNTWXALHRSCFMDKXVVISQELMTCQHQIHLGTGKVKEIL

SEQ ID NO: 191764 - protein, 138 aa, Triticum aestivum
  unsure (1)..(138): unsure at all Xaa locations
  Clone ID: PAT_TA_86182.pep
RNPSRSLEPSAAAATSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKSXEKEESDDDMGFSLFD

SEQ ID NO: 191765 - protein, 83 aa, Triticum aestivum
  unsure (1)..(83): unsure at all Xaa locations
  Clone ID: PAT_TA_86183.pep
MVKAVAVLTGSEGVKGTIFFTQEGDGPTTVTGXVTGLKEGLHGFKLHALGDTTNGACQLDHTNPAGHVMGEPDEIRHAGDLGM

SEQ ID NO: 191766 - protein, 73 aa, Triticum aestivum
  unsure (1)..(73): unsure at all Xaa locations
  Clone ID: PAT_TA_86184.pep
MLGVAIAQGCRSLELLSLFGIXGVIDACLEALSKSCPNSLTTLDVNGCTGIKRRSRDDLIQLFPRLSCFKVHS

SEQ ID NO: 191767 - protein, 158 aa, Triticum aestivum
  unsure (1)..(158): unsure at all Xaa locations
  Clone ID: PAT_TA_86185.pep
MQIFVKTLTGKTITLEVESSDTIDNVKAKIQDKEGIPPDQQRLIFAGKQLEDGRTLADYNIQKESTLHLVLRLRGGMQXIFVKTLTGKTINLEVESSDXIDNVKGKIKTRXGHPPDQQRLNFAGKATRGWRTLADYNIRRILHWCPCGSFSRPDKTTL

SEQ ID NO: 191768 - protein, 145 aa, Triticum aestivum
  unsure (1)..(145): unsure at all Xaa locations
  Clone ID: PAT_TA_86186.pep
MASTFSGDETAPFFGFLGAAAALVFSCMGAAYGTAKSGVGVASXGVMRPELVMKSIVPVVMAGVLGIYGLIIAVIISNGXNPXKPYFLFDGYAQLSXGLACGSRARRMASDLGTVATAQPFVGYLTYRTCLLRITLVGNPSTKKH

SEQ ID NO: 191769 - protein, 44 aa, Triticum aestivum
  Clone ID: PAT_TA_86187.pep
FGLLLVNIYFIFENATRELYSFKDLVDQMGQLTMNQATVIKHLT

SEQ ID NO: 191770 - protein, 133 aa, Triticum aestivum
  unsure (1)..(133): unsure at all Xaa locations
  Clone ID: PAT_TA_86188.pep
MLKFPKGKQNRAXIQEKEKVKIQYILHFVMSPNXXSRNHQCTXKQXSQDEMCYTVQPWRGRSLFRAPPRSWENEGSGRGEELWRWAAMAASRGAALAASREGEESESKAHLSFSRVGMATNRGGGRDEGLGIG

SEQ ID NO: 191771 - protein, 195 aa, Triticum aestivum
  unsure (1)..(195): unsure at all Xaa locations
  Clone ID: PAT_TA_86189.pep
RTFQIIVLQGIVGSLPWTAVVFFTMWFELIGFDNKSSAGLNSLFAIGCASGSFLGGVIADRVSRRYPDSGRIMCAQFXSAFMGIPFTWILLTVIPQSVDYWXSYAVTLFLNGLNISWXCANCANXPMFAXVVPPKQRXMIYAFDRAFEGPSLLVLPLSHGDEKATVQREDVNRTVVEGPKATYVIGRRRLTYRKL

SEQ ID NO: 191772 - protein, 135 aa, Triticum aestivum
  unsure (1)..(135): unsure at all Xaa locations
  Clone ID: PAT_TA_86190.pep
APHVVXSSXKVGXNLGSTIWKTVEKGRRCRRCSQITGTNISLGGCEGVVEXRNRGERRWWXSTAMAPWPWRGRRPRWRGCGGLQLEPEVVGDADKADEALEHILVGRGRLRPWERRWRVDGNSGTRSRGEAREGE

SEQ ID NO: 191773 - protein, 148 aa, Triticum aestivum
  unsure (1)..(148): unsure at all Xaa locations
  Clone ID: PAT_TA_86191.pep
MAGNGATTRRLLTLFPLHVTLIFLLGANGADAATSFSFANECSHPVWVGVLSGATSPXAPHRFYLRPGRTPPLRRPSSGAWPELWARTGAPVQRRNRRLACATAMXQXDSPXTRGRPPXSSGITSPPRGAFSNSSRFNCRAPRSSGSG

SEQ ID NO: 191774 - protein, 175 aa, Triticum aestivum
  unsure (1)..(175): unsure at all Xaa locations
  Clone ID: PAT_TA_86192.pep
EIXEHFLXKGSRTSIENGGXEHFREKNKEEFSEGKNEEQMICEXSPDCPCLVAALHPGNLSPCQTVVTARRRHASTLLGSSTTVWEVAWEVGSIGGWGRCGSRASSRGPATHGWHWRQCQVYRRQGELRLAPWVEKGHGGAGRSTVVARWDGGKQRDCGVVVWAWAWGGDNDGND

SEQ ID NO: 191775 - protein, 120 aa, Triticum aestivum
  unsure (1)..(120): unsure at all Xaa locations
  Clone ID: PAT_TA_86193.pep
MDRARHKSSPSSERFLGAFLPXPAAGDQPASAXFRVDEDNSSVGVGFPERXQPPRXPALPCLRSGGNLXPLRAPGGDLXGFPEALFAPLCSPLEFPSGMPFGSAIPARADKSSPVPVPVT

SEQ ID NO: 191776 - protein, 146 aa, Triticum aestivum
  unsure (1)..(146): unsure at all Xaa locations
  Clone ID: PAT_TA_86194.pep
AEFISTLIFVFAGVGSAIAYTKVSGGAPLDPSGLIAVAICHGFGLFXVAVAIGANISGGHVNPAVXFGSALRRQITILNRIFYWVANSSXAIVRASSSNFCTGVXTLXTXFRXWALLXLXMEINLTXGRNLTPPTQGSGQCPNRNG

SEQ ID NO: 191777 - protein, 115 aa, Triticum aestivum
  unsure (1)..(115): unsure at all Xaa locations
  Clone ID: PAT_TA_86195.pep
MSLSATFRVAKIPRTTLPPKSCKATPSSVSASSAPASGDPPPKAAKKKKEAAPWCVYLISSSRALRTYVGVTTDSLXAXRQHNGEFKGGCQXSSGWKAWIXXCLFXGLXNRMNMQ

SEQ ID NO: 191778 - protein, 135 aa, Triticum aestivum
  unsure (1)..(135): unsure at all Xaa locations
  Clone ID: PAT_TA_86196.pep
DPDPIYSPRALLSSPLQPLSRAMAPAPHLSFLALHRIARESNSPAHAPPSLPFAPAPVPRCRLSTSTPRRLGLASLTETPPPLXPEGLPPSPVGYQASDITRAPLPRTTLSPQRHTSPPLAPTSAGXTPPXRAFF

SEQ ID NO: 191779 - protein, 98 aa, Triticum aestivum
  unsure (1)..(98): unsure at all Xaa locations
  Clone ID: PAT_TA_86197.pep
MSRGGSAGGGQSSLGYLFGDGEPAKPAAAPAAKPAPAEKPAPAAADVAKQIQLGIPGNRANNYYRAVAKHGTSLRTXFNKVNAAPGGGXSLGYLFGGI

SEQ ID NO: 191780 - protein, 84 aa, Triticum aestivum
  Clone ID: PAT_TA_86198.pep
MSPPSAPPPGRRASPWRRRRLFPWKSPTASTILTSPLFFCLSQVSFDEEAGWEYRMILWRWWCRSGEALMAMNSTSWEEEGRGG

SEQ ID NO: 191781 - protein, 161 aa, Triticum aestivum
  unsure (1)..(161): unsure at all Xaa locations
  Clone ID: PAT_TA_86199.pep
MELPWGALLLALLSVSSSSAVATLAVTPPPPAPARAPAPVXAPXPAHAPPQAXEAEXLLINGNFXTEXRNVNXNLIVGRHXLPGWXLRGHXXYVSAGPXPGXMFFTVXHXXHXLRLXTTRXSPKLSXRXXSLAAPHSKRAITCSVIRRTSSKGQTRTGWVP

SEQ ID NO: 191782 - protein, 72 aa, Triticum aestivum
  Clone ID: PAT_TA_86200.pep
EVVWEGEAPASDKAEKNVTNTDATNRPTLPSKPQPAANTDRNNAPSKTAGGKKPAKAAPKQGKNIMSFFKKV

SEQ ID NO: 191783 - protein, 112 aa, Triticum aestivum
  unsure (1)..(112): unsure at all Xaa locations
  Clone ID: PAT_TA_86201.pep
MSRGGSAGGGQSSLGYLFGDGEPAKPAAAPAAKPAPAEKPALGSCRCNQADPTGFQVXRANNYYRXKMAKNTXXSLTDRPSXTRLXLLPXGXSSLGTCLGGNFPVDAANNWR

SEQ ID NO: 191784 - protein, 135 aa, Triticum aestivum
  unsure (1)..(135): unsure at all Xaa locations
  Clone ID: PAT_TA_86202.pep
LPSLATTHSQGGCLAAAATAGAAPAASAATAAAGARCSPTWRPPPARPPWSCPPPPTRGVPAXSRWPAGKPAAATAPTCNCGPRXGCPAATATEPXAQXGRPXXATQDXEGXXQXHHNINNNQGFNYNRRMRANK

SEQ ID NO: 191785 - protein, 146 aa, Triticum aestivum
  unsure (1)..(146): unsure at all Xaa locations
  Clone ID: PAT_TA_86203.pep
YRGEESPRRLSLLLGASTSKPTLCMKKTHKKKPIKPMPXPLEGYEKLIXPEEDAGEEDHPRAAQWTYNAEXSSCLXPKSPDNLFPLTXLCYIPWVPXCSGGRSLCSRELQHNYYVADNFXAXPRRSPQCEXTASNXQPXVYVIXXX

SEQ ID NO: 191786 - protein, 122 aa, Triticum aestivum
  unsure (1)..(122): unsure at all Xaa locations
  Clone ID: PAT_TA_86204.pep
MSCCGGNCGCGAGCKCGNGCGGCKMFPDVEATAGAAAMVMPTASHKGSPAGSEMAGGETGGCDCTTFKCGPPAAXPAATATEPGAQGGPAGKGDRGREKQHHHITTTVSITITAACARARAK

SEQ ID NO: 191787 - protein, 176 aa, Triticum aestivum
  unsure (1)..(176): unsure at all Xaa locations
  Clone ID: PAT_TA_86205.pep
RFLLLFLPLTPEPKPQELPMASTTFSSAFSILSLPSSSPSPSASAPRTLPVANRRRRAVAVASTATDPRRSLESGDAIAGSPLRRSATLSDHLQNVLXLCRSFRPAAAVRGPAAAAAEGAPVRETDCGHRGQQRAYPTSRFRMDNWALKSKVLRGLPKNSNKDRPGKNQGSGKVQT

SEQ ID NO: 191788 - protein, 95 aa, Triticum aestivum
  unsure (1)..(95): unsure at all Xaa locations
  Clone ID: PAT_TA_86206.pep
PXLHVRGGYINSLPLXVSFASTXQIMHXESALCWXVPLSVLVAWIMXIXXDLXFKXXQXXSLXISVLXTVFXLQVKIIIXSSFRXTXVGEGILTT

SEQ ID NO: 191789 - protein, 117 aa, Triticum aestivum
  Clone ID: PAT_TA_86207.pep
ANALLYFSLPTLPRTDCSKVLVSLKRDSVLPPVPLNFAQIHRKQSTRMGRNSRSSGRETVVHVASSDQVLALHVSNFAPLISLKRVRCGLAGATDLPASGSSRRLRCLPCLMCSRKV

SEQ ID NO: 191790 - protein, 121 aa, Triticum aestivum
  Clone ID: PAT_TA_86208.pep
AALSGAGAPSAATPASPPGPPLPRRLAARAAAQPPHPASPTRHSRILPSRATSAGAWGEGTPPPGSTPTSLLQYSADQTSLRLTSPGAANQDDQDARRLPPNLPPLQSPDQDARPTLPLGA

SEQ ID NO: 191791 - protein, 56 aa, Triticum aestivum
  Clone ID: PAT_TA_86209.pep
CAISQFGAEEHLCLSAALCLPQIIITKTNDETYHSEFLIDKSSLQISRGGGSGFPP

SEQ ID NO: 191792 - protein, 111 aa, Triticum aestivum
  unsure (1)..(111): unsure at all Xaa locations
  Clone ID: PAT_TA_86210.pep
MEAVRASAAWVASRSSHVKVDMLEIEKAVDKIQGNVPKVEWDFEGIHYFDNGPLTVQYLFVLGRTELCFWPXGXLTXDNLASXTKLALRERXSTLDAXXLKNYTGPQLQER

SEQ ID NO: 191793 - protein, 86 aa, Triticum aestivum
  Clone ID: PAT_TA_86211.pep
VSLEMCVSISTTHKHAGFETRCRCGVGGTDFRCFKSHINLCPDLDDMPIIGFSVYIVVLVGMLQLSLLRLYLCSWSFPVSCKAIIS

SEQ ID NO: 191794 - protein, 103 aa, Triticum aestivum
  unsure (1)..(103): unsure at all Xaa locations
  Clone ID: PAT_TA_86212.pep
LKKRSPRAARRRRKRERATDXXAPGMLLPRRGRVGVGEDADSGAVVVEAEAVDERRKGYCWIRVWGREGRAWGSVARGRCLPEPDGVGGGGGEEIVGRGAGLD

SEQ ID NO: 191795 - protein, 77 aa, Triticum aestivum
  unsure (1)..(77): unsure at all Xaa locations
  Clone ID: PAT_TA_86213.pep
ALCCRCTPSSQGGRLYXXHIXRSSYQLYVASXTLXATMVDIYXINAXEEVXXGTXXMVRXXXKFXNRGEMFEGRRVD

SEQ ID NO: 191796 - protein, 206 aa, Triticum aestivum
  unsure (1)..(206): unsure at all Xaa locations
  Clone ID: PAT_TA_86214.pep
NHWXCXPXXFFXXXYQXFKQPGXKXDQVASTFWXXXXQVLKVXKSXMKGSLLLXLXIILSSAXPVVYRQRCXCSRVHICCSDKKKGLLXLSQSQRISGNFGVKDLGGVGLPDLSTMGKPSGGWRRIDGEAEADASGGDWRGRRRCGVPACASWRRRSGGASRSSWSGRSVEGRSMAAVARGGRRRARRPFLQNDREGEVEMGGRGG

SEQ ID NO: 191797 - protein, 137 aa, Triticum aestivum
  unsure (1)..(137): unsure at all Xaa locations
  Clone ID: PAT_TA_86215.pep
ATTAAAALSCSCSRSPSPSSTLLLRRTVSDFHRRPAHAGVRRPRLAPLHVVDDSKEVETRSETDRLVDGLNFGELCNDFECISTXYVESTARXXARDILEIRXDNRALKLLPVAXKXKDLXGICGALKIXXALWITP

SEQ ID NO: 191798 - protein, 66 aa, Triticum aestivum
  unsure (1)..(66): unsure at all Xaa locations
  Clone ID: PAT_TA_86216.pep
XXEXXILSTDXGQHXDVFKXYVEXHNRRSYXGDIXTEKKRNXDRXLXVHQHAXVXIKRXXAERRKI

SEQ ID NO: 191799 - protein, 152 aa, Triticum aestivum
  unsure (1)..(152): unsure at all Xaa locations
  Clone ID: PAT_TA_86217.pep
XIXPIXKVFDTGIFPHWXIILSYXFVQRXWXPKXHIGRSXLRTRREXWLGXXTGIAVNNELANEGDXGSSXXTRRGRSNPAAARRQKKGLSRPRPRQAPPARHFHAKVPPLSETRAARTASPWRRPHPGTSEISSWTLGGGGRASSSRAGTE

SEQ ID NO: 191800 - protein, 191 aa, Triticum aestivum
  unsure (1)..(191): unsure at all Xaa locations
  Clone ID: PAT_TA_86218.pep
EAKPRELPMASTTFSSAFSILSLPSSSPSPSASAPRTLPVANRRRRAVAVASTVTESPKVLELGDAIGRVTLXGGPQPWSDHLQRTSWRLCRSXXPAAAVRGPRRGGGRXGPVRETDFDWXIEEVPXRAYPTSRARLTNWRRSKFYGSQRKEHLGQAKRQQSRIQSKQVTPFPILKTLTPNSVFKDFLKKK

SEQ ID NO: 191801 - protein, 111 aa, Triticum aestivum
  unsure (1)..(111): unsure at all Xaa locations
  Clone ID: PAT_TA_86219.pep
LQDNRLIFNKNGAIYSANLSSTSWSFYDKSGSLLSQLIIAQKGDANTTLAAVLGEDGSIAFYMLQSGNGKTNLPTPIPQDSXCDTPTHCKPYSICNXGTGCQCLPRVFSKL

SEQ ID NO: 191802 - protein, 116 aa, Triticum aestivum
  unsure (1)..(116): unsure at all Xaa locations
  Clone ID: PAT_TA_86220.pep
MRECISIHIGQAGIQVGNACWELYCLEHGIQPDGQTNGDKTIGGGDDAFNTFFXETGSRQVXPRAVFVXXTTVIDEVRTTPTAVFNPTLINXRRTGKICRGTTNKNCGFSWTHPQL

SEQ ID NO: 191803 - protein, 102 aa, Triticum aestivum
  unsure (1)..(102): unsure at all Xaa locations
  Clone ID: PAT_TA_86221.pep
HGSQXKXERXFXHXDARWXSGRGFGXXLXRRXXTLKKMVPXNVVAXVDDKSFPXXXXTXRPHXHXSDQRSASQLRRSEVXIKSREAXRRGAPLRQYMSAATS

SEQ ID NO: 191804 - protein, 128 aa, Triticum aestivum
  unsure (1)..(128): unsure at all Xaa locations
  Clone ID: PAT_TA_86222.pep
AGNPLTIAEPSQHEAHREAAQNPQELTASASSYYKSTRQIHSPTQSMQQQLSKRQFRGLINTXXLRRCQISHGGXRSGPLVYQQQAQGGGRRCILFHVLLFSPRGSXFEASNPGQLFXPAXGKPPAER

SEQ ID NO: 191805 - protein, 138 aa, Triticum aestivum
  unsure (1)..(138): unsure at all Xaa locations
  Clone ID: PAT_TA_86223.pep
MAPKAAEKKPVATAEKTTAGKKPKAEKRAPATKEAGGEGKTRGRKKGSKPRRAFETXKIYIFXVSNKXTPDIRISSQGIXIMXSXHQQIXXELPXRSRQLARXNKTHITSRRXQLRSLSSPGXXQHAXSXGXRRHISS

SEQ ID NO: 191806 - protein, 156 aa, Triticum aestivum
  unsure (1)..(156): unsure at all Xaa locations
  Clone ID: PAT_TA_86224.pep
MALSVSSLASAFSHLSLPSTSXPHXPPLLRLPTTRRAARLVLFASGAXAAEPVLEAEAPAADDGPXEVLAVDVDEDALSGLALXKYVKQXLPGGFXXQRIXATGRXXMASARXLLXEGXGKVFINFXDAXEYLXXXPXXVXYCKXPGLTSLNLRSA

SEQ ID NO: 191807 - protein, 80 aa, Triticum aestivum
  unsure (1)..(80): unsure at all Xaa locations
  Clone ID: PAT_TA_86225.pep
VETRAARXLGRGXGSQRDNCXGRRLPWEVXTFXNPLRGGXGWHGLDSNKDEVKHQAYLTGTPSSHSMRNNSGKIMDPPAV

SEQ ID NO: 191808 - protein, 120 aa, Triticum aestivum
  unsure (1)..(120): unsure at all Xaa locations
  Clone ID: PAT_TA_86226.pep
PLARSAAMRSKANGRHRVQGLRQEQDGHRRRRQAEARPHPLLPPSWADSGHSTWRRPPRQRASAAVTKGGWGESXARCSGWREKANYGGKKQSPNKARRLNKKESTTPKKTKTXAGRRXF

SEQ ID NO: 191809 - protein, 103 aa, Triticum aestivum
  Clone ID: PAT_TA_86227.pep
CPGQVSSTGTEDAAPAPGLRRADGRNSSMMTKAAITSGSRLNPASSSSWLQHIFPIPDCLLPSRTEGGETRSFLAWLGGRGGRREEVVLSWGSGISAASILKT

SEQ ID NO: 191810 - protein, 85 aa, Triticum aestivum
  Clone ID: PAT_TA_86228.pep
APTGPTKPASQQWPAPLSSSSPSSWSPSRWRHSPTPRARRPRPRRRPKRRRPPPARPPTRPPLTPQPPDPPLRMHREPAVQHSDD

SEQ ID NO: 191811 - protein, 156 aa, Triticum aestivum
  Clone ID: PAT_TA_86229.pep
LSSAEKERKQGFFAALKEEVVRGLSPARSRGKTPARSASPARMLIPRRRKAPPPPPEKQMEQQQYLPEQLIARSGNLRPGGEVLPLNGPTPTAPADSERIPAAGGFGGPRQLTPLVQFGSRRPGVGLRDRTRSLGYGARRHSQLRCLFIGTMIFII

SEQ ID NO: 191812 - protein, 110 aa, Triticum aestivum
  unsure (1)..(110): unsure at all Xaa locations
  Clone ID: PAT_TA_86230.pep
MAAPRGAAVVLAMVLAAMVVAPPATVHAAISCSTVYSTLMPCLXYVQQAGSPARGCCTGIQXNLLAEANNSPDRRTXCGCLQNFANGASGGPTXXGAAGSPQMELASPKS

SEQ ID NO: 191813 - protein, 98 aa, Triticum aestivum
  unsure (1)..(98): unsure at all Xaa locations
  Clone ID: PAT_TA_86231.pep
HSFLPSLLLAFFLLPQGENPRRIDPISIPSPDFLHLQTPTAIRSPSTCAPAQSHSPPSLLIPLPFPTSKPPPPPLPPRPPSPSPSRTAAALLXPRRXF

SEQ ID NO: 191814 - protein, 59 aa, Triticum aestivum
  Clone ID: PAT_TA_86232.pep
YYTVKVTGKESVEKFICPHKEAAPHLTEDYEKGEVPTRFKICLNQDWSRRTVTLNPSFQ

SEQ ID NO: 191815 - protein, 92 aa, Triticum aestivum
  unsure (1)..(92): unsure at all Xaa locations
  Clone ID: PAT_TA_86233.pep
MAKVXPNLAVPSLGMAAAXAARXDXPVTLTVWXKXLLFNCRGFTVXDXSGKLVYRVDIYXSDXRAXVXVLMDAXGXPCSTXXXXEGISLMGD

SEQ ID NO: 191816 - protein, 97 aa, Triticum aestivum
  unsure (1)..(97): unsure at all Xaa locations
  Clone ID: PAT_TA_86234.pep
DRLRSLGGRIQEMVGDVASHVERARCVMTWRDPRATTMYLLVCLCLAVGHVPSRRSRRWALLSGFYLMRHPSXRKXLPDXPGNXFRRLPCKVGLPAD

SEQ ID NO: 191817 - protein, 87 aa, Triticum aestivum
  unsure (1)..(87): unsure at all Xaa locations
  Clone ID: PAT_TA_86235.pep
SFKRXRCLTDRXSTRFKXCXQEEEKXSRIXQKFHWGXXLCSVRPAGIPADVQFRILLGAACSXSVPLWPNAFYGPAEAFRVCRLCTC

SEQ ID NO: 191818 - protein, 73 aa, Triticum aestivum
  unsure (1)..(73): unsure at all Xaa locations
  Clone ID: PAT_TA_86236.pep
PSSLSPALASXLSRXQWXPGPRRRACWRCWWPARSWPATRAXAASXQPHXTXXPSRIXPXPXIPTPCSPLXSS

SEQ ID NO: 191819 - protein, 68 aa, Triticum aestivum
  unsure (1)..(68): unsure at all Xaa locations
  Clone ID: PAT_TA_86237.pep
LHPXTGXWXLXXFXCGXXRRTGGVXXMLLIRTVRSLLEGSXRDAXTXMSKRXXSGXIGRWEGEAXGGG

SEQ ID NO: 191820 - protein, 130 aa, Triticum aestivum
  unsure (1)..(130): unsure at all Xaa locations
  Clone ID: PAT_TA_86238.pep
EPPLQLAHSPSPSGRLLPSHHHPASYPAPPPXSPSPASPRRRLAPXPAPFAPPPSLAPXGXASYPASFXHAATTPPSPASSPPGSTXPSPXSPXPDPSMGRAGGDHAWSGRSTAAVGLTPARHRIGWVWG

SEQ ID NO: 191821 - protein, 74 aa, Triticum aestivum
  Clone ID: PAT_TA_86239.pep
RRPSPPDPDDHPSIHPPWTTPRATASRRPPPPPPPARPPRRRRRPRRSSRCRRAASRWRTSSSASTWTPRRAPR

SEQ ID NO: 191822 - protein, 60 aa, Triticum aestivum
  unsure (1)..(60): unsure at all Xaa locations
  Clone ID: PAT_TA_86240.pep
HLEVVSALSLNCELPYVCMYISIETLCSLLLLILDINTHRXTNGSQINSVKMXESIFQTY

SEQ ID NO: 191823 - protein, 141 aa, Triticum aestivum
  Clone ID: PAT_TA_86241.pep
MAPKADKKPAAENKVEKAAEKTPAGKKPKAEKRLPAGKTASKEAGGEAKTRGRKKGSKAKKGVETYKIYIFKVLKQVHPDIGISSKAMSIMNSFINDIFEKLAGESAKLARYNKKPHHSREIQTPSLVSPASRKASRRNKA

SEQ ID NO: 191824 - protein, 92 aa, Triticum aestivum
  unsure (1)..(92): unsure at all Xaa locations
  Clone ID: PAT_TA_86242.pep
QXELACXECDHKPLELNASILPXXSFXQRCVPPQPNXDITNLSFEAVLLLVYSRFVCIENRSEVFCSRYAKLVKGAPIVSSLQEVLVQVAMI

SEQ ID NO: 191825 - protein, 81 aa, Triticum aestivum
  Clone ID: PAT_TA_86243.pep
GCCCHGGSKESNIVRRKLEKRQQGRTLDSHIEEQFSVGRLLACISSRPGQCGRADGYILEGKELEFYMRKLQKKKGKGATA

SEQ ID NO: 191826 - protein, 51 aa, Triticum aestivum
  Clone ID: PAT_TA_86244.pep
SSDRKIACRCLKSLATSIKSINMGKVSGVPGKCGVSVPFPISMSTNCDTVN

SEQ ID NO: 191827 - protein, 118 aa, Triticum aestivum
  unsure (1)..(118): unsure at all Xaa locations
  Clone ID: PAT_TA_86245.pep
WASPIDASWPWQCPAMELKNALSTSSEASLLTRHKTYSITVASQGSVILPPSLLAKPNSSPAILXSSTKTSAEVRQRELXRHPFXRVXTQWALSATXCNTHWLXATSXXXTFXAILGN

SEQ ID NO: 191828 - protein, 125 aa, Triticum aestivum
  unsure (1)..(125): unsure at all Xaa locations
  Clone ID: PAT_TA_86246.pep
SPSPLPRFVGSSSLLSPRARAHVRSLMGKKGLVVVTSILAVLTVVFGVISAVLLALKHHQDDHGEFSTYRRSPAMPCGVVAAILASMTQILAXVAICCCGAWRMTKGAXRIAAVGFFITHGXSRS

SEQ ID NO: 191829 - protein, 155 aa, Triticum aestivum
  unsure (1)..(155): unsure at all Xaa locations
  Clone ID: PAT_TA_86247.pep
LPSLATTHSQGECLAAAATAGAAPAASAATAAXGARCSPTWXPPPARXPWXCPPPPTRGAPAGSRWXAGRPXAATAPPASAXPRAAAXAAXATDPAPXRPVGEXKHXDXEDKAQHHQFTTKLYHNRMKRPRRALNKIKHVRVLILNAVVHNVFGS

SEQ ID NO: 191830 - protein, 131 aa, Triticum aestivum
  unsure (1)..(131): unsure at all Xaa locations
  Clone ID: PAT_TA_86248.pep
PSNHHQASPAAPPQASPRSISPGRPLTTTFPALRPASTPSFLASHRPTVAPHYSIPSLVDEEGRIQALRTRTMPRHRKRLHLPMPREARCEGYHGRAGPCGGCELPRRWIGAXPPPGVEIVRPGHYAPGPP

SEQ ID NO: 191831 - protein, 136 aa, Triticum aestivum
  unsure (1)..(136): unsure at all Xaa locations
  Clone ID: PAT_TA_86249.pep
MASTFSGDETAPFFGFLGAAAALVFSCMGAAYGTAKSGVGVASMGVMRPELVMKSIVPVVMAGVLGIYXLIIAVIISTGINPRAKPXLXDGYAHXLSGLACGLAGLAAGMASASARRRAKRRSQAVGMIPNLRNLP

SEQ ID NO: 191832 - protein, 179 aa, Triticum aestivum
  unsure (1)..(179): unsure at all Xaa locations
  Clone ID: PAT_TA_86250.pep
XPXXSAADYXXIIIVXLRWDDFPTPWXADNXXCQXSXLSASLIGIKRXSLSTXFPSTYLHCLXIRQLLKQLQVKRAWLIRNFFYPCQLRRLASWIIVNESWSSSALEKSLASLKEFGDMTSDGGSSHDKDLENDPISGDLDTICGDAVMKFSVEYSSLLLLSQRNGPSGSSTDTGLGWS

SEQ ID NO: 191833 - protein, 131 aa, Triticum aestivum
  unsure (1)..(131): unsure at all Xaa locations
  Clone ID: PAT_TA_86251.pep
MRECISIHIGQAGIQVGNACWELYCLEHGIQPDGQMPGDKTVGGGDDAFNTFFSETGAGKHVPRAVFVDXKPTVIDEVRTGXYGQLFNPEQAYIGKEDAAXNFXRGHXTIXKXIVYSGLNCSRNFKAMVIF

SEQ ID NO: 191834 - protein, 45 aa, Triticum aestivum
  Clone ID: PAT_TA_86252.pep
FSNGTCKGCSFWGYDRVTNWFPFNEMESCTTGRTQHQWRMKNDYK

SEQ ID NO: 191835 - protein, 163 aa, Triticum aestivum
  unsure (1)..(163): unsure at all Xaa locations
  Clone ID: PAT_TA_86253.pep
GSLPGTLARPRTIHSLSPSSRLLLXTESSAGARAVAAPSLLLPRPMSSPALLELSRRTSTLNFIFPEQRFELGXPVRSPSTSSSTRISPPSXRRSALLRPPRASXSAPSAPVTLESRSQDATVDDDCYYSGSAYYYXQAADDXXSSLGGSKQEASPLHRTQXG

SEQ ID NO: 191836 - protein, 72 aa, Triticum aestivum
  Clone ID: PAT_TA_86254.pep
YIVGGSRPINIEIMMAARLRHKYKDIYKIDSSHMMFHNLKFCQLWAVREVMHHHYLLILMKKTRVRKLINKY

SEQ ID NO: 191837 - protein, 104 aa, Triticum aestivum
  unsure (1)..(104): unsure at all Xaa locations
  Clone ID: PAT_TA_86255.pep
KKXEKKKNFXNDXQGSITDGRKHXRFQPKTHGXXDGGNKXFVXTSKLVPVPSNQLGGSRQKIPPTHHGCNVLNHPVVTNRIADSQQFSFTDSQHGCGRIPARRP

SEQ ID NO: 191838 - protein, 168 aa, Triticum aestivum
  unsure (1)..(168): unsure at all Xaa locations
  Clone ID: PAT_TA_86256.pep
RSPAXRGXKKPXCPVYGIXXLXPNXXANXKADPNXTASXSAFVXRKLHQIICEALERXSGGPXQGWXFXPPTAHMXTRHRPRGGRRRRRTRRARSRTPRRSAGPRGGGGRRRQGGPQEAARRGNGGRREGGEGGRWRRPGSTSFSPATGQSLSTDSGDWDAVTCEAVG

SEQ ID NO: 191839 - protein, 146 aa, Triticum aestivum
  unsure (1)..(146): unsure at all Xaa locations
  Clone ID: PAT_TA_86257.pep
AAXMASSDSPPPGKPPLPWRVRLLVGAASFLHSASLRADXTVNRSLLSLFERTVPPSSAPDAAGVSSTDHAVLSHLRXRLFXPAPAAXGSQSQLPVVVYFHXXGSFXIXWXTASXTSXRRXXRXXXAVXPSVDYRXRRSRSLLPPD

SEQ ID NO: 191840 - protein, 168 aa, Triticum aestivum
  unsure (1)..(168): unsure at all Xaa locations
  Clone ID: PAT_TA_86258.pep
SLPNIPCSSHGVPHLVKGTWVNQHSTLADRTCSRVSNPAISTQLPCLQYRNFCRHNGMALSQPFFQKFFRTALTQVGARIAKKRSQEQPHLTSASADSTAACHIHKPPIGAAEPGGKGPVLLAGRDPDDDSRRTISXRXAXXTENSXHNGXSGREPQGIAXXXGXTIP

SEQ ID NO: 191841 - protein, 68 aa, Triticum aestivum
  Clone ID: PAT_TA_86259.pep
LQAAAISGVVALGFRRANSEQRFGESDEGFVEITLQFEMDRIAEGSGRSGAILAGFVRRRCRAEEELG

SEQ ID NO: 191842 - protein, 121 aa, Triticum aestivum
  unsure (1)..(121): unsure at all Xaa locations
  Clone ID: PAT_TA_86260.pep
KVVEVSTSKTGKHGHAKCHFVAIDIFNGKKLEDIVPSSHNCDVPHVDRQDYQLIDITDDGYVSLLTESGNTKDDLKLPTDDVLLGPDQDWDLLMGKDLILSVMSAMGEEQXCAVKETGGGK

SEQ ID NO: 191843 - protein, 49 aa, Triticum aestivum
  Clone ID: PAT_TA_86261.pep
KILVKSVSRRTDEINHFTNMQTIINKSQVNPLLFTSASNKNKVSKAASR

SEQ ID NO: 191844 - protein, 186 aa, Triticum aestivum
  unsure (1)..(186): unsure at all Xaa locations
  Clone ID: PAT_TA_86262.pep
HSAAPAPMALCRTAPANSSCFHPRAVASSPSSLSVGTKVFVGLKAQTRLGSSESSCPNVNARFYTAVNRRVSLGLSNKRATKGTYFHDACPAPHGYRYKNTWVKEPGNGLDIWECFISVNGYLHWGTLLMKXSITKLLGNMLYLDSVDDTKEDPLYINGPRXDLHMHGVYIHAKPKDQLDSXLGFX

SEQ ID NO: 191845 - protein, 179 aa, Triticum aestivum
  unsure (1)..(179): unsure at all Xaa locations
  Clone ID: PAT_TA_86263.pep
RLHRPQPLQQPQEATKVGGVQGRQQPLLERGDDQWPQLPAVLSARPRRPHGGARDNLPRQQQQNAPAQHPPQHDVGVSQHRFRVGLGQHRPYSXGGVNSMFQAVDSRTTSPSTILLRGHTLPXKEDEWRHHKLPQRRSTSKGITPTXVRWRTLLTGIYXSIQLNNSXLRNRYNMAHGAS

SEQ ID NO: 191846 - protein, 109 aa, Triticum aestivum
  Clone ID: PAT_TA_86264.pep
MDDVVTDAPPPSRFSPDDLDNFAAPLPQPTPILVVSPNPKPRPAAPRRPISPTSLALLPSPPPPLHASLLLPDLRLRGHAARGGGARRRSEGRGQGLRPGRVGRAVYLR

SEQ ID NO: 191847 - protein, 163 aa, Triticum aestivum
  unsure (1)..(163): unsure at all Xaa locations
  Clone ID: PAT_TA_86265.pep
MANPRVFFDMTVGGAPAGRIVMELYKDAVPRTVENFRALCTGEKGVGKSGKPLHYKGNAFXRVIPRLQXPRAGDFNRGQPEPGXDSIXXEXFPXPKXRPXKHNKPRVFPQWXTPGXNXKGPNXFXIWNVPCXWXXRKQLPARPPMFFKKSKRSPDSTGIGQLN

SEQ ID NO: 191848 - protein, 165 aa, Triticum aestivum
  unsure (1)..(165): unsure at all Xaa locations
  Clone ID: PAT_TA_86266.pep
MRECISIHIGQAGIQVGNACWELYCLEHGIQPDGQMPGDKTVGGGDDAFNTFFKRXTGAGKHSPVLSSVDFEPTVIDXVKDWRLTPSPSNPEQLIXGKEDAANNFARGHXYTIGQGIVDPCLDRIKNFSNNCTGSXXILVXNAXGGXMVAWSFGLLTWKNQTWVS

SEQ ID NO: 191849 - protein, 74 aa, Triticum aestivum
  Clone ID: PAT_TA_86267.pep
RREGEMKRQRESVPWGEEKNHAAFSPLSRTRRKRPSGGVLIAGCCPCLPRAAAADAGEQHREPGQRRGRGRALR

SEQ ID NO: 191850 - protein, 90 aa, Triticum aestivum
  unsure (1)..(90): unsure at all Xaa locations
  Clone ID: PAT_TA_86268.pep
LVIISGHGLQXXWAXFDPPFWAAXXNDGCXWRGHAHDEGLGVVFTPSSISGXHLALACTRTIIIQSGLTKDPVNLSQEIDRQTGCSCASL

SEQ ID NO: 191851 - protein, 91 aa, Triticum aestivum
  unsure (1)..(91): unsure at all Xaa locations
  Clone ID: PAT_TA_86269.pep
SYGISTFWDLHIMLTPHGTPEGSCAKXLTFPAFPTWVFNGWRRYNXSLKSEQXKTKPRGTRQHGRRYPSTXTXGNTKDPXXQXKSLNVRXK

SEQ ID NO: 191852 - protein, 124 aa, Triticum aestivum
  unsure (1)..(124): unsure at all Xaa locations
  Clone ID: PAT_TA_86270.pep
MARLNSKAVAAAVVLAAVVLMMAGREASAALSCGQVDSKLAPCVAYVTGRASSIXSKECCSGVXGLNGLARSSPDRKIACKCLKEPPPTSIKSINMGXVSGVPGXXGVSVPFPINMSTNCNNVN

SEQ ID NO: 191853 - protein, 164 aa, Triticum aestivum
  unsure (1)..(164): unsure at all Xaa locations
  Clone ID: PAT_TA_86271.pep
MANPRVFFDMTVGGAPAGRIVMELYKDAVPRTVENFRALCTGEKGVGKSGKPLHYKGSAFHRVIPDFMCQGGDFNQGATAPGGESIYGEXFADENSVHKHTXPGILSXMANAGXNTNGPILNLXVPCNXFQXXHXVFRXAXXGWTLXKSXRGSXXGTVKQVSSG

SEQ ID NO: 191854 - protein, 77 aa, Triticum aestivum
  unsure (1)..(77): unsure at all Xaa locations
  Clone ID: PAT_TA_86272.pep
FFSRFFSPKXGVXEARFVASAHCAVAPYWVRXAGEQEITAFXSIXKDGTLYLEFNAANQRIKIQGQAVTVMVGTLLA

SEQ ID NO: 191855 - protein, 141 aa, Triticum aestivum
  unsure (1)..(141): unsure at all Xaa locations
  Clone ID: PAT_TA_86273.pep
KGELGLXIXXXGVFXKKMSRCXFXTPSMVXXPGXYPXXSQGVSHVWXXXALAEXFGEVXVXKFGWXXFXTXWGKXHXVXAXXXIXFRXXCXTGSLRRGANLAREGNEIIRAACKWSPELAAACEVWKAIKFEFEPVDTIDK

SEQ ID NO: 191856 - protein, 171 aa, Triticum aestivum
  unsure (1)..(171): unsure at all Xaa locations
  Clone ID: PAT_TA_86274.pep
LLLLLLVDQRRLSRPLPPRARTPPPVADPAQLPTHTAPDHLSSYASSVRLRRRTTGATYSPRAPAAPPCAEYCSPPPAADPAHPSISGRGSGCSHPPPARLRRRSTAAPRRSESLGYFLPPSFNKRLRSSSPAXQPVSYPLPSRCSSXVRXLGAVQXXTTILPRHSQLAQC

SEQ ID NO: 191857 - protein, 134 aa, Triticum aestivum
  unsure (1)..(134): unsure at all Xaa locations
  Clone ID: PAT_TA_86275.pep
RNPAPNPTPPRAAAAGGIAAVRADCDKALAYLQRGNPSKALRLLRDAVARHGEGSPLLLRAQGTVHSRAAAPLNDPAARARHHRAALXAARRAVELAPDSLELXHFHALLLYXAAXGNRDYXDVIAXCDRXLRI

SEQ ID NO: 191858 - protein, 171 aa, Triticum aestivum
  unsure (1)..(171): unsure at all Xaa locations
  Clone ID: PAT_TA_86276.pep
LRTLAAKKTLGLALGGARGVATFTLPDLPYDYGALEPAVSGEIMRLHHQKHHATYVANYNKALEQLXDAAVAKGDASAVVHLQSAIXFNGGGHVNHSXSGRTQPINEGGGEXPHGKLCWXPXDEILGXIEKXIKKMNAKGAALKXSGWXWXALGKEQXFNLNLIRTLLTKN

SEQ ID NO: 191859 - protein, 127 aa, Triticum aestivum
  unsure (1)..(127): unsure at all Xaa locations
  Clone ID: PAT_TA_86277.pep
MAQSMLMSGVNGVASGRSLLQAARPSSASTPFSRLALSSSSSAAAYYKHMPSLSVRTMALFGKKTKAAPAKKSVAPKPKTEDGIFGTXGGIGSTKENXLFXGVLHDWFAASILGKASXXGILSQLNX

SEQ ID NO: 191860 - protein, 106 aa, Triticum aestivum
  unsure (1)..(106): unsure at all Xaa locations
  Clone ID: PAT_TA_86278.pep
MKFIAAYLLAYLSGNASPSAEDLTSILESVGCEIDNEKMELMLSQVKGKDITELLAAXGRENLLRSIWVGGGVAVSAAAPAAGXAAAPAAESKKEEKXXEKEESDE

SEQ ID NO: 191861 - protein, 87 aa, Triticum aestivum
  unsure (1)..(87): unsure at all Xaa locations
  Clone ID: PAT_TA_86279.pep
KKGSLGTIAPIAIGFIVGANILVGGAFSGASMNPAVSFGPALVSWEWGYQXWVYWVXGPLIGGGLAGVIYELLFISRTHEQXPTTDY

SEQ ID NO: 191862 - protein, 86 aa, Triticum aestivum
  Clone ID: PAT_TA_86280.pep
FFFFFFLRAKPQLHIYFLLMFMHSAKWHQVSASQTQSYNILSFSSVNIHVYKTRTHSITNQDTVHSCTSRLRNNHLKSRASHRVYN

SEQ ID NO: 191863 - protein, 74 aa, Triticum aestivum
  Clone ID: PAT_TA_86281.pep
PAVSDPAANSSIVAGSDLVVKPASLVTKPASLTTSTSTPEVDKKRSSGAISDKDVGITANKPRPPACDVSKQIN

SEQ ID NO: 191864 - protein, 58 aa, Triticum aestivum
  Clone ID: PAT_TA_86282.pep
ARSLGAAVIYNKKAAWDNHWIFWVGPLVGALAAAAYHQYILRAAAIKALGSFRSNRSN

SEQ ID NO: 191865 - protein, 50 aa, Triticum aestivum
  unsure (1)..(50): unsure at all Xaa locations
  Clone ID: PAT_TA_86283.pep
SRVXYTXVKNTXILXDXGSTIYILXNXTXLXXLSRVIWFSHSKPRHVSNG

SEQ ID NO: 191866 - protein, 85 aa, Triticum aestivum
  unsure (1)..(85): unsure at all Xaa locations
  Clone ID: PAT_TA_86284.pep
NSSQSLAPAXPXXAAXAXXEXPPSQTLKXXGGXPRNFFPXNXRFFXTTQKGAKXDQXRXXRVXXXFXKNXGPWVSKXQGKPXEXT

SEQ ID NO: 191867 - protein, 52 aa, Triticum aestivum
  unsure (1)..(52): unsure at all Xaa locations
  Clone ID: PAT_TA_86285.pep
ASRGYXVVAPHWXSMRENAPFXRRVXSKQTTTNXKLXGLSKNSXQXXNSPKK

SEQ ID NO: 191868 - protein, 173 aa, Triticum aestivum
  unsure (1)..(173): unsure at all Xaa locations
  Clone ID: PAT_TA_86286.pep
MARTKQTARKSTGGKAPRKQLATKAARKSAPATGGVKXAHRFRPGTVASARFRXYQKETECHPQXPXXRLLRXFAQXFKTXRFQSSGXFRPGKRPPXLICGVFXGTTSCASKPXXTSCPRNQXARRIRCKRPRPIPMFRQLTCPWNAILSSWINCRLIFCYINLLQKKRGPIP

SEQ ID NO: 191869 - protein, 108 aa, Triticum aestivum
  unsure (1)..(108): unsure at all Xaa locations
  Clone ID: PAT_TA_86287.pep
PVKXPQPDGIIGPDPYXFXFDRXGXRVXFPKSPWVYKXXVXXEXNCPKGDXQYEHXSIPAXXXKXFXLRAXYLTKKDAWAGNXXTXSKIRKTPKNDFPKKQRFKNPRV

SEQ ID NO: 191870 - protein, 87 aa, Triticum aestivum
  unsure (1)..(87): unsure at all Xaa locations
  Clone ID: PAT_TA_86288.pep
DDVVAGVHPPPPPRARGAPAPSPRLRAALPRRRRSCAKEQETXRXLAVVXRATRSWPRRPGPRLKQRVPXLKXKAKXTWRKRAXPKX

SEQ ID NO: 191871 - protein, 137 aa, Triticum aestivum
  unsure (1)..(137): unsure at all Xaa locations
  Clone ID: PAT_TA_86289.pep
RSPPPPSRRAVATAPPPMASSAAGAGKSLIQTFRKFFKKPWEITGPXLLARXRNAXPGALXXRXNXPGNLXKEXLRXLIQTSXPXTXXEXXXTREMXXKXPXXXQTLLXXPXXSAXMAXKXFDPXKDSRPQXNXAVX

SEQ ID NO: 191872 - protein, 80 aa, Triticum aestivum
  unsure (1)..(80): unsure at all Xaa locations
  Clone ID: PAT_TA_86290.pep
KTFPXXTPGXSKTHXXGKXXGXGSLKKGGPFWGKXXEGKKEXPVXPEGGRGGSPKREGKXEERGGXRWPIAWRPGWEEFA

SEQ ID NO: 191873 - protein, 70 aa, Triticum aestivum
  unsure (1)..(70): unsure at all Xaa locations
  Clone ID: PAT_TA_86291.pep
XHRTQESRNNPKTNEANQKRELIXKGRLLGPPGKKQGFLXXKXGFLGXSPEGXGPPKGXTFKKXCRXYQX

SEQ ID NO: 191874 - protein, 131 aa, Triticum aestivum
  unsure (1)..(131): unsure at all Xaa locations
  Clone ID: PAT_TA_86292.pep
LSPPSXTPSPSXASPSSSXKSLXLASXPXSKRSMDPSSSPSAAPARSRXWSSSXALSLFSFMDSTVDPSLSTSVALSPSXXPSSWTSLGTAXPSILXPLSSPSASSXSSSXSKXSPKKKSPXSTINVMSSG

SEQ ID NO: 191875 - protein, 89 aa, Triticum aestivum
  unsure (1)..(89): unsure at all Xaa locations
  Clone ID: PAT_TA_86293.pep
LXTGXTIGYSXNVFLXXFXLXWPXAGXERGXXXGGGWPDXRXWXAPSVRGXGGDADGAAGGRXAXELGGSGARRGRRRGRATVRWRAXS

SEQ ID NO: 191876 - protein, 60 aa, Triticum aestivum
  unsure (1)..(60): unsure at all Xaa locations
  Clone ID: PAT_TA_86294.pep
YIXXSXHFNXSDKVXEVPXGVPDHXSCXNKLAHXLPMEAAAASKXNLFIRETVELSKAVN

SEQ ID NO: 191877 - protein, 136 aa, Triticum aestivum
  unsure (1)..(136): unsure at all Xaa locations
  Clone ID: PAT_TA_86295.pep
KIYFXLKXKGAFSEAXPLXEERRXRVPGSGTRTKFGCLXEEETPKFXXTKVIPCWLCGVXTRTQESPNMDADSGGHRGDQELASSIGLLSGPCDTSTVHRRLQAEDTEEAYGAQTQPSKDGHHVAALAVGMPAAED

SEQ ID NO: 191878 - protein, 57 aa, Triticum aestivum
  Clone ID: PAT_TA_86296.pep
DVEDGKVVRHQDWWDKKPLKNRETVSFPLLGRLAQTSRRGAMLLTHVLMGFGKDPTP

SEQ ID NO: 191879 - protein, 148 aa, Triticum aestivum
  unsure (1)..(148): unsure at all Xaa locations
  Clone ID: PAT_TA_86297.pep
PAPPXTPKWRPPPPPSSPSPRSASPTADSLPPPPARPPASGRSPRRRRPPPPSPGPAGGAGERAALGAPTGRHRRGGLPPRARPHASVRRRGTHRGISGRERTAHLPSLKVFRIRRGRLRLRQTLYPHTIASKFIQPRLYITSNYFTP

SEQ ID NO: 191880 - protein, 107 aa, Triticum aestivum
  unsure (1)..(107): unsure at all Xaa locations
  Clone ID: PAT_TA_86298.pep
WAALRWRSGQRSGPSGFGLGGGKARRGRAVGQSIGLRRPQPFFLSLSFAVGLGLGLGXRGXKVSNLRGGRLAAHSRVYYRMRRRRELFMPVPLVVGLACEESWGERG

SEQ ID NO: 191881 - protein, 162 aa, Triticum aestivum
  unsure (1)..(162): unsure at all Xaa locations
  Clone ID: PAT_TA_86299.pep
MANPRVFFDMTVGGAPAGRIVMELYKDAVPRTVENXRALCTGEKGVXGKSGKPAALQGXAFHRVIPXTSMCQXRDXNPXGNGTRRRSIXTARFPXQNFVHXTQXXFSXMXNAGQXXVPFXIXTSPXICPTLVLQGWTSKQKPGTQQVSRGNAGVFFPFPFVQ

SEQ ID NO: 191882 - protein, 74 aa, Triticum aestivum
  Clone ID: PAT_TA_86300.pep
EPRPHPQPSPSSRPPASGPPLPPPPASPTAVVPASPPWPPPPPPSARRPRARPPPSSPRPRRSPSSRWALCQSR

SEQ ID NO: 191883 - protein, 93 aa, Triticum aestivum
  unsure (1)..(93): unsure at all Xaa locations
  Clone ID: PAT_TA_86301.pep
MASKRILKELKDLQKDPPTSCSASXVGXEXFQWEAYHXXLRXXLTXLFFGKLFSKXLPFNPPKXXFRTRXFHPKXKRNGHXLXXXKEKWXPFY

SEQ ID NO: 191884 - protein, 115 aa, Triticum aestivum
  unsure (1)..(115): unsure at all Xaa locations
  Clone ID: PAT_TA_86302.pep
MSDTDEHHFESKADSGASKTYPQQAGAIRKGGHIVIKARPCKVVEVSTSKTGKHGHAKCHFVAIDIFNGKKLEDIVPSSHNCDXPHVDRQDYQLXDITDDGXVSLLTESGNTKDX

SEQ ID NO: 191885 - protein, 117 aa, Triticum aestivum
  unsure (1)..(117): unsure at all Xaa locations
  Clone ID: PAT_TA_86303.pep
SDQEKESGDPPAPAAIWEPPPKSXAXPTHQCSMPQPLAQXCRRPMLHHGNRPAGAXSSRPRGGHPPHPVANGARTGVVHHGLEHGRAPHGAMAEQHVSPPPPPHALAGEATPPPPAR

SEQ ID NO: 191886 - protein, 89 aa, Triticum aestivum
  unsure (1)..(89): unsure at all Xaa locations
  Clone ID: PAT_TA_86304.pep
VDNTPVNXPFGQSNGTGRFSIKPSRNVXLHHPATTRDDNXXLQHGLXNPGAXNCHLGPPAXEGPRPPGGREXXATLXNXGXGPXTXXDG

SEQ ID NO: 191887 - protein, 67 aa, Triticum aestivum
  Clone ID: PAT_TA_86305.pep
RCIGLVLELKMHRRQRRCMSGRESEDIYGLNSNSIEGSGGACPVRAARFLMQQPQCCIFATLRAVYL

SEQ ID NO: 191888 - protein, 110 aa, Triticum aestivum
  unsure (1)..(110): unsure at all Xaa locations
  Clone ID: PAT_TA_86306.pep
PPSTPSAAPPHTRRRASRRPPCTSTPPRPISWRRPSTPPSSRRDPLXRVAPPRRVAFLPSPRLSFKAVVLERARRAQGLLQLKKRWVLPLCCCVPGKAPVGNVKKRHCSA

SEQ ID NO: 191889 - protein, 50 aa, Triticum aestivum
  Clone ID: PAT_TA_86307.pep
PTTFDSHQHRTKPFSTTTQNLKGAKELNQGVGFTTRLFQPVCIMSQVTRL

SEQ ID NO: 191890 - protein, 137 aa, Triticum aestivum
  unsure (1)..(137): unsure at all Xaa locations
  Clone ID: PAT_TA_86308.pep
MAPKAEKKPAAKKPAEEEPAAEKAEKAPAGKKPKAEKRLPSAGKTSAKDGDKKSKKKSKKSVETYKIYIFKVLKQVHPDIGISSKAMXIMNSFINDIFEKLAGEAAKLARYNKKPTSLRELLVRSPPEVQTVAQGVT

SEQ ID NO: 191891 - protein, 60 aa, Triticum aestivum
  unsure (1)..(60): unsure at all Xaa locations
  Clone ID: PAT_TA_86309.pep
VGNGXLNXXVGXGXGKXXXGVCXFXFXXXFPXEERCXPPAAPAXTXPRRSLDAIACRLAS

SEQ ID NO: 191892 - protein, 80 aa, Triticum aestivum
  Clone ID: PAT_TA_86310.pep
ERERESNKFRFREVQQQGSWVQRRGKQRAAEGDRQGSSGRNIREEQQQKGRGEEQQQLGRGKGRRRSSWFELRSGGAAAR

SEQ ID NO: 191893 - protein, 140 aa, Triticum aestivum
  Clone ID: PAT_TA_86311.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPLICSAWQKTGLLMEGLIRRMS

SEQ ID NO: 191894 - protein, 65 aa, Triticum aestivum
  unsure (1)..(65): unsure at all Xaa locations
  Clone ID: PAT_TA_86312.pep
YGNKLXRTXXXTIFLQRXFQKEXISGACNCCVKFACCFGGASVTARSYSALVLLYATLLFKLRLM

SEQ ID NO: 191895 - protein, 120 aa, Triticum aestivum
  Clone ID: PAT_TA_86313.pep
PRVQRTLGERFVRFLTKGSRRQRDCDGVVALPLRAPLAWGRVSEAASRSRRRRAKRRPMEAGPAVQGSSEAGRNCRAMAGKIQSSDRDRERAGVRARGGEATWPWPAGGRHGRSRGGDGV

SEQ ID NO: 191896 - protein, 79 aa, Triticum aestivum
  unsure (1)..(79): unsure at all Xaa locations
  Clone ID: PAT_TA_86314.pep
PPGRRRAQRLPRSAFGENFSPARAKGYQFGMVXVFGSVEELDAVEGDGKVEEAKAALRPMLDEVMVLDFVVDAPAAASL

SEQ ID NO: 191897 - protein, 41 aa, Triticum aestivum
  Clone ID: PAT_TA_86315.pep
EQECVKMPLHKACIAYDVKRPSNQQTNLKEININRGVKEET

SEQ ID NO: 191898 - protein, 111 aa, Triticum aestivum
  Clone ID: PAT_TA_86316.pep
ECKSSRRTSRPLLLPAIVVVLAFFVAQCGARVLTVDELLDQYSESDHHSASPPPGSPGCAPEPEASPPPVIPAPSFAYSRPPPPMQFYSPPPPEVVPSPPEDYAKARLKVP

SEQ ID NO: 191899 - protein, 108 aa, Triticum aestivum
  unsure (1)..(108): unsure at all Xaa locations
  Clone ID: PAT_TA_86317.pep
XPRGSLGMXPLLXRYVPXXGDPVQVXFWXPSTPGRPXTGPXPSXXSXPTSSGSPIDVNAYLVRRXKRXCVKANNGLTRVEVQGGNEIVFARCVYDSVSNTQPLCPGKK

SEQ ID NO: 191900 - protein, 75 aa, Triticum aestivum
  unsure (1)..(75): unsure at all Xaa locations
  Clone ID: PAT_TA_86318.pep
RWQLHRFRLRGNDFGWAAPCVRSGRANXFDGKMSGSRPLRDGSVDIEVCFAPDTMAALLRDDEFMQYVSCPAHLL

SEQ ID NO: 191901 - protein, 145 aa, Triticum aestivum
  Clone ID: PAT_TA_86319.pep
LVSAKAKLRQHVTLRRIVLVAAASAAAFILLLTVRTLSASHARSPGAASSTTSPPEAVRRNTQQQQQGGCAKLPGPVAEALVHYATANATLPQTAAEVAMTARLLAQRAPCNLLVFGGLGPTARSGRAQHGGRNAFSRGGPVPRL

SEQ ID NO: 191902 - protein, 62 aa, Triticum aestivum
  Clone ID: PAT_TA_86320.pep
GVQGLNGLARSSPDRKIACRCLKSLATSIKSINMDKVSGVPGKCGVSVPFPISMSTNCNNVN

SEQ ID NO: 191903 - protein, 119 aa, Triticum aestivum
  Clone ID: PAT_TA_86321.pep
MDPGSEVSFEFVPVIRQYRSGRVERLLPVDAVPPSVDAATGVASRDVVFDPANGVWARLYLPARPPDGAGDRLPSWCTQRRRLVGGSAADAPSTRSSTPVRPRARLGCRQYACAGHPSG

SEQ ID NO: 191904 - protein, 56 aa, Triticum aestivum
  Clone ID: PAT_TA_86322.pep
QFVDSDSRFRVQDRNDFETAWSVSKPIQSSPIIVEIQTRPDYITAPDHLNQSKTTH

SEQ ID NO: 191905 - protein, 164 aa, Triticum aestivum
  unsure (1)..(164): unsure at all Xaa locations
  Clone ID: PAT_TA_86323.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNXGGFIFREHNASPGYYDGRYWXTMWKLPMFGCXDATQVINKWKSQEGVPDAYVASSDHNIASACSAHRLNHG

SEQ ID NO: 191906 - protein, 144 aa, Triticum aestivum
  unsure (1)..(144): unsure at all Xaa locations
  Clone ID: PAT_TA_86324.pep
CVATGRFSAPGLRAVVPRDGRHFRLAQAPPSLETAGSXSATXSLVSVWTTVGSLGXSASVSAAAAGSASLASSVSAAAGASSLVASTSTGAGASTSASAGAGTSSVLATSSAATGVSTAGASSVSAAVGFWTSAVAIAVVDARK

SEQ ID NO: 191907 - protein, 146 aa, Triticum aestivum
  unsure (1)..(146): unsure at all Xaa locations
  Clone ID: PAT_TA_86325.pep
MRECISIHIGQAGIQVGNACWELYCLEHGIQPDGQMPGDKTVGGGDDAFNTFFSETGAGKHVPRAVFVDLEPTVIDEVRTGAXAKLFQPEQLISGKEDAANNFARGHYTIGKEIVDRALTYQEASDNCTGLKDPCLNAVGVDWSGL

SEQ ID NO: 191908 - protein, 119 aa, Triticum aestivum
  unsure (1)..(119): unsure at all Xaa locations
  Clone ID: PAT_TA_86326.pep
HSANVATRVXLCPXLAITLILNGVQPVLSCVXGCGWQVFVAYVXVGCYYFVGIPLGLFLGFYLGLGAKGVWSGMVIGGTLLQTLILLWVTFRTDWQHEVEKAHERIAMWEDKKNSLQQD

SEQ ID NO: 191909 - protein, 50 aa, Triticum aestivum
  unsure (1)..(50): unsure at all Xaa locations
  Clone ID: PAT_TA_86327.pep
FSYKILLLGHPDSRTKDTPVFKRRVHSNLSKPANSKHIAAQSSIQXXAAS

SEQ ID NO: 191910 - protein, 106 aa, Triticum aestivum
  unsure (1)..(106): unsure at all Xaa locations
  Clone ID: PAT_TA_86328.pep
MSSSEVACTLAALILHDDGIPITSEKIATVVKAAGIKVEAYWPALFAKLLEKRSVDDLILSVGSGGGGAPAAAAAAPAAGXAAALKRRKXEKKEEAKEXESDDDMG

SEQ ID NO: 191911 - protein, 74 aa, Triticum aestivum
  unsure (1)..(74): unsure at all Xaa locations
  Clone ID: PAT_TA_86329.pep
SQIVSFVGTNSQETPNYKINKKEYEELESEERKERKEDFSDELCHEHITWQRKPMAARVASALTTRLSXGGGPG

SEQ ID NO: 191912 - protein, 114 aa, Triticum aestivum
  unsure (1)..(114): unsure at all Xaa locations
  Clone ID: PAT_TA_86330.pep
LXNTTRIRRLARDVVVPRAAVQVAPFHPSGGAEGARRRRLRGRRELPAREGPSARCPPRXSVXAGAHGVLNRRSEAPGLRRSRRRRAPPLRITQLPGGFXEALLNXRXGDARRX

SEQ ID NO: 191913 - protein, 170 aa, Triticum aestivum
  unsure (1)..(170): unsure at all Xaa locations
  Clone ID: PAT_TA_86331.pep
PIPSLILINSTHXNSSTQYPIKIRXELXQIPKFKEQLPXXPKFGSTAAATPNSAMSSCSFSVDGCLLVKCTCSFSYFRHRGRPSHLSSVAMVESSASLPVAPRPHASFHQIFGVRGGETRGRGRRRGCSSDQGQKMVPRRRGRCYGRRPPVWPSRERGEERSWVAGARGG

SEQ ID NO: 191914 - protein, 91 aa, Triticum aestivum
  unsure (1)..(91): unsure at all Xaa locations
  Clone ID: PAT_TA_86332.pep
MFHGTTAGGXKSLDALYYLANPRMCYTVEFLGRVDTAPVRDGGAASTDVANRVQRLMAASLGYECTMLTRKDKYLMLAGNDGVVRAKGAAC

SEQ ID NO: 191915 - protein, 145 aa, Triticum aestivum
  Clone ID: PAT_TA_86333.pep
MLAMVILPSVGRSPSLGQEERVTTLAPASGPAQAMRCSECGPHCTEMCRVSVPPKCRKYCNVPSCEDCRSAAIAKCRAGCTTGSCNCDGEATRSCYGSCSGSSSCADCMRLTSEQCTSDCNGKCATTCTTKSRMANSVGWASWYV

SEQ ID NO: 191916 - protein, 86 aa, Triticum aestivum
  unsure (1)..(86): unsure at all Xaa locations
  Clone ID: PAT_TA_86334.pep
XADPVXAPXXAAXAXARXRMKDXXRGXAXLGASGXGGGEXSESRRRRWARRGXGMAREEEAGTGSLVVVGVAEXFGGAXXGXAPPL

SEQ ID NO: 191917 - protein, 84 aa, Triticum aestivum
  Clone ID: PAT_TA_86335.pep
SEACAVVALVTDIILSWKATAIVSLLRLHPGSEHCSGFNHVMDEPACYRYSYIHLGPVLLIRSLILVWEHTECMIIKIKKKKKN

SEQ ID NO: 191918 - protein, 108 aa, Triticum aestivum
  unsure (1)..(108): unsure at all Xaa locations
  Clone ID: PAT_TA_86336.pep
CXRTTPPARRRGVGLXSILVGLLRGRLTGXLQAPAPEVVHPPLSSXYQSIHPIQRPAEHTHTRTHTWLASVGGGVGSSEGDTRALNAGAAEARKQRQWRETAPHSAGH

SEQ ID NO: 191919 - protein, 67 aa, Triticum aestivum
  Clone ID: PAT_TA_86337.pep
PFALLHRCCGRNAMPASSTTLGARPISRIMGEARCWLAAEIHHLDRIFEPPLFLLHVWSSTIGRCPK

SEQ ID NO: 191920 - protein, 117 aa, Triticum aestivum
  Clone ID: PAT_TA_86338.pep
TAAASPIQIPRDSRDAEYLVPIRGDQVTPLVSLVRFPQSPLEIRPDFVLVGLEKIRRRAKLRRVNRPSPVIPSTVSTLLLHIRVVAPLLVSPPAMATLPVGESARLSPGRHPARPCK

SEQ ID NO: 191921 - protein, 150 aa, Triticum aestivum
  Clone ID: PAT_TA_86339.pep
APLLITHSAHPGHVLKLFPGSPPFQCDGCRQYSDDERWYRCEPCDYDLHVCCALLRTYLTHPLFPGRIFAFRHRPPSVPGYSCRSCDGCGDLVLGFVYHNAERQLDLHPQCASLATVLTGEEGVFILSEEAPVRGNCGLCGQGKNGRRGS

SEQ ID NO: 191922 - protein, 107 aa, Triticum aestivum
  Clone ID: PAT_TA_86340.pep
MSRKNASSSTSAAATSRKNAPSSSSAAGAASKKEKPLSVSAMLASMDGTAPKSKPAKAAPKPKPSKAPASSYMGGIDLPPSDDEEDEADVAAVAAKPKPSRATSTQR

SEQ ID NO: 191923 - protein, 75 aa, Triticum aestivum
  Clone ID: PAT_TA_86341.pep
RWLSCSKDDAMFIGLHHAMVESWQEHNAPPCTVVSYIYIYKLCCILVPFFCGGKQFELDLYYFLSLVYNQMKTTM

SEQ ID NO: 191924 - protein, 101 aa, Triticum aestivum
  unsure (1)..(101): unsure at all Xaa locations
  Clone ID: PAT_TA_86342.pep
AKLPAAVNQCAIHRFLPHPHPHPNPRSDPPPPPPPLPSXTATSHPFSDTPXPPPPSPSAGRHGLLPPPPDAPARXTPSSPCPHHRPPPPSPPPAPSSSPTI

SEQ ID NO: 191925 - protein, 87 aa, Triticum aestivum
  unsure (1)..(87): unsure at all Xaa locations
  Clone ID: PAT_TA_86343.pep
LFXGVIFIXVLKXDSLXQXKSALTPVXSSDXGXLKPAMSLVHGRRNYKTLDSTSRISQLLSECGHFLSFQSIRFYEAVESSSASHKM

SEQ ID NO: 191926 - protein, 125 aa, Triticum aestivum
  unsure (1)..(125): unsure at all Xaa locations
  Clone ID: PAT_TA_86344.pep
MRECISXHIGQAGIQVGNACWELYCLEHGIQPDGQMPGDKTVGGGDDAFNTFFSETGAGKXLPRAVFVXXEPTVIDKXRXGAYGKFFNPEELTIXKEXAXXXSPVALNNWKGCCLTFKSIERQGS

SEQ ID NO: 191927 - protein, 166 aa, Triticum aestivum
  unsure (1)..(166): unsure at all Xaa locations
  Clone ID: PAT_TA_86345.pep
FHLASSFSEGVRARNICPSVPSYERRFTTSCYMTQNLGISVPMMSSSPLFANAPXEKKGVKNFAIDFLMGXGVSAAFPXTAATPIXRFKLLIQEPRMKXXKAXRPSXQNKGLXXXFGXTIKDEGFGQFXKGXMXINLNFQXRFXFSIQVXFKXXHFKKARMLRELG

SEQ ID NO: 191928 - protein, 154 aa, Triticum aestivum
  unsure (1)..(154): unsure at all Xaa locations
  Clone ID: PAT_TA_86346.pep
MAPTVMASSATSVAPFQGLKSTAGLPVSRRSNGASLGSVSNGGRIRCMQVWPIEGIKXFETLSYLPPLSTXASSSSPTTWIRSKWGALPPIQQVGFIFRXHNASPGYYDGRYWDMLKLPISGXTGPXXVINKWXESRRIPDPTPHNRFNIASWV

SEQ ID NO: 191929 - protein, 155 aa, Triticum aestivum
  unsure (1)..(155): unsure at all Xaa locations
  Clone ID: PAT_TA_86347.pep
RHATVRPLALRQVRPSARRPRPRLRATCRPSAGSTPPPARRPXYSPAHAIPPLVPTSDRFSSAAPLRAQISWFNRHGVRLLVGGVXRRGRAAAVRGGAGDPHQXXRGGLPAGEGGAPVIVAARHXSSPXPAATCCARRRNCCXXAARCSXRTTXA

SEQ ID NO: 191930 - protein, 120 aa, Triticum aestivum
  unsure (1)..(120): unsure at all Xaa locations
  Clone ID: PAT_TA_86348.pep
VKSVSCDDGGGYRVQEEDGSEEIYDKVILGIHAPAALKVLGAEATHEELRILGAFQYVCSDAYLHCDXXLMPQNXPGWSAWNFLGETKGYVCYLLTKPDQDIESAKTSLGRINSCSGMYT

SEQ ID NO: 191931 - protein, 76 aa, Triticum aestivum
  unsure (1)..(76): unsure at all Xaa locations
  Clone ID: PAT_TA_86349.pep
NASKFRYIHLNSTKDKRKRFIQPLXPQVHXRWIPNLFPXHKXWXIXXTNXLRCXEXNLQPNXXLXLKRQKGPTSWX

SEQ ID NO: 191932 - protein, 98 aa, Triticum aestivum
  unsure (1)..(98): unsure at all Xaa locations
  Clone ID: PAT_TA_86350.pep
VYQPPPGVPGGDFAKXQEAVCXISNSXTSVXEVFSRIDHKXDLMYAKRAFVPLVRGEGMEEGEFSXAREDLXALEKDYEEVGAEXSTEGEDGDEGDEY

SEQ ID NO: 191933 - protein, 118 aa, Triticum aestivum
  Clone ID: PAT_TA_86351.pep
MSAYCGKYKDELIKNAAYIGTPGKGILAADESTGTIGKRFASINVENVEDNRRALRESLLHPGCLQYSACDLLRGDLYQSTRVEAVKSRGHVSPDKVARYISDNGKNNQILTQYIGGP

SEQ ID NO: 191934 - protein, 53 aa, Triticum aestivum
  unsure (1)..(53): unsure at all Xaa locations
  Clone ID: PAT_TA_86352.pep
PSKKRLTXSXGXLXLRKKPDPAXYLLXXPILEFXXPTLLLFXTXTXGFQXAKL

SEQ ID NO: 191935 - protein, 59 aa, Triticum aestivum
  Clone ID: PAT_TA_86353.pep
LAACLRMYFLRPKIFVLNLSIYGCINSHFSIRYIYIYINIRQIFWEEGSIIVRIVSAWT

SEQ ID NO: 191936 - protein, 117 aa, Triticum aestivum
  unsure (1)..(117): unsure at all Xaa locations
  Clone ID: PAT_TA_86354.pep
MSCCGGNCGCGAGCKCGNGCGGCKMFPDVEATAGAAAMVMPTASHKGSSGGFEMAGGETGGCDCTTCKCGTXRAAAPAAAATEXPRPRRPAGXGEHEDEEEKQAIIITSQQPSVSVH

SEQ ID NO: 191937 - protein, 45 aa, Triticum aestivum
  unsure (1)..(45): unsure at all Xaa locations
  Clone ID: PAT_TA_86355.pep
HLYYELNLXYSLVPKVMQXKLRVSTNCLATDYPRSRHTAMSRWIC

SEQ ID NO: 191938 - protein, 98 aa, Triticum aestivum
  unsure (1)..(98): unsure at all Xaa locations
  Clone ID: PAT_TA_86356.pep
MTCPRSRDCMHTASHCAPSERHAHAIRTARTRQPWYSKPPEMQQETSPSQQHTEDNTSERRRWGDWXKXXVGNWPLGSXXGGPXXQFPXXESXYRVXA

SEQ ID NO: 191939 - protein, 82 aa, Triticum aestivum
  unsure (1)..(82): unsure at all Xaa locations
  Clone ID: PAT_TA_86357.pep
MXASFLRPLXXPXXFLSTLKPXVPIXPITAVRXIAAPKXXNSTPXARPSMRATRXRSNEPTPDXAEANPXXIXDDXTPPSSD

SEQ ID NO: 191940 - protein, 154 aa, Triticum aestivum
  unsure (1)..(154): unsure at all Xaa locations
  Clone ID: PAT_TA_86358.pep
YISLSPNLLLHLRPPLRPGRHGGVPPAPQHHPAHPPGPPHLPAPSTTSCVQHHCVAATAPPHPAPPSSSGDPAFCRCLLLPLPGCSPNLSPCSSSFSTTCCFFSHQLLLLLPCAPSLSVCYCSSTSLAPNCCYSSSQCSVAXNSCYPLLSKLLR

SEQ ID NO: 191941 - protein, 65 aa, Triticum aestivum
  unsure (1)..(65): unsure at all Xaa locations
  Clone ID: PAT_TA_86359.pep
LALLRANXNXPPIQFLHFCSXXTWTRSXAHXHCXCHXXIAVTSPXKIXDCTIIGTXXXRXAGXAC

SEQ ID NO: 191942 - protein, 156 aa, Triticum aestivum
  unsure (1)..(156): unsure at all Xaa locations
  Clone ID: PAT_TA_86360.pep
TLATSWHQQGHPGGMTRTXPXQSLTTGRTHRRRSEESCGYSSAGLVXGAGSGMWWSGRWPGRAXVGGGRXLVXPWXXSTGDATDALDPDLDRAGRDGSQMGRGMVVQEEVGGVAQVRWALLRGAWDSSSRRGVGQSAPSGKPAGGGRWEGVVRGVG

SEQ ID NO: 191943 - protein, 125 aa, Triticum aestivum
  unsure (1)..(125): unsure at all Xaa locations
  Clone ID: PAT_TA_86361.pep
MAPTVMASSATSVAPFQGLKSTAGLPVSRRSNGASLGSVSNGGRIRCMQVWPIEGIKXFETCPTCNAQKEPPLSKSTNLFAQLVPCPQFNKXGLNFPLAKGTPXTWRKLEPIDEPTQVLGEEKGL

SEQ ID NO: 191944 - protein, 72 aa, Triticum aestivum
  Clone ID: PAT_TA_86362.pep
NPNHSRTGAQKETSELEYIISSSTLSPSALFQLEHEFAAHFGRYYINISIEHWTASPYMQTQEIKPNKDTLA

SEQ ID NO: 191945 - protein, 144 aa, Triticum aestivum
  unsure (1)..(144): unsure at all Xaa locations
  Clone ID: PAT_TA_86363.pep
AMASTGAPMSAGAAVEKEEAVASAVIANPHADLAEIMPSLPTAPGFPPYRLRRYGGFWHTDLYLXSSARSHACFKAAATDCFSXLPQRPXQLVKGVASPGXTAXTASVGXTTVQRKTQDXSFLNSPDKTHGCXQEXFPRCXTXA

SEQ ID NO: 191946 - protein, 142 aa, Triticum aestivum
  unsure (1)..(142): unsure at all Xaa locations
  Clone ID: PAT_TA_86364.pep
VPSAPSQSNMSTSYGTQNPPRANFTPSATLHSRPPGGPQSFPPVSSHGPMSVQVLSSPVGAPPQQTYPPSMQMRPPMSTPPQNERHTSTFPQAGTNTWAMHKWXFIXPACWYARMSSQXNKQGYNQTSIAXSNSKXXHXDLL

SEQ ID NO: 191947 - protein, 114 aa, Triticum aestivum
  unsure (1)..(114): unsure at all Xaa locations
  Clone ID: PAT_TA_86365.pep
AVPTSRGSMVKSIRRWYEESSCSARHRQIRVQLRVNMQPQLRNCWXARRXQDTXLSNPXQXQXAGXXTSKRGTXGQTPNXPFSKNRYSTXXQXXYPQEGXPXHFXKRXFNXQXL

SEQ ID NO: 191948 - protein, 76 aa, Triticum aestivum
  unsure (1)..(76): unsure at all Xaa locations
  Clone ID: PAT_TA_86366.pep
VELXPPXLEAAGCFRTPGTGPGTAPSLFLPTSLISVRPPTAPPATAGACGCLISAAAMVSVARRRRQEMAAVVEVA

SEQ ID NO: 191949 - protein, 123 aa, Triticum aestivum
  unsure (1)..(123): unsure at all Xaa locations
  Clone ID: PAT_TA_86367.pep
MAPVKLYGATLSWNVTRCVAALEEAGVEYEIVPINFGTGEHKSPDHLXAKEPFGQGATFQDGDLYSFQQXLXXYPSRKNKPSFLXEGDIQGVXXWXFVQXGGXQXIAXLPILLXCLIHPSLGH

SEQ ID NO: 191950 - protein, 75 aa, Triticum aestivum
  unsure (1)..(75): unsure at all Xaa locations
  Clone ID: PAT_TA_86368.pep
LLIRKLPFQRLVREIAQDFKTDLRFQSSAVSALQEAAEAYLVXGLFEDTNLCAIHAKRVTIMPKDIQSPADPREA

SEQ ID NO: 191951 - protein, 85 aa, Triticum aestivum
  unsure (1)..(85): unsure at all Xaa locations
  Clone ID: PAT_TA_86369.pep
LFVQYYKLDIKIAXPSXSKKPVGXDEEEGXGDVGIVVSWSEXPXQRETEQRHRQQVFIPSLANSWRHQLVXLVCXSHVSVDLEVF

SEQ ID NO: 191952 - protein, 59 aa, Triticum aestivum
  Clone ID: PAT_TA_86370.pep
PIKMIPDLATLRKQFDTPGRSSQLPGIDVIVTTASATDEPILYTMNCVLSIFAVSTNAS

SEQ ID NO: 191953 - protein, 95 aa, Triticum aestivum
  unsure (1)..(95): unsure at all Xaa locations
  Clone ID: PAT_TA_86371.pep
MAMASTALSSXLSLLHAKPATTSLPRXHXFXPIHGRXSSVAVACTSTAADSPKVLXLGDAIXGLTLEEAXGLVXXHLXERLGVXAXXFAPXXAVX

SEQ ID NO: 191954 - protein, 102 aa, Triticum aestivum
  unsure (1)..(102): unsure at all Xaa locations
  Clone ID: PAT_TA_86372.pep
MADQLTDDQIAEFKEAFSLFDKDGRWVASPPKELGNIMLPWXKNPTXEAELQXTISIXXHPEXNGTITFPKFPKLNGPKIXXTXQKEEXKEXLKXFXKGXNV

SEQ ID NO: 191955 - protein, 145 aa, Triticum aestivum
  unsure (1)..(145): unsure at all Xaa locations
  Clone ID: PAT_TA_86373.pep
RFLLLFLPLTPEAKPRELPMASTTFSSAFSILSLPSSSPSPSASAPRTLPVANRRRRAVAVASTVTESPKAXEXGDAIGRVTLEEVRNLFDISKNSWLWRSFVRCVAVPPRRRRGGRRETIHWHEVQQAVNISPMTTGLSKYGPK

SEQ ID NO: 191956 - protein, 101 aa, Triticum aestivum
  unsure (1)..(101): unsure at all Xaa locations
  Clone ID: PAT_TA_86374.pep
KQSSCRSLKQLIFLFFSLGVLRWSPEKLGFXGYINQYNXGFQLLIXKKXPPXGGXVPNSPKGAYYPAKXLLLKXXTGKPGVPTNPLXKPFPTGXTXXPTFP

SEQ ID NO: 191957 - protein, 92 aa, Triticum aestivum
  unsure (1)..(92): unsure at all Xaa locations
  Clone ID: PAT_TA_86375.pep
PMDLSLSLESLQRLSHTTSYSCMLTNSSMKLANHLHASNQSIQAGCRFAVHALAVRTXVPPRAVCSLSAVIGISAVLASHTXVXITPFSHPP

SEQ ID NO: 191958 - protein, 131 aa, Triticum aestivum
  unsure (1)..(131): unsure at all Xaa locations
  Clone ID: PAT_TA_86376.pep
FTPDATHHLRLVSRTPELHLLVPVSAAVEQEPSRRASSPSKEPESSDPSSKRTSSAPPIHGRRVLPEPXWEMLANVEDPFDYPAVFFNGSFFFXXGFKXGFSNPSKWSXYQTTLLNNKFGXIVXSFNNQYL

SEQ ID NO: 191959 - protein, 131 aa, Triticum aestivum
  unsure (1)..(131): unsure at all Xaa locations
  Clone ID: PAT_TA_86377.pep
MASTSTSLSLAFCPLFRPTPQPQSQPRYLDPKFPKPLRLSLAPALSCAAPLAAVPDGVAIDXIIXKDWSFLNASGXXLPRALAAGALSPASXVLXVMXTVXFXSASSXESPXELLVAXXESLXXLGFMSSL

SEQ ID NO: 191960 - protein, 60 aa, Triticum aestivum
  unsure (1)..(60): unsure at all Xaa locations
  Clone ID: PAT_TA_86378.pep
PNXXYKGXLNXXSXIXXNRFNXXXXPDTRQFLAQAKSVXQLRSKXLXNLLGCCCEGDXRL

SEQ ID NO: 191961 - protein, 69 aa, Triticum aestivum
  unsure (1)..(69): unsure at all Xaa locations
  Clone ID: PAT_TA_86379.pep
PXCRLVKXXIXLDLXSTNXXLQXSXIPAPDXAFXIXEXGEGXRRGXEEKGGWGWGGWMDCWGWRGLCAA

SEQ ID NO: 191962 - protein, 108 aa, Triticum aestivum
  unsure (1)..(108): unsure at all Xaa locations
  Clone ID: PAT_TA_86380.pep
AADAXXXMPPSLLLXTSSXLXMHLPQTSXXTPLLVSFPPXRLHVDLXLRLDAAGPNXXQXCXLSRXXXWRQQXXXKPEGYSPGIXKRCXXKVXXXFRXXSLTQGXLIA

SEQ ID NO: 191963 - protein, 132 aa, Triticum aestivum
  Clone ID: PAT_TA_86381.pep
KVSRQQAITCSLFFKKTKQNKQNKQSPSSELNFTADSEQTNKQTNRSEAIVCLGYAERIEYPPSGWLTVRCPWVLKGFGGCGGYAAAAANRDSNKGHPFPKDAQISGTWLGIGIQHQLARTTLEKFWGIPPG

SEQ ID NO: 191964 - protein, 106 aa, Triticum aestivum
  unsure (1)..(106): unsure at all Xaa locations
  Clone ID: PAT_TA_86382.pep
MSRGGSAGGGQSSLGYLFGDGEPAKPAAAPAAKPAPAEETSXAAADVTKQIPXAGIPSXRANNYXRAKWQXXGNSLTAFFXPRVXXCPGGWPXLGXXWGNFAKLPP

SEQ ID NO: 191965 - protein, 132 aa, Triticum aestivum
  unsure (1)..(132): unsure at all Xaa locations
  Clone ID: PAT_TA_86383.pep
MARLNSKAVVAAVVLAAVVLMMAGREGLGGAVRAGRWDSKLAPCVAXERGXASSIXSKECCSGVQGXLNGMARSSXPDRKIACKXLKDLPNNIKXINMGKSPXCPAXALSVPSPSTFHNCTCQLVNIYLTAC

SEQ ID NO: 191966 - protein, 108 aa, Triticum aestivum
  unsure (1)..(108): unsure at all Xaa locations
  Clone ID: PAT_TA_86384.pep
FNSXKXXHMERDMKCCGKLLESCFSGNXPYRVFTTDLHILCNQEKSFHQVCRRGEREYNIQNLDTEFKIIKLDGANTTQYASSFSGYSHAYTKSYRHTLQPSELCQNW

SEQ ID NO: 191967 - protein, 115 aa, Triticum aestivum
  Clone ID: PAT_TA_86385.pep
FFFFFPLINFIHFFRLRHSSMYHITGDFTGTAEDRDEHPSYLRAAATPRAKQEKKNTSAPLCVLDLLLVPMYASPCFRAGHHPVLLDRPLPRPLHLPLAPLLQELFGCCRRSLGR

SEQ ID NO: 191968 - protein, 148 aa, Triticum aestivum
  unsure (1)..(148): unsure at all Xaa locations
  Clone ID: PAT_TA_86386.pep
NSCXWNXLRLTLXXCYPARXSPXXLXQSXSVGRIXSERXGVXLRRAPDRHQQSAAADRQQHQQGDGRGNAGYDRGWQSMIRATVASLRARKPRTTGSVAGRPRVRAPEAPGGAVLALSANLGRATTGSRYSFGIHQCGDGARSAARSE

SEQ ID NO: 191969 - protein, 88 aa, Triticum aestivum
  unsure (1)..(88): unsure at all Xaa locations
  Clone ID: PAT_TA_86387.pep
MANPRVFFDMTVGGAPAGRIVMELYKDAVPRTVENFRALCTGEXKGVGKSGKPLHYKGSASNALIPDSMCQGGDXTKGNGTGGDPSNG

SEQ ID NO: 191970 - protein, 62 aa, Triticum aestivum
  unsure (1)..(62): unsure at all Xaa locations
  Clone ID: PAT_TA_86388.pep
LXTXDLXPSYVSKDMLXWXXXTGPNPXTFRSQGGRDGXXVEEEAKGMNXQNDHFSEQSXCLX

SEQ ID NO: 191971 - protein, 155 aa, Triticum aestivum
  unsure (1)..(155): unsure at all Xaa locations
  Clone ID: PAT_TA_86389.pep
APSPLSPVLIHYAAIYFTINCPDSVPVRVPASYAVATPNSHANPKPASQLARQPSPAQPSPMAEDAGDRDQQQQQPAAAVGPGAGHACGEDGGGXDESSVKSSSGKCPSHDGXRAGRHFRDSPSSTKSPSSATRHKXSXAAAPDXPSREEXTXNX

SEQ ID NO: 191972 - protein, 188 aa, Triticum aestivum
  unsure (1)..(188): unsure at all Xaa locations
  Clone ID: PAT_TA_86390.pep
MRGRETPPKARSGAATPSCPQSPLRITHDGEFYARLLTRESSLANPSFRYYGAGPAAVPFGWESQXPGTPKDATSCCRKALPAVPAITPPPSYHARAATASSYGDSGRCRAEEQGRPAAQELCCSAVQEAKWSGGSSPRVRRDVSPGCSRVVISRVTAGSGQAQASRIRISRSPALFGENVGACESPI

SEQ ID NO: 191973 - protein, 83 aa, Triticum aestivum
  unsure (1)..(83): unsure at all Xaa locations
  Clone ID: PAT_TA_86391.pep
EVAKEEAHTWSLLSSGIASHCFERMVVPRQIQWLWWCVLSLLFLLFLVALFPTSXMVIVTQNESRLQAIILSISSRPGCASEV

SEQ ID NO: 191974 - protein, 127 aa, Triticum aestivum
  unsure (1)..(127): unsure at all Xaa locations
  Clone ID: PAT_TA_86392.pep
QKXPSLATEKRKKEHTPLNTKLHSSNGSTYCHIEEGGEAHPFLLPGXQRQWREPTRMVQGLDSEESSPRAATDSVIRTEATKRNYHFIADTILQGHPLSLNISKMKRSQHEKAGAKIFPSQQGGLQL

SEQ ID NO: 191975 - protein, 128 aa, Triticum aestivum
  Clone ID: PAT_TA_86393.pep
VLQAVIDHLVLWRLIPESRKPNSVVINFFDEDEHSQPYFKPPHLDNPISTLLLSETSMAFGRSLVTDSNGNYKGPLTLSLKQGSLLVMRGNSADMARHVVCPSSNRRVSITFVRVRRRRRTSSRSVAT

SEQ ID NO: 191976 - protein, 99 aa, Triticum aestivum
  unsure (1)..(99): unsure at all Xaa locations
  Clone ID: PAT_TA_86394.pep
RGSSVPAGVSXPRLHLLRXRALRGXSKPSARLLPVKVKKHSRFPPKIWKSREQRKSLIMAIATVAGYLTKLVXVIFVLFRNMRVLSFVSCCVLCIEAGQ

SEQ ID NO: 191977 - protein, 76 aa, Triticum aestivum
  Clone ID: PAT_TA_86395.pep
ICLLFTGIHELQAAILQLHCIPLYFSLKNNLLLFKNSELVEFRLCRSSRCVSCADVLCILGKHKLYVDSPSTNTGI

SEQ ID NO: 191978 - protein, 91 aa, Triticum aestivum
  unsure (1)..(91): unsure at all Xaa locations
  Clone ID: PAT_TA_86396.pep
CSHLLRAPDSIHSNLSNLSWRRXXRVGPXGPVLSIPMLPLRLAHPRQPPRPLARQVRQRLVXVLHQXPSXLXHVLXDXPLGLLPLHPPXXS

SEQ ID NO: 191979 - protein, 100 aa, Triticum aestivum
  unsure (1)..(100): unsure at all Xaa locations
  Clone ID: PAT_TA_86397.pep
PRLLISPSSAPSSLAXPLFIYNGVDPETAADATVIDYVDXDPXSCLSNQMVDPWEPDAXPGRXLXHGGRRXLTSSXEVPXMRXCLXDXXAFVPXLXXGSC

SEQ ID NO: 191980 - protein, 53 aa, Triticum aestivum
  Clone ID: PAT_TA_86398.pep
FFFFEERPKLIPKLQEINPTRQRFLFLSDLQFSTTPREYMQTWARPNVFTFLG

SEQ ID NO: 191981 - protein, 139 aa, Triticum aestivum
  unsure (1)..(139): unsure at all Xaa locations
  Clone ID: PAT_TA_86399.pep
MANPRVFFDMTVGGAPAGRIVMELYKDAVPRMVENFRALCTGEKGVGKSGKPLHYKGSSFHRVIPDFMCQGGDFTKGNGTGGESIYGEKFADEKFVHXHTKXGIXSMATRAQHQXLQFFIXTVPCNXLXARRVWRGMDV

SEQ ID NO: 191982 - protein, 141 aa, Triticum aestivum
  unsure (1)..(141): unsure at all Xaa locations
  Clone ID: PAT_TA_86400.pep
RKSTPIQSPQKPSQPPGEXANPRVFFDMXXGGAPXGRIVMELYXXAVPRTVENFRALCTGEKGVGKXGKPLHYKGSSFHRVIPXFMXXGGDFTKGNGTGGXXIYGEKFADEKFVHKXTKPGXLSMATRXQNNGFQFLSRPG

SEQ ID NO: 191983 - protein, 127 aa, Triticum aestivum
  unsure (1)..(127): unsure at all Xaa locations
  Clone ID: PAT_TA_86401.pep
MSDTDEHHFESKADSGASKTYPQQAGAIRKGGHIVIKARPCKXVEVSTSKTGKHGHAKCHFVAIDIFNGKKLEDIVPSSHNCDVPHVDRQDYQXIDITDDGYVXLLTESGXTKDDLKLPTDDVLLGR

SEQ ID NO: 191984 - protein, 115 aa, Triticum aestivum
  unsure (1)..(115): unsure at all Xaa locations
  Clone ID: PAT_TA_86402.pep
LQSKRLRNKVAGFTTHLMRRIQRGPVRGISLKLQEEEREXRMDFVPEKSALEVDEIRVDKETMDMLAFLGMADLPGVERAPETTSAAAPYRQFNGPRGGNRPRFRVIVPLYYACL

SEQ ID NO: 191985 - protein, 152 aa, Triticum aestivum
  unsure (1)..(152): unsure at all Xaa locations
  Clone ID: PAT_TA_86403.pep
MAPKAAEKKPVEKTPAGKKPKAEKKVPASXEGGGDKKGKKKAKKSVETYKIYIFKVLKQVHPDIGISSKAMSIMNSFINDIFEKXAGESAKLARYNKKPTITSREIQTSVRLXLPGELAKHAVSRAQGVTKLLADSVCPVCVSGDDDVPVVL

SEQ ID NO: 191986 - protein, 91 aa, Triticum aestivum
  unsure (1)..(91): unsure at all Xaa locations
  Clone ID: PAT_TA_86404.pep
QASKQAATAASPLPPEAMARTKQTXRXXTGGKAPRKQXXTKAARXXAPATGGVKKPHRXXPGTVALXEIXKXQKXXELLIRKXXFQXLVXD

SEQ ID NO: 191987 - protein, 66 aa, Triticum aestivum
  unsure (1)..(66): unsure at all Xaa locations
  Clone ID: PAT_TA_86405.pep
SEVIMLLRSELGHDKAPPEPVQSLHSDLSRSRRSPSMTDLKXFCSXWLARLNSFSCLXPHCSSSXL

SEQ ID NO: 191988 - protein, 119 aa, Triticum aestivum
  unsure (1)..(119): unsure at all Xaa locations
  Clone ID: PAT_TA_86406.pep
MQIFVXTXTGKTITLEVESSDTIDNVKAKIQDKEGITPDQQRLIFAXKQLEDGRXLADYNIXKESTLHLVLTLRXGMXIXVXTFTGKXITXEVESSDTIDNVXVRFXXRRDXSGQQXLF

SEQ ID NO: 191989 - protein, 86 aa, Triticum aestivum
  unsure (1)..(86): unsure at all Xaa locations
  Clone ID: PAT_TA_86407.pep
PCXKTCKPXSXTXDPLTPIXRPSPNQRSLGKPEELICSRVLXXSHAYVSNXCVRRRGRAXCNQLYHAPRSAKYRCEDVTKSKTQSN

SEQ ID NO: 191990 - protein, 88 aa, Triticum aestivum
  Clone ID: PAT_TA_86408.pep
FIWRQKGIIHLVISGSVDVISYKLGINVGEWLGINKIRVCIYRSRLFRKQKWAKRSKFQLLNAFICININKLCCIHIYSSDYKHLQMV

SEQ ID NO: 191991 - protein, 122 aa, Triticum aestivum
  unsure (1)..(122): unsure at all Xaa locations
  Clone ID: PAT_TA_86409.pep
MASSRTAAMLVLMAAVXALQPCVSRRRAFISMPTDHVVARIPPVSPAEXXXFNFHSDSCPQLQDVVRSAVQXALQSEIXLAAXLLRIXFHDCFPQIESIRGPGARLRARRMRQRPTVMPWPG

SEQ ID NO: 191992 - protein, 52 aa, Triticum aestivum
  Clone ID: PAT_TA_86410.pep
GMRCRHIYWSSREEHRLIFTIHRKRHLFSSLTVFTCEYVNKLEIGAVEKNTA

SEQ ID NO: 191993 - protein, 150 aa, Triticum aestivum
  unsure (1)..(150): unsure at all Xaa locations
  Clone ID: PAT_TA_86411.pep
APPSSLLSLFHFPLASASAIASSPLLPLSRLLPLNPSRHHPVPTLYCSTAHPPPLGSGAGRPVRAGGGAPLEGKGRQRRRWPXXTPAAMVSPCATALSPLLPYSLTHLSPTQTNPAARRPPWRPVPSLACSSSGEXSLCXIXVGRIRRFP

SEQ ID NO: 191994 - protein, 124 aa, Triticum aestivum
  unsure (1)..(124): unsure at all Xaa locations
  Clone ID: PAT_TA_86412.pep
RGFGWFPGFCSPHXGXTPTFVQKGYAINXIRQFYMRKVRYTQQNFYEKLSTIIDEFPRLDDIHPFYGDLLHVLYNKDHYKLALGQINTARNIIAKISKDYLRLLKYGDTLYRCKFVVILVVEHM

SEQ ID NO: 191995 - protein, 53 aa, Triticum aestivum
  unsure (1)..(53): unsure at all Xaa locations
  Clone ID: PAT_TA_86413.pep
YAKRXFGHWYVGXGMEEGEFSEXXEDXAAXEKDXEEVXAEFDEGEDGDEGDEY

SEQ ID NO: 191996 - protein, 97 aa, Triticum aestivum
  unsure (1)..(97): unsure at all Xaa locations
  Clone ID: PAT_TA_86414.pep
QXRXAXXCXLXXAXXFLXAQKYPHHHXXDRRMVWCQRNXEEWQLVDDLXXIXSKKYGRARAXAXEVKRRRRXKGEGXKHVRSGGSCEGGCILWXXXX

SEQ ID NO: 191997 - protein, 46 aa, Triticum aestivum
  Clone ID: PAT_TA_86415.pep
SPLSVIGRNSDLHQKIILFSTVIISKKNHSYKLLLSVSCVMLEFVC

SEQ ID NO: 191998 - protein, 59 aa, Triticum aestivum
  unsure (1)..(59): unsure at all Xaa locations
  Clone ID: PAT_TA_86416.pep
XVESFATRGLGDVAXLVALSGAHTIGRXQCXXFEXRSQRAXDTFSRXXAANXSKXPDRL

SEQ ID NO: 191999 - protein, 122 aa, Triticum aestivum
  Clone ID: PAT_TA_86417.pep
GTGEDKTIIISEVSNRTAKSVLSAATYPETSTTRHSPLARDQITPKTKTAATHVTTGCRSVPPNHRRERSEILRKSTNASTDRPGKKKYRRRKNERSVWREAEESSPGEDAAPIGRSRRGRV

SEQ ID NO: 192000 - protein, 76 aa, Triticum aestivum
  unsure (1)..(76): unsure at all Xaa locations
  Clone ID: PAT_TA_86418.pep
MADQLTDDQIAEFKEAFXLFXKDGDGCITTKELGTVMRSLGXNPKEAXLQDMINEXDADGKXNIXFPEFXKLMGQD

SEQ ID NO: 192001 - protein, 82 aa, Triticum aestivum
  unsure (1)..(82): unsure at all Xaa locations
  Clone ID: PAT_TA_86419.pep
TPXPXPGGXFGXXAPNFGXXPXSXXSPXTPXXRAGXRXWXXXLHPLXVLLRHQHRDVXHWQXKKHSTQXETVALESGIWMLS

SEQ ID NO: 192002 - protein, 138 aa, Triticum aestivum
  unsure (1)..(138): unsure at all Xaa locations
  Clone ID: PAT_TA_86420.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDXTIDNVKAKIQDKGGIPPDXQGSHLWLGKARGPHPLEKKFK

SEQ ID NO: 192003 - protein, 114 aa, Triticum aestivum
  Clone ID: PAT_TA_86421.pep
LGGTIALGLTSQPVLQGLIVFAVLGLLSFVAGLPFSYYHTFGIEERHGFNRQTKKGFWLDQVKGILLGAILGGLILAVLLWIMNRMGSSWWWVAWIAFFGLSFVTAWSNPGIGA

SEQ ID NO: 192004 - protein, 126 aa, Triticum aestivum
  unsure (1)..(126): unsure at all Xaa locations
  Clone ID: PAT_TA_86422.pep
MANPRVFFDMTVGGAXAGRIVMELYKDAVPRTVENFRALCTGEKGVGXSXXPXXXKXSXFXXXIPXFNXQGGDFTRGXRAPGXXFLXGXXXFPDXKFRSXKEKQXPGXFSIGXTRGPKXQXGXQXF

SEQ ID NO: 192005 - protein, 72 aa, Triticum aestivum
  unsure (1)..(72): unsure at all Xaa locations
  Clone ID: PAT_TA_86423.pep
EQRQFRGSYKYEALSPVPNSVMAAVGTXPLLYQQQAHAXGDGCYFSFXSSYXSHXEAXSNASSPXSSFXAXL

SEQ ID NO: 192006 - protein, 122 aa, Triticum aestivum
  unsure (1)..(122): unsure at all Xaa locations
  Clone ID: PAT_TA_86424.pep
MANPRVFFDMTVGGAXAGRIVMELYKDAVPRTVENFRAXCTGEKGVGKSGKXLHYKGSAFHRVXPDFMCQXGDFTRGNGTGXESIYXEKFXDEKFXXKXXQVPGILSMGKXRXPXTXRPSFH

SEQ ID NO: 192007 - protein, 82 aa, Triticum aestivum
  unsure (1)..(82): unsure at all Xaa locations
  Clone ID: PAT_TA_86425.pep
EPCPTXPPPSATPPSPSSASPSPAXXPGPSLPXPXPXHPPXEXPPSDLPXPSPPSSQQPXDSSGPRRTSGSSSTTRRIWRTG

SEQ ID NO: 192008 - protein, 95 aa, Triticum aestivum
  unsure (1)..(95): unsure at all Xaa locations
  Clone ID: PAT_TA_86426.pep
HGMIQVXWISXSXRWGRESFWDXXRXPQQRLPSHGFFAQIAYVEHFTTTGTIFYNCTMLVLHLLAFLLVVLINILFDDTWIXLLFLVVMDTVNRY

SEQ ID NO: 192009 - protein, 122 aa, Triticum aestivum
  Clone ID: PAT_TA_86427.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRI

SEQ ID NO: 192010 - protein, 76 aa, Triticum aestivum
  Clone ID: PAT_TA_86428.pep
FFFCKKIRSIIKEYFPRKYRCYQACKVQHTYYYTEENVLDPCIDKLRAKAPLRRLLLHTFTVDETVIREKNLFVRL

SEQ ID NO: 192011 - protein, 108 aa, Triticum aestivum
  unsure (1)..(108): unsure at all Xaa locations
  Clone ID: PAT_TA_86429.pep
RDXSPXPVSLSPPNDQMDRKISQTWGRTERIKKQNPQLGDFSVKKLRGTRGGCGSSSQGTCSVRVEAKSTKKIKKKLAQSLLPRGIPRSRMNQKSVVWWDGVGGFTRV

SEQ ID NO: 192012 - protein, 46 aa, Triticum aestivum
  unsure (1)..(46): unsure at all Xaa locations
  Clone ID: PAT_TA_86430.pep
PPPPPADXTELMKAXXAGHPRYPSLLSAXIECRKVRPCAPPCMLPA

SEQ ID NO: 192013 - protein, 115 aa, Triticum aestivum
  unsure (1)..(115): unsure at all Xaa locations
  Clone ID: PAT_TA_86431.pep
MRECISIHIGQAGIQVGNACWELYCLEHGIQPDGQMPGDXTVGGGDDXFNXFXSEXGAGKHXPRAVXVXLEPTVIDXVRXXXYRSLSPEQLIXXKEXEPTIXPXXYTIXRXXYLA

SEQ ID NO: 192014 - protein, 99 aa, Triticum aestivum
  unsure (1)..(99): unsure at all Xaa locations
  Clone ID: PAT_TA_86432.pep
MADQLTDDQIAEFKEAFSLFDKDGDGCITTKELGTVMRSLGQNPTEAELQDMINEVDADGNGTIDFPEFSTDGRKMKDTDSXEXSRRLQGHKDKRLFCC

SEQ ID NO: 192015 - protein, 123 aa, Triticum aestivum
  unsure (1)..(123): unsure at all Xaa locations
  Clone ID: PAT_TA_86433.pep
IXSFXISXFLXXQRKKELCXPFFEHSMKYXQXLLXSPPLLRISRKXSLXAXNXSAGGAREXRRLXWXWXVRXPXARVSAGGGXXGEEGWTRPGEEESGGRLLLSTLAFVASCNVKTMRASALA

SEQ ID NO: 192016 - protein, 117 aa, Triticum aestivum
  unsure (1)..(117): unsure at all Xaa locations
  Clone ID: PAT_TA_86434.pep
MVKFLKPGKAVILLQGRYAGKKAVIVRVFEEGTRDRPYGHCLVAGLAKYPKKVIRXDSAKKTAKKSRVKVFLKLVNFTHLXPXYTLDVDLKEVAPGRRXPHSKDKKVGAQSAKQVGR

SEQ ID NO: 192017 - protein, 98 aa, Triticum aestivum
  unsure (1)..(98): unsure at all Xaa locations
  Clone ID: PAT_TA_86435.pep
MSRGGSAGGGQSSLGYLFGDGEPAKPAAAPAAEXAPAEKPAPXAXDVAKQIPAGIPGSRANNYYRAXGQNTGXFLTDRPSTKVHXAPGGGRPGYFWGK

SEQ ID NO: 192018 - protein, 47 aa, Triticum aestivum
  Clone ID: PAT_TA_86436.pep
LRSGQKLFFLSEKNIVKNTEKMFKVWRKLPETSFYCRWYRRRPADWP

SEQ ID NO: 192019 - protein, 123 aa, Triticum aestivum
  unsure (1)..(123): unsure at all Xaa locations
  Clone ID: PAT_TA_86437.pep
MKFIAAYLLAYLSGNASPSAEDLTSILESVGCEIDNEKMELMLSQVKGKDITELLAAGREKFXAVPXGGGGVAVXTAAPAVEVCAPAXSQRKKRXSGEEEXXDDMGSCSLNVGLVSYLGRICL

SEQ ID NO: 192020 - protein, 72 aa, Triticum aestivum
  unsure (1)..(72): unsure at all Xaa locations
  Clone ID: PAT_TA_86438.pep
QPPSDLAEKSPPEANQGSLVPLLKMQIFVKTLTGKTITLEVESSXTIDNXKXKXXDXXGXPPDXXRFXXAGX

SEQ ID NO: 192021 - protein, 58 aa, Triticum aestivum
  Clone ID: PAT_TA_86439.pep
YFYMTMITCLTVSPKDSFQINLKSNSRSDHVCPACIMRLIKKDIGATLATRTTAPARP

SEQ ID NO: 192022 - protein, 84 aa, Triticum aestivum
  unsure (1)..(84): unsure at all Xaa locations
  Clone ID: PAT_TA_86440.pep
MVLQNDIDLLNPPAELEKLKHKKKRLVQSPNSFFMDVXCXXCXNITTVFXHSQXVVVCPXCQKXXXQXTGGKARXTXXCSSAGR

SEQ ID NO: 192023 - protein, 77 aa, Triticum aestivum
  unsure (1)..(77): unsure at all Xaa locations
  Clone ID: PAT_TA_86441.pep
ATIIXNCHCKHXSFVIGESGRXTXHIYNNKXASHTSFSHLNQXSYIIIIAFTRPIXRCXXNNSGVRGLARSAAFIQG

SEQ ID NO: 192024 - protein, 85 aa, Triticum aestivum
  unsure (1)..(85): unsure at all Xaa locations
  Clone ID: PAT_TA_86442.pep
QCVKVNPDSPQKQVRFLTLSGDKKLLTPQPRLRTGFFSVLESQMIPTGCIPEACTSVGAVKYGRPIDLDEVIKXXLIXIGVRFQG

SEQ ID NO: 192025 - protein, 87 aa, Triticum aestivum
  unsure (1)..(87): unsure at all Xaa locations
  Clone ID: PAT_TA_86443.pep
HHHAKPPAASHAPAPPTHGPPTPKPIPPAPKPTPPTYAPIPKPPKPSPSPPAYXPXXKLELPSXKPPTKXRPXXXXXKATHNHPRPL

SEQ ID NO: 192026 - protein, 88 aa, Triticum aestivum
  unsure (1)..(88): unsure at all Xaa locations
  Clone ID: PAT_TA_86444.pep
MSCCGGNCSCGSACKCGNGCGGCNMYPEVEAAGATLLVSATATHKASSGGMEMAAENGGCGCTQCKCGTSCXLPGWKFTAMNGSNLKK

SEQ ID NO: 192027 - protein, 105 aa, Triticum aestivum
  unsure (1)..(105): unsure at all Xaa locations
  Clone ID: PAT_TA_86445.pep
NKSPANLVSDRPQARRILLPHRLKMQIFVKTLTGKTITLEVESSDTIDNVKAKIQDKEGIPPDQQRLIFXXKQXXDGXTLADXNIEXEXTXHXVLRXGGGFRSPS

SEQ ID NO: 192028 - protein, 97 aa, Triticum aestivum
  Clone ID: PAT_TA_86446.pep
PKPSLAPAPLAARRFRRPPSPNPGAPPPPPPGGLPLPGRAARGVFRLGRFSRGVQVFQDTWAWDGSEHQEIRIQLGGSRMDLILPFKVGDAVRDKIL

SEQ ID NO: 192029 - protein, 49 aa, Triticum aestivum
  unsure (1)..(49): unsure at all Xaa locations
  Clone ID: PAT_TA_86447.pep
SCCFLNLASKPSYRTHGVQGLVGRRWISSGVLSWPHHLGSEPXQDXTFI

SEQ ID NO: 192030 - protein, 83 aa, Triticum aestivum
  unsure (1)..(83): unsure at all Xaa locations
  Clone ID: PAT_TA_86448.pep
ANRVNYTALAPRESPARPTTLHDIPDKLLKLILLYLTSPQWLVRAAATCKQWRRIIVDANFLSYIDSSPNPSXXXKAIXMTQK

SEQ ID NO: 192031 - protein, 76 aa, Triticum aestivum
  unsure (1)..(76): unsure at all Xaa locations
  Clone ID: PAT_TA_86449.pep
MDLLRLRSCCCACCCNCCCACCCNCGGNCCCGCCCICCGNCCXACCCNCCXACCCNCCCNCCCGGCCNCCCGCICA

SEQ ID NO: 192032 - protein, 98 aa, Triticum aestivum
  unsure (1)..(98): unsure at all Xaa locations
  Clone ID: PAT_TA_86450.pep
RRKXXXPKPGWPXCXXRXXXPXXRXAXGGXGLXGVXGNXQXSXSXPXGPPXXFXPXGGXXPXPXALGXXWFFRPQRVXDLLIGAKXETMKKLIVNLSD

SEQ ID NO: 192033 - protein, 179 aa, Triticum aestivum
  unsure (1)..(179): unsure at all Xaa locations
  Clone ID: PAT_TA_86451.pep
PSSTASSSPSCTSTSPRLTTGVDNLLARRAMTTQRNHHRAAAEEFPLHSPGSSTGSADSAPWHHRAPATPPPVLPFDTSDADEMLLLNMLSQHREVQQAAAAPTTAPVNQEADEEDKVALGVDSRVPRSAGSDRXGNSXAEIPGLRRPTXSGLAGALRQAPXAXCAXXTTKXRLAXXXG

SEQ ID NO: 192034 - protein, 104 aa, Triticum aestivum
  unsure (1)..(104): unsure at all Xaa locations
  Clone ID: PAT_TA_86452.pep
PQRRLLSIPTHLLFHLDSEEEPRARFPSAAGDNQDSPPGAPLLLPPPSTCGTPRPWHPHARRLPFAQALHPCRGERRVPSXSXRLEXRRXPXGLFVXVAPXGPP

SEQ ID NO: 192035 - protein, 149 aa, Triticum aestivum
  unsure (1)..(149): unsure at all Xaa locations
  Clone ID: PAT_TA_86453.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTGEXGNTKDDLKFPTDDFLLGQFKDWVCLXGKDLILSGFPHGK

SEQ ID NO: 192036 - protein, 70 aa, Triticum aestivum
  Clone ID: PAT_TA_86454.pep
RGVFNPKQSCPFSLSIANRHLWSRHLFFPPLPDVYTLENQWKPGLIVLSLSISFYSDTLSALCSAKNENA

SEQ ID NO: 192037 - protein, 89 aa, Triticum aestivum
  Clone ID: PAT_TA_86455.pep
SQLASQARSMKIGNKAVGVVALVAATVLLQLAVAPTAMARLPRVSNETIVMVTEEGVQQQRYYCMQSCRWTPCTNPNCNCISNSCFMIR

SEQ ID NO: 192038 - protein, 50 aa, Triticum aestivum
  Clone ID: PAT_TA_86456.pep
SSFRIEALGKILVLFLFEIQKYVLPGKQILCKSCEPIYKQLKFWLVKKKK

SEQ ID NO: 192039 - protein, 151 aa, Triticum aestivum
  Clone ID: PAT_TA_86457.pep
GAGLGAIAGAVLSIEVLEASRAYWCSDRLGTCSMADFIEQLLHARFVQQQLGSSAHMAYRWQLSIPDFGHDDVYDIFGDISVERVSREALGEIPHYVVADQVRSRQGENCPAPSSTYGTGEMARCHCSMLSSLCVDNGHHGHPVFGNIVRT

SEQ ID NO: 192040 - protein, 149 aa, Triticum aestivum
  unsure (1)..(149): unsure at all Xaa locations
  Clone ID: PAT_TA_86458.pep
RTNVSFYTMAGKQYXHLKTXEKRSANHLFWSPAGKYILIAGLRNFNGVLEFFSVQDLETITTEDHFNCTNIEWDPTGRYVATYVSFWRHPLENGYNLWTFSGKHLHREYREXFYQLLWRPRPPSLLSKEWKRTSRTQAISDKYRKETTH

SEQ ID NO: 192041 - protein, 129 aa, Triticum aestivum
  Clone ID: PAT_TA_86459.pep
MAPKAAEKKPVEKTPAGKKPKAEKKVPASKEGGDKKGKKKAKKSVETYKIYIFKVLKQVHPDIGISSKAMSIMNSFINDIFENLPAICQLARYNKNPPSRPGSSDSVRLVLPATRQHPSPAQGVTIHSS

SEQ ID NO: 192042 - protein, 72 aa, Triticum aestivum
  unsure (1)..(72): unsure at all Xaa locations
  Clone ID: PAT_TA_86460.pep
WXFFQFFRSWLLSLLLFVDRAXCALIRQRDRPGCKAKRAVLPFIRCFVFGLFLNSTFYRDCGDEPYSPRSSG

SEQ ID NO: 192043 - protein, 141 aa, Triticum aestivum
  unsure (1)..(141): unsure at all Xaa locations
  Clone ID: PAT_TA_86461.pep
KPIPGDWNGAGAHTNYSTKSMREAGGYEVIKTAIEKLGKRHAQHIAAYGEGNERRLTGHHETADINTFKWGVADRGASVRVGRDTEKDGKGYFEDRRPAXNMDPYVVTSMIAETRSSSEHHHGMPTAASHDTSRSLVEGGD

SEQ ID NO: 192044 - protein, 50 aa, Triticum aestivum
  Clone ID: PAT_TA_86462.pep
ATPSTCLMSGEIGCNLSALILILHIIHLHMPAIASYVFCPNNICKVCWWK

SEQ ID NO: 192045 - protein, 112 aa, Triticum aestivum
  unsure (1)..(112): unsure at all Xaa locations
  Clone ID: PAT_TA_86463.pep
MGMSSVAXXAGXITXTLDXCRXTTTXPAXGXFXVYVXXHRQRYXXRMECLNHXLFXXLLDEADEAFGYAYARPLKLPCNTKAFXKVXDXIXGXQAQRTHSLRRTPIRALAGL

SEQ ID NO: 192046 - protein, 109 aa, Triticum aestivum
  unsure (1)..(109): unsure at all Xaa locations
  Clone ID: PAT_TA_86464.pep
SLPPRPLLPVAGFXSDXDVQIXXAFDPFAXXNAGDTXXPAGSKDYXHXGIXXRNGRKSLTTVQGLNNEFSXSXILXDLKXXFXCXGTVVXTQXLNHLQIRRRTHKPCGL

SEQ ID NO: 192047 - protein, 115 aa, Triticum aestivum
  unsure (1)..(115): unsure at all Xaa locations
  Clone ID: PAT_TA_86465.pep
XALQQHPGRMNERMXQRXKGGEERPQQVNKRWXSDSLCPLVQRPAQXIGLTITWCXAAAGRTXXDVAVAVNLGAPGHGASKVTVAAXVVXWAQGXALXAGGGALAVEHIIAVXDP

SEQ ID NO: 192048 - protein, 168 aa, Triticum aestivum
  unsure (1)..(168): unsure at all Xaa locations
  Clone ID: PAT_TA_86466.pep
MAPKADKKPAAENKVEKAAEKAPAGKKPKAEKRLPAGKTAAKEGEAKTRGRKKGSKAKKSVETYKIYIFKVLKQVHPDIGISSKAMXIMNSFINDIFEKLAGESXKLARYNKKXTLPPASQTSVRLVSRRVASTRSGTSVTINSLTDRRPQVSYMRLYLNMWYRWTSC

SEQ ID NO: 192049 - protein, 91 aa, Triticum aestivum
  unsure (1)..(91): unsure at all Xaa locations
  Clone ID: PAT_TA_86467.pep
DNFQGTYVRPLDADDLSHIIQQPRESTHKLWNRFLTKKNQIVDCPDAEALATFKHSVWDEWLARHLGPGKAKDNGSLNYTNDLLLRGQGXG

SEQ ID NO: 192050 - protein, 99 aa, Triticum aestivum
  Clone ID: PAT_TA_86468.pep
KPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 192051 - protein, 74 aa, Triticum aestivum
  Clone ID: PAT_TA_86469.pep
HSSVNSLYIPTALLHAAPSLLRRKTALLELLSCDAPLFVEQYDGSLHPDEFAFFDMLRDDYEVCPHLRRLRASA

SEQ ID NO: 192052 - protein, 158 aa, Triticum aestivum
  unsure (1)..(158): unsure at all Xaa locations
  Clone ID: PAT_TA_86470.pep
FRVIADNYVTDDSGTGVVHCAPAFGEDDHRVCLSAGIIEASGLVVAVDDDGHFIEKISQFKGRHVKEADKDIINAVKDKGRLVSKGSIEHSYPYCWRSGTPLIYRAVPSWLXQVEKXGIITRMQQGDYWVQIIQGKEIHNWLEVQGRAVTDNLGTHSV

SEQ ID NO: 192053 - protein, 77 aa, Triticum aestivum
  unsure (1)..(77): unsure at all Xaa locations
  Clone ID: PAT_TA_86471.pep
MGHSNVWNSHPKNYGPGSRVCRVCGNSHGLIRKYGLMCCRXCFRSNAKDIGSSITVKNGNLQRQGLGNINECGAPSS

SEQ ID NO: 192054 - protein, 69 aa, Triticum aestivum
  unsure (1)..(69): unsure at all Xaa locations
  Clone ID: PAT_TA_86472.pep
WVLGRSLGDMSEAXMQHVFTDFVXCQISFCSPVCHPNFRMTESVMTLKVFQVRRSVIIXLENFGPWSSQ

SEQ ID NO: 192055 - protein, 86 aa, Triticum aestivum
  unsure (1)..(86): unsure at all Xaa locations
  Clone ID: PAT_TA_86473.pep
RXNRRSIPSDVYNHVSGAXLFDRRLQLVKEVGLAMKVHASPVCITXPKIPXYQMTVLLFPERSNVRASTFSLICPEGGLDHGFLFI

SEQ ID NO: 192056 - protein, 113 aa, Triticum aestivum
  Clone ID: PAT_TA_86474.pep
FFFLDIRYHIFGDKVQSSFAITMNIARRYNPSSFRIHIINNSPLAAFEQNGKSLHLSQKHARLRHLNLQSKKEKCTVLIYRLQSNICSDNYALSRRESSKLPSNSPFPASDAE

SEQ ID NO: 192057 - protein, 169 aa, Triticum aestivum
  unsure (1)..(169): unsure at all Xaa locations
  Clone ID: PAT_TA_86475.pep
QLSTAKSQSTLTRDPRFRVIGRIDSNWKASCRFLRENRDIFDVPKGHAGVPKDFAEHKLHVRADAKPVKQPLRRLSEEKRRIVGEEIARLLAAGFIMEVFFPEWLANPVLVLKKNNKWRMCIDYTSLNKACPKDPFALPRIDQVIDSTAGCELLSFXDAYSGYHQIKSD

SEQ ID NO: 192058 - protein, 149 aa, Triticum aestivum
  Clone ID: PAT_TA_86476.pep
VLTSAELSATTGRGREPQGLRPAPLRLRGMYSPNSLLRESVTGGELHRRWPSSQAPGLSLGKQASRALALFTGSGPFPKRDSFTGIRLLHMLRAFSQKMSFTGICLLHELWAFSKKMSFTGIRLLHSSGPFQKDDFTSIASHSSGLSKR

SEQ ID NO: 192059 - protein, 122 aa, Triticum aestivum
  unsure (1)..(122): unsure at all Xaa locations
  Clone ID: PAT_TA_86477.pep
IIRDWTGPPXFXFFXCNXVIYDGXHRPMKRXYNXSLVLPTQSSQXQMAVKQXTTTPVHQQPMKSSWXPGIEHEMHNPQTKPKTXRTNTXITYRYXSSSLRTNGFTAXEHSVAIQEQQIRAKN

SEQ ID NO: 192060 - protein, 44 aa, Triticum aestivum
  unsure (1)..(44): unsure at all Xaa locations
  Clone ID: PAT_TA_86478.pep
KMAHQCSLMLKTGHLMKQHQLYSTSRTFSTMKTVIXXXNSFFRP

SEQ ID NO: 192061 - protein, 167 aa, Triticum aestivum
  Clone ID: PAT_TA_86479.pep
LIGCCLEVDTPLLVYEFLSNGSLHDILHGNDNKPLNLDTRLRIAAESADGLAYMHSKTITKILHGDVKPANILLDDRFVAKIADFGISRLIARDKQHTAKVIGDMSYMDPVYLQSGLLTEKSDVIALELCSWNLLVRRRHAPDTTVSNISLELIKEGEATELLQRNA

SEQ ID NO: 192062 - protein, 90 aa, Triticum aestivum
  unsure (1)..(90): unsure at all Xaa locations
  Clone ID: PAT_TA_86480.pep
LLVKPEVQSQGWXNAKGDRPIHPSYGTSTRLNKKENKNEARCLSTAAAAEAQAHGRRRTTNSFYFTYKNETIAVPKQGREVRERQCTYFL

SEQ ID NO: 192063 - protein, 68 aa, Triticum aestivum
  Clone ID: PAT_TA_86481.pep
MIYQFRGGLREDLQLALVLFEPTEYDEFYNMELKQEAAQLKCDASKKRVRDATPSYSSTQVATKQQKF

SEQ ID NO: 192064 - protein, 132 aa, Triticum aestivum
  unsure (1)..(132): unsure at all Xaa locations
  Clone ID: PAT_TA_86482.pep
XSMSYHQLCFVSTNVLAAHVLFKLTWTCSKNDRVICLSFIPASSFFNCIKIPNKPLSFKKIFASLFASPTEKLLHYVSSNRGLLTSQTQLLFCHTHPNRSYPCMAFVLVVAHTPSGTKLVGLVLRIGHPQIC

SEQ ID NO: 192065 - protein, 153 aa, Triticum aestivum
  unsure (1)..(153): unsure at all Xaa locations
  Clone ID: PAT_TA_86483.pep
AEHFRDAEGQRCALVIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLLPRSGCGXYNTXRGVKRSXNYXSQDTCHLGMDTH

SEQ ID NO: 192066 - protein, 127 aa, Triticum aestivum
  unsure (1)..(127): unsure at all Xaa locations
  Clone ID: PAT_TA_86484.pep
MGLAKDGAEMXXGTLEIGIEYXTVSGVAGPLVILDKVKGPKYXEIVNIRLGDGTTXRGQXLXVDGEKXVVQVFXGTSGIDTVYYCHSQAGFENPVSLECLDHFNGLXKTIDNGPXIARLLEFNSTTH

SEQ ID NO: 192067 - protein, 119 aa, Triticum aestivum
  Clone ID: PAT_TA_86485.pep
LLNTTLNEQVFLLSKRMQSTVLPEKHPSYYIVAFYFLSYCLHPAYSVILDLLKKNRIVASRFVQCYCPVHFSILLPEKVQHYCPYSSVLLPKFSSTIAYKHVERMLLTGLGARNYLLIL

SEQ ID NO: 192068 - protein, 118 aa, Triticum aestivum
  unsure (1)..(118): unsure at all Xaa locations
  Clone ID: PAT_TA_86486.pep
MGIDLVAGGRNKRTKRVAPKSDDVYLKLLVKLYRFLVRRTKSXFNAVILKXLFMSKTNRPPLSMRRLSNFMKGKEEKNIAVVVGTITDDMRXKSPAXKLPLXVTETARQGFQCWWECL

SEQ ID NO: 192069 - protein, 135 aa, Triticum aestivum
  unsure (1)..(135): unsure at all Xaa locations
  Clone ID: PAT_TA_86487.pep
QGGLDDFVGXHFVPGSVAYALYGVAVDEGDYSTIKYLLITYVDPEVPAIHKARSSQHRVTLYNFVNKHLQLAGEYHCLDRQLSRXLLLQKLAGSSIVNVGDDAGARKADLHAFNRXESSPRSSXSARATVLXXRD

SEQ ID NO: 192070 - protein, 105 aa, Triticum aestivum
  unsure (1)..(105): unsure at all Xaa locations
  Clone ID: PAT_TA_86488.pep
WLNTVTCLTTSRLISDCPFLEKHHLLLQAAINHPHGPISAATTAMRRSPGSSNAXLRHAGRRSVSKADELSLDRSGKDPNCASDAXRAFALEEFNISRMSVAPVV

SEQ ID NO: 192071 - protein, 68 aa, Triticum aestivum
  unsure (1)..(68): unsure at all Xaa locations
  Clone ID: PAT_TA_86489.pep
EGLVDHILEXARGQHSSIHHIXWIXGCPXTRWSSNSPLGYGGTAFKAQYSXFLIGRXPARDHTVYVTP

SEQ ID NO: 192072 - protein, 55 aa, Triticum aestivum
  Clone ID: PAT_TA_86490.pep
ISCQFLSLVYNRANLDAYTVEEWWCTRLKLAYKCYLFCCLKIATGMFKYTDEITI

SEQ ID NO: 192073 - protein, 98 aa, Triticum aestivum
  Clone ID: PAT_TA_86491.pep
APRASLQRRGVCQGAAADQGGEADGGRKEVRPCQGELLPAARHQPVCHHRTVVAYKLDDGELMSSKVSVEHSHYDKQHHHILGNVRYFSSSSFFIFVR

SEQ ID NO: 192074 - protein, 50 aa, Triticum aestivum
  unsure (1)..(50): unsure at all Xaa locations
  Clone ID: PAT_TA_86492.pep
XFLSSQTXLIRGVXLKITIXHXNAKRAAMDKKVKXXDSKGDDDYSXEISL

SEQ ID NO: 192075 - protein, 172 aa, Triticum aestivum
  unsure (1)..(172): unsure at all Xaa locations
  Clone ID: PAT_TA_86493.pep
VVYFVTPLFNGLGVSAIWAVLTVVVVMEYTVGATLSKGLNRALATLVAGCIAVGAHQLAELAERCGDQGEPIVLTVLVXFVASAATFLRFIPEIKAKYDYGXTIFILTFGLVXVXSYXVEELISSRTTVHTYRRVSARTRLLSRLGGKSQSSGTPVIVSTVASKHVAPVRFF

SEQ ID NO: 192076 - protein, 95 aa, Triticum aestivum
  unsure (1)..(95): unsure at all Xaa locations
  Clone ID: PAT_TA_86494.pep
MSGMEEEENAAELKIGEEFLKAKCLMNCEVAIILEHKWEQLQHMSDGGADXVSXVFEKSXAYVXRFSRYXNPDAVXQARRSPLLDFSHLGTCPKL

SEQ ID NO: 192077 - protein, 70 aa, Triticum aestivum
  unsure (1)..(70): unsure at all Xaa locations
  Clone ID: PAT_TA_86495.pep
SSQKGIHLCILYNNVPLGFVYXYLATASSDHTVKIWNVDGFKLEKTLIGXQRWVWDCXSQXKGLLKTGAR

SEQ ID NO: 192078 - protein, 78 aa, Triticum aestivum
  unsure (1)..(78): unsure at all Xaa locations
  Clone ID: PAT_TA_86496.pep
DGLSGWSCRPCXPRPDGLGKRQCFVSVLRIVQFTFSXSLASKXKKRFLLPELHTACLPVAPLYLGPFXLCSIRLCGXX

SEQ ID NO: 192079 - protein, 57 aa, Triticum aestivum
  Clone ID: PAT_TA_86497.pep
TGHSINYKNLSIIPFFESSLDRRMEAEQLIHINYSCLAPLIKLFIRYRIFFRLKELT

SEQ ID NO: 192080 - protein, 121 aa, Triticum aestivum
  unsure (1)..(121): unsure at all Xaa locations
  Clone ID: PAT_TA_86498.pep
ELLLSVLRFLDLSCLFKLPFLFSDEMGQHVTLTRSQMKIRQWGVWILVPEINVIEDFPRIHKQWHRCAFGSSGLHLSVSDEFCKFIIRSFIIRRHMECDLFPPWTWPRTRPTVALXSTVWA

SEQ ID NO: 192081 - protein, 140 aa, Triticum aestivum
  unsure (1)..(140): unsure at all Xaa locations
  Clone ID: PAT_TA_86499.pep
QQQCXXDEIEAIKLXPPGKNSEGCQQRPSGCXGNXRXTKVKLXPXPTGESNLRXLPGPPXPGPQTSSRXXRVXNWXHXPQAITKPKSENSKSSXNSWSRIXXFXEKXIASXXGCKCPRHASSQQTXSSXNSCRIRXKSPP

SEQ ID NO: 192082 - protein, 93 aa, Triticum aestivum
  unsure (1)..(93): unsure at all Xaa locations
  Clone ID: PAT_TA_86500.pep
WXNWRGXPXXXRPDGXERXRLRXEAGNPGXXTGAQRGRXXIARPXGQGLTLEXHMRAGATMGTDRXSSLRCXIEGENMGIWRRSSLRARWRGR

SEQ ID NO: 192083 - protein, 126 aa, Triticum aestivum
  unsure (1)..(126): unsure at all Xaa locations
  Clone ID: PAT_TA_86501.pep
QIVALLLIIIIKQAASSNNIKXQQATPSSSKQATTATASNPQAXTTSTSRXQQQHQQPQQQQHQQPQQQQHQQPQPXQQSLASQCKWGSXIRXRGHNSAANAEQXQHMITDKKXCXPMVYRAISIK

SEQ ID NO: 192084 - protein, 64 aa, Triticum aestivum
  unsure (1)..(64): unsure at all Xaa locations
  Clone ID: PAT_TA_86502.pep
KMFTHFQNCSKIKNVSVFQFLHKFNXFCVFKNRLEFPVSHKINSNGNLKKTGRELKKITLSKNX

SEQ ID NO: 192085 - protein, 76 aa, Triticum aestivum
  unsure (1)..(76): unsure at all Xaa locations
  Clone ID: PAT_TA_86503.pep
NXFGVXLKSLPNXNXFXLSESFERHSSRSRAXDWSIQYGSCXXLFGSPVFSQSLPMNLVFDLLISLVSPFKPAPPC

SEQ ID NO: 192086 - protein, 92 aa, Triticum aestivum
  unsure (1)..(92): unsure at all Xaa locations
  Clone ID: PAT_TA_86504.pep
TRVEIDAGYFLFVCCPQVAYANGSMYDFPPXQFNFLVGXFGIVNCCNVCXTSFMPTLXRAXQRVXTWXIKXVLAECPXVATEHXXWXHTHXX

SEQ ID NO: 192087 - protein, 119 aa, Triticum aestivum
  unsure (1)..(119): unsure at all Xaa locations
  Clone ID: PAT_TA_86505.pep
GQRAGGRGAGPXRSSARKHRRPKXXSSCKEEGSTXRREPXDCARXPPKAXPXXGTXCAGXPXQGNQLIYPPGXXXPLXXPFPWXXPLFXNAIXTLPNSFNNGXVSLGXXLLAFVXXPXG

SEQ ID NO: 192088 - protein, 71 aa, Triticum aestivum
  unsure (1)..(71): unsure at all Xaa locations
  Clone ID: PAT_TA_86506.pep
TQASKLGGCPGRDPIFLQQSIKYVFRIHFGQXNMCKSLGQPFQLGFNFNLMXQXGYXXXPGLIXXRXLHLT

SEQ ID NO: 192089 - protein, 101 aa, Triticum aestivum
  unsure (1)..(101): unsure at all Xaa locations
  Clone ID: PAT_TA_86507.pep
RRSMDKNRPNGEHNLVEWARPLLGEKQRFYKLVDPRLEGNFSVKSAQKXEAQXASPCLNPEPKXRALIXQIGQALKPXLXLXDMAXSSXFQXTCKPEKITT

SEQ ID NO: 192090 - protein, 85 aa, Triticum aestivum
  unsure (1)..(85): unsure at all Xaa locations
  Clone ID: PAT_TA_86508.pep
PXSXSRRXRGXXRFSIXVGKLPXVTSSWARRGKGXPANNRAXLEVPSNKRRAAXTXMKXQCXKPRLRGLLQXIAASGKXTXXLPS

SEQ ID NO: 192091 - protein, 65 aa, Triticum aestivum
  unsure (1)..(65): unsure at all Xaa locations
  Clone ID: PAT_TA_86509.pep
HFTGYPFPSQRIIGLGFIHVYYLWLCGXLAVGAKTSCRTTIAVTSATTPIVFFPLTILSSLSLVW

SEQ ID NO: 192092 - protein, 137 aa, Triticum aestivum
  unsure (1)..(137): unsure at all Xaa locations
  Clone ID: PAT_TA_86510.pep
LARKFGNXGLKQKNSKIEVYHPEIEGLQETLRGQGGPAPKPSQXSVEEDXXWKGSAFQSLVRKLXSKFQXFVRCXMLNGQXIPLLPGGRXNXXXXTXGFPGTNNEAXQREGFGXXXRGQFPKGRLXNKNREGXKTXK

SEQ ID NO: 192093 - protein, 103 aa, Triticum aestivum
  unsure (1)..(103): unsure at all Xaa locations
  Clone ID: PAT_TA_86511.pep
YQLCSIFFXEXFDCGVLFXSLLNXLCPXIXSXFXFXRYLWLVVLECXGFQXARXXXLFLVGAKGWDIGLKLAAGPGLIPSEGHLAPDTCVSATHHNRIQRYVA

SEQ ID NO: 192094 - protein, 111 aa, Triticum aestivum
  unsure (1)..(111): unsure at all Xaa locations
  Clone ID: PAT_TA_86512.pep
TKSGKEGKRVNXNWXXSLAPTFXFXDESILLRLXLXLALTXXLKXXIXXXNXEVSLXDXXAXVTFPLGXSPPXGEAWAPSWATLXYRWAPGRKVCPAPXNGXCRPFDXSSN

SEQ ID NO: 192095 - protein, 132 aa, Triticum aestivum
  unsure (1)..(132): unsure at all Xaa locations
  Clone ID: PAT_TA_86513.pep
GIEFRIELPPGTTPXTEPYXMAPXEXIELRKQLXDLLVXGYIRAXSSPWXSPILFARRXDGTLRLCIXYRHLXHXHSQNNYLMPRITDLFXQLCSAXVFSKIDLRSGYHQLKVRTEDIPKTAFTSRYGLYEF

SEQ ID NO: 192096 - protein, 101 aa, Triticum aestivum
  unsure (1)..(101): unsure at all Xaa locations
  Clone ID: PAT_TA_86514.pep
EKPSSSCLTSFPEEKPSSSCTPVSNESMISSGSQNADYLDKIGSGTTTSSVAMVTNSNNSFXSALAIXTSHAICWIPSLXVHDDRFTYNNSTXLGCWDQVD

SEQ ID NO: 192097 - protein, 50 aa, Triticum aestivum
  Clone ID: PAT_TA_86515.pep
RPSFSSYKLLIDGLCSFNCLDDAHLVLKQMVDQGFVPRMGTWTKLLTSLC

SEQ ID NO: 192098 - protein, 120 aa, Triticum aestivum
  unsure (1)..(120): unsure at all Xaa locations
  Clone ID: PAT_TA_86516.pep
SRNLPDKEFRYLRTVIVTAAVYWDFNQELXTPSFNLPAPGRRHTLYVXFVFAECCVFIKQSQPPVYCNPFTLLQXSSQATGAYLIPKLRYQFAEFLLPSSLKRLRILISPTCVGLRYGLV

SEQ ID NO: 192099 - protein, 144 aa, Triticum aestivum
  Clone ID: PAT_TA_86517.pep
EVAAAEADVVNLKQKACDLRGQLSSQAQLSSIPLCESCNKRLQDKLAEEKQNEISSSTEASSAIGTNPLSRMLPNAGMADIVEQLRRQAAQNSSSSTGAQRLLRQNSNSLHRLQGLNAFSSNRTEEPGGGPPTALAKLTNRLNS

SEQ ID NO: 192100 - protein, 181 aa, Triticum aestivum
  unsure (1)..(181): unsure at all Xaa locations
  Clone ID: PAT_TA_86518.pep
AKLANLHVTATCGARNMDLVKGLGADEVMDYRTPEGASLLSPSGAKYDGVVHCTVGVSWSSFRPLLSDAGGRVIDITPNLWAILRYILHGVTFSKKRLVPLLVSPNKADLEFLVALLXDGKLKTXIDSRFPLGDAGKACRQYRHRLANFVTHRLTSHSCYNTLYITKVPRHKTLATFSKKK

SEQ ID NO: 192101 - protein, 93 aa, Triticum aestivum
  Clone ID: PAT_TA_86519.pep
SVYEAQIQKFNCKRQRTLKNINSFTGSSMGGTKLGSSHDKENKSKKQLFLSAKVCLLSLKRTLEDLHKKDLFPYNPKPLLKSLSRFEELCAQY

SEQ ID NO: 192102 - protein, 133 aa, Triticum aestivum
  unsure (1)..(133): unsure at all Xaa locations
  Clone ID: PAT_TA_86520.pep
MACASHVMIFLVFSNLAIAMATLPPPLYDPNLGKCKNSCEEELNLSLYLHQVVTGPAHNQEVILSPGFPNMFGMIAVVDWTIYXVPDSTSSIIARAXGMTIQATQSXVNGVAWFPPFSMVLQDSKVWAVLXCK

SEQ ID NO: 192103 - protein, 93 aa, Triticum aestivum
  unsure (1)..(93): unsure at all Xaa locations
  Clone ID: PAT_TA_86521.pep
RLIFAGKQLEDGRTLADYNIQKESTLHLXVLRLXGGMQXFXXXXNXKNXNPEXXNXDXNXNXKGXDXRKXRXPPGQXGLTXXGNNGXXVPPLT

SEQ ID NO: 192104 - protein, 122 aa, Triticum aestivum
  unsure (1)..(122): unsure at all Xaa locations
  Clone ID: PAT_TA_86522.pep
EVQTPIMIDQFYCDKTSCTNQTSAVAVSGVQYENIRGTFTIKPAHFACSDSSPCSEITLTGIQLRPLIVPQYHTCSSPFCWQAFGELYTPTSLLXQGLXLENRXGNFFLVLKPDNRGILVPG

SEQ ID NO: 192105 - protein, 64 aa, Triticum aestivum
  Clone ID: PAT_TA_86523.pep
TKHTLKETISKQDEKCNNLRFCQHDFLRRKCSLLFHASEPSLELIGARFTIGRTNPITTTIHSG

SEQ ID NO: 192106 - protein, 112 aa, Triticum aestivum
  unsure (1)..(112): unsure at all Xaa locations
  Clone ID: PAT_TA_86524.pep
SSRRVRAQGSTPIPDLXPPTSSVISIALLPXALHPCSPPLLPPVVGRDPSTRSSSHCAPHEGSRPLLQISAQHSFFQYERVYMMVSLQTVSTRYYLATRLRRWASGGRRDGP

SEQ ID NO: 192107 - protein, 93 aa, Triticum aestivum
  Clone ID: PAT_TA_86525.pep
CLHVGVGTVTPKIGKPNRFNRFMCLFGVWFYCSVAVSFSIRCSVQLRFPAVTNRYQRRNRYYLRWPYARALYLYVTVAMTCERLSAAICPSAN

SEQ ID NO: 192108 - protein, 161 aa, Triticum aestivum
  unsure (1)..(161): unsure at all Xaa locations
  Clone ID: PAT_TA_86526.pep
KGSITSVQAIYVPADDLTDPAPAITFAHLDATTVLSRQISELGIYPAVDPLDSTSRMLSPHVLGEAHYNTARGVQKVLQNYKNLQDIIAILGMDELSEDDKLTXARARKSAVLSNFHVAEFHRRTWKYVELRRVSKFQGXLDGKYMTSEQHHMVGGIEHAS

SEQ ID NO: 192109 - protein, 66 aa, Triticum aestivum
  unsure (1)..(66): unsure at all Xaa locations
  Clone ID: PAT_TA_86527.pep
KHTTEINDSLKLPGCLPGSAFFKAIKNLAVARGFHFLLDMKSSETFTQITSNCXVANCRILLTKVW

SEQ ID NO: 192110 - protein, 152 aa, Triticum aestivum
  unsure (1)..(152): unsure at all Xaa locations
  Clone ID: PAT_TA_86528.pep
MAVGKNKRISKGRKGSKKKAVDPFTKKQWYDIKAPLLFTSRNVGKTLVSRTQGTKIASEGLKHRVFEVSLADLQNDEDQAYRKIRLRAXDVQGMNVLTNFWGMDFTTDKLSPCKKCRHSLGSLDVNTDNYISMFAXAHKNAEQVSHCYPTIS

SEQ ID NO: 192111 - protein, 58 aa, Triticum aestivum
  Clone ID: PAT_TA_86529.pep
AACQMPIEYQKLFLHLNFHPHHTKTTQHAHQTEREIREVLASAGRTYLRRRLRKRRTQ

SEQ ID NO: 192112 - protein, 57 aa, Triticum aestivum
  Clone ID: PAT_TA_86530.pep
DQFDTRHDLLRTRDENGAETDRTECYYICFHFFAEAETNTETPEMNTEIDTIKNGHG

SEQ ID NO: 192113 - protein, 75 aa, Triticum aestivum
  unsure (1)..(75): unsure at all Xaa locations
  Clone ID: PAT_TA_86531.pep
CFARDYAFVALCTRRXCSAXXXRRRIXSSXSSPFSYTNRVYICISLRGNQFXSREHVRKITFEMSEKSQQIFMYS

SEQ ID NO: 192114 - protein, 107 aa, Triticum aestivum
  unsure (1)..(107): unsure at all Xaa locations
  Clone ID: PAT_TA_86532.pep
SSCIAICIIAYGAAEVETLRSDLPRAKEQARASDXXAEKAAANVKDKRATRRQFXERVSQIEQNSRTHRKXNLLXEXIXAKATDLARALXDAQXXRXESXXXCXXXQ

SEQ ID NO: 192115 - protein, 67 aa, Triticum aestivum
  Clone ID: PAT_TA_86533.pep
NVKTNVKNSSVFVPRRYAHRWYYNITNYIRESPKKKKETSTLSYIYSTVQLYVLPPFLNTCLSRHFK

SEQ ID NO: 192116 - protein, 62 aa, Triticum aestivum
  unsure (1)..(62): unsure at all Xaa locations
  Clone ID: PAT_TA_86534.pep
RXVQXGGHLFSWGXGFTXCXSWXXXDSXVTXXCSSSLDYXGRVQVWNLFFDLXSCLIQMNHP

SEQ ID NO: 192117 - protein, 96 aa, Triticum aestivum
  unsure (1)..(96): unsure at all Xaa locations
  Clone ID: PAT_TA_86535.pep
LGMSITCSDYIPSCLKIPDEAGSSLRKWLCFGIPAALLVGAGSVLXXFRLHSXGKSGLVKDPVXXXYLXXXPXVXXXQKNLGXKXQRSXPNGRYPX

SEQ ID NO: 192118 - protein, 75 aa, Triticum aestivum
  unsure (1)..(75): unsure at all Xaa locations
  Clone ID: PAT_TA_86536.pep
PLSXRAGAPEIHHRQIRQGHQRCAAVXEEEKEEDNEMTLDEFEKVREEEGRREYLGGGAARRSRTTELARARVRV

SEQ ID NO: 192119 - protein, 59 aa, Triticum aestivum
  unsure (1)..(59): unsure at all Xaa locations
  Clone ID: PAT_TA_86537.pep
LIFAGKAPGGRAHAGRLXHSGGSLPFXWXSAFXVAEMXXXSTSSFILXQVILAVGVCCH

SEQ ID NO: 192120 - protein, 49 aa, Triticum aestivum
  Clone ID: PAT_TA_86538.pep
GNERANWVPICMQFHGFCRRTSGAVVASFLSVFIFVLLVVLAAFSIRKR

SEQ ID NO: 192121 - protein, 75 aa, Triticum aestivum
  unsure (1)..(75): unsure at all Xaa locations
  Clone ID: PAT_TA_86539.pep
KXPXGXFFLGGXFXXLGXXRGRGXAXRXVXHAXXQKRLFLSASAWSRHLNSRAGAFWQSYTCLQKYVYKLMARLF

SEQ ID NO: 192122 - protein, 70 aa, Triticum aestivum
  unsure (1)..(70): unsure at all Xaa locations
  Clone ID: PAT_TA_86540.pep
XFFXIFVPTXGQXXFXPXNKDQVCXYAFXKELDXVHKCXPFLYVHHQPPHKGELXSSTYNNTGVYPPNTK

SEQ ID NO: 192123 - protein, 84 aa, Triticum aestivum
  unsure (1)..(84): unsure at all Xaa locations
  Clone ID: PAT_TA_86541.pep
RGRAFGLQFKGLFVGGXRDRSSTVRGTPNXIYTDTFFFRYNSVTFGITTHAGLQVAXRKSEPDETQSVATRVVIWSSGXNNCVX

SEQ ID NO: 192124 - protein, 62 aa, Triticum aestivum
  Clone ID: PAT_TA_86542.pep
ATIPITGTGINPARSLGAAIIYNKKQSWDDHWIFWVGPFTGAALAAIYHVVVIRAIPFKSRD

SEQ ID NO: 192125 - protein, 86 aa, Triticum aestivum
  unsure (1)..(86): unsure at all Xaa locations
  Clone ID: PAT_TA_86543.pep
VNRXXXPKXLWDIIXLXNWLPIXRPRPXIIIRSXFYXHTIGRYRHLQTVVVRILFFLEKEKSLIANINACLXDFMHKPCMHXCMRA

SEQ ID NO: 192126 - protein, 45 aa, Triticum aestivum
  Clone ID: PAT_TA_86544.pep
KNQSIWMKYFVDHEMISCCTYFNPLTQITPIRFLPNFVGNSLRLN

SEQ ID NO: 192127 - protein, 66 aa, Triticum aestivum
  unsure (1)..(66): unsure at all Xaa locations
  Clone ID: PAT_TA_86545.pep
LAAXVLXLAGNAARDXXXTRIVPRHIQLAVRNDXELTKLLXGXTIAXXGVXXXIQQHLLXKRGFLQ

SEQ ID NO: 192128 - protein, 64 aa, Triticum aestivum
  Clone ID: PAT_TA_86546.pep
TEINLAKPWPFGTCVLTRGKGDRSTRRYSWTCDSTCNYITPVNGHIAGCARSRPPSSEPTAAAR

SEQ ID NO: 192129 - protein, 112 aa, Triticum aestivum
  unsure (1)..(112): unsure at all Xaa locations
  Clone ID: PAT_TA_86547.pep
YLNTYDGRTIRYPDPLIKANDTIKLDLXTNKIVDFIKFDVGNVVMVTGGRNTGRVGVIXNREXHXGTFETIXXEGCPGPXFXHPSGXXXHXGXGHXXWVPXXGGKGHFWGEG

SEQ ID NO: 192130 - protein, 89 aa, Triticum aestivum
  Clone ID: PAT_TA_86548.pep
MKGTKLAAILILQAVLVMGVLSHVNADFFPKCCNNCRSFSGVDVCDNAHPKCPKGCSACRVVSTSPEMWRCADMKSTVDGTCGGPCKKY

SEQ ID NO: 192131 - protein, 100 aa, Triticum aestivum
  unsure (1)..(100): unsure at all Xaa locations
  Clone ID: PAT_TA_86549.pep
GTRAFNLIDGGVAANNPTLCAMSHVAEDIIVAXNGDLLGKSYMVISIGCGTSSNPKGKYSAKDTAKWGILNWFXKGGTVPILDMFNXAXGDMXTXTLRXL

SEQ ID NO: 192132 - protein, 115 aa, Triticum aestivum
  Clone ID: PAT_TA_86550.pep
DGFRSIADEVFQGIPSPAFQLQELLDNFATKGLNAEDLVVLSGAHSFGLTHCNFVTPRLYPTVDPTMNATFAAALKKVCRRGTGIVRKTGRKGILKAGRVVQNWWAKTENEKGAW

SEQ ID NO: 192133 - protein, 94 aa, Triticum aestivum
  Clone ID: PAT_TA_86551.pep
MGGGGAFAWLLVAVLLMALGSSTSTAACSSRVLPAAEGDVMARAAGAGGAYGGRGGERVVMGRSLLQRAAWRPPSPLPNPPRATVAPGPPPRKA

SEQ ID NO: 192134 - protein, 139 aa, Triticum aestivum
  unsure (1)..(139): unsure at all Xaa locations
  Clone ID: PAT_TA_86552.pep
MVXLKLQKRLASSVLKCGKGKVWLDPNEVNEISMANSRQNIRKLVKDGFIIRKPXXXHSRXXXRRXHXGQXXGXHSGYGKXRGTRELXPQQVLXMXKMRVLKRLLRKYREARSRQTHYMTCTEKGTCQDKGPHGIHNPR

SEQ ID NO: 192135 - protein, 62 aa, Triticum aestivum
  Clone ID: PAT_TA_86553.pep
TTLHSTFHHRSSRGRLKFIYSLLGVLRKGKDIGLIDAKQKVAVFVTTKACRPGYIDQSLPET

SEQ ID NO: 192136 - protein, 138 aa, Triticum aestivum
  unsure (1)..(138): unsure at all Xaa locations
  Clone ID: PAT_TA_86554.pep
QLENTMFAPGSRMENYNKKPSSPKDTTALANLKEVLHESGLEILYSVPVVHCAQAFGVVLRAKEKVSSAGKAIPGWKVVYSGDTRPCPALVDASRDATVLIHEATFEDSMKDEAXARNHSTTKEXIAVGTSAGAYRIS

SEQ ID NO: 192137 - protein, 75 aa, Triticum aestivum
  unsure (1)..(75): unsure at all Xaa locations
  Clone ID: PAT_TA_86555.pep
HNFINSCLISVLTFLILFKNVGNFYLPFSHSLWPQLSLSXXLINSFPGLCMTQPCVTXARHGRXQGRMXTVQAMX

SEQ ID NO: 192138 - protein, 53 aa, Triticum aestivum
  unsure (1)..(53): unsure at all Xaa locations
  Clone ID: PAT_TA_86556.pep
SEIEIGTQYERPGVIGNSKEQTPTLVSRSANEEQSDDKARRSSQTKMNXERMH

SEQ ID NO: 192139 - protein, 71 aa, Triticum aestivum
  unsure (1)..(71): unsure at all Xaa locations
  Clone ID: PAT_TA_86557.pep
DLQRSGATDKGSNPGSSIKKETSVYCSPCLSGSPMVLSWPTCQPHKVRSCKLXDLXPYCSGWSRVQGLLLT

SEQ ID NO: 192140 - protein, 165 aa, Triticum aestivum
  Clone ID: PAT_TA_86558.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTTCAHPRQARHIMPRTSARRRIRGELGWRTVCLHRFTKELLVVINFSVYLNNGMKSFL

SEQ ID NO: 192141 - protein, 60 aa, Triticum aestivum
  Clone ID: PAT_TA_86559.pep
WVQMTQNWGSTYQAFAALDKSVGLEVRITGGTDGKTIIVGDAIPAWWSPGLCYQGSNNFW

SEQ ID NO: 192142 - protein, 75 aa, Triticum aestivum
  unsure (1)..(75): unsure at all Xaa locations
  Clone ID: PAT_TA_86560.pep
AQKGQAXNXCWWFXPXAXIXXIXSLTSGSSDLTASFXATSLXPLIHXEXSLRXHITXKHTCRXXCAFPLXWTHHS

SEQ ID NO: 192143 - protein, 52 aa, Triticum aestivum
  unsure (1)..(52): unsure at all Xaa locations
  Clone ID: PAT_TA_86561.pep
AXTSAXDPLXSXNXRRXXWHPLXGGHXXSPPSRWXSPGGGAGVGSRREASSV

SEQ ID NO: 192144 - protein, 126 aa, Triticum aestivum
  unsure (1)..(126): unsure at all Xaa locations
  Clone ID: PAT_TA_86562.pep
DIEYQGYHIPKGWKVFAAQSVTHMDSQFFHXPNKFNPSRFEKSAPPYCYMPFGGGPRMCPGNVFARVETMVAMHYLVRQFRWEITCEKETYKRDPKPTPXLGLPIKLRLTPLAKNLQTTWYNRLTH

SEQ ID NO: 192145 - protein, 37 aa, Triticum aestivum
  Clone ID: PAT_TA_86563.pep
RFRWKLCCKENTFVRDPMPSPLRGLPIQIERRTSPPP

SEQ ID NO: 192146 - protein, 130 aa, Triticum aestivum
  unsure (1)..(130): unsure at all Xaa locations
  Clone ID: PAT_TA_86564.pep
WSYGSCREPVFAGELRLLRAEGRPFLFLWALKPFQTKMLHLFGGHDXQRSWRFCRPXWSVSGXGKARSERXLQWTRXLFHLLXWGPPHKIQGLXCNSIFLSGLVVNCYVFMVMFNAMFWSIGTFLVKKKP

SEQ ID NO: 192147 - protein, 62 aa, Triticum aestivum
  unsure (1)..(62): unsure at all Xaa locations
  Clone ID: PAT_TA_86565.pep
ETXFHXQIXLXLLWXNRDNRXLSPXDVHHPSAXLXCXDVVAPXXPIWTXTAXCXLPSQDLXP

SEQ ID NO: 192148 - protein, 148 aa, Triticum aestivum
  unsure (1)..(148): unsure at all Xaa locations
  Clone ID: PAT_TA_86566.pep
VHPKNWYPIPLILCRPWGKLPENVPCHPKLADFANCMKKKGRGMSIFVSTIDGDYHELAEDAKTACHQLEAYIEYKRCEGVAEIIVAPSMSEGFRSIVQTMGLGNLKPNIVVVRYXEIWRRENLTEIPSTFVSIXNDCITANKLYCKV

SEQ ID NO: 192149 - protein, 180 aa, Triticum aestivum
  unsure (1)..(180): unsure at all Xaa locations
  Clone ID: PAT_TA_86567.pep
DSANDRTDEYGGSLENRCRFALEVVDAVVREVGGHCVGIRLSPFTDYMDCHDSDPQALALHLVKKLNDYGILYCHMIEPRMAHGDGRRQVPHRLLPFKEAFNGTFIANGGYDREEGNKXVGEGYTDLVAYGRXLANQTTRRFELSAPLXDYDRMTFILYLSGLNDIIPTIITLKLMRKKK

SEQ ID NO: 192150 - protein, 65 aa, Triticum aestivum
  Clone ID: PAT_TA_86568.pep
FQVIQNRCWSRTKNRHSHTNATLNSFTILCCIQLAPYALVYLQKNDASGSANGRINRLLTIIGVI

SEQ ID NO: 192151 - protein, 50 aa, Triticum aestivum
  Clone ID: PAT_TA_86569.pep
AKERDSCTSRLDGYMLIYFSVAFYFTIVSVMRPGRGLIFFLACNEWKAKE

SEQ ID NO: 192152 - protein, 78 aa, Triticum aestivum
  unsure (1)..(78): unsure at all Xaa locations
  Clone ID: PAT_TA_86570.pep
SQKLQSQDWNNGKRRPIHPXYGSTQLNKKVNENKNKMSIYSGRSTSTWTTNDAPLLLYLQERNERLCRNRGGRSGRDN

SEQ ID NO: 192153 - protein, 120 aa, Triticum aestivum
  unsure (1)..(120): unsure at all Xaa locations
  Clone ID: PAT_TA_86571.pep
RKLHGKXHPPTXIXYSKRPLELLHMDLXGXPSXDXXGGIKYCLVIVDDYSRYTWVYFFKRKSETXQQTVIDFANEAQRQHDVKILTIRSDNGTEFKNYTLDEFLSDEGIKHQYSAPYTPQ

SEQ ID NO: 192154 - protein, 71 aa, Triticum aestivum
  Clone ID: PAT_TA_86572.pep
MGAEAMKASHSTLMVATTLFSSHLVSGHYSNSTQQSFGQLCNASLAPATGLYCNQIERAVPIANFASCIMD

SEQ ID NO: 192155 - protein, 57 aa, Triticum aestivum
  Clone ID: PAT_TA_86573.pep
GKHMQSNARNKTSQIPKQHAYKTVQQANQSYCMSDTLTRNNKYGGHWRQGCEELVDE

SEQ ID NO: 192156 - protein, 170 aa, Triticum aestivum
  unsure (1)..(170): unsure at all Xaa locations
  Clone ID: PAT_TA_86574.pep
PLLPRSYAQEASHKPSXSAMPSRPSSSMPSRQIPQAAPVPHAAKSLAPPAKSSAPVHLASCQRTTGISIASGASASSSAPPQSSAGPTLLKTKATAGQGTRPSPHKKQVAFQVPSSEDKADDEELAEIIRDRQQRAASAKGTDVPLLLDPKLILDFIDLWHKDPNTPMPN

SEQ ID NO: 192157 - protein, 57 aa, Triticum aestivum
  Clone ID: PAT_TA_86575.pep
LVRHVGRGTPRRPGKAVETYIFAMFNENQKPEGVEQYFGMFQPDMSQVYHVDFSASS

SEQ ID NO: 192158 - protein, 136 aa, Triticum aestivum
  Clone ID: PAT_TA_86576.pep
EEPAAEKAEKTPAGKKPKAEKRLPAGKKTASKEGGGEKRGRKKGKKSVETYKIYIFKVLKQVHPDIGISSKAMSIMNSFINDIFEKLAGEAAKLARYNKKPTITSREIQTSVRLVLPGESPSTRLRGNKASPIHSS

SEQ ID NO: 192159 - protein, 78 aa, Triticum aestivum
  unsure (1)..(78): unsure at all Xaa locations
  Clone ID: PAT_TA_86577.pep
XRDKISGNPTGPERFLLCPSXTGXSSRQGXHPFKMTVLDLTTWSSSLPDQNSETVDRVNHKVCIWIHVMSLDPVNFSS

SEQ ID NO: 192160 - protein, 189 aa, Triticum aestivum
  unsure (1)..(189): unsure at all Xaa locations
  Clone ID: PAT_TA_86578.pep
FPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLXKLKDLQFFVGESMHDDGGXVFAYYXEGAADQLPVLAHGLKKQVQPTYAKPSVSVCKGAITMLGSNCCYAKLRKWECLKETKLG

SEQ ID NO: 192161 - protein, 126 aa, Triticum aestivum
  unsure (1)..(126): unsure at all Xaa locations
  Clone ID: PAT_TA_86579.pep
ATALSPEVLWEHGFTAARADLVHLDMEMKWFRDLLHLLCPTDVADCVDMMNKSLFLVGEIGGNDYNVPLTSLVPVEKIRSFAPSVISKXSXXTDXIGLGXKPNSRKLPIGACRGTHFQGEFQKGPW

SEQ ID NO: 192162 - protein, 128 aa, Triticum aestivum
  unsure (1)..(128): unsure at all Xaa locations
  Clone ID: PAT_TA_86580.pep
AGSCREVRTSVYIWVLLLGIFAYVTLHVVFFKHLAPQCLRDMFWGIRAYWKNTLGHIMTPGSGKTADDQXPAXQLEEXITDXEQASIAXRIAXGQXASNAXRITXGQELQSXEDNRWPSGFXCRENNX

SEQ ID NO: 192163 - protein, 71 aa, Triticum aestivum
  Clone ID: PAT_TA_86581.pep
AHTLLRSPDSGSGISLVIFYIVKRKTWDYLHQMWDTPKYKNKLVVVVVVAAMAVVTVAEVVTTLTTAGRPS

SEQ ID NO: 192164 - protein, 57 aa, Triticum aestivum
  Clone ID: PAT_TA_86582.pep
SPWLHFIKNKAHRSYSYNMCRVQQCTTLVKRGNLAWSQNYKMSDDEKIHAPRTIADR

SEQ ID NO: 192165 - protein, 74 aa, Triticum aestivum
  unsure (1)..(74): unsure at all Xaa locations
  Clone ID: PAT_TA_86583.pep
RSXRLTLSGSILNNCHPCKYLTTNTFTQXYVSPXMSYFFNHSYKITGINGKVHTMLKGNHNXNCSSLNLEVAQC

SEQ ID NO: 192166 - protein, 128 aa, Triticum aestivum
  unsure (1)..(128): unsure at all Xaa locations
  Clone ID: PAT_TA_86584.pep
HLNLLLXILGESLHGSSSRLRDXISLRTSLNNLYSLPRRVASFSRTGLRTPVATLTRATSMDMVAESSRVDSAWSSSPQNALTISSINSHCCTEHATVYKTPTRGSADQTEERKREMGVYLADGSAAE

SEQ ID NO: 192167 - protein, 133 aa, Triticum aestivum
  Clone ID: PAT_TA_86585.pep
APSIDSSKQGDSIQAIRLYSETGNLCGFCAREFERLKKMASAALAYKCVEVAYMKAAFYKHPGAIKDKHALQATSLMVPPAESPSSSASDVDNLNNQSTAAKAISRALYSPKIGGNSYPGTSSLDGVAAYQMT

SEQ ID NO: 192168 - protein, 78 aa, Triticum aestivum
  unsure (1)..(78): unsure at all Xaa locations
  Clone ID: PAT_TA_86586.pep
GIIXCKFIKLEIXWRIGXSRGGLLVAQTRRRVVVDVSITGHQQRSRVYWREEGEEMINTRKHMHNKAISGARCVLTQC

SEQ ID NO: 192169 - protein, 91 aa, Triticum aestivum
  Clone ID: PAT_TA_86587.pep
SVCGPLRCGTWRRDPTKPPDAPTTTSHQRQGAAASADSMMTDAKSVLCSYDRGICSRSDPLCVLLRLSSPSRPSPCSSPSILFSVDGGQNT

SEQ ID NO: 192170 - protein, 42 aa, Triticum aestivum
  Clone ID: PAT_TA_86588.pep
RLFLLIHNMVTLCILLPATIPSSETWWRVRQLYNFIKGSRFH

SEQ ID NO: 192171 - protein, 53 aa, Triticum aestivum
  Clone ID: PAT_TA_86589.pep
HNTDTSAHIHAHTLISILTQYRHKRSYTRAYTNLYECTHAHPRLEGIPTPKRG

SEQ ID NO: 192172 - protein, 105 aa, Triticum aestivum
  Clone ID: PAT_TA_86590.pep
MEATTTSQLLLLVLVVCSVHVVTCNSFFSYGNETDRLSLLDFKDAISLDRHEALMSWNDSTHFCSWEGVLCMVKTPHRVTSLNLTSRDLERPHPPLVTCIAKPWA

SEQ ID NO: 192173 - protein, 65 aa, Triticum aestivum
  unsure (1)..(65): unsure at all Xaa locations
  Clone ID: PAT_TA_86591.pep
DIYSLGMIMLELLTGKSPGDTTNGLDLPQWVASVVEEXWTNEVFDLELMKDAATGSXTGEELXXT

SEQ ID NO: 192174 - protein, 69 aa, Triticum aestivum
  unsure (1)..(69): unsure at all Xaa locations
  Clone ID: PAT_TA_86592.pep
MAAAAPADAKAEAAXMDLLEDDDDFEEFDIDQEWDDKEDGNXXVXXWEDDWDDDNXNXDFSXXXRXGGG

SEQ ID NO: 192175 - protein, 64 aa, Triticum aestivum
  unsure (1)..(64): unsure at all Xaa locations
  Clone ID: PAT_TA_86593.pep
TVSDIHPRTRAVTTYNYNYKNQRTLVGGVAFLPDLSLGPGEHADVSHLDXXLAEXXEXXTVEFP

SEQ ID NO: 192176 - protein, 104 aa, Triticum aestivum
  unsure (1)..(104): unsure at all Xaa locations
  Clone ID: PAT_TA_86594.pep
MHCWKIPPLSTGSDCWCCSCATSCHEARTWRNKLLKLDFQEMVMFPXHLPARIWPHHELETALSSAYMWVHDFKISPSHLASEDMLFIIPGTVHFSCTVDSHFP

SEQ ID NO: 192177 - protein, 78 aa, Triticum aestivum
  unsure (1)..(78): unsure at all Xaa locations
  Clone ID: PAT_TA_86595.pep
MSCCRGNCGCGTACKCGNGCXGCNMYPEAEAAGATLLVSATXTHXXXSGGMXMAAXNGXCGCTXCKXGTXXXCXCCXC

SEQ ID NO: 192178 - protein, 158 aa, Triticum aestivum
  Clone ID: PAT_TA_86596.pep
AARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERADSVCLFCRCRDYMCFAWWSDPCSCYLGVCDVLMQCLMLHLVVSASE

SEQ ID NO: 192179 - protein, 157 aa, Triticum aestivum
  unsure (1)..(157): unsure at all Xaa locations
  Clone ID: PAT_TA_86597.pep
KXTLVCAYESSSLPATVRTQAVEAGLHCFDMEGISSDKDAKGRQRVNHVTVFERPGLHEFLQKTSEFADLILFTAGLEGYAKPLVDRIDAHNXFCRRLYRPSTVTTXYRDHVXDLSCLSKDSXEXCLSXSHPYXFLLXPXNGIPCLLFSWTAMDDQL

SEQ ID NO: 192180 - protein, 184 aa, Triticum aestivum
  unsure (1)..(184): unsure at all Xaa locations
  Clone ID: PAT_TA_86598.pep
FTHSFSYLGFQPRSVDKRESSRKYLYWGARIDCPGKHCSSCAGLGHQESSLRCALEEALFLDRIFVMPSRMCLSSVHNTKGIIDSSNATSNPRWETSYCAMESLYDIDLISKTVPVVLDNPRSWYGIVSRITKLGEGDVAHXQGLARMNSKISTYSXAPPVNALQSXCLVMEXRDKRTRDYITF

SEQ ID NO: 192181 - protein, 157 aa, Triticum aestivum
  unsure (1)..(157): unsure at all Xaa locations
  Clone ID: PAT_TA_86599.pep
MAPVKLYXATLSWNVTRCVAALXEAXXEXYEXVPINFGTGEHKSXTHLAXNPFGXVPXLHDGDLXVFEXRAICXYACXRKNXPXLXKXGDIKXSAMVDVWXXVXAISTPXLGAHLXECLSXXAXGXMTKGXDDNLXXXNXWELQATXXSILXGNPHG

SEQ ID NO: 192182 - protein, 102 aa, Triticum aestivum
  unsure (1)..(102): unsure at all Xaa locations
  Clone ID: PAT_TA_86600.pep
AFSXIHXNXXDXFSYXSYDVMGXDASALXYXXIVXRVLRCFXPSXFSVXVXIFXXXGHAAXCGKKLXAXAYDCNXVVEHELPCXSXLIXQSFXANXXVAVSX

SEQ ID NO: 192183 - protein, 152 aa, Triticum aestivum
  unsure (1)..(152): unsure at all Xaa locations
  Clone ID: PAT_TA_86601.pep
MQIFVKTLTGKTITLEVESSDTIDNVKAKIQDKEGIPPDQQRLIFAGKQLEDGRTLADYNIQXKESTLHLXVLRLRGGAKKRKKKTYTKPKKQKHKHKKVXLAVLXFYKVDDATGKVTRSRXMPERRLRRRHFMATLDRTTAEVRLLLTTEA

SEQ ID NO: 192184 - protein, 80 aa, Triticum aestivum
  unsure (1)..(80): unsure at all Xaa locations
  Clone ID: PAT_TA_86602.pep
PPLVIQVGXAXGQGNSWNCXEAXXAVRAXNLRYVXPMGLPXAXXFXHXTTAAQVRLGKMLADAYXATXHLIDDPVTMIAY

SEQ ID NO: 192185 - protein, 72 aa, Triticum aestivum
  Clone ID: PAT_TA_86603.pep
FHQHHHHAVVLPELIYYFASLAGSRKRGCHRAERVLNAEVSCVRYLIGRIVKVYDYINRVYQRFRLTVYEAT

SEQ ID NO: 192186 - protein, 60 aa, Triticum aestivum
  unsure (1)..(60): unsure at all Xaa locations
  Clone ID: PAT_TA_86604.pep
KRLALALKRIRHDIRPAWHCIVGTXFGSYVTHSLGGFLYFSVDKAYILLFRTAVEPLSKP

SEQ ID NO: 192187 - protein, 53 aa, Triticum aestivum
  unsure (1)..(53): unsure at all Xaa locations
  Clone ID: PAT_TA_86605.pep
EPGVVGAAVYAAVKAGYRHIDCAREYHNEKEIGLALKKLFEEEVVKREDLFXT

SEQ ID NO: 192188 - protein, 62 aa, Triticum aestivum
  unsure (1)..(62): unsure at all Xaa locations
  Clone ID: PAT_TA_86606.pep
LNDLFIMRSKRLTYLSLVIELFDEIINRSMIQLIXIXVDXGXENLXVXMIXXXPXFFFXEXK

SEQ ID NO: 192189 - protein, 139 aa, Triticum aestivum
  unsure (1)..(139): unsure at all Xaa locations
  Clone ID: PAT_TA_86607.pep
ESVSAKPAPHXISNRLDVSSRSTAKTYNVGXSFYAYQRGKRTSSSPNGKVPSLLTKFSPVERTVCGMHRTIDSSQTHGMRPDSKGSTPSAGLCVRLLTSVNYIYIYIYIYIYIRYLSFFLSSLFLHGLKRLKYVLTTQS

SEQ ID NO: 192190 - protein, 91 aa, Triticum aestivum
  unsure (1)..(91): unsure at all Xaa locations
  Clone ID: PAT_TA_86608.pep
ISRVAAKTVTRLQVTKQHQQLKALQKHKGDREAPIQILLAGERHQGATRAGIHLLAVLVEAASRINTMIGTLMATXHDGVXIRAMHLTTGV

SEQ ID NO: 192191 - protein, 58 aa, Triticum aestivum
  Clone ID: PAT_TA_86609.pep
SCRENQDAIEALAKRKRMLETEKATIQQKPTLDLMAETKQFRQYVFKRKYRAKTLVSE

SEQ ID NO: 192192 - protein, 94 aa, Triticum aestivum
  Clone ID: PAT_TA_86610.pep
LGIKMMFEAGSMPKLEKLRIDFTPATNGYLFSTGGLTGSGPYDFGIENLPSTLTTVVCECKSFDGDCTLEATRAALERAVSTHPSCPVLDFSIY

SEQ ID NO: 192193 - protein, 69 aa, Triticum aestivum
  unsure (1)..(69): unsure at all Xaa locations
  Clone ID: PAT_TA_86611.pep
RKAAEAWAALNRLPLVPSVTRAXDGAKRGNSVATYLPLVPTERIARVFANPAADTAPATAPEMQPIPTQ

SEQ ID NO: 192194 - protein, 61 aa, Triticum aestivum
  unsure (1)..(61): unsure at all Xaa locations
  Clone ID: PAT_TA_86612.pep
STLCPYIRKAPXYVYIXIINDHHSTSSKLHMKSCTWIAQKQEHLYIYMTPLCSHRSHCTEQ

SEQ ID NO: 192195 - protein, 80 aa, Triticum aestivum
  Clone ID: PAT_TA_86613.pep
KKRVVFHKYLLEDSLGLSCSTNAAKLARENPSVVLLHRSMMSWILSSVHIEMPWMQRYTMNYTVPGAERWSLPSRAQMAN

SEQ ID NO: 192196 - protein, 123 aa, Triticum aestivum
  unsure (1)..(123): unsure at all Xaa locations
  Clone ID: PAT_TA_86614.pep
VYGPDHSSADSWENPRQGPCGDCDRHPHACRGDFNLIRSGVDKNNNNINWPRVAMFNNAIASMALREVARSGARYTWTNKQLNPVHYVLDRVFMXPEWEMIYPLCSLVAETRIGSDHVPLVLS

SEQ ID NO: 192197 - protein, 137 aa, Triticum aestivum
  unsure (1)..(137): unsure at all Xaa locations
  Clone ID: PAT_TA_86615.pep
SLPKSLGGLKNLQKLNLARCERLAXIPESLGSLKNLQTLNIFHCQKXXSXQESLGSSKNXXTLXLXSXYXLKSLPENLGXLKNLQTXNLLPXPGLXXLPKSVGSSKTSNIRLSNGGNKGLQRTLKAQKKHQLSSGIN

SEQ ID NO: 192198 - protein, 166 aa, Triticum aestivum
  unsure (1)..(166): unsure at all Xaa locations
  Clone ID: PAT_TA_86616.pep
MEFVKGHHTXNNHXXHMXGRVVLRPMFPSQVIADKQPTHCGIIVRGDHQKESECQKPKXNTSTMSEKNNLVLFENQSEVRGVCENPXSFLHYVIVCKDNAPQTNTSHTLPIVLSSLLQEFHDVFLDEQPPRLPPLXGIEHRIYLIPGAPLLNKVPYRINPEEKKKK

SEQ ID NO: 192199 - protein, 145 aa, Triticum aestivum
  unsure (1)..(145): unsure at all Xaa locations
  Clone ID: PAT_TA_86617.pep
IKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKXINDNFGIIEGLMTTVHAITATQKTVDGPXSKDWRSXKXQA

SEQ ID NO: 192200 - protein, 158 aa, Triticum aestivum
  unsure (1)..(158): unsure at all Xaa locations
  Clone ID: PAT_TA_86618.pep
FTHLLVAVNKXQKWNKAKPIKNLDSSTAISFIRELIFRYGVPHSIITDNGTNYEYDEFKAFCASQGTRVDYASVAHPRSNGQAERANGLILQGLKPRVMRDLKHAAGAWVTELPSILWGLRTTPNRLADRNPFXLVYGAEXVLPSDCCCPPPPRWNPQ

SEQ ID NO: 192201 - protein, 84 aa, Triticum aestivum
  Clone ID: PAT_TA_86619.pep
ARESNHGFATASTPHLKVWKLFLPCVLSLALNNISLNPSLICNTFFWEVAGVYGICLRKCPYWKDFFLCASSFVRKGLAFTVNH

SEQ ID NO: 192202 - protein, 92 aa, Triticum aestivum
  Clone ID: PAT_TA_86620.pep
TNLQRNRRRNVFLFLFFFSCSGGIEQRDSSMILGYKKKVVVSSNSLGEVVILWFHSLYISVQSMKRDMKVVAFILQEKDQSYCLCFSIEKKK

SEQ ID NO: 192203 - protein, 166 aa, Triticum aestivum
  unsure (1)..(166): unsure at all Xaa locations
  Clone ID: PAT_TA_86621.pep
HXKXIYMNXIELTGQQANAHNGHGSVQKKKTSRARIEPKQIICPLLPTRTILLLPLMLSLRTGMTKDAAASHRRRRRGGGLHLPFETAPRTTLELLFGHMHLRLDLLFACESCIFCRVHGTALSFERGEAADEDVVGVVPVEHADPDVPGVRPELVPAPRQDLVPA

SEQ ID NO: 192204 - protein, 143 aa, Triticum aestivum
  unsure (1)..(143): unsure at all Xaa locations
  Clone ID: PAT_TA_86622.pep
EAPLHTRTQLFVKFIRVIYYQFKHGFQRTHDSRSSEDKGNSLFLDEAWFSRDIFLYRLSKDFLAVIFEAQVVDGDLLSRARKLKTLLETTFGWDLKNNAVNLIDEDDEFAPVVVEMDGSXGAHIPRNLTTWTHRVLASNKGTW

SEQ ID NO: 192205 - protein, 81 aa, Triticum aestivum
  Clone ID: PAT_TA_86623.pep
RRVGLHGYKPSSTSLSSPKKLSLTEGEPLSQEDGTRYTSLVGAAGPFFLVGHIDQKKFDLNQHHSSSSSTTETNNRQRSSS

SEQ ID NO: 192206 - protein, 67 aa, Triticum aestivum
  Clone ID: PAT_TA_86624.pep
SQLKSSHRVFSILLMDSSNHVVEPEQLPSPALPHDAMPADTESRQPSRHGEHPPPSHRAHIGQKSRR

SEQ ID NO: 192207 - protein, 118 aa, Triticum aestivum
  unsure (1)..(118): unsure at all Xaa locations
  Clone ID: PAT_TA_86625.pep
TMAPVNMIFLQLLCPCAPXSFMGLHRRPXPRSATTRDGSFSHGYGYPQVPYPKIVGMGKTWIDLLPMGNGYPYPQNIWVGHGYEISLMGSPMDTRKILMNENNSYDMWRQHPTPIVQP

SEQ ID NO: 192208 - protein, 121 aa, Triticum aestivum
  unsure (1)..(121): unsure at all Xaa locations
  Clone ID: PAT_TA_86626.pep
AGVLGQLTPHPYSVSKFAVVGLVRAVAGELARSGVRVNAISPNYILTPLVKRILQEWYPEASGEEHRRIVESDINEMEGVVLEVEDIAKAXLYLASDDSKYVNGTTRRRRVTGKPTSRTGQ

SEQ ID NO: 192209 - protein, 115 aa, Triticum aestivum
  unsure (1)..(115): unsure at all Xaa locations
  Clone ID: PAT_TA_86627.pep
PRPPSIITXXLARXCIVXISXXXGXVPDSLSVXFXXSYXTGXXPXREILXLVKDXFDFRPGMISXNLXLXKGGXMFINXAXYGHFGRDXXDFTXEVVXPLXFDXASGRAWSLAAS

SEQ ID NO: 192210 - protein, 134 aa, Triticum aestivum
  unsure (1)..(134): unsure at all Xaa locations
  Clone ID: PAT_TA_86628.pep
ARLTAAATTTTPQAAQTTATSSNSSSSKEKERLEYLMLLGILGASMTYQTGLKPPGGLWQDNMNGHYAGNPILHDTNKHRYNAFFYXNSTSFMGSFWVVLMLLPLDIPWNTTCHSGRMHHFAHAYLLFPMQQAF

SEQ ID NO: 192211 - protein, 79 aa, Triticum aestivum
  unsure (1)..(79): unsure at all Xaa locations
  Clone ID: PAT_TA_86629.pep
PKYXLXTXIDVYFTSVYSNPLVIDTGSXXKVVTRNGSCRINRXLVKVNKGIFDIQIIDVYXXSVYSNPSVIDTGSVXKE

SEQ ID NO: 192212 - protein, 111 aa, Triticum aestivum
  unsure (1)..(111): unsure at all Xaa locations
  Clone ID: PAT_TA_86630.pep
SXRRVTRVCQXFQKKXLGPMTEFGYRYXXVTRGSILLNCWLHVLDWCMFPSWXGAVXPQESTGGSFGSVRLCVTRNNVHVXFFQCTHFFAHYNVQNLDLAPCXGMLLGIYY

SEQ ID NO: 192213 - protein, 115 aa, Triticum aestivum
  unsure (1)..(115): unsure at all Xaa locations
  Clone ID: PAT_TA_86631.pep
HXIAEIDFSSFTGFASLVVXFSFPXXXACLLQFWPXLGSYCCXLYYCQHRLFIHHCSXGMPLLXXCCVCLHXACXGWIXRXXVPPSSXAXTFXEDMPXIELGXIRXAVXFYXVWA

SEQ ID NO: 192214 - protein, 45 aa, Triticum aestivum
  Clone ID: PAT_TA_86632.pep
NYGLAARIAVSNLHNNAKKSFSETIKDMYLHYTERSGLLLCGFQT

SEQ ID NO: 192215 - protein, 178 aa, Triticum aestivum
  unsure (1)..(178): unsure at all Xaa locations
  Clone ID: PAT_TA_86633.pep
VXXASRDVTXESXRKWIREXPVLXXRGSEIDDLRGANTESGELDGGNIRYGRQQRADHXDEIFXDELGEQLGVRILEYTLGEFVLVDSESMTRLLEKLKVALKCRIALLPQQLREQANEIGDGVQLLSEHRGDFHVQGIFQAHFELDGLDRTETELGKLHPRANGFVLEMREKDRQGV

SEQ ID NO: 192216 - protein, 78 aa, Triticum aestivum
  unsure (1)..(78): unsure at all Xaa locations
  Clone ID: PAT_TA_86634.pep
XTLVSSSTRSAAPSSFPFPRDPPPLPRFLFHAILRHELDIHLRCCASATQLHQEAAHPCPTPIHGHQXSMRDLCVKAN

SEQ ID NO: 192217 - protein, 109 aa, Triticum aestivum
  unsure (1)..(109): unsure at all Xaa locations
  Clone ID: PAT_TA_86635.pep
IYIXLHQPFHFSVYAFDMENEKNEKIQIMDPLRDTSKGGQDIEARHSKTKXHIAKALQDCMVISFPDWKRNMXSWQHESNQHATVMFSQHSTHLPSMVISVGRTSLQRM

SEQ ID NO: 192218 - protein, 71 aa, Triticum aestivum
  unsure (1)..(71): unsure at all Xaa locations
  Clone ID: PAT_TA_86636.pep
MAAKEPMRVLVTGAAGQIGYALVPMIAXGVMLGADQPVILHMLDIEFAAEXLXGVKMELIDXXFPFXRGFV

SEQ ID NO: 192219 - protein, 126 aa, Triticum aestivum
  unsure (1)..(126): unsure at all Xaa locations
  Clone ID: PAT_TA_86637.pep
GTTDVSIEXTNXHFSWNTSSQVPTLXDVNFRIRQGMRVAVCGTVGSGKSSLLSCILGEIPKLSGEVKTCGRISYVSQTPWIQSGKIEDNILFGTEMNRERYEKVLEACSLIKDLDILPFGDQTIIX

SEQ ID NO: 192220 - protein, 123 aa, Triticum aestivum
  unsure (1)..(123): unsure at all Xaa locations
  Clone ID: PAT_TA_86638.pep
CEGIXRIVGTQVFRPSVKTPVARYRSYGDWYRPPXIFXSFYATEVSWCKKMTSNGEQXSAQHRTETIMQSCLDKNDIYKVNGVQTSITTETIMQSCLDENYALTLNGVQLQNNIENLVLPLIV

SEQ ID NO: 192221 - protein, 54 aa, Triticum aestivum
  unsure (1)..(54): unsure at all Xaa locations
  Clone ID: PAT_TA_86639.pep
DKIKLTSLDLALYSSNTLLDCCLYSNXXXNIITHHKXITHKHTXIALTCTTCHY

SEQ ID NO: 192222 - protein, 85 aa, Triticum aestivum
  Clone ID: PAT_TA_86640.pep
MCIDFKHINQACLKDHFPLPCIDRIVDSTMGCERLSFLDAYFGYHQIRLYGPDEIKTTFITLFGCFFYITMPFGLKNVGATFMRM

SEQ ID NO: 192223 - protein, 52 aa, Triticum aestivum
  unsure (1)..(52): unsure at all Xaa locations
  Clone ID: PAT_TA_86641.pep
QKAPRVLDSKRHQMIKLSAKSIFHSSVSFVSGDLCTPSXAHXXFTXLXGXKR

SEQ ID NO: 192224 - protein, 68 aa, Triticum aestivum
  unsure (1)..(68): unsure at all Xaa locations
  Clone ID: PAT_TA_86642.pep
LSNEQXVGLAHMXCVSEHCPLKIRRHKNKNANTNSQRVYDSENYRALCSCITFCPKRGVAVSFQGPIW

SEQ ID NO: 192225 - protein, 41 aa, Triticum aestivum
  Clone ID: PAT_TA_86643.pep
QLVARSIDFTHHGSLAGIPVATTRDRGMKNDGKKYHYVKNS

SEQ ID NO: 192226 - protein, 52 aa, Triticum aestivum
  Clone ID: PAT_TA_86644.pep
HQVSARYIHLRDKLGTEEYVVCSSDCMKHDCAVFHSETNICKKFHSGPKKKK

SEQ ID NO: 192227 - protein, 152 aa, Triticum aestivum
  unsure (1)..(152): unsure at all Xaa locations
  Clone ID: PAT_TA_86645.pep
ASASLANSDLPGPSSSRSQLEAAFLKKNLNTVDMVALSGAHTIGKAQCSNFRTRIYGGDTNINTAFATSLKANCPQSGGNTNLANLDTTTPNAFDNAYYTNLLSQKGLLHSDXVLFNNDTXDNTVRNFRQRGGLTALTRHRWENRALTGPGR

SEQ ID NO: 192228 - protein, 81 aa, Triticum aestivum
  Clone ID: PAT_TA_86646.pep
TVKTNKNTVHFAYLSTYATMTHKPALTHEDKSKSIENNSILIDTHRQWMCHPNSSNIALVELDVHLQTEVDGSLGGIETER

SEQ ID NO: 192229 - protein, 173 aa, Triticum aestivum
  Clone ID: PAT_TA_86647.pep
LPYLTVEQSKNLRGAFDFIGINHYLVVRTRAHDSTFNLEQRDYYADASAIANPFEDMQAGRLEYAPWALGKLLDHLKLKYGNPPILIHENGYADAPRISGKIVYEDDNSSCKIIWNQLSKGSVHLPTYICYLPVQKICLAFIGTLGSSNHSSSDPNRSRSDMEVRSGTDGISL

SEQ ID NO: 192230 - protein, 58 aa, Triticum aestivum
  unsure (1)..(58): unsure at all Xaa locations
  Clone ID: PAT_TA_86648.pep
MAAIRRLIPSFNRVLVEKVVQPKKSAGXILLPETXKQLNSGKVIPVGPGXLNKEGXLI

SEQ ID NO: 192231 - protein, 91 aa, Triticum aestivum
  unsure (1)..(91): unsure at all Xaa locations
  Clone ID: PAT_TA_86649.pep
AXPRXEPXXXAXWLHSNLTDXXVKVXXXSWHMPAQQRNPLXEYXXAXXPGXLXFXVXGISDRASNLPHMQXXEKAFSAAVSSLXIYSTEFH

SEQ ID NO: 192232 - protein, 82 aa, Triticum aestivum
  Clone ID: PAT_TA_86650.pep
MAMVFTMEEVAQHHSSNDCWLLIAGKVYDLTKFLEEHPGGEEILLSLAGMDATTNFEDVGHSSDAREMMDMYYIGVIDTTTG

SEQ ID NO: 192233 - protein, 77 aa, Triticum aestivum
  unsure (1)..(77): unsure at all Xaa locations
  Clone ID: PAT_TA_86651.pep
HTTNSEENKSSHPLHYASKLGSHVQAILXVSRHFSKQKCYLXHFDLVSCVSXSEFLLVISVCTAISPMEANTICTAG

SEQ ID NO: 192234 - protein, 135 aa, Triticum aestivum
  unsure (1)..(135): unsure at all Xaa locations
  Clone ID: PAT_TA_86652.pep
XQKSXTCRTSTRXXVRAQSXFPRXIGDETTKGETXPGACERLGGEYEXLQRECERLARTVCGDARRDTSYRCTPGAIQPLRLPSSTTTAMATATACAHPRRHWDTPAMRSGHAEAEENAASSKPVGSSSSLLQEE

SEQ ID NO: 192235 - protein, 151 aa, Triticum aestivum
  unsure (1)..(151): unsure at all Xaa locations
  Clone ID: PAT_TA_86653.pep
FLSLRGCHEICHLPSSIGGLRQLQTLDVRHTSIVTLPVNITKLEKLQYIRAGTTAPANEAPTPHHLVPQLSNCCGGITWXGVVMPPGIGKLTALHTLGVVNVSASGTKXPRNLKDSPLHKPXVSGLTRITFPAQLIPVHLEHVVRRTTSSV

SEQ ID NO: 192236 - protein, 119 aa, Triticum aestivum
  unsure (1)..(119): unsure at all Xaa locations
  Clone ID: PAT_TA_86654.pep
FFFFXVPPSKVLKXVYLTFDFFNLKTVNFLANQHITRERAGNQQIAKKPPGRLNGSGKHLTRLSDPMHNKTRQSPSTTTKISPNSLEQIWEAAMGDRGINRSATIVHKLLTIISLHLFH

SEQ ID NO: 192237 - protein, 121 aa, Triticum aestivum
  Clone ID: PAT_TA_86655.pep
ITLTHSAADPPPEGPSGSPINFEMIVTHRTHALQQSIRQTTNDARIENPVALVENHHLCRRNMEGEKVLPNGLIWKRLLLLLCYSLKMVLRLIPFNPPCCSSLFDLRRQSLHSLLLHFVAI

SEQ ID NO: 192238 - protein, 75 aa, Triticum aestivum
  unsure (1)..(75): unsure at all Xaa locations
  Clone ID: PAT_TA_86656.pep
TKHQTAVQETECATWGKKTQVKCATKHVLGVQLNGYHCATIMQSMVADKRRSKNKTYHCTVRFLPWGLLRVXQHL

SEQ ID NO: 192239 - protein, 105 aa, Triticum aestivum
  unsure (1)..(105): unsure at all Xaa locations
  Clone ID: PAT_TA_86657.pep
MYRANVQFIFSVFRGCFGLKIDLVMHVVWCDQEYLICAMTIWPCCSHAVLRSMVLRFGSCGERIWRGRKQQGSAERLLRSTEQXEQGARDVQEDATTILNWIECL

SEQ ID NO: 192240 - protein, 50 aa, Triticum aestivum
  Clone ID: PAT_TA_86658.pep
AEQNELYSGPKKQILKTHNFPYPNKMRINTGKQSLIYLLNLIFPIFWEII

SEQ ID NO: 192241 - protein, 65 aa, Triticum aestivum
  unsure (1)..(65): unsure at all Xaa locations
  Clone ID: PAT_TA_86659.pep
FFFYVNKVCQYLHAPSTAHSTTFKRILRYLNFTEGLGLHIPKSPFMHVTAYSDADXASCADDRRS

SEQ ID NO: 192242 - protein, 91 aa, Triticum aestivum
  unsure (1)..(91): unsure at all Xaa locations
  Clone ID: PAT_TA_86660.pep
PLALQPFLVLISHRMRPNSNQYWYWSRWRAGDMFQLSDRLLYXPAYNSXESGMYHAIVAMAWVGKVWLRMYILMIMDSMKWNSLRSGPXTF

SEQ ID NO: 192243 - protein, 75 aa, Triticum aestivum; identical to SEQ ID NO: 116116
  Clone ID: PAT_TA_86661.pep

SEQ ID NO: 192244 - protein, 171 aa, Triticum aestivum
  unsure (1)..(171): unsure at all Xaa locations
  Clone ID: PAT_TA_86662.pep
HIHGRRGQAGHPQGRGAGRPRLADARAVSRAAPRVESRAAALAASLADAQATSSPDARATSMTRSGSSLHRRLLXARARLLLPSGARRTLHSGRAVSTPSSMARYGNYRGLLPPASAPDTXWAAXSPSLPXTXTRRXRRXKSGNLFCXXHKLAXVRSGVXMFCGFPXKSTE

SEQ ID NO: 192245 - protein, 73 aa, Triticum aestivum
  unsure (1)..(73): unsure at all Xaa locations
  Clone ID: PAT_TA_86663.pep
FFTVVKQAKYTENKTSKVSTSXTRNLTSICTERFSTGYNPKGQSSAHYTLXKTRRRNLRLPHTIFTCIQIWSG

SEQ ID NO: 192246 - protein, 90 aa, Triticum aestivum
  unsure (1)..(90): unsure at all Xaa locations
  Clone ID: PAT_TA_86664.pep
QMPEHPTPCLPRLKGVQHNNISTHAKNDRLHQPFTRHKSEGATYGRTPSXRRTEEETTETQLGXYILKLKVYLXSHPAFLQLLMNTWFXD

SEQ ID NO: 192247 - protein, 139 aa, Triticum aestivum
  unsure (1)..(139): unsure at all Xaa locations
  Clone ID: PAT_TA_86665.pep
PPPPPPQQSTAPRPPLAGATTTPSQSKNAILVSNRQKGNPLLKHIRNARWTFADIVPXYVIGQSSCXLYISLXYHLLHPDYLYYRIRESKXFKLRVILCHIDIEDVVNLYXITRTSLLHDCTFCWLXLENVXVLEXINV

SEQ ID NO: 192248 - protein, 148 aa, Triticum aestivum
  unsure (1)..(148): unsure at all Xaa locations
  Clone ID: PAT_TA_86666.pep
QRLIFAGKQLEDGRTLADYNIQKESTLHLVLRLRGGMQIFVKTLTGKTITLEVESSDTIDNVKAKIQDKEGIPPDQQRLIFAXGKQSEDGXTLADYNIQKXPPSLGCSPPWWHAWWDCLSWVTSSVPRWDVFPSCLVATCCGQRIRCV

SEQ ID NO: 192249 - protein, 138 aa, Triticum aestivum
  unsure (1)..(138): unsure at all Xaa locations
  Clone ID: PAT_TA_86667.pep
PNEATFVAVLSACDNLGLVEGGMRLFSEMENKYRIQHTVQHCTSVVNMLGKAGMVDEAYEFMSKRPRLGSEPTVLRALLHASSVHGNIRIGEMXAKXYSDLGPDNAHHFVTLMKMYDNTGRLEDSEKVKKTMRDKSLT

SEQ ID NO: 192250 - protein, 140 aa, Triticum aestivum
  unsure (1)..(140): unsure at all Xaa locations
  Clone ID: PAT_TA_86668.pep
MGKIKIGINGFGRIGRLVARVALQSDDVELVAVNDPFITTEYMTYMFKYDTVHGHWKHSDIKLKDDKTLLFGENXITXFGVRNPEEXPWGEVVPITCGXTGVFTDKDKPXCSXKGGAKKWHLCPSKEPYFVVGVMRTLHS

SEQ ID NO: 192251 - protein, 101 aa, Triticum aestivum
  unsure (1)..(101): unsure at all Xaa locations
  Clone ID: PAT_TA_86669.pep
EFLALVSRQGGLRAVHEIRGHTLGGRGPHSRGXPETLLAQLRCSVVFFWSIKNPQKLARQLDSIWVSLFCKTPKQGENINWALGSKLIXIPKSYXMTYXCI

SEQ ID NO: 192252 - protein, 131 aa, Triticum aestivum
  unsure (1)..(131): unsure at all Xaa locations
  Clone ID: PAT_TA_86670.pep
VDPWPIARLQAMATQGVTLETLPNKVPLDFLKKITSNFSKELQLGEGAFGEVYKGILDSGELVAVKKLAENPLCHVKQYLTMTSKYYGAPNMKICELVASAGKHKQTGADMEAYYCRIIELTRYEYFLXGA

SEQ ID NO: 192253 - protein, 155 aa, Triticum aestivum
  unsure (1)..(155): unsure at all Xaa locations
  Clone ID: PAT_TA_86671.pep
MAPKAAEKKPVEKTPAGKKPKAEKKVPASKEGGEDKGKKKAKKSVETYKIYIFKVLKQVHPDIGISSKAMSIMNSFINDIFEXLAGESAXLARYNKNPHHVPGQTPSASPRLAKHPSPRAQGVTHSPSRALVCFFSRGLIICTCVTPHLYMCNIF

SEQ ID NO: 192254 - protein, 62 aa, Triticum aestivum
  Clone ID: PAT_TA_86672.pep
PRLVKTIHRTNRSRNKTCVRTLWTFPSTKKGFTLAMYIMKVEQPAPLPCPVIGPLPYWTPSQ

SEQ ID NO: 192255 - protein, 100 aa, Triticum aestivum
  unsure (1)..(100): unsure at all Xaa locations
  Clone ID: PAT_TA_86673.pep
FFFFEIXKXXGSNLRKCPWXXGKXXLENQEQGXNWXXNSXXFXKVTHSXLSTXIKVAAVEFPTFLLSPFFRSFXLFLSPRIDALQATIGNXEHLATRLSR

SEQ ID NO: 192256 - protein, 122 aa, Triticum aestivum
  Clone ID: PAT_TA_86674.pep
IACDTENTRVFACFYSSQTGIWSKINSLQLQSFMSTPEPSTLIGNSFCWLLKVHPDLQHVILEFDLDKQSLTVTDLPPQVKARPFNLRIVPTEDGGLGSSISQHFTAIMEERPGSVWCTTDY

SEQ ID NO: 192257 - protein, 70 aa, Triticum aestivum
  Clone ID: PAT_TA_86675.pep
LQEGVIGGAGLDVFESEPDVPPELFSMDNVVLSAHRAVATPESIRGTIELVAANLDAFFAGKPLLSPVEL

SEQ ID NO: 192258 - protein, 88 aa, Triticum aestivum
  Clone ID: PAT_TA_86676.pep
TTQNNYPLRPSKCFWVTLSIDCADAVGDISRYRRSPQLGLPAPPPSTCCRIQMQHSGLPGRLDSLRQALTMQGVLDLGVQGCRQTSWT

SEQ ID NO: 192259 - protein, 53 aa, Triticum aestivum
  Clone ID: PAT_TA_86677.pep
YNEETRLNTTQTALLSYVVNNRLTPQASHVHSLRTLISSYQASTSPPSDLRPG

SEQ ID NO: 192260 - protein, 101 aa, Triticum aestivum
  Clone ID: PAT_TA_86678.pep
PPPSPVVPDGWTVVTNTTDLAIQQVGQFAVRIYALSTGKLRLGFVDVVSGMTRPSNGGFDYQLVITVSDGPAPRNNRPYNASVWGILGTMSWKLWSFTLMV

SEQ ID NO: 192261 - protein, 60 aa, Triticum aestivum
  Clone ID: PAT_TA_86679.pep
GPHLPRRQAGGQPQPAPHPHPCHHPRRRAGGQVVRPSPPSPPFAQILKSRAVNGFTVCSL

SEQ ID NO: 192262 - protein, 53 aa, Triticum aestivum
  unsure (1)..(53): unsure at all Xaa locations
  Clone ID: PAT_TA_86680.pep
LPGXXNLVSYXXXLXAXQPYFWGANXLTXGFXSXAFLXXXGNXYXATSVVYYA

SEQ ID NO: 192263 - protein, 121 aa, Triticum aestivum
  unsure (1)..(121): unsure at all Xaa locations
  Clone ID: PAT_TA_86681.pep
MARTKQTARKSTGGKAPRKQLATKAARKSAPATGGVXKPHRFRPGTVALREIRXYQXKSTELLIRKLPFQXLVREITXDFKXDLRFQSSAXSALXEAAXAYLVGLFDDTXLCXIHVXRHII

SEQ ID NO: 192264 - protein, 34 aa, Triticum aestivum
  Clone ID: PAT_TA_86682.pep
RRTANHGFHVEKHQSALALWWQRSELVSVSAWRC

SEQ ID NO: 192265 - protein, 58 aa, Triticum aestivum
  Clone ID: PAT_TA_86683.pep
PPFFDPFRPTDLRSVLLCSRRKHYLQGSSVCLGQLNKNTRGPEQKKEKRKNVPCRKNE

SEQ ID NO: 192266 - protein, 75 aa, Triticum aestivum
  unsure (1)..(75): unsure at all Xaa locations
  Clone ID: PAT_TA_86684.pep
XXVCRFXVIIRXYXIVFLDHXXLXERTLFXCLLXWCNXTSWVPNEVYSSCLSVXVQHXDTSIPAYVSTKFGLERM

SEQ ID NO: 192267 - protein, 91 aa, Triticum aestivum
  unsure (1)..(91): unsure at all Xaa locations
  Clone ID: PAT_TA_86685.pep
PGXAREKTXVRXLKXSPXDPGTFRSQRRPTDGREAQTQRFGNNIEETEDTSVNAGFSGSKPGQRKKPFKGNRQGRSSILSKLDGPYLFPLN

SEQ ID NO: 192268 - protein, 93 aa, Triticum aestivum
  unsure (1)..(93): unsure at all Xaa locations
  Clone ID: PAT_TA_86686.pep
MQHVNSKIIVCSXPQRGPYLSLSMQEGRKRNKSXTAFSXSQGRLRVSKVSKTQXAXTXHGKDNPPPQGGRTIPXXIYYXXXAXLNSDXKPGYN

SEQ ID NO: 192269 - protein, 120 aa, Triticum aestivum
  unsure (1)..(120): unsure at all Xaa locations
  Clone ID: PAT_TA_86687.pep
XLVIXARIPGFXVRCSTPASXLDSNIYRSMCYVTCIMIWLLLIHSGYMFDRNMCTICVYSAISISCCYVDQARTYRHGMHARLMTACLSIHRAIASSTPQYSTPYVLILEASVCIERSIN

SEQ ID NO: 192270 - protein, 116 aa, Triticum aestivum
  unsure (1)..(116): unsure at all Xaa locations
  Clone ID: PAT_TA_86688.pep
GRPRACVQFSSPGDVVCRHVVLQLHIAACAVHNRCCCISXACPRAWSPPPVQFGQSCSSLSSPHAVRGERQRYGSETRMSEAFYVRATSEGARQVGIRXWGSLELAVAPRFXATDR

SEQ ID NO: 192271 - protein, 121 aa, Triticum aestivum
  unsure (1)..(121): unsure at all Xaa locations
  Clone ID: PAT_TA_86689.pep
MVSLKLQKRLASSVLKCGKGKVWLDPNEVNEISMANSXRQNIRKLVKDGFIIRKPQKIXQSRARRAHEAKQKGRHSGYGKRRGTREAXLPTKIXWIRGSRPRXLLRKYREAKKIDKHMSMT

SEQ ID NO: 192272 - protein, 88 aa, Triticum aestivum
  unsure (1)..(88): unsure at all Xaa locations
  Clone ID: PAT_TA_86690.pep
KXXXIIHSXGTXXSCHIYTFLVNDSILYGLIPSVTLHGLDILPQFCADSAPQEDLYKHVQQKIVVXKDIVLTXERSINXNLNLHIPHA

SEQ ID NO: 192273 - protein, 110 aa, Triticum aestivum
  Clone ID: PAT_TA_86691.pep
RLCWCRWQRHRPATPIRSDLSVDKGSSMVLPAVQILSSRVAQIYHQATSCACVRSVSGSHRGRRTISSAPISHADTSGTICPRPREPTRYRVVLAGIISNIFRAIHGLDA

SEQ ID NO: 192274 - protein, 120 aa, Triticum aestivum
  unsure (1)..(120): unsure at all Xaa locations
  Clone ID: PAT_TA_86692.pep
LSGLPIKVQTVGDIGVTGVLRRPRNEALAGLYVKLDLTHTLLSHLMITPPLSRLTGPCKSVPVANNPXANHLRPCLVIHQLPESGGNCSSVILNYSFTSFGSGLXXKXTPGLNLDSVANI

SEQ ID NO: 192275 - protein, 150 aa, Triticum aestivum
  unsure (1)..(150): unsure at all Xaa locations
  Clone ID: PAT_TA_86693.pep
FPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLXKLKDLQFFVGESMHDDGGVVFAYYXEGAADXTFLYFTWAERGKC

SEQ ID NO: 192276 - protein, 93 aa, Triticum aestivum
  unsure (1)..(93): unsure at all Xaa locations
  Clone ID: PAT_TA_86694.pep
HHCLIPSTXDHVSTVLVYCKHVTTASPPCTNNKFLPADADACQCQPCTVTDNMCRESATMGSYCSSCCSTAATICMEPVTQMRPPRAAPPPSA

SEQ ID NO: 192277 - protein, 50 aa, Triticum aestivum
  Clone ID: PAT_TA_86695.pep
HIMDSIISRELTKYNMNHKLFLLHGPTVLLIYSSATTSGWGPEVTYVEVN

SEQ ID NO: 192278 - protein, 100 aa, Triticum aestivum
  unsure (1)..(100): unsure at all Xaa locations
  Clone ID: PAT_TA_86696.pep
TTFGLPYANISTARPSPYFDVTPRVRCARCLPVIRRCCHVFCLRXAFHHVMMCIASSCFQNFHPSRYPRSFVARSDSSHTCTARGCSNRFXVAGKCSGMG

SEQ ID NO: 192279 - protein, 81 aa, Triticum aestivum
  unsure (1)..(81): unsure at all Xaa locations
  Clone ID: PAT_TA_86697.pep
TXYVXKTFIQTRESCPLLLYAINAIENXRKCKNRENKITXTVPNRFAFPSTTTKNKSIPTKRKGHVPFYMITXARILNFNF

SEQ ID NO: 192280 - protein, 73 aa, Triticum aestivum
  Clone ID: PAT_TA_86698.pep
RGKSLSIASKVHDPSLQKQKKNRMYLKRTELSSYCTKEHPLMSHDSSNSGKQQQTQSGPCETCNAHNFTAFEQ

SEQ ID NO: 192281 - protein, 123 aa, Triticum aestivum
  Clone ID: PAT_TA_86699.pep
LVWLTQEASSSTVHCTRLNHTCTLVSCANERIFFATAEISMSPPSPSIQKPHFHCSSLFSKFKPSLLHTGSAASSPTTLLLAVLPHRRLPFFLELRLLAGDPSSCSATSSPATLLLVAPPPRQ

SEQ ID NO: 192282 - protein, 57 aa, Triticum aestivum
  unsure (1)..(57): unsure at all Xaa locations
  Clone ID: PAT_TA_86700.pep
SXYXAXXTGIVXKPCXXCSIPXTXISINXGXXDQVNXXYLMKPXSLALXRKHCLQHX

SEQ ID NO: 192283 - protein, 91 aa, Triticum aestivum
  Clone ID: PAT_TA_86701.pep
SAPETIIISPESSPRHSPQRNPQRESITHFPLADVGAYIFTANLSVCRRRKDRRSTEGTRHAPRNKRQDDPTRITESTLTNVLGRSTHTLK

SEQ ID NO: 192284 - protein, 91 aa, Triticum aestivum
  unsure (1)..(91): unsure at all Xaa locations
  Clone ID: PAT_TA_86702.pep
AELKPGEDGWTYDTRANGMLAGNRKLQKRLDRFVCKLPDFEINTIEMIGKEAIPGISHYKEKTVRKVVXNIEYPVLPSDHFGLVLSITYAS

SEQ ID NO: 192285 - protein, 78 aa, Triticum aestivum
  Clone ID: PAT_TA_86703.pep
GGWCFEPNTRVAHASYAFNDYYQRNGRSVQSCDFGGCGSVVYQQPSFGNCVLPQWRNGLKRLGGGPNTGPPYVHLAQG

SEQ ID NO: 192286 - protein, 159 aa, Triticum aestivum
  unsure (1)..(159): unsure at all Xaa locations
  Clone ID: PAT_TA_86704.pep
VMLITTILLSLVMLIIWDTHVVLVALYFVPFLILEGTYVSAVCTKILKGGWMPFAVSLLLALIMFGWYYGRQRKAEYEMANKVTLERLGELLAGPDVHRIPGLCFFYSNMQDWLTPVLAHYIRNLRSLHKVTXFLTLRYSWWQVMQGRVASGAWTNGLW

SEQ ID NO: 192287 - protein, 55 aa, Triticum aestivum
  Clone ID: PAT_TA_86705.pep
HESCFQFLPCLDADCHLIYVVDRRLVQHLSRRIFLQCWHVCPNFIVGNISTLNQM

SEQ ID NO: 192288 - protein, 128 aa, Triticum aestivum
  unsure (1)..(128): unsure at all Xaa locations
  Clone ID: PAT_TA_86706.pep
SVVNGGVWLLDSTHLXAMARRVVVDVVDHKGSIGLGVERLKVARGRLVAAEXPETEDDRRRPKQRERXDPRRSRALLXALVVEDDVVETGGDDGQDGEAMRWLWPRGRRRTAATASVSSPERRRGRGE

SEQ ID NO: 192289 - protein, 71 aa, Triticum aestivum
  Clone ID: PAT_TA_86707.pep
SREDCHGESSQHTSQPPKSTLSEITLILQINKPKTGELLLLVVRPANRFSSLILVSSSIHLSFLYIILSVG

SEQ ID NO: 192290 - protein, 142 aa, Triticum aestivum
  unsure (1)..(142): unsure at all Xaa locations
  Clone ID: PAT_TA_86708.pep
MACXXAIFVXLSLLLSAVAAXGCXSTYXQPPVXVPXQXVXVPPXXHXGGGXXHXXXHGGQCSINVLXLRVCPNXLGXXLGLKIGVPAXXQCCPLLQGLADLDAXVCICTAVRANIXGSTQXAVDISLLLNAVRLPVCLIASH

SEQ ID NO: 192291 - protein, 117 aa, Triticum aestivum
  unsure (1)..(117): unsure at all Xaa locations
  Clone ID: PAT_TA_86709.pep
GKHRVPFVSCYLRSSNAQFGTPYPRSASFDTDIGAFIESSFVSSKEGSMDRLVINESITSRRALAPGKVLQLRGFTVGVRLAVKPKAAPTIAKHHLRISLEHSENMYPADVSNDTXV

SEQ ID NO: 192292 - protein, 53 aa, Triticum aestivum
  Clone ID: PAT_TA_86710.pep
AFYNYLRSPYIPPHKHEELLWIYKEGLCLTTFVVPLKTSFVAVATADSSHPIT

SEQ ID NO: 192293 - protein, 97 aa, Triticum aestivum
  Clone ID: PAT_TA_86711.pep
GGLRFTISGFNFFELVLVTNIAMSGSIRSMSVKGTNTAWITMSQNWGANWQCLAGLKGQALSFAITSSGGQYKVFQDVVPAWWLFGQTFSTWQQFDY

SEQ ID NO: 192294 - protein, 108 aa, Triticum aestivum
  unsure (1)..(108): unsure at all Xaa locations
  Clone ID: PAT_TA_86712.pep
RLRRSGTEDDTGCTEAGEAAYVLARVTARCRVRWKPVGIYSPIVVXKVSPAAGTRLTRALYXRPAPSAIRGPVASLALLLSPWTIRAIDDQFNDVKIPKKXFRXKKXX

SEQ ID NO: 192295 - protein, 49 aa, Triticum aestivum
  Clone ID: PAT_TA_86713.pep
HTHMRHIRGQMPMALTSDTAPGALCTRYTTYTQSCRSRGVISPGSPELG

SEQ ID NO: 192296 - protein, 121 aa, Triticum aestivum
  unsure (1)..(121): unsure at all Xaa locations
  Clone ID: PAT_TA_86714.pep
LTSSITKLIYLQTIDLRGTTTKSSMPKSFWHIPTLRHVYLNEEFSPPARNVRPNDFQTLFIELCSNRMIKFLGQMTKLTTLSLXYGPMIXGLLCIFGSMPHLVDVSIGNFQDYGMHSVVQS

SEQ ID NO: 192297 - protein, 111 aa, Triticum aestivum
  Clone ID: PAT_TA_86715.pep
TTKSSVMVTLLCCNVKFSTRFLYFDKEEPCLTDKLVPRPFLGGAATTLYNFVNMKYHAPIFLLICCYSDLVNLLQSEMLFAFVNLCKCLSRDALCICYICKCLPCFPLKKK

SEQ ID NO: 192298 - protein, 108 aa, Triticum aestivum
  unsure (1)..(108): unsure at all Xaa locations
  Clone ID: PAT_TA_86716.pep
VVEPYNSVLSTHSLLEHTDVAVLLDNEAIYDICRRSLDIERPTYTNLNRLVSQVISSLTASLRFDGALNVDVNEFQXTNLVPYPRIHFMLSSYAPVISAEKVTMSLCR

SEQ ID NO: 192299 - protein, 87 aa, Triticum aestivum
  unsure (1)..(87): unsure at all Xaa locations
  Clone ID: PAT_TA_86717.pep
GRFCPFATAHFDRPRVTIHWFSALQHFPIGPKRCRYGKRMLIDHXWVFSGNLNIFASDNXEGSGHIKILMMKISVLLELLGKFQATT

SEQ ID NO: 192300 - protein, 125 aa, Triticum aestivum
  unsure (1)..(125): unsure at all Xaa locations
  Clone ID: PAT_TA_86718.pep
RRRSSARPTTSSALVSMTASMATSRWRTPSRPPSRRPSSGIRRRSLGPRPSTDRPSTSAXISTPRSLQMXGPMIPFQMMRLSSSVSXTKTTRYMFFLMISMVPXGHPDVSIWDCLNWXLXAIMYG

SEQ ID NO: 192301 - protein, 127 aa, Triticum aestivum
  unsure (1)..(127): unsure at all Xaa locations
  Clone ID: PAT_TA_86719.pep
MXGRGKGXKGLGKGGAKRHRKVLRDNIQGITKPAIRRLARRXGVXRISGLIYXETRGVLKIXLENVIRXAVTYTEHXRRKTVTXMDVXXALXXXGXTLYXFGSAATILSLCQGSWSCIALAVARKWD

SEQ ID NO: 192302 - protein, 107 aa, Triticum aestivum
  Clone ID: PAT_TA_86720.pep
HDVSLFDTTALTTTHNLHDNRTLFMDEFGSKYCDFPGVEKWRYELLVSSLVNMFDNLETFRDEYQDSDSIRKGVEEWHLSAQQAQAAVVAVAPAATKEQLLGLLEKV

SEQ ID NO: 192303 - protein, 75 aa, Triticum aestivum
  Clone ID: PAT_TA_86721.pep
ARLLAKCPGKRLGSCTGSGEVKRHAFFRGVNWALVRSVRPPEVPVPVARSKAKTMSRKERQEPYKQQHEDHFDYF

SEQ ID NO: 192304 - protein, 60 aa, Triticum aestivum
  Clone ID: PAT_TA_86722.pep
KCWYCVPQLLYLLLFLYLVERTCLFEVSMKDRSKESFGEHIYLKFPWELPVVKNSCRKLM

SEQ ID NO: 192305 - protein, 68 aa, Triticum aestivum
  unsure (1)..(68): unsure at all Xaa locations
  Clone ID: PAT_TA_86723.pep
LTSASCSXLXASIRSPXXTSFRWXALXXWVPNXXHYTRXVXSAVVVSQXXSGFAPSPMXRSMAKXFXC

SEQ ID NO: 192306 - protein, 75 aa, Triticum aestivum; identical to SEQ ID NO: 106874
  Clone ID: PAT_TA_86724.pep

SEQ ID NO: 192307 - protein, 118 aa, Triticum aestivum
  unsure (1)..(118): unsure at all Xaa locations
  Clone ID: PAT_TA_86725.pep
XKSAXRXXHKWVXQRAQPPXWILLILLLSSGPXVVVGTSGVVGVVVDGGVKLLGSSILALILSATTSPSMPASTLPMQRVHTLAVEIDGAARPHPSGGREGVPLQDRSGGMPSGFGER

SEQ ID NO: 192308 - protein, 70 aa, Triticum aestivum
  unsure (1)..(70): unsure at all Xaa locations
  Clone ID: PAT_TA_86726.pep
ACFRRLLSLLGYQEATSSHRQLYPFNFHSLNPHIWXSKCHLLHNGHNSSNRSXNPSGGPGTNRXRSRYPX

SEQ ID NO: 192309 - protein, 136 aa, Triticum aestivum
  unsure (1)..(136): unsure at all Xaa locations
  Clone ID: PAT_TA_86727.pep
RNRLENLPGVLRAMGLSHRFLEKISGGGESLRYLSPDFVLEDASYDMEVERAFSDRMVKVKVEMNAXHVDTKLEFLXSIGYGENKKXAHILXVLHSTREMLNERFDYLLGKRGGVQXLXRFVSXXPKVLNQXXRCQ

SEQ ID NO: 192310 - protein, 125 aa, Triticum aestivum
  unsure (1)..(125): unsure at all Xaa locations
  Clone ID: PAT_TA_86728.pep
MLQSSPHLIFFRPPPRDTIYNNPCTHLEWEQNVKPSLRGFEVIDAAKAVLERVCPRVVSCADIIAFAARDAAFFLSSSLXDXXMPGGXXQGXXPLKXRXXFLAPAXLXLKNSQGQGGLVVGTTGF

SEQ ID NO: 192311 - protein, 67 aa, Triticum aestivum
  Clone ID: PAT_TA_86729.pep
KEENIITENETQLMALTAVGHSSLRSGSGSSVHQTIGEILDAGVTGKAAASSSGQATSPYSRGHLVH

SEQ ID NO: 192312 - protein, 117 aa, Triticum aestivum
  unsure (1)..(117): unsure at all Xaa locations
  Clone ID: PAT_TA_86730.pep
EIKHFKNWKPKKISTCMHAVTWQSVAIRTFDQDGSSSPRLPPSRPSQFWHTAKTXPEISXTXQEXXXDSTPXPSFLRVFVGRQPWTAATTATTTAGGGIXXGYRIXWAXPCRXIFPP

SEQ ID NO: 192313 - protein, 60 aa, Triticum aestivum
  Clone ID: PAT_TA_86731.pep
KAHPFYFGLKPLKKMVHIFLGHHKVIGLILIVFSFGHLNAIKYFKCSNNHNLKCLLLDIF

SEQ ID NO: 192314 - protein, 117 aa, Triticum aestivum
  unsure (1)..(117): unsure at all Xaa locations
  Clone ID: PAT_TA_86732.pep
YLKKGRYAQRVGSGAPVYLAAVLEYLAAEVLELAGNAAKDNKKTRIIPRHLLLAVRNDQELGRLLAGVTIAHGGVIPNINSVLLPKKSPAAAXXEAKSPKKKTSTKSPKKKTAATKE

SEQ ID NO: 192315 - protein, 128 aa, Triticum aestivum
  Clone ID: PAT_TA_86733.pep
ETPKRACKFVPYPCPMPYPMQCYLNCPPQQCLCCPTPMPPPQEPKPCECSHWQSHHHGGCCCSSKPALPPPCNWLNHRGCTCSRQPNWPPPTCPPFFPPLCWIEECPPDPCSSCDEIDLLLLLYQHRP

SEQ ID NO: 192316 - protein, 125 aa, Triticum aestivum
  unsure (1)..(125): unsure at all Xaa locations
  Clone ID: PAT_TA_86734.pep
VARAMFACCALDGKIIVAGGFTNCRKSISEAEIYDPEADTWESLPDLRQAHPSACSGLVIKDKMHVLHKGISTVQILEDGGNYWAVEDYSWLQGPMAMVGGXLYVLSNSCIRKQHGENFPDKWSL

SEQ ID NO: 192317 - protein, 77 aa, Triticum aestivum
  Clone ID: PAT_TA_86735.pep
ESKLIEDARKSMNKYQVSNSIVISSAAFSLCCYSQHFGKYLCKGISIKNSLVWCKCNIKKAFPYMLLDVLQKGQVKE

SEQ ID NO: 192318 - protein, 70 aa, Triticum aestivum
  Clone ID: PAT_TA_86736.pep
MPIHVSSFNARHIELAFCHLAQNVENSRDIIITGGIKELLRISKESSRDDARNLAKKALNSNPAFLKEIQ

SEQ ID NO: 192319 - protein, 67 aa, Triticum aestivum
  unsure (1)..(67): unsure at all Xaa locations
  Clone ID: PAT_TA_86737.pep
REFWFTYTHSDIFTINILHAIVFVVDHGRVWLWYTCVQPCKLSSTLVSYFLQYRICHDAFSSAVLXK

SEQ ID NO: 192320 - protein, 77 aa, Triticum aestivum
  Clone ID: PAT_TA_86738.pep
KTGAARQSLRSGTKTGDFYAGYKFRITPKFRYTLVVPESTGLSLADRWTRGPLSVSSAPSGPFFLLSLPRAFSTSDA

SEQ ID NO: 192321 - protein, 83 aa, Triticum aestivum
  Clone ID: PAT_TA_86739.pep
ILKRLSRPECRVDPRRRNLQSSKVVNHTSNTRLQSEHVHGSFILHRRINGIQACLHSTSLFLEVLADILEHNSKITSSSMISQ

SEQ ID NO: 192322 - protein, 153 aa, Triticum aestivum
  unsure (1)..(153): unsure at all Xaa locations
  Clone ID: PAT_TA_86740.pep
DECLRLQLKYSEKDQAENLMIVDLLXNDLGKVCEPGSVHVPRLMDVESYKSVHTMVSTIRGTKKPDLSPVDCIKAAFPGGSMTGAPKVRSMEILDALESNPXGIYSRSIGFXSYXRTFDLXIVIRTVVLHMGKLGGGRRASGLSDLRRSEYPR

SEQ ID NO: 192323 - protein, 51 aa, Triticum aestivum
  Clone ID: PAT_TA_86741.pep
FFFFRECSQYHISLFIQVCFTNHFSYELTPTFHHICTFRRLSLLTNKKERG

SEQ ID NO: 192324 - protein, 163 aa, Triticum aestivum
  unsure (1)..(163): unsure at all Xaa locations
  Clone ID: PAT_TA_86742.pep
PRSXELFRXXSTLXSQITGRFEXXGGSRSRSSDXCQEWLRVNLGFXLCNHQFXGNACRSEMSALHDHQDQVRGLSSCASAACWLQVEFSTRMNHVLRMFAGGTTRRLVDWNFRCAWMEVGEEPFAPGQRTGYNSNLERLEAERHEQLEWQFLEPPAVWRPRRR

SEQ ID NO: 192325 - protein, 77 aa, Triticum aestivum
  Clone ID: PAT_TA_86743.pep
RSTKAQNDNLLGSAQSTKQTLRFIRSSGFTETTNVTCTSCTKIPDYPSCVVHFILADLCIYGHLCTGREETLYDSWL

SEQ ID NO: 192326 - protein, 189 aa, Triticum aestivum
  unsure (1)..(189): unsure at all Xaa locations
  Clone ID: PAT_TA_86744.pep
HTHISTVAAGTLGYLDPEYHATFQLTVKTDVYSFGIVLLEIITGQPPVLMEPQTAHLPNWVRQNIAKGSIHDIVDKRLLDQYDVSSVESAVDIALNCVQNASIXRPTMTEVFQGSKCGTGGFNAKTPYSGIPSKNPWILKFESIRDDIWVNSDTQSGTGWAADRVALSDKEIRLCSLKIGIFSGYVLEI

SEQ ID NO: 192327 - protein, 140 aa, Triticum aestivum
  unsure (1)..(140): unsure at all Xaa locations
  Clone ID: PAT_TA_86745.pep
PMFASVLQDEDDDFXDQQEDSPDDAKDEEYESIEENLRESDFPADSDSETPKLSQDFGNSDDPGSENGDVSFPREASSTKFNAFARNMHDLPGXELPAPWXSSHHPHLLPYANDTSDGDALSITNRHPSRGISSLVKYRC

SEQ ID NO: 192328 - protein, 99 aa, Triticum aestivum
  Clone ID: PAT_TA_86746.pep
RQPAYSNEGFTIAPRGLDKNLPTWPPDPVLGHFGRVQQFSTCTQERVISECDILRPQTGKMRRLNVQDLNATTLPSKHVSQHGSGSHVRLKPSLGLDIW

SEQ ID NO: 192329 - protein, 82 aa, Triticum aestivum
  Clone ID: PAT_TA_86747.pep
DNTPLSVLPAAIKVRVLRAMSSSLGINIGTATCITTGPDFLKQQAVTDLTKWDCLWITVAWGFLFRILFYISLLLGSRNKRR

SEQ ID NO: 192330 - protein, 94 aa, Triticum aestivum
  Clone ID: PAT_TA_86748.pep
CSGQIGLHLAADLHGGAARIHTFKQKTMGRSIRCAKEGHLRWMLRQGRRPCRQRNAPEATTFGRRGVGAGARWIMGNRATELGRWLTELAGGRG

SEQ ID NO: 192331 - protein, 143 aa, Triticum aestivum
  Clone ID: PAT_TA_86749.pep
IPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLHVAVSSWPWICFCLWVSLVVLGVSNGSVR

SEQ ID NO: 192332 - protein, 149 aa, Triticum aestivum
  unsure (1)..(149): unsure at all Xaa locations
  Clone ID: PAT_TA_86750.pep
RFSYKELDRATARFDQSNKIGEGGYGPVYKGTLRDGTAVAVKVLSLQSRQGAREFLSELITISDISHENLVKLYGCCVEGSHKILVYNYLENNSLAQTLLGSQQHNSIQFNWRTRVNICIGVAQGLAYLHDXVRPHVVHRDIKASIYSG

SEQ ID NO: 192333 - protein, 127 aa, Triticum aestivum
  Clone ID: PAT_TA_86751.pep
IACSLRDLRSRPALSPFLSQFFSLLFPSQVFLSEQFFGQRRSSYSDPTLLLCRRLVPSNIVQWFNLPPLIPTSNLLRPLSLLFADPLLFRVVFIPLFPKVSYVLPWRHFPLLQFSVRDYPLLLRRLQ

SEQ ID NO: 192334 - protein, 118 aa, Triticum aestivum
  unsure (1)..(118): unsure at all Xaa locations
  Clone ID: PAT_TA_86752.pep
RTTKLLCHLLAXGKEXADGKHHLCLVXVKTGRXSGXGSXTVXQGPDGNRXQGTRFFXPGSGLSMXVIPYSCLIXLMXWVXXSXXHXIXEXNPKSYLXSDCCXGVYAXGYNLRLIEXVG

SEQ ID NO: 192335 - protein, 84 aa, Triticum aestivum
  unsure (1)..(84): unsure at all Xaa locations
  Clone ID: PAT_TA_86753.pep
RLSCXITFAAGDVIVSVDQVAGCPQQXCVGAAMRRXSCPTQRSIXEHNAVSSGRXISGSGAASLEVYVMYMTDEAIFIAYLITI

SEQ ID NO: 192336 - protein, 59 aa, Triticum aestivum
  unsure (1)..(59): unsure at all Xaa locations
  Clone ID: PAT_TA_86754.pep
EHVFGVAHIFASFNDTFIHVTDLSGRETLVRITGGMXVKADRDESSPYAAMLASQDVAG

SEQ ID NO: 192337 - protein, 85 aa, Triticum aestivum
  Clone ID: PAT_TA_86755.pep
RLHDLNLLDVKNRSISEVYVSPNSKLAGCRGSDEVEEKQSILELVRTSSTHLIYCGLKHTLIQVRNSRCTSTTTTTVLLEASLLP

SEQ ID NO: 192338 - protein, 81 aa, Triticum aestivum
  unsure (1)..(81): unsure at all Xaa locations
  Clone ID: PAT_TA_86756.pep
DCYEXYNLSCLESGPLYLVEXSGWLVFLFLLLAGEHAWFFRSRASFCTIYKLIVTLLGEHACSCLDQVLPSVLSKKKKKKT

SEQ ID NO: 192339 - protein, 123 aa, Triticum aestivum
  unsure (1)..(123): unsure at all Xaa locations
  Clone ID: PAT_TA_86757.pep
LNMSFPIFHAAGRVLMDECRMAALFGVVVASTAARPGKVNASVALKMDWWRLVAAASECAPDRWVPHTRQVAWLGSQVLDVRFGCXVCLVLXLDXHPFINWIXVATDVVXTWFSLLLYTCKSL

SEQ ID NO: 192340 - protein, 82 aa, Triticum aestivum
  unsure (1)..(82): unsure at all Xaa locations
  Clone ID: PAT_TA_86758.pep
GWWXLATRRPSTXXTPTAXXPDXGSMEGXSSXSTSSESDLXAARHGGWSLVNXRFXRFCAFGWXKXVSLQGAXTXVGXXKWX

SEQ ID NO: 192341 - protein, 60 aa, Triticum aestivum
  Clone ID: PAT_TA_86759.pep
YLLAFDFPLGSFVVTLFVSMSPVLLDHYCFIIQSFLLSFLRFFYFLYYPLLPLFFELFIL

SEQ ID NO: 192342 - protein, 76 aa, Triticum aestivum
  Clone ID: PAT_TA_86760.pep
RDVPTRLPPYNVFCILFVFSMWNLCAYPYNTLMCHYLLFFFRQLCIMPCRTEMPSISYILLILFAAFLFLRKKKKK

SEQ ID NO: 192343 - protein, 36 aa, Triticum aestivum
  Clone ID: PAT_TA_86761.pep
GYKLLLANYNYITILVVYPYSLPYTRFHSLEKGTFN

SEQ ID NO: 192344 - protein, 30 aa, Triticum aestivum
  Clone ID: PAT_TA_86762.pep
ISFKVQILVCRDNLRGKLLAIMHQNGILTK

SEQ ID NO: 192345 - protein, 87 aa, Triticum aestivum
  unsure (1)..(87): unsure at all Xaa locations
  Clone ID: PAT_TA_86763.pep
NSPQCHLKFDSCQGVMVHNLTISSPENSPNTDGIHLQNSKDVNIHHTDLACGDDCIXIQTGCSNXTYIMLNCGPGHGXSIGGQXKGT

SEQ ID NO: 192346 - protein, 70 aa, Triticum aestivum
  Clone ID: PAT_TA_86764.pep
VWRGEILAMAKMYTQCLRVQALLGGNNSPTPRCPEAVDWIMYVVLQEVRTLVPEEGGGLYRVRQDPSPAP

SEQ ID NO: 192347 - protein, 107 aa, Triticum aestivum
  Clone ID: PAT_TA_86765.pep
MARALDGCYSAKDVAYSCGYCGYALNLSSSTRNTANIGSKYGKQIRKGVVSFFAIDESRFTQTDEVSCTPYFRSSRSWGFFRKRTRLLCRKCSGHIGNLMTTRICLV

SEQ ID NO: 192348 - protein, 129 aa, Triticum aestivum
  unsure (1)..(129): unsure at all Xaa locations
  Clone ID: PAT_TA_86766.pep
HESLLEALPGDNVGFNVKNVAVKDLKRGFVASNSKDDPAKEAANFTSQVIIMNHPGQIGNGYAPVLDCHTSHIAVKFAELVTKIDRRSGKELEAXQFLKNGDAGIVKMIPPTHGCGTLPLTSSWPFAVT

SEQ ID NO: 192349 - protein, 169 aa, Triticum aestivum
  unsure (1)..(169): unsure at all Xaa locations
  Clone ID: PAT_TA_86767.pep
EDGWLDTASGAATSTAMEPNTYLVPHKAHDSEVPDSLPDSEPPAPLPVESNWAPIMEFTVADIFQHSPFGDILNSLKHLSLSGDPGPNYGQDGWDADDKEFRPTHHPLRTTVDDLTNVLRLRSEDIDGMDDDPGRLSRTMLQDTGRHSSYDIYMVASKRWDGXNNGGXP

SEQ ID NO: 192350 - protein, 158 aa, Triticum aestivum
  unsure (1)..(158): unsure at all Xaa locations
  Clone ID: PAT_TA_86768.pep
KTLLFGEKEVAVFGCRNPEEIPWAAAGAEYVVESTGVFTDKDKAAAHIKGGAKKVIISAPSKDAPMFVCGVNEKEYXSDIDIVSNASCTTNCLAPLAKXINDRLALLRVDDHIHAMTATKKTVDGLQQDWKVERCHSTHPTHGCAKFGSQTYGTGSST

SEQ ID NO: 192351 - protein, 137 aa, Triticum aestivum
  unsure (1)..(137): unsure at all Xaa locations
  Clone ID: PAT_TA_86769.pep
RKTKEMNFCLCAYDQNRVMLIGRGVSYHKTDETALCCSAYGQNGVLFIRRGVVYHKTGVDGLLFIHRLLLPLALASMGYCSSTIVLQTPPATVHRASTGACSSTPTGWDVAASXGSCSSXXTTTTRVCSSNSSAGWX

SEQ ID NO: 192352 - protein, 157 aa, Triticum aestivum
  unsure (1)..(157): unsure at all Xaa locations
  Clone ID: PAT_TA_86770.pep
KSSITDRKTSLPSRRPRSVPSSSLDPNMAARIGAAVLCMVLIIXRGARSHSDRSSXRGTRPLCCRGHQCGRRCQRRRRSSGEVEYRXEAARRRRSQAGXAGXXGPGAPSLXSREPCMTRRLRRXSIRFPRTTVSSRGXSIXRCSDXLXGNYFIXXGI

SEQ ID NO: 192353 - protein, 62 aa, Triticum aestivum
  Clone ID: PAT_TA_86771.pep
VHQAEVPGQGAQVRSGCGDQKYGGLISLSQQPKMAAPAKLQLLLPPLALLIKLLGLQYRLVR

SEQ ID NO: 192354 - protein, 76 aa, Triticum aestivum
  Clone ID: PAT_TA_86772.pep
LDSVYGRRMVSVLCQVIPSMHNIGPGLLFRLTPFSLEARKGGDIYHNISNILHSIDSMPSIGTTICSPCLMGSVWL

SEQ ID NO: 192355 - protein, 83 aa, Triticum aestivum
  unsure (1)..(83): unsure at all Xaa locations
  Clone ID: PAT_TA_86773.pep
FVRLIDRPGFYQVGRSSFSCVFFGPVGWLDCFELKKQFIPIGYIYTTRRGKRNEKXKSRTCRGTLVVSELTXQMSNILXKXKG

SEQ ID NO: 192356 - protein, 72 aa, Triticum aestivum
  Clone ID: PAT_TA_86774.pep
ACSALSKENDKLETRIVEQSNSRNEATLKEQKGKQQQLDQQQQQQQQSPHDSFALPDLNLPAQDGADGSVPC

SEQ ID NO: 192357 - protein, 62 aa, Triticum aestivum
  Clone ID: PAT_TA_86775.pep
PVVADWAIRNASCPEEGKDMPNDYACISVNSHCVAANNGPGYLCQCSKGYEGNPYLLNGCQG

SEQ ID NO: 192358 - protein, 63 aa, Triticum aestivum
  unsure (1)..(63): unsure at all Xaa locations
  Clone ID: PAT_TA_86776.pep
YKCFASESCSFLSETELAVSYLKLKLAVSSRLHFXTPMKLHFLSAKNRSVEFIKFFICSILQI

SEQ ID NO: 192359 - protein, 94 aa, Triticum aestivum
  unsure (1)..(94): unsure at all Xaa locations
  Clone ID: PAT_TA_86777.pep
RIXXTXERXCXFLGAVXQCTXXXSSCFYLVFTXSKFSRHXTSXEXCLXLTFTLXDMXQRELSGHPYXGXNPYTXNSMLKXXGXKDAPDGXILPD

SEQ ID NO: 192360 - protein, 71 aa, Triticum aestivum
  unsure (1)..(71): unsure at all Xaa locations
  Clone ID: PAT_TA_86778.pep
AHPXRALALHXLXXXTAAAGXSXAAXGASSDAAGXSSXTAGASGSAGGAAXSFXSXGSAGSASXHGGPWCX

SEQ ID NO: 192361 - protein, 66 aa, Triticum aestivum
  Clone ID: PAT_TA_86779.pep
PSILLSIITHQHNSHITSPYPKLLLRIKFILSNDLHDIFFTLSFLDSYHFGTNFHELLFISSTKYK

SEQ ID NO: 192362 - protein, 109 aa, Triticum aestivum
  unsure (1)..(109): unsure at all Xaa locations
  Clone ID: PAT_TA_86780.pep
CRAKQGRGQFLLVLSVTASLDTSLALTLTCGGFSRPYAPSSLDNNTKGIPNFIFALLHALFPFSSVVXCNLIPVKRLTWLIXQXIRNKYXLXYDSQESXXVCIXRLLXS

SEQ ID NO: 192363 - protein, 74 aa, Triticum aestivum
  unsure (1)..(74): unsure at all Xaa locations
  Clone ID: PAT_TA_86781.pep
SPEIHXLMXLWSACYWRYHTRNRDHQLVNXXSMIXSIDVLDLAYISEVCXXXCVYRYXXPAXNWISVGRXLXFX

SEQ ID NO: 192364 - protein, 83 aa, Triticum aestivum
  Clone ID: PAT_TA_86782.pep
GSRYFSGKEVEAQEDEMRGGKLRCRQPLCCIVADGKWITAFYSRPEYGAITLLCVILSNCLLFVSQDDASRTISLGFSCNNKA

SEQ ID NO: 192365 - protein, 109 aa, Triticum aestivum
  Clone ID: PAT_TA_86783.pep
NYSLRPEKCFVFFAKKKKNLIRLTPLKNKPVSFLPPPPPAGATVGSNATDHLRSRHGGPPAQLDHRNPPALPHHRRPRKRPAHQPSGAAPPSTCAAATEATTAATRRTS

SEQ ID NO: 192366 - protein, 91 aa, Triticum aestivum
  Clone ID: PAT_TA_86784.pep
WMNQAKRAFKKIIMQLIVMLIPRMRLKIITRCIRKNFNKLVVCSFNLLHVLVAGPEKHTLYWVLALRKKEITASGKLCWDINSNRCSTYGD

SEQ ID NO: 192367 - protein, 162 aa, Triticum aestivum
  unsure (1)..(162): unsure at all Xaa locations
  Clone ID: PAT_TA_86785.pep
ATKAARKSAPTTGGVKKPHRYRPGTVALREIRKYQKSTELLIRKLPFQRLVREIAQDFKTDLRFQSHAVLALQEAAEAYLVGXFEDTNLCAIHAXRVTIMPKDIQLARRIRGXRPRSTSPYNSIAGCTCTVPLVQICWIGTLFAVKKSGWYRLQRSFLSLAK

SEQ ID NO: 192368 - protein, 73 aa, Triticum aestivum
  Clone ID: PAT_TA_86786.pep
GSVKSMSVKGTNTAWIPMSQNWGANWQCLAGLKGQALSFAITSSGGQYKVFQDVVPAWWLFGQTFSTWQQFDY

SEQ ID NO: 192369 - protein, 81 aa, Triticum aestivum
  unsure (1)..(81): unsure at all Xaa locations
  Clone ID: PAT_TA_86787.pep
XLLENLQXXPWLKXXQQXHEXHVVKNXPLQSTXTSERSPTXGARRXCSLCHTXNSSKHQDGXKLTIQVLTDPMXPXRDTAX

SEQ ID NO: 192370 - protein, 73 aa, Triticum aestivum
  unsure (1)..(73): unsure at all Xaa locations
  Clone ID: PAT_TA_86788.pep
ISEQVATFPDLSTLVTLVVNMVQMHNSTYFVSFSLHTWHLVRKCXLYYVXRDKYDEPNXXGXHVKKLXFXGXV

SEQ ID NO: 192371 - protein, 68 aa, Triticum aestivum
  Clone ID: PAT_TA_86789.pep
LEAKLTMAILLQRFEIRASPNYVHAPTVLMLLYPQYGAPLIFRPLASQPSAGSTTSSCPPSPQFLCQN

SEQ ID NO: 192372 - protein, 56 aa, Triticum aestivum
  Clone ID: PAT_TA_86790.pep
MEPLEAAIAIVFNALLLVFMVKLFFAMFQMKLVVILFYLVVLLFALAFSGRGPAGF

SEQ ID NO: 192373 - protein, 111 aa, Triticum aestivum
  unsure (1)..(111): unsure at all Xaa locations
  Clone ID: PAT_TA_86791.pep
KAVKSGSIKKTAKKIRTSVTFHRPKTLSKARDPKYPRISTPGRNKLDQYQILKYPLTTESAMKKIEDNNTLVFIVDLKADKKKIKAAVKKMYDIQAKKXNTLIRPDGKKKA

SEQ ID NO: 192374 - protein, 138 aa, Triticum aestivum
  unsure (1)..(138): unsure at all Xaa locations
  Clone ID: PAT_TA_86792.pep
AFEIPPVCTHTWPYFLSCTLAVVRTCTCYVRASTMTRTRLYYDTCVPLHPLVYMYIHVRDQNDTYVRSTSGSRLSGTPCLRRCTGGSSSQGANILPGHXCCXISGGPKXGGXFRXXRAXRGSNCRXEHISLKXDSCAA

SEQ ID NO: 192375 - protein, 59 aa, Triticum aestivum
  Clone ID: PAT_TA_86793.pep
FFFLGLQTRLICITKSRFQTRTPQVSVSRVERTKEHALVVSAASSVMHNCTYTSSPSRQ

SEQ ID NO: 192376 - protein, 107 aa, Triticum aestivum
  Clone ID: PAT_TA_86794.pep
CSIRRSRWGARDDCGFFPTKIMEIWEPALDPRKHFSQDDIQNIRIQYMNQLFFGRKTPQTRGLSLINLGDSHNPHDSLVMYLAVDYIKRKSPYFFRVQKTFLHTRHV

SEQ ID NO: 192377 - protein, 65 aa, Triticum aestivum
  unsure (1)..(65): unsure at all Xaa locations
  Clone ID: PAT_TA_86795.pep
FFFFLPLNDKVQWTSRXSGAANRPRRRDPNTSPDHSIGRSDGRCVQRAGTXSTRADDSRLLGIPR

SEQ ID NO: 192378 - protein, 79 aa, Triticum aestivum
  unsure (1)..(79): unsure at all Xaa locations
  Clone ID: PAT_TA_86796.pep
IPLVTSVXALSMXRIXVDXVASTTXCFSVRLDMXYLLFSASTIXSVMXLXXKYXXLVVXXEDXXNRSVXWNQXRXXLQC

SEQ ID NO: 192379 - protein, 51 aa, Triticum aestivum
  Clone ID: PAT_TA_86797.pep
FFFSFYKRLKSLRASSPQHAQVNSDLGLQAAGPNPARSTSRTLFASTGQHS

SEQ ID NO: 192380 - protein, 130 aa, Triticum aestivum
  unsure (1)..(130): unsure at all Xaa locations
  Clone ID: PAT_TA_86798.pep
LLIALTNLNISSNQLTGKIPNQIGNLKHLESLDLSYNLLSGAIPSSLSSLTSLSHLNLSYNNLSGAIPSGPQLQTLDNQMYIYSGNPGLCGPPLSRNCSANDAXQSGLEDMNLMSSVYLGTSIGFVVGLG

SEQ ID NO: 192381 - protein, 69 aa, Triticum aestivum
  Clone ID: PAT_TA_86799.pep
LCIQSCNAGRLISSLPLSRRCFRSFYDDGVASSAPFMSSRFCAVCLSGPNCFRSARALEILQGIIFLSQ

SEQ ID NO: 192382 - protein, 78 aa, Triticum aestivum
  Clone ID: PAT_TA_86800.pep
ALRGVVLERNVSLRGFGPGMSHNSFIDNEIGWLGALDFGPQLSRLVAKFRLRSCKTACKFRLNTFCSDLVVLVYKKKK

SEQ ID NO: 192383 - protein, 78 aa, Triticum aestivum; identical to SEQ ID NO: 106977
  Clone ID: PAT_TA_86801.pep

SEQ ID NO: 192384 - protein, 43 aa, Triticum aestivum
  Clone ID: PAT_TA_86802.pep
KMKFSSCFSKELSWFRGSREVRSSLPSHTTSNISTIFSLIYML

SEQ ID NO: 192385 - protein, 89 aa, Triticum aestivum
  Clone ID: PAT_TA_86803.pep
LNYRSVLPKGDFPKISVGFAKGDFPEKLQNSHCLKCSVPREVPEELHNSHCVKCSAPKENCPRNGLLQEMFPEESSTDICSLSMITRHE

SEQ ID NO: 192386 - protein, 111 aa, Triticum aestivum
  Clone ID: PAT_TA_86804.pep
RLYLWSMEAGPGGAAAWARRRVVELEPLLPPRALLDMSSSDVWTVGFAEGVRVIFLRTPAGLYAVELNSGRANKMGEFSIEKVMPYMRFCIGAWGRLPASDEPHTQLLVVR

SEQ ID NO: 192387 - protein, 142 aa, Triticum aestivum
  Clone ID: PAT_TA_86805.pep
FCNIPTKQQAISTDQLAKATREADESLIYQHRRTRARTARGIKSGCKSKQQNSQELDLPTTWTLAQSSYGSVNPSINSTSSLFLQLAPSTGAAQTPSTGVSGGVDDDGDDDLRASATAALLTEQPREPCSAGDTHLPLLQPT

SEQ ID NO: 192388 - protein, 118 aa, Triticum aestivum
  unsure (1)..(118): unsure at all Xaa locations
  Clone ID: PAT_TA_86806.pep
MVKAVAVLTGSEGVKGTIFFTQEGDGPTTVTGSVTGLKEGLHGFHVHALGDTTNGCMSTGPHFNPAGHVHGAPEDEIRHAGDLGNXTAGADGVANINVTDCISPYWXNSIVGRLFRPW

SEQ ID NO: 192389 - protein, 68 aa, Triticum aestivum
  Clone ID: PAT_TA_86807.pep
PGRRIFVLIKVPAVVNVFVCDIHMDQMACVLYVFFLLSKWWLVLTRSYIPKRKNTCLHIKKKKKNSRL

SEQ ID NO: 192390 - protein, 88 aa, Triticum aestivum
  Clone ID: PAT_TA_86808.pep
SLAHTDYSERKEKNHLGCVCAHKAHRPRSVPAQVLVRAVPGVGLPRRPALARARRPIRDVADVLGAGELRDDHEQEEDPGQERRSRRE

SEQ ID NO: 192391 - protein, 172 aa, Triticum aestivum
  unsure (1)..(172): unsure at all Xaa locations
  Clone ID: PAT_TA_86809.pep
ETNLAMSGLLDNIVAERAAQADRGEKNFLSVMLNASESTDAMRKLLTQDYVSALTYEHLLAGSVTMSFTLSSLVYLVAMYPEVEEKLLKEIDAFGPKDVVPNVEDIQTXFPYMEQVLKETIXIHTCPSDCREHPRIQIGGMSSXGTWVWLHRQAKTKAQTDSANVCKQDQAR

SEQ ID NO: 192392 - protein, 80 aa, Triticum aestivum
  unsure (1)..(80): unsure at all Xaa locations
  Clone ID: PAT_TA_86810.pep
TAYLQXGAPXRMXXNFXVAVLPXGNVAXDIPAFDHXTNYSLPYVEXSSXGSMEXLXLNGXIHXGAXSXDLXXLDXLVMAA

SEQ ID NO: 192393 - protein, 116 aa, Triticum aestivum
  unsure (1)..(116): unsure at all Xaa locations
  Clone ID: PAT_TA_86811.pep
EGFIARQQSQLQQIINQEHRKLPEDLDYHSMLNLSLEAREKLSKVRPQTLGQAGRIGGVSPADMTVLLISMESTRRAAEYKRQQEMMRSVAAARANANANAKADXSSDEAVHASTA

SEQ ID NO: 192394 - protein, 122 aa, Triticum aestivum
  Clone ID: PAT_TA_86812.pep
FFFFMERASDMLIIICAVTTQFVLSEALKPLNLDLDKKKSPGESAQTEARNHKTTAKAKPCRRNSTIGTHHPAAHSPPRSRASVYSSGDTSTPSLLPGVAGTPSNSPSPSSLPSGDEKSSGT

SEQ ID NO: 192395 - protein, 52 aa, Triticum aestivum
  Clone ID: PAT_TA_86813.pep
RGRAGEREREGVQEPPAHQGLPAQHPHANNLASYIAIQYTHTRLIMRFRLFV

SEQ ID NO: 192396 - protein, 88 aa, Triticum aestivum
  unsure (1)..(88): unsure at all Xaa locations
  Clone ID: PAT_TA_86814.pep
DSRIHWEERKLETRNILDGSFVLVGAVLGDCLACTKLVALFLWASSLRLGINKIDLASEWVWSDGHSIQLXSFMSISWVAPMDFLTQP

SEQ ID NO: 192397 - protein, 149 aa, Triticum aestivum
  Clone ID: PAT_TA_86815.pep
TATLTFKDTRKLGQGAFGIVYKGAVMIEGTQVEVAIKKNTSDVSDETRKAFKNEVEIMSPLNHRNIIHLVGWCNEKNNLLLVYELVENRNLEARLYNHGGTDLVLDWRQRYNILVGIASGLEYLHNNCSRTVLHRDIKPANVCWIWTHC

SEQ ID NO: 192398 - protein, 159 aa, Triticum aestivum
  Clone ID: PAT_TA_86816.pep
VHLTPHALSFILPRSKTWRMDDIDIGVVCDEGSPGSTLSRTRTPVPKEDDYLIVIPYAHIFDLMLKALKLPPASYYHKICLGGKNRVTVTFNSSSQLVDGLLVPTSISGAILDGYEDAEDSAAIAAIRYMENAYGREMRDYHYTMSRAENNQHLVRWLV

SEQ ID NO: 192399 - protein, 85 aa, Triticum aestivum
  unsure (1)..(85): unsure at all Xaa locations
  Clone ID: PAT_TA_86817.pep
DTTTNRLQDSTSDNQTPVLNLPRNHYKNSTEQSNXKDXTVHXEQGXGYXRVXXXCPLLKGGTHPGTGVSXPQKXFXKXXGPALSG

SEQ ID NO: 192400 - protein, 88 aa, Triticum aestivum
  unsure (1)..(88): unsure at all Xaa locations
  Clone ID: PAT_TA_86818.pep
DAPEALENHTLMMRCVSXSGEEXPSMKEVAERLEALRRYQRHPWXAGAGXPEEGQSLLGREQQRDVNYKFKPQDVLDLEEASTYTFSL

SEQ ID NO: 192401 - protein, 96 aa, Triticum aestivum
  Clone ID: PAT_TA_86819.pep
RSYGTVVERLGSDSSKIATNSESLFQQALSKKKQPTIEGFSSQHEHKNERMTSSSSNSARLSVERKPFEVLVKKVDAGYKMPFLVSCMFPGAILLV

SEQ ID NO: 192402 - protein, 127 aa, Triticum aestivum
  unsure (1)..(127): unsure at all Xaa locations
  Clone ID: PAT_TA_86820.pep
LRYEPRRXPCGRLGRXRECRPGCPPXXPSCGVLXSSLQQKFPPFQSLHTWAYYFVIGPIGDMEMHLVPSIILLLSRTSPSSSSSVRPVLLRCVFPFFFSKFRSGSLCLLPSLRFYFSFTKIRMRETV

SEQ ID NO: 192403 - protein, 94 aa, Triticum aestivum
  unsure (1)..(94): unsure at all Xaa locations
  Clone ID: PAT_TA_86821.pep
PTIRHTRHTNNSGGGPLVGMRRHQRPRDHHPGDVVLVHRGRRFHRDPCXXAAYSCLPHSPCVEAAYSCLPHSPCVEAVTHAIHAHMXAXGFCCC

SEQ ID NO: 192404 - protein, 87 aa, Triticum aestivum
  Clone ID: PAT_TA_86822.pep
PLPSDAASSSCYRRRLAVFEEITGLQLVDKVKENIPSMHSLLEYARLLVRRRWSRGNHRRQPHCRCSRSPIDAAFGLPPNNIGSQAR

SEQ ID NO: 192405 - protein, 125 aa, Triticum aestivum
  unsure (1)..(125): unsure at all Xaa locations
  Clone ID: PAT_TA_86823.pep
XSTKAVLLRXRHDXSPTMNYTHGLISTGQAAPQTCKQFLLTFMMRYQIVRSSVSSHCLPRCRGQQRRRSSEAWQLMKHRHIVERTPLEFLNAVHRTIAFVFYPSSADLGFLLLLLNFSSFRGCMN

SEQ ID NO: 192406 - protein, 95 aa, Triticum aestivum
  Clone ID: PAT_TA_86824.pep
KQNLDSSPNSDCLSWPLLLERTMAWSLSFFQAPSMKQIPMIGGLPAAGQVALLIRAKERLDRRAEAAAHLVTRHSVMIFGGVILGSNHQSSGKYL

SEQ ID NO: 192407 - protein, 84 aa, Triticum aestivum
  unsure (1)..(84): unsure at all Xaa locations
  Clone ID: PAT_TA_86825.pep
INVKYRIFLPFPDISLFRDINTNYIRIYIDILECRFTHFAPYVVRIGYQKTLYLGMGRVHDSXLFXHXFXSWAIXFXGVQRLTS

SEQ ID NO: 192408 - protein, 132 aa, Triticum aestivum
  Clone ID: PAT_TA_86826.pep
HRFRPGTVALREIRKYQKSTELLIRKLPFQRLVREIAQDFKTDLRFQSSAVSALQEAAESYLVGLFEDTNLCAIHAKRVTIMPKDIQLARRIRGERASVRRRLLSSVLTSVSTGEMCVFVVSVRARWCMFLI

SEQ ID NO: 192409 - protein, 92 aa, Triticum aestivum
  unsure (1)..(92): unsure at all Xaa locations
  Clone ID: PAT_TA_86827.pep
LSLFTPTYLSVISVLXXEKFVMYYALTFTSSIYTSIIECLXGRFWRKEXVMRGPRXPRGXNXHXXXXPRXFLXFXGGXRXPXXSAGFXMALT

SEQ ID NO: 192410 - protein, 165 aa, Triticum aestivum
  unsure (1)..(165): unsure at all Xaa locations
  Clone ID: PAT_TA_86828.pep
LKAICDIRVEQDDIRNYIDTSVKRGYDLSTFRKERIGGDSLGISYWYEDDPILGHRLYREIRRVEQMKKEPGKRSKGKRISTPPVVSYHWETVASTFEEFDDVAEKXFSSRNRTEXPLGKXLKIEYSRVEKIIKKXKKGGPVPIAYMVYRATGVVYTRDGKPAYH

SEQ ID NO: 192411 - protein, 68 aa, Triticum aestivum
  unsure (1)..(68): unsure at all Xaa locations
  Clone ID: PAT_TA_86829.pep
TYIHRRAHSQPSRLAITHALTGQHIQPLLQLTPCMMLSIPIHAPPTHAKSHRLGLIPXQTTPTHPCTN

SEQ ID NO: 192412 - protein, 76 aa, Triticum aestivum
  unsure (1)..(76): unsure at all Xaa locations
  Clone ID: PAT_TA_86830.pep
ICNITCYVTWVPSYFLILFGLWSVRDLDXAFSRFMPXFVCXEXSCKCVYSSKHCIVMLFXKSXKLLHLHLHVCLXX

SEQ ID NO: 192413 - protein, 149 aa, Triticum aestivum
  unsure (1)..(149): unsure at all Xaa locations
  Clone ID: PAT_TA_86831.pep
HPSQCSRPPPCAAIPNVHAFYLIVLFLCPQELPLSLSSTMSVGREEKGGEGGGAPAHRPSVXAHAHAHISHTLSINGSASRGLAWGRXXVEWKIKNLLVLGLGGQXVTMEPGAAPKKRGKEAXPVSXKAQVPRXTRLKHHISXVLSXNX

SEQ ID NO: 192414 - protein, 61 aa, Triticum aestivum
  Clone ID: PAT_TA_86832.pep
SRAPSHIEEMSCVVIDINVCMLSDCSTKNMYALLNKIGMSFVQLFSCNRSGEVCLCSKKKK

SEQ ID NO: 192415 - protein, 100 aa, Triticum aestivum
  Clone ID: PAT_TA_86833.pep
ESLELMEASRGLEGHKDEYFRVPMKIVTASTMSIVLSPADQTWQFSVDLETMEVTRYKTKTQGSPSVSYPCELPWLPAIHACMVRCKRGGSFPCTHICKC

SEQ ID NO: 192416 - protein, 72 aa, Triticum aestivum
  Clone ID: PAT_TA_86834.pep
GVSNARIRCLWRYLLLHSPTKVNKKVRKLIVFPGLDGIYHDDSKKGQSGSSLCRHESDRGGYWGMKQFAMFS

SEQ ID NO: 192417 - protein, 138 aa, Triticum aestivum
  Clone ID: PAT_TA_86835.pep
FYPLLVLVLYCKAHVFTSRRRSRETTTAEVACCRPTPPPRASAVPTARGWPAHPRRQRLHRSAAPGPPTPGTLLAAHRPEPALPADTACSRRRRRRRRPGGSPRRATRAASWSGTRRCCCRRSRSRWRWRRRCRSRRC

SEQ ID NO: 192418 - protein, 174 aa, Triticum aestivum
  unsure (1)..(174): unsure at all Xaa locations
  Clone ID: PAT_TA_86836.pep
YIVASRTCLSRHSQISSNLXYLXSFPQISISWRALTFTPVAHCVILXPSSLDDDMEIASGTRRVNLLEGNLAILAPPDLILDSMALISEAASSTGTTRAPQARAVACTRGCGPFSCLVSSDITPGNGPKLQKLLFGCLMGSAGRYEIGTASIGAANNLYCPSAEAPGEFLGKGM

SEQ ID NO: 192419 - protein, 130 aa, Triticum aestivum
  Clone ID: PAT_TA_86837.pep
VPGQQRHNNVARPLPRPLGVGAGPVLDALYHDHDGATMSGQKRAAVGGPGEKTVERRKKRMIKNRESAARSRARKQAYTNELENKISRLEEENEQLRSYKAFEPVVHCVPQQEPKNKLRRRNSAASDIII

SEQ ID NO: 192420 - protein, 101 aa, Triticum aestivum
  unsure (1)..(101): unsure at all Xaa locations
  Clone ID: PAT_TA_86838.pep
MGTDVKIMVVGDGSVGKTCMLISYTTNSFPGEYVPTVFDNYTANAVVNGHAVNLGLWDTAGSDEYNTLRPLSYPGTDVFIICFSLVSPVSLENVKKXWHPE

SEQ ID NO: 192421 - protein, 105 aa, Triticum aestivum
  Clone ID: PAT_TA_86839.pep
AGQIQKNAALYCEVKIVCDDKEVTAATTADPTPPFSPSPVNNNNRSRTPTPPSSTPNRDSTEAVDGKNDSKTKERRKIPSFSGACHPDCCFSHFHSWNAVCAIFR

SEQ ID NO: 192422 - protein, 150 aa, Triticum aestivum
  Clone ID: PAT_TA_86840.pep
FGRLQQLASVAGDVLLGKEKIQKVLLSRLTETVVMWLSNEQEFWDVFEDESIQLQPSGLQQLILDMHFLVEIAVCGRYPHRPVQQLVSVIITKSNCSFLGKGGDPQSALPEDEWFLRLPRLQSTTHAKDSGIRPRTPIAHMTTDTEDQIH

SEQ ID NO: 192423 - protein, 106 aa, Triticum aestivum
  Clone ID: PAT_TA_86841.pep
LNIIDSDCQIVVGSFLPSYPMEPKQKKARVVAAPTLSQAPPAVRLSSADTHSSEQGHHSLAAPRMNVVTSSAYSADQNWASTVVQSAPAEASRSASSGDLNSLPLV

SEQ ID NO: 192424 - protein, 144 aa, Triticum aestivum
  unsure (1)..(144): unsure at all Xaa locations
  Clone ID: PAT_TA_86842.pep
NNDLPGSMPNFLFTNEATLVYLDLSNNSLVGSLYPIWQNQTDLLVVNISLNRIEGQLPANISSMFPNLWILDVSHNNMSGVVPSSLCTIGRIEIMDLSNNNFVGQVPSCLFTNCSALNILNXSNNNLGGMILDGASNCHCVGIY

SEQ ID NO: 192425 - protein, 87 aa, Triticum aestivum
  unsure (1)..(87): unsure at all Xaa locations
  Clone ID: PAT_TA_86843.pep
LVXWWXVECQIPXQYXLTLYXYESRFGKSMQARNSSGFYTGSRYQGMRFDSLKDVCSRNKTTLHWTVQWAIKDNEYERHDQSYQGSS

SEQ ID NO: 192426 - protein, 115 aa, Triticum aestivum
  Clone ID: PAT_TA_86844.pep
KNPHDPLDRFSYPPLIFPLGTESTDPADLRRLKLLRRRTALRPHTAGSSTPHPPKDHRRRRSSNATAAPEDDALIAVETTIVSVIASRICTSSSPENTGRAPPPRPKHRRFCPAR

SEQ ID NO: 192427 - protein, 146 aa, Triticum aestivum
  Clone ID: PAT_TA_86845.pep
EYTCGNASQYVDAAEKIFPYETACSRRCTISRLRISCGAGSPRFSGCVRCMDDTTYRQLDRDPGSSKTVFMGHRRWLRDDDPWRKRKDLFDGETEPRKRPCTRSCEEIDKLLKNWKDCPLPGKKQKAPEPGKKRKAPEPLLKVWKT

SEQ ID NO: 192428 - protein, 43 aa, Triticum aestivum
  Clone ID: PAT_TA_86846.pep
ENPSCSLQRAPSMARRRSVTTSSSRQAFRTASLLPLPPSLFVC

SEQ ID NO: 192429 - protein, 54 aa, Triticum aestivum
  unsure (1)..(54): unsure at all Xaa locations
  Clone ID: PAT_TA_86847.pep
KIXKQXXHQAEVHMQQVVAAXPAXKXXTISKRAVDGWHXXIYLVNXMANALXXM

SEQ ID NO: 192430 - protein, 69 aa, Triticum aestivum
  Clone ID: PAT_TA_86848.pep
AACLAWRPADCCPRSRAGAPPRPADRTAGAAHFQCAPRPLPQPLILRSSPIPIPCSAQRGSMVMKKTPI

SEQ ID NO: 192431 - protein, 67 aa, Triticum aestivum
  unsure (1)..(67): unsure at all Xaa locations
  Clone ID: PAT_TA_86849.pep
HPISLLVLLSILGAWCFLYVFRAPDXPVVLFGRTFTDRXTLLGLLVSSXLAFFXTSGRLKLRARRWW

SEQ ID NO: 192432 - protein, 77 aa, Triticum aestivum
  Clone ID: PAT_TA_86850.pep
DGNGDRAFRQEGAAGGDGSGRRPWRHWPVQEDQPRRPRPAASLVDVGSHGACSFHATNYVSAGHHNIYTRDLNFKPI

SEQ ID NO: 192433 - protein, 72 aa, Triticum aestivum
  Clone ID: PAT_TA_86851.pep
FFFFAQIQFFQMSHSEINHTPEQKKKKEEISIQKSKYKFASMHDAHRSGRVNAPLTREREHGSVVQEVLELG

SEQ ID NO: 192434 - protein, 97 aa, Triticum aestivum
  Clone ID: PAT_TA_86852.pep
LPITYRLGVSDVVVLMLRHQGCRRTDCRLPTGPSLPLSQISSSILSYFAEWKWPESHSTEIMCVAICQLLLILGKEYHAVCLEALIACFTFSVGQSC

SEQ ID NO: 192435 - protein, 60 aa, Triticum aestivum
  Clone ID: PAT_TA_86853.pep
DQVLYNATAPAGATEGIVNGFASSQAAFFSAFASAMVKMANLSPLTGSQGQVRTVCSIPN

SEQ ID NO: 192436 - protein, 84 aa, Triticum aestivum
  Clone ID: PAT_TA_86854.pep
IAAPPPARYLRMGSLPVPTDDSAYLPALLPSASPTGTGAPRYQMLPLETDLNTLPVIPNLPEKVFPTDAKSTEGDLCRAFVVIV

SEQ ID NO: 192437 - protein, 56 aa, Triticum aestivum
  Clone ID: PAT_TA_86855.pep
ANKTGHVNPILQIPRGALFRKGAAGDWVNHMTPEMARRLDEIVADKLHASGLTFHE

SEQ ID NO: 192438 - protein, 54 aa, Triticum aestivum
  unsure (1)..(54): unsure at all Xaa locations
  Clone ID: PAT_TA_86856.pep
SXGATSXLIIHPXGNIMVDSPRYXXKLXXXLXKLXGTRYMFLTHIDDVXDXXKW

SEQ ID NO: 192439 - protein, 161 aa, Triticum aestivum
  unsure (1)..(161): unsure at all Xaa locations
  Clone ID: PAT_TA_86857.pep
ESSTQPVGMSFASFPSSSAAPSAAGATASSHMSATALLQKAAQMGATLSRPSGQGQMAASTFSSXXSAAITNVTNNAPAAATSSSAATSTVGVGFGHAFEAPAHFGVDQRPXANRNAGXAGSGPRGRRPCSGFVSPGSEVHPPGVVGLETHGHSNSGTHRV

SEQ ID NO: 192440 - protein, 74 aa, Triticum aestivum
  Clone ID: PAT_TA_86858.pep
VVIYICSLTDLTGRLNVDPILRQKCISRKRISFFADYCHPVPFLHICLFIYCNNTPAYLIYFVCCMCYYVHCSD

SEQ ID NO: 192441 - protein, 34 aa, Triticum aestivum
  Clone ID: PAT_TA_86859.pep
SIIIFISILNIYLESFGSEHLCHNKEDYIEEYAR

SEQ ID NO: 192442 - protein, 43 aa, Triticum aestivum
  Clone ID: PAT_TA_86860.pep
LLLWTCRSCGNYSHIIMEAAKSMKIASQWFPLWQVPEKASRWD

SEQ ID NO: 192443 - protein, 121 aa, Triticum aestivum
  unsure (1)..(121): unsure at all Xaa locations
  Clone ID: PAT_TA_86861.pep
LKKIRLSQTIAAAMAGREQRIQWLLVENNRLWKEAGLGSRKEQRFISLMPCRAPLLCLLSSPLSEVLAGGKHIQVERXTVSSRRCPSGPCXHXVIESSFXLNNSHSVSLXRSSSWXSXXXF

SEQ ID NO: 192444 - protein, 111 aa, Triticum aestivum
  unsure (1)..(111): unsure at all Xaa locations
  Clone ID: PAT_TA_86862.pep
GSXRCPSLSVQYRSVGGMTHRYLIVCGVRVCDMLFFLQIIYQCEPPYGNGNEMAMTNVGKMLVKHVVCQFSSHGNRMKMANSPHLRRYTYFKNIKSNEKTNLWHTGEQMKH

SEQ ID NO: 192445 - protein, 109 aa, Triticum aestivum
  unsure (1)..(109): unsure at all Xaa locations
  Clone ID: PAT_TA_86863.pep
XLXQCLFXVLMXCXXMPNGVQEQNVEEGASRGXECXCXXMQRRTXRAMTRVTKKRSTRLLAGKGGPSTLTTRQTPLTWWPHRLGSLQSALGRLLRCRLRRDRNSSGLRR

SEQ ID NO: 192446 - protein, 75 aa, Triticum aestivum
  unsure (1)..(75): unsure at all Xaa locations
  Clone ID: PAT_TA_86864.pep
KPXXXPKKIPXPHXKVXLASSFIKCLSATSEVREELRQFKLLHFEWKDDLSIPGMAASLSPPFSSWPLGWMDLVV

SEQ ID NO: 192447 - protein, 94 aa, Triticum aestivum
  unsure (1)..(94): unsure at all Xaa locations
  Clone ID: PAT_TA_86865.pep
SFVLLLAPAQRILCFVLPHGQEEEPPPVPPPRRARLHLPRLPQPCPPRRGVPLLYLNPSSPFRVLSSYLPFFAXSFDQVLXPXLXFGXXXXGPR

SEQ ID NO: 192448 - protein, 80 aa, Triticum aestivum
  unsure (1)..(80): unsure at all Xaa locations
  Clone ID: PAT_TA_86866.pep
GTYGYMAPEYAMEGVFSTKSDVYSFGVLVLEVVTGIRRNSSNQTMGFPSLIVXSXNMWKEGKTGEXPXSXXRXXCSKDDF

SEQ ID NO: 192449 - protein, 67 aa, Triticum aestivum
  unsure (1)..(67): unsure at all Xaa locations
  Clone ID: PAT_TA_86867.pep
KICVDNELWYCLAKTVAEETAWEYAEKNGLNVVTVCPCVVLGPQLQPVVSTSSELLVYVXKGGPCGC

SEQ ID NO: 192450 - protein, 70 aa, Triticum aestivum
  unsure (1)..(70): unsure at all Xaa locations
  Clone ID: PAT_TA_86868.pep
SAKANXNCIYLLDSYEEHPSRASSSVGARPATTVIVTSCSVNMCEIPSSNHALRDDDEEGEDDAHEGQRL

SEQ ID NO: 192451 - protein, 67 aa, Triticum aestivum
  unsure (1)..(67): unsure at all Xaa locations
  Clone ID: PAT_TA_86869.pep
VSXGXXTKLIISGVVWCCAVILPRSRLQSPAKTRSQQLLLWLLVPDCLFTRACFHLHSCVSHGKQPS

SEQ ID NO: 192452 - protein, 41 aa, Triticum aestivum
  unsure (1)..(41): unsure at all Xaa locations
  Clone ID: PAT_TA_86870.pep
KVIANLVSAKVSVFYSKIKKTSPKSSQRFYLAQTLKXXRKX

SEQ ID NO: 192453 - protein, 86 aa, Triticum aestivum
  unsure (1)..(86): unsure at all Xaa locations
  Clone ID: PAT_TA_86871.pep
FTIRKWPLLIEGKNCYQGENIRYVILKYQFRGAVLCLLPLGIXXLFXNLXMLTHKQRNILWRKQRVYTNEFMLLSVFRWGITCVFV

SEQ ID NO: 192454 - protein, 78 aa, Triticum aestivum
  Clone ID: PAT_TA_86872.pep
NRRLYPIIMHTCSANLEALSLAFSGPLSISLFLSFSAAAPRARALGLCMLQVRTDFIHQHPLYVYICKKKQNIFWVTS

SEQ ID NO: 192455 - protein, 174 aa, Triticum aestivum
  unsure (1)..(174): unsure at all Xaa locations
  Clone ID: PAT_TA_86873.pep
LVSEKREAKGDVTSAVKSSVVPLGATLMASMLSSNGTAVFSRNYLSRVSVSHDLVESELYKRCTSLLGDLGIANGGPDVVWNGSIQKNGNAGKISREQGSPNLLGLFYVKNNDATFQRAMAFTRIRQRDCGPTQAQTDGKRPTHEIXGHRNLTVPTEGLXEYLSSHVLDXXALX

SEQ ID NO: 192456 - protein, 118 aa, Triticum aestivum
  unsure (1)..(118): unsure at all Xaa locations
  Clone ID: PAT_TA_86874.pep
EVHLPPKPELPKVELPPVPEVHLPSKPELPKVELPPVPEVHLPPKPELPKVELPTFPEVHLPPKPEMPRXELPXXXEXQKXGAXKKPXXPTVPVFKFQPGAHEMPSAPSSPFKGIFYQ

SEQ ID NO: 192457 - protein, 116 aa, Triticum aestivum
  unsure (1)..(116): unsure at all Xaa locations
  Clone ID: PAT_TA_86875.pep
GVYDHXLXNGTXPPXGXFFXFXMKKVSXALYNKATXDTSNDRCWGRSTNKPKEKQRRKKEKLMPTTADQRTETTGDRCTLQRSTTTLLALRSAVPSNTFKKETTTTALLPGLVLGF

SEQ ID NO: 192458 - protein, 68 aa, Triticum aestivum
  unsure (1)..(68): unsure at all Xaa locations
  Clone ID: PAT_TA_86876.pep
HFHTNKRWSTAXDRRVIDKNRIKSRTISLRAGGCRARGRRTPPARPTTRRPPGAGRPPRHPPXRAPCR

SEQ ID NO: 192459 - protein, 101 aa, Triticum aestivum
  unsure (1)..(101): unsure at all Xaa locations
  Clone ID: PAT_TA_86877.pep
FTXATLAXKXVPXXLXSSSPCVDXYYXPFLVQXXIFXKNCXIXRFSLRRRTTNPKSAMRKXPPVAPIYGEQRNHIIYLXGQTIYRSCAQVNLCDYVINEPI

SEQ ID NO: 192460 - protein, 70 aa, Triticum aestivum
  unsure (1)..(70): unsure at all Xaa locations
  Clone ID: PAT_TA_86878.pep
FLIVQCYIKXVWTLMGXTXHFXIFWGXAXIGGQPKMGFLLIQXSXNRFTXXKTDEPPEXXSXXXSXXWPX

SEQ ID NO: 192461 - protein, 64 aa, Triticum aestivum
  Clone ID: PAT_TA_86879.pep
MSEPQPSYSAFREASFGHAILDIKNRTHAYYAWHRNQDGAAVAADSLWFTNRYWMPTDDSFDDV

SEQ ID NO: 192462 - protein, 72 aa, Triticum aestivum
  unsure (1)..(72): unsure at all Xaa locations
  Clone ID: PAT_TA_86880.pep
CXXRPXSXCXLXXXHXCSGVXXGPXXXPTAAIYXXPMXFEMXIRRLLPADLFPVLCETVFLAICLIAVKEME

SEQ ID NO: 192463 - protein, 65 aa, Triticum aestivum
  Clone ID: PAT_TA_86881.pep
RALPWTPQGPASVQRPPQYVRQQPAVKPAYAHRHILIRLLSHYLILYSAFLRERQTEHQGLLSMW

SEQ ID NO: 192464 - protein, 98 aa, Triticum aestivum
  unsure (1)..(98): unsure at all Xaa locations
  Clone ID: PAT_TA_86882.pep
NMVFGMNDARTKASGRTEVEDLCSKLTSLLPQDYRLDASQGPPDIPSQLMQATTYIKDLYXRVERLRQMRDDKTQSRRMAGRTQXQXLDTGXAGQXVP

SEQ ID NO: 192465 - protein, 103 aa, Triticum aestivum
  unsure (1)..(103): unsure at all Xaa locations
  Clone ID: PAT_TA_86883.pep
KKSTHAVMSEIDQFINEVAILSQINHRNVVKLHGCCLESEVPLLVYEFISNGTLYDLLHRPSRTEQDGGLSPLSWEERLXIXXXIAGALAYLXXSAXXPSGQD

SEQ ID NO: 192466 - protein, 81 aa, Triticum aestivum
  Clone ID: PAT_TA_86884.pep
SRWLCRASSSHVWPLLSARHVFAKMSQCTGLLVFLCSCAFVAPFLLANCYSLQYLEHFSCVICNLGANQRIGKVIQIEDLN

SEQ ID NO: 192467 - protein, 166 aa, Triticum aestivum
  Clone ID: PAT_TA_86885.pep
KSRRRLPRDRSSPPPPAPLPPRPSSSPPPPAPLLLSPSSGRRPCSRRPPDDALLPLRPPRPPHQPAPQPSSMDISNKEQEQEEFESVMVALALDVMLSEERPTYARRKLHLSPGPEEKETADLTKLHLVSASKKKDLGRDMRYMTWHGMQWTILVLMTFSNFVKNT

SEQ ID NO: 192468 - protein, 80 aa, Triticum aestivum
  Clone ID: PAT_TA_86886.pep
FRVGRTVHRLMSLICNGSKGLRVHVCIRPRPDRMDDYQQQVSQPLTARIHLPMSRSGGETGEIEARTRLTSSIHQLTGFN

SEQ ID NO: 192469 - protein, 69 aa, Triticum aestivum
  unsure (1)..(69): unsure at all Xaa locations
  Clone ID: PAT_TA_86887.pep
NLXINVYLSXFETCXISQXSCSCITIWHMSLSISXRLLHXAARNXCXXWXLGTIKGFTSLXNCTXPXMD

SEQ ID NO: 192470 - protein, 42 aa, Triticum aestivum
  Clone ID: PAT_TA_86888.pep
VLMSRKYLDYVSQLDEVAHVISTIVIQQFYPIYDFGFNKKKK

SEQ ID NO: 192471 - protein, 69 aa, Triticum aestivum
  unsure (1)..(69): unsure at all Xaa locations
  Clone ID: PAT_TA_86889.pep
KRGKSXNXTATHKXXXTXPKXQRYTTRPSSSTLLVXIXMQXKXELXHPELRRXADGVXLVGVXGLEDXG

SEQ ID NO: 192472 - protein, 76 aa, Triticum aestivum
  unsure (1)..(76): unsure at all Xaa locations
  Clone ID: PAT_TA_86890.pep
QETQDFSYLHRTRGNLIYNRHPFTHMGRCFXXYRLFTKETPNSYLPELSWGDHDLLSTRGLSMCCFTVCLLFRQER

SEQ ID NO: 192473 - protein, 153 aa, Triticum aestivum
  unsure (1)..(153): unsure at all Xaa locations
  Clone ID: PAT_TA_86891.pep
XIARRCWCLLLQPAASSSSXPLLLSLLFLRSCCCSSEPLVLLLLIFSNLLLLCLLXLLARCCXFSRAPNLLXXFPXNLLQLQSXRSLXILLXTQVAMVLSXXKVXXSFFXKVXXRTKGGIXKVGXSWLXAGQSTKMXNPYSXXDXIKXIXWEG

SEQ ID NO: 192474 - protein, 68 aa, Triticum aestivum
  Clone ID: PAT_TA_86892.pep
FFFCIANERSIAMPNNKVSTLYTNKIPRRNVKLDGFFFHEGKHTRSIAAYVHPSYITISSTQACAIAI

SEQ ID NO: 192475 - protein, 67 aa, Triticum aestivum
  unsure (1)..(67): unsure at all Xaa locations
  Clone ID: PAT_TA_86893.pep
FXFFXLVNICFQQRLCTNIHQSVSSLFNSFQMNNFFSEQTNPVQQLIGQYGKSFLNSAKRIKKLWPT

SEQ ID NO: 192476 - protein, 118 aa, Triticum aestivum
  Clone ID: PAT_TA_86894.pep
MLPEDSMHLFLTCPVANRVWQRLGILPQAEGIIDLWDAPIPHQLPHKAWPFILMSLLWKIWAARNDMLFRNIDQRSVITLRALISDLDLWSHRLMERCDKEDVSSWRSYLSARCIVPL

SEQ ID NO: 192477 - protein, 65 aa, Triticum aestivum
  unsure (1)..(65): unsure at all Xaa locations
  Clone ID: PAT_TA_86895.pep
LLDYRRFTSSSFSLFLSYYVPTTCVTHNIXXEATTLSGWSKIFXAFKFSRITCVNSWWYHIFLKK

SEQ ID NO: 192478 - protein, 163 aa, Triticum aestivum
  unsure (1)..(163): unsure at all Xaa locations
  Clone ID: PAT_TA_86896.pep
RSRYDHFKIDNNLTIDVFLPPKQHAKGTLVFYHLNTNLAVVSLEKRIHGIRPFDICRKGDLSKPVVAIARKIEAGFLMASKGEVIYGQTCSIYVEKLMLSTCKINKAGIGGPLXNFDGAFVGXNHYDGSEVLLPAKAWDCQILKGELIGEDKVALMDILHGLV

SEQ ID NO: 192479 - protein, 122 aa, Triticum aestivum
  unsure (1)..(122): unsure at all Xaa locations
  Clone ID: PAT_TA_86897.pep
PGVDTLGEGPLDSDKGLDLDDLVVLILLSHPTVPELQVIAPGVGLELLEVLLIVIQPESSVPALPREAPTSLRPAEALLLGPNSDLITSESPWELDSASDAPRQDGTXPVXSQGEGXPNWXW

SEQ ID NO: 192480 - protein, 79 aa, Triticum aestivum
  Clone ID: PAT_TA_86898.pep
YTSTVNYSYSVIFLICRPVNPKQRSVHKDSNWKPLTWKLQRPPHLLEFHVANFRSGNAGSALLYTLKRDHCLESTNEGL

SEQ ID NO: 192481 - protein, 98 aa, Triticum aestivum
  Clone ID: PAT_TA_86899.pep
RLQSGLEAHGQRAVCTQGPRAVPRGAAVAAPEARGRLPPQAEPALRRLHGRRAPQRQLPVNKSTSTCQSKIVVVHSTDLVEIESVGIRPNPIPDWSFT

SEQ ID NO: 192482 - protein, 47 aa, Triticum aestivum
  Clone ID: PAT_TA_86900.pep
CFQICLFLLHTSLRDLSINNFLSISTFASESSIERSQALRSRGSTRC

SEQ ID NO: 192483 - protein, 77 aa, Triticum aestivum
  unsure (1)..(77): unsure at all Xaa locations
  Clone ID: PAT_TA_86901.pep
VXGITXSVTKXDGSDTNHPVIGXSYKDLTRRXNHVHXRKXGAFXGTLIFHQLKSCTPRSKVNRVWLSRAGSSSSGQS

SEQ ID NO: 192484 - protein, 121 aa, Triticum aestivum
  Clone ID: PAT_TA_86902.pep
HNPLSLIPPSPPPAAATARPAWWCASATHPSSSATSSTPSPPNTTAPPSSLRHPSTITNATSRDPLDGLSDPPRNQHLTPSLLLLLHGPAAAPLSLASPYCCSFSFACCYSLAPRLCCSSS

SEQ ID NO: 192485 - protein, 164 aa, Triticum aestivum
  Clone ID: PAT_TA_86903.pep
ICCGRISESLVQMRCLSHLDVNASDENEVLSLNVLLPNLQRLRLGGRLAEGTLDESPLFQAVGGQNLHVLNLYWSQLREDPLPSLSRLSNLTHLEFTRAYNGEQLAFLTGWFPKLKILYLIDLPSLNRLEIQQVPWQAWKDILVNSAHDGGPLALSPHALISGS

SEQ ID NO: 192486 - protein, 164 aa, Triticum aestivum
  unsure (1)..(164): unsure at all Xaa locations
  Clone ID: PAT_TA_86904.pep
PLSDLWPRGDSSRFPCLIPNIAAPDPRRFLARRSCQSLPPETSVARRVRRQPRGTPEQPAAAEPKLLGSRRARLHRRRTGHPRRRFGHRYLRRSKPHPPAPSPSPEDRRRVAVTDPDRRRFPASEIARSMTSRIIRNVSAKTHQTYRFIYSDDTLXYIHITLIW

SEQ ID NO: 192487 - protein, 41 aa, Triticum aestivum
  Clone ID: PAT_TA_86905.pep
LELLSGCVCTSEKVKPLKASTQSCRGNNSKGTSTVMCLQYS

SEQ ID NO: 192488 - protein, 53 aa, Triticum aestivum
  Clone ID: PAT_TA_86906.pep
SPPARSPGSSASSSPPPAGSLGFIHLFCTVRLLTSRHFFVASAFFPSLISSLL

SEQ ID NO: 192489 - protein, 86 aa, Triticum aestivum
  Clone ID: PAT_TA_86907.pep
RVGGPPRAWAVECGDCGVLVSASGTVVFNGSRTERFSKWQDEVGAVTGAVKLHKCYCFDVSGVKIMEQINSLDEAYDLCLWINLII

SEQ ID NO: 192490 - protein, 98 aa, Triticum aestivum
  Clone ID: PAT_TA_86908.pep
MAETEYRCFVGGLAWATDDHNLQQAFSQYGEILDAKIINDRETGRSRGFGFVTFGSEESMRQAIEEMNGKELDGRNITVNKPIPPVRRGGGGALRGAA

SEQ ID NO: 192491 - protein, 109 aa, Triticum aestivum
  unsure (1)..(109): unsure at all Xaa locations
  Clone ID: PAT_TA_86909.pep
SSPTPTTTTATYPXHQQRGFELLXVLCSGWLAELPLRPXRFLPXAGSSAVYLRPCYXSSSTAXYTXSXLKIITTQYALNLLFLVSVPGCXXXGLKLLATVSFAEXPVPC

SEQ ID NO: 192492 - protein, 138 aa, Triticum aestivum
  unsure (1)..(138): unsure at all Xaa locations
  Clone ID: PAT_TA_86910.pep
TTYEYVVAMRAQSEPPGLSVNDEQQSLPSSPMSSAPTAFSGSSFARHYKGAWCTPPRIFVDQDEIIPHLGPGRLPSTVDXDSTDPVERAKQHAKRQVRINPWKLAKLDQTRHEKRSKRALIVLNHVHYPTSAILTQTL

SEQ ID NO: 192493 - protein, 114 aa, Triticum aestivum
  unsure (1)..(114): unsure at all Xaa locations
  Clone ID: PAT_TA_86911.pep
AYELMDQIKVESDLRHGKLAAALASAKSEVMFLKASLFDRESELRRAHDATKKLQDDARTNSTADELKAQLQGALQENGQLKLELRQYESEKSXAKSDADAAAEAAKKGETEPS

SEQ ID NO: 192494 - protein, 144 aa, Triticum aestivum
  unsure (1)..(144): unsure at all Xaa locations
  Clone ID: PAT_TA_86912.pep
FAXXXEDIXRAIXFIHRXASQGGXTYVHCKAGRXRXTTXVLCYLIKYMSMTPEAALDHVXXIXPRVLLAPSHWXAVIVFXTLTTGRXPIXSTNLXCXLXXXKXSIPDTXIXDCTMEFDYMMAVTPCQLMVXXQTSDWVFDQCHT

SEQ ID NO: 192495 - protein, 146 aa, Triticum aestivum
  unsure (1)..(146): unsure at all Xaa locations
  Clone ID: PAT_TA_86913.pep
MLVYQDKLSGDELLSDSFPYRELENGVLWEVDGHWVVQGAVDVDIGANPSAEGGGDDEGVDDQAVKVVDIVDTFRLQEQPAFDKKXFISHMKRYIKNLSAXLEGDDLDAFKKNVDPPQILLSTQGLIPCWRNMHDDGGWFAYTRSC

SEQ ID NO: 192496 - protein, 137 aa, Triticum aestivum
  unsure (1)..(137): unsure at all Xaa locations
  Clone ID: PAT_TA_86914.pep
MPKRGAGATTGAKFRITLGLPVGAVVNCADNTGAKNLYVISVKGIGARLNRLPAAASGDMVMATVKKGKPELRKKVTPAVIIRQRXPXRRQDGVFIYFEDNAGVIVNPXAKXEGSAITGPLLRMPVCGPYATLPDVV

SEQ ID NO: 192497 - protein, 91 aa, Triticum aestivum
  unsure (1)..(91): unsure at all Xaa locations
  Clone ID: PAT_TA_86915.pep
XHKYXYYLYVVTDTNYSRRVVEIHRFVPGINRRRLHNKSGTLTVTGTTGSASKLQGCTERPDKRICNDKHIFSRISMHACSVLIDPRPLXS

SEQ ID NO: 192498 - protein, 59 aa, Triticum aestivum
  Clone ID: PAT_TA_86916.pep
FFFCALTVDGNLYMNMTGAESMYTHMSCSNRGNLLVTGTHTSQNTSHMHTTRQHTCCLC

SEQ ID NO: 192499 - protein, 56 aa, Triticum aestivum; identical to SEQ ID NO: 134756
  Clone ID: PAT_TA_86917.pep

SEQ ID NO: 192500 - protein, 109 aa, Triticum aestivum
  unsure (1)..(109): unsure at all Xaa locations
  Clone ID: PAT_TA_86918.pep
CXYVPKIHPSGXLSCFFRVEXGVLPRGANSHXIGSAPKXPRLPEVGSADPLGVSSTPTFSISSSSRHRASCYSLAVILSFQTRNHRLAWTTGPSHGGHEQGDGQGRAGR

SEQ ID NO: 192501 - protein, 105 aa, Triticum aestivum
  Clone ID: PAT_TA_86919.pep
LGLPYEAQSSASTPLPHLATNPPQDFLSKKKLTPSTDFSDFNQTPLQRRSLFFCSLYRSFIRFMKMKIHPFRKMKMKIITVHISFSHSDFFCCLGLEERSSDFWS

SEQ ID NO: 192502 - protein, 113 aa, Triticum aestivum
  Clone ID: PAT_TA_86920.pep
MKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 192503 - protein, 66 aa, Triticum aestivum
  Clone ID: PAT_TA_86921.pep
SRTPSATPELGFNDDVSEHRLSSALQGGFLLRILQTPLEHRERVWLCKTNTTHIRREYNIFMSPIY

SEQ ID NO: 192504 - protein, 122 aa, Triticum aestivum
  Clone ID: PAT_TA_86922.pep
GYPGGAVLYIYDAIFKQDKFQHILVRHEQAAVHAADAYSRCSNEVGVCLVTSGPGVTNAVTGLSTAYMDSIPMVVISGQVPTAAIGQDAFQECDTVGITRPVVKHNFLVKDEKNKKKTKIKG

SEQ ID NO: 192505 - protein, 49 aa, Triticum aestivum
  Clone ID: PAT_TA_86923.pep
FFFFGQYSFLLLLTISSTLDRHACHIIQFFLSSDLFSSHPLDCYIHWHI

SEQ ID NO: 192506 - protein, 76 aa, Triticum aestivum
  Clone ID: PAT_TA_86924.pep
KERTSEMHGEERSRDEVAAVQQGIQRRSSNKGRKKKQQQVMLRKKQEVRGEEEEARAAELREEKKRSSGAAAVSCR

SEQ ID NO: 192507 - protein, 78 aa, Triticum aestivum
  Clone ID: PAT_TA_86925.pep
FFFLKLLIISSSLMIRNVMMHLTASHKLFKWCLETRSKIISQATTPEVPILCNLNTSIQAVQSCSNAHFSNQASYQRI

SEQ ID NO: 192508 - protein, 64 aa, Triticum aestivum
  Clone ID: PAT_TA_86926.pep
HFGAVWFKPQLAPSKICYDQCKGMTKFLASPCCLVCSHCTIPKNCQNSPLCGLQPIISWWYKHI

SEQ ID NO: 192509 - protein, 97 aa, Triticum aestivum
  unsure (1)..(97): unsure at all Xaa locations
  Clone ID: PAT_TA_86927.pep
RESRHXSXLRVAASAXQAADGSHXEGAXXVPSKXVFLAXSFPXHASALISPTRXXLQIESLKSLGGGSPXRXAGXXCCGRRPTNSLXSLPXWEARFL

SEQ ID NO: 192510 - protein, 83 aa, Triticum aestivum
  Clone ID: PAT_TA_86928.pep
KMTESKRTQIVPGTTYFLFNNACFVSLFLSPVCVCARDAYCPRTVHSCMRTFLWLPELNSSELKYVCAFSIELNRYATTIPQL

SEQ ID NO: 192511 - protein, 59 aa, Triticum aestivum
  unsure (1)..(59): unsure at all Xaa locations
  Clone ID: PAT_TA_86929.pep
HFNLFWFGADLPEPLTDSFLDYLMKTCTGVXHANGNIVFMSNKHLIGPLFVSKQTLQQH

SEQ ID NO: 192512 - protein, 60 aa, Triticum aestivum
  unsure (1)..(60): unsure at all Xaa locations
  Clone ID: PAT_TA_86930.pep
RAVFQHFCILFWRHRLFIHFIIGTFIGGHQCALWRKKEGWFSXEVIMSSNLEVCCSITLL

SEQ ID NO: 192513 - protein, 57 aa, Triticum aestivum
  Clone ID: PAT_TA_86931.pep
RLLLEKAEEEFGFRHEGALAIPCDTEAFKYILQCVERHDKGLAADDVDVDGMLPVVD

SEQ ID NO: 192514 - protein, 81 aa, Triticum aestivum
  unsure (1)..(81): unsure at all Xaa locations
  Clone ID: PAT_TA_86932.pep
ILKMSMTSVLLLVLNVLFSTWDGDVLNVLYMQGTQLLVSAMKGTVQTGNCDKLSVHGPLTIDLLYSDXNMXHTXESRXALQ

SEQ ID NO: 192515 - protein, 50 aa, Triticum aestivum
  Clone ID: PAT_TA_86933.pep
DIRSRDFQDNTCIDTQQSCVYDEHVSPSAASPVLPLTWHCYMWLHVMCYV

SEQ ID NO: 192516 - protein, 106 aa, Triticum aestivum
  Clone ID: PAT_TA_86934.pep
MAAEAAPLDLSLTLAPMSPWAVLPSGSSSHRSGAARSRLFSCLFCERKFLKSQALGGHQNAHRKERVVGSWNAHLYLPDHPRPPLPDTATGYLVDDGDEDNYQNLI

SEQ ID NO: 192517 - protein, 82 aa, Triticum aestivum
  Clone ID: PAT_TA_86935.pep
IKFLEPLVYCYLATSLATWEQVAAVDHRSTSWLGAGGRCSSRRSMRSSQSRACRLLHHAWRSPARHRQDDVGPSRCRSRPSS

SEQ ID NO: 192518 - protein, 85 aa, Triticum aestivum
  unsure (1)..(85): unsure at all Xaa locations
  Clone ID: PAT_TA_86936.pep
PTPXCDSTGCLCEHIQXFPVHPHTSFAHWSCCDFYVLPFTKSYGLVTSSDALLXNNVATCWSLXSARRSRSGELMTGSRQPSFLL

SEQ ID NO: 192519 - protein, 93 aa, Triticum aestivum
  unsure (1)..(93): unsure at all Xaa locations
  Clone ID: PAT_TA_86937.pep
VETYKIYIFKVLKQVHPDIGISSKAMSIMNSFINDIFEKLAGEAAKLARYNKKPTIASREIQTSVRLVLPGELAKHAVSEGTKAVTXSPPLSR

SEQ ID NO: 192520 - protein, 125 aa, Triticum aestivum
  unsure (1)..(125): unsure at all Xaa locations
  Clone ID: PAT_TA_86938.pep
GGIDHGDWYRPPLSRRSAKKFRFAPATRDCQREVLKYPQARSGYEGVVIARRNRGLNXFIVRKISSGEGVERTFQLYSPLIASIEVKRRGDVRRAKLYYLRERSGKSARIKEKLPSRAAKAAAAE

SEQ ID NO: 192521 - protein, 161 aa, Triticum aestivum
  unsure (1)..(161): unsure at all Xaa locations
  Clone ID: PAT_TA_86939.pep
VLPTDYQIASEAKAKRIIRIILKSLRANELSSQCFTQFAESNILIVGSFGMVKFKNVSILRNLPADVLLERQRSNYMSAHNIILGLFSGNPPQGIRHLLDLIDVDFTPREPFMFTDHWCQLKGIGVAYKTCMNTSNRTPKSIYYSNLGSRPMLILEDXXRQ

SEQ ID NO: 192522 - protein, 71 aa, Triticum aestivum
  unsure (1)..(71): unsure at all Xaa locations
  Clone ID: PAT_TA_86940.pep
QNPQAXRHFLECQFFQISVSLDAQEVVRLVGEKHKLASASFAELQIWTGGEWHYFMNQKYANGCMLLELGV

SEQ ID NO: 192523 - protein, 67 aa, Triticum aestivum
  Clone ID: PAT_TA_86941.pep
ACNISLVSVVYIISQFYFSCKKEEIKFETFADLLDQIYIHRVYKKVTNKYLQFIMFKLELLRVKSQI

SEQ ID NO: 192524 - protein, 104 aa, Triticum aestivum
  unsure (1)..(104): unsure at all Xaa locations
  Clone ID: PAT_TA_86942.pep
LMFLFEPEGKVPLFWGITADGCVAFSDDIDLLKGSCGKSLAPFPQXCFYWNALGGLKSYENPRXVTAVPADXEEICGATSWWKITVVAHSVGDLRLVLASRNPF

SEQ ID NO: 192525 - protein, 91 aa, Triticum aestivum
  Clone ID: PAT_TA_86943.pep
PYTKRTDVQIAAYKRYRRTNGSISSSYLKRFKYYIPTLFFPFNRLLMLNQIFLQLLVSWLMPNLLMHFNKLFKWGRILVWKLDRITRVLKF

SEQ ID NO: 192526 - protein, 172 aa, Triticum aestivum
  unsure (1)..(172): unsure at all Xaa locations
  Clone ID: PAT_TA_86944.pep
RNTLSWDEEYNIILGIAKGIMYLHEDSSVRIIHRDLKANNILIDDAMDPKIADFGLARLQVGGHTQTMTARVVGTYGYMAPEYAIHGNVSPKIDIFSFGVLVLEIVTKRRNCGSDDCETDTVNSXVMDDITDDDESLEGHPRIQALRXIHIGLLCVQADLTXQPDIPSITSC

SEQ ID NO: 192527 - protein, 76 aa, Triticum aestivum
  Clone ID: PAT_TA_86945.pep
NLAFMYGHAKLSGSVCFLVYACACMCTSVLNSGLCKIVTVLQISYRFSGTLSETCSNRYSGGLFKTLICTCQSHFF

SEQ ID NO: 192528 - protein, 119 aa, Triticum aestivum
  Clone ID: PAT_TA_86946.pep
LSSTSSTLPRLKVLENSSDGFHLANADLVMRGPGDLLGKKQSGHLPEFPIARLEIDGSILQEAHLVALKILGTSNDLSLFPRLKVELSMRQPLCLLGRLTSPVRGTDNTMRPAMTACAV

SEQ ID NO: 192529 - protein, 141 aa, Triticum aestivum
  unsure (1)..(141): unsure at all Xaa locations
  Clone ID: PAT_TA_86947.pep
MQDFTKSIDPTRPVTVGISSGFKSGISSVVEIMGYNYLGNGDIDAHRNQFKQQPGMGTEEGSTFATRGIYFTDDTKHYQSAYDKKPRPTFYSIEEGWKFYAERPYLAGMFIWTGFDYRGEPTPXGWPSVTSYFGMMDVCGF

SEQ ID NO: 192530 - protein, 93 aa, Triticum aestivum
  unsure (1)..(93): unsure at all Xaa locations
  Clone ID: PAT_TA_86948.pep
GRFTEKSDVFAFGIVVLXVITGRRAVSQVKVGTASSDLEGLIDPYLGGIFSTTEAARLAEVAVHCTSEAASQRPTMEAVVQQLKRLMPWFGTD

SEQ ID NO: 192531 - protein, 119 aa, Triticum aestivum
  unsure (1)..(119): unsure at all Xaa locations
  Clone ID: PAT_TA_86949.pep
LLXXVXXASSXXXLAFAMXPXXKLFLVXLGXNLMVNXVHGXCGPHCXILLXGYVAAXVXIGCCLCFYTGLSNXDDCXSRPPWXDAXSSTTTGXXDLPHDRTGELXTHLXCQAQLDSAKG

SEQ ID NO: 192532 - protein, 82 aa, Triticum aestivum
  Clone ID: PAT_TA_86950.pep
VGFIFREHNASPGYYDGRYWTMWKLPMFGCTDATQVINEVEEVKKEYPDAYVRIIGFDNMRQVQCVSFIAFKPPGCEESGKA

SEQ ID NO: 192533 - protein, 45 aa, Triticum aestivum
  Clone ID: PAT_TA_86951.pep
ASFCRAGGTEVLRDFDFLSELFYGFFFTNGSKANLALFFLIVRQI

SEQ ID NO: 192534 - protein, 149 aa, Triticum aestivum
  unsure (1)..(149): unsure at all Xaa locations
  Clone ID: PAT_TA_86952.pep
PVLRGKEECDELANYMSSEYNIKVASLLQDMSDKYLDMLYSLFDPSIAMLDYFQRPEANGYTVVDAACCGLGGEKNAMFSCTPASSLCKNRTSHVFWDFVHPTEITAQKLTAVAFQGSAPFVTPXNVEQLLALPCSNAAPMHITVVLSN

SEQ ID NO: 192535 - protein, 156 aa, Triticum aestivum
  unsure (1)..(156): unsure at all Xaa locations
  Clone ID: PAT_TA_86953.pep
LFLWGDDGEIRLGVHXAVQLENGFDFPALYSQCSNLGTLANVAHAVATKSMFQIFYNPRITFTPTVQHCSMATVTGLCLRLTLMQNPRDLVRLRPSPSCRLDTCMRTQPRPQLSVNQDSDSIDGILEQPRPSACVLPLHACDCINYPARASSTWLW

SEQ ID NO: 192536 - protein, 149 aa, Triticum aestivum
  unsure (1)..(149): unsure at all Xaa locations
  Clone ID: PAT_TA_86954.pep
ESFIKKFSCKSPVYHNCRIYASDGRLLCYCDRKKLEWYIQRDLAKLVEDNPPGIMLLFEPKGRPEDEDNEFYIQSKKNICVGCGEKSHYIRYRIIPSCYRMHFPEHLKXHRSHDIVXLCVDCHEIAHSAAEKYKXRLAEELGIPFCQKI

SEQ ID NO: 192537 - protein, 146 aa, Triticum aestivum
  unsure (1)..(146): unsure at all Xaa locations
  Clone ID: PAT_TA_86955.pep
QGAADVPCTLLHFVDGELIDVAKARIVPPGNPVFHGNPMPPTVYRVQLGRMLPGCDDLLPPFRPTGADEDDVMTLSACLSWPLLWPKSQIRLGAGDTTPQTRPPVVPAPTMARPPQRYRTSGHHMDXIXTSYGQVRTTHTRTFTTR

SEQ ID NO: 192538 - protein, 73 aa, Triticum aestivum
  Clone ID: PAT_TA_86956.pep
GWQVHVTVSFNTSTINLGGTNQRHFCARLYCTDDERRGYAMIKVSYHRGHDNTLLETELLVQTTSAQPTLRTL

SEQ ID NO: 192539 - protein, 83 aa, Triticum aestivum
  unsure (1)..(83): unsure at all Xaa locations
  Clone ID: PAT_TA_86957.pep
ENPNVLNYPVSNPIWSIFMHVASHLYTDVNSSYSMQAEQLPLFYKNKGFPRATLNKRSNRIQVHDFXEETDSSVYLKSGRNLS

SEQ ID NO: 192540 - protein, 48 aa, Triticum aestivum
  unsure (1)..(48): unsure at all Xaa locations
  Clone ID: PAT_TA_86958.pep
QVXRVCWLREVMWCLLLVDTEINQTFWISXCKRSGVPPMYELVNTTTT

SEQ ID NO: 192541 - protein, 136 aa, Triticum aestivum
  unsure (1)..(136): unsure at all Xaa locations
  Clone ID: PAT_TA_86959.pep
KKLTHRIRQKRAQEVQTLLQKPDHEIDRMKLSVTHLRLLQEARERIQSKTPSGPSSSNQSSSHFGDTDDFDPFGDNYDNDRTENHALENATKLNYHSYMDKKTRAKWTKSDTDLFXRLRXFGSDFAMIQQLFQSPR

SEQ ID NO: 192542 - protein, 112 aa, Triticum aestivum
  unsure (1)..(112): unsure at all Xaa locations
  Clone ID: PAT_TA_86960.pep
HRINTDAELARGHVHGFRMSLWYEHLGKTHDDFLRPGSLECMRRVNKMADEYWNLYIGDELTGDLPGHLLTYPVALSKAGTTWMIPGFEFFPDTXARVLGKPTGHDDYYMST

SEQ ID NO: 192543 - protein, 77 aa, Triticum aestivum
  unsure (1)..(77): unsure at all Xaa locations
  Clone ID: PAT_TA_86961.pep
LVRXXPWVHLVXAPAHSHGTHVTKDAAYTKDAVHFSDLNALIFLYEGSIMKLQQVPFILPLIIAPEQNEKYCSLGWH

SEQ ID NO: 192544 - protein, 107 aa, Triticum aestivum
  Clone ID: PAT_TA_86962.pep
RSWLYGALRESYLPLSCCCSSLLLRPAASLLPLAFLNCCCSLLPPNSSAASSFFSLSLLLLLNRSSSCCDSAARCSPTADPIDAHPDPGPLGRCPRDALKWARVSTR

SEQ ID NO: 192545 - protein, 123 aa, Triticum aestivum
  unsure (1)..(123): unsure at all Xaa locations
  Clone ID: PAT_TA_86963.pep
TWVQPKXPTYVSTXDSRSXTGSTRDQRDQEPAASRSRTRRTHITIKRDQDGRPRAVEQRGNRPPPSRRERRASLPPIVHPTLEGRLGPCEGVSENDAHHRIDRLARSLPIEEEDAIGPTCFGP

SEQ ID NO: 192546 - protein, 129 aa, Triticum aestivum
  Clone ID: PAT_TA_86964.pep
NSDDMHTRSATSMIWVHVGANNQILVLTSIVGSVAGQRGHRPVQLQVANKMIPFNRPAAPESAVPFSLAADPSGPAGLVLSTNHGAPLQAIPTRRSPGRLPASRVHIHTAARGSCSTECQPRRETPSLL

SEQ ID NO: 192547 - protein, 102 aa, Triticum aestivum
  unsure (1)..(102): unsure at all Xaa locations
  Clone ID: PAT_TA_86965.pep
MSLIAGEEFQHILRVLNTNVDGKQKIMFALTSIKGVGRRFSNIVCKKADIXDMNKRAGEXSAEEMDXLMAVVHNRXXKVRMVLQQKEDYKTXVSQVVSNAWT

SEQ ID NO: 192548 - protein, 67 aa, Triticum aestivum
  unsure (1)..(67): unsure at all Xaa locations
  Clone ID: PAT_TA_86966.pep
VEQDLDNKSDLLLASNPVHKKVPVLIHNGKPICESVVILEYIDDAYGTVGPSFLPVDPYERAIAXSG

SEQ ID NO: 192549 - protein, 54 aa, Triticum aestivum
  unsure (1)..(54): unsure at all Xaa locations
  Clone ID: PAT_TA_86967.pep
IFLLHFLYLGCGSARQGMLDINFAQTHKRRKIHSSTGNPQNNKQMKIHXTYMGN

SEQ ID NO: 192550 - protein, 82 aa, Triticum aestivum
  Clone ID: PAT_TA_86968.pep
SSGNVTHGHSHCQEGTCVAAHTFTHRQIRSTYDKMSTCIYGSVHVYYTSGLLPFAPHASSTHPGAGTRGGQMLGGWVDLAVG

SEQ ID NO: 192551 - protein, 76 aa, Triticum aestivum
  Clone ID: PAT_TA_86969.pep
RTIDVSFSLAGALAGTGGGTRCSLASPAEGKAGQQHQAARSIAACSFPHVHVKLIRLPVSEEIVPDSWSVYAVLCR

SEQ ID NO: 192552 - protein, 94 aa, Triticum aestivum
  unsure (1)..(94): unsure at all Xaa locations
  Clone ID: PAT_TA_86970.pep
QILHPAVSILQHITEKNFGNHLPQPSKSIRYTSYGDTPELPPQYWVXSRLSHQXNCIKEIFDVXVTKLXYSQXCNXRIMTTTPXXAXLXGDTST

SEQ ID NO: 192553 - protein, 153 aa, Triticum aestivum
  unsure (1)..(153): unsure at all Xaa locations
  Clone ID: PAT_TA_86971.pep
RVLFLRYEEMLADPVXAVRELARFLGVPFSAAEEAAGLPMDITAMCSIDTMRGLDANKKGSSGTFVKFPHETFFRKGVVGDWVNHMSPGDGPGASTPFVRGQLRGRPHLLVLISHSSLQDRPMIKEPKGFGVCSSCLVSILILQLENKIILGK

SEQ ID NO: 192554 - protein, 100 aa, Triticum aestivum
  unsure (1)..(100): unsure at all Xaa locations
  Clone ID: PAT_TA_86972.pep
STLRTVSDSAVGTCNRVLPYKKGEYSGEICWERFMTGIDFHDSNEAITAVNILFKGMLVKLNSWGTFNISXMKPDGHAGPXXGVPYIFTGQQQRLPIGQX

SEQ ID NO: 192555 - protein, 114 aa, Triticum aestivum
  unsure (1)..(114): unsure at all Xaa locations
  Clone ID: PAT_TA_86973.pep
VRSIYGPKKRAPGSNTTRRVFEDNGTPKYRGAAHPLCFTDEVLDHEFPAGFKPVNIEEYDRTTDPGVWIRXYILHIHMARGDDLHAIKYLPLKLKGPARHWLKSLLENTIGSWE

SEQ ID NO: 192556 - protein, 149 aa, Triticum aestivum
  unsure (1)..(149): unsure at all Xaa locations
  Clone ID: PAT_TA_86974.pep
RDLSFEVGDFIYLKVSPIRGVRRFGVKGKLAPHYIGPYQILARRGEVAYQLSLPENLSVVHDVFHVSQLKKCLXVPEEQLPVEGLEVQEDLTYIEKPAQILXTADRVTPXRKTIQNVAKXRWNHHSKGRSNLGAKMILDGQIPTQLSPE

SEQ ID NO: 192557 - protein, 182 aa, Triticum aestivum
  unsure (1)..(182): unsure at all Xaa locations
  Clone ID: PAT_TA_86975.pep
LGRSYLGVLNCDSGSVSLLDXPFSDLSNVVAGNDYFXIXGASASAPMSIAKVTLDKNKTKAISFSIVWSSSPDAVQYRPFFSTPEFIEFPTSSPGQKAYAYFYPPLXNPCFKVYQDEKPPLLVKTHGGPXAETRXIXDLSVXXWDKSXDGHFLECXTTXGSTGYGRRYXXNYWGKWGIVQVX

SEQ ID NO: 192558 - protein, 82 aa, Triticum aestivum
  Clone ID: PAT_TA_86976.pep
AADDGAGRRGGGGRGKGRRGGKRMMKRTSAWRRTPRILVRLMFACCQLVLLSTFSELIVLNFCVTIACTYIELSKFVLSMIH

SEQ ID NO: 192559 - protein, 193 aa, Triticum aestivum
  unsure (1)..(193): unsure at all Xaa locations
  Clone ID: PAT_TA_86977.pep
PASTKESSTCLTNNREMGLATPRDNSSITSNREDSNQDHVFLAFGRDSSDSPISVASTMSSPVALNGSRNEESGPGQSTVKVRTLEKSMSGSSNQETKSMPPAREGEQLAKEKLYCCSCRESISREPHLDHDSSTAKIWTLLLENKFHNCTWVYGHHHLQHIPREQDTXSXPYXDSMVSYNXQXLLNLQDPRL

SEQ ID NO: 192560 - protein, 88 aa, Triticum aestivum
  unsure (1)..(88): unsure at all Xaa locations
  Clone ID: PAT_TA_86978.pep
PNTSRARALDXIDCGSCRIXHEAXTTRTRFKSPHGSXRSARQGSSHLXGQRSYPASTDSLDVRRXXRTCRRQXLRTPPATLLRDXEGG

SEQ ID NO: 192561 - protein, 145 aa, Triticum aestivum
  unsure (1)..(145): unsure at all Xaa locations
  Clone ID: PAT_TA_86979.pep
RIVHLSGRVDEYGRAVLPGEVLAAHPNHVLSRPCGSRQQGGPRIVIIVSPEAELERGEIYFLLPAASVPADAKKKTNDQARAEPRRRRRRGGPAXHRHHVRSKSEGSAATPSKVTWSSSIRRPLSTHVPHLARIADPDQLWLPVP

SEQ ID NO: 192562 - protein, 107 aa, Triticum aestivum
  Clone ID: PAT_TA_86980.pep
GTIGKWVRCSSEFPYTHDVPSSIGYQFNLTTRGYRALVFSGDHDLLVPFLGTHAWIRSFNFSIVDNWESMACGMGQSAGLSLSLLDFAFHFRPSLNIANPSMGLQSD

SEQ ID NO: 192563 - protein, 102 aa, Triticum aestivum
  unsure (1)..(102): unsure at all Xaa locations
  Clone ID: PAT_TA_86981.pep
AGVTVCLSLQRRNNKSRVIFQFIFKWAHRQWKDEQNSEQTGLNLHTXNMCCQVSSSTDCQDSXXGKAMLXDLNILTKGLQHNVQSSDCSSXSPLQVXIFSLK

SEQ ID NO: 192564 - protein, 80 aa, Triticum aestivum
  Clone ID: PAT_TA_86982.pep
TEEQKKLNTETVHDRNGKTAMILTTMYRNQLEVHALRYPGLNHVHTATATSITCIHTTRLQKSGDYYIHSRTLRLELSNS

SEQ ID NO: 192565 - protein, 81 aa, Triticum aestivum
  Clone ID: PAT_TA_86983.pep
RHHARPAPSRCCLSLSHATRIATFSAITFHFLMYKILNCLIPRVWSIGPYMRFVVIPCGEGHVPAVNIGFLIVHHGVSRVS

SEQ ID NO: 192566 - protein, 66 aa, Triticum aestivum
  Clone ID: PAT_TA_86984.pep
TTHITHFRLQSYKFIKEGNDPAPTRETRPIFIRVVARCGADGSRSRPCWMLSHRSCGGDGGGASRN

SEQ ID NO: 192567 - protein, 65 aa, Triticum aestivum
  Clone ID: PAT_TA_86985.pep
RKKKKIDKLVCFVFVLLGLRDQLARVDIIDSKKCLQSCSVYVCKILDLVNVDNGIHRSTSILKKK

SEQ ID NO: 192568 - protein, 91 aa, Triticum aestivum
  unsure (1)..(91): unsure at all Xaa locations
  Clone ID: PAT_TA_86986.pep
PWGFLLFIWGSRQNVFHLRKITFEIFLRMHYGFWKVLCHFQLFLPXMALVXTSLLXLPSLWDHDLHQIXQVXTPHVIIPIKINQIIRSPXX

SEQ ID NO: 192569 - protein, 79 aa, Triticum aestivum
  Clone ID: PAT_TA_86987.pep
TFSRVVFAYTYMDDIIVPRGWYNWGDPSRELTVFYGQYKCTGPGASYSGRVSWSRELTDEEAKPFISLSFIDGTEWIRI

SEQ ID NO: 192570 - protein, 90 aa, Triticum aestivum
  unsure (1)..(90): unsure at all Xaa locations
  Clone ID: PAT_TA_86988.pep
XNLSTXIYTKCYTTXYXXYXWWXPXTSXXFSCXVXSXFTKIXLXXXAVKYWXKPXXGXSGXXALTPLNGQXPELGIDXSXGXPXPNXSPX

SEQ ID NO: 192571 - protein, 88 aa, Triticum aestivum
  unsure (1)..(88): unsure at all Xaa locations
  Clone ID: PAT_TA_86989.pep
SKETLDTVHRYISTAPGXSAIKNSQSRYHAATLLKKTCLKRLSLGEVLQVLYIATDKMKWFVPHSSGWQPLSWNVIVADTAPDASGKS

SEQ ID NO: 192572 - protein, 110 aa, Triticum aestivum
  unsure (1)..(110): unsure at all Xaa locations
  Clone ID: PAT_TA_86990.pep
PAGLWISWRIPSQLGAXAFLDLCTRASSASSSRRVAQSRLLRLAXAPLVLSLQPVPPSLCSSPGRWRLEDPSASTRFSPALTGGPPSVSSVGFVAWPASSLRLHVLAWWP

SEQ ID NO: 192573 - protein, 99 aa, Triticum aestivum
  Clone ID: PAT_TA_86991.pep
ARRFIGSKEKSKTNPELLKSYILGGHVSNYMRFLQKRDDGSYEKKFSRYIKAGLAADGLADKWLAVHESIRKNPVHVSKRKTLPAGFVQERFKRQAKHP

SEQ ID NO: 192574 - protein, 143 aa, Triticum aestivum
  unsure (1)..(143): unsure at all Xaa locations
  Clone ID: PAT_TA_86992.pep
FYGWRAAPARPLRVLPRVAWPLLSRQGGGSFHSRRPLLRALAXGVPQSLGHSAASVAPLLPKGKVKEXACVVLLXLXGKGLLCPNLHXNAKNPSXEMIKDMFLQLQWEFGAAPLGLPNWKXCLKVIXFLVGXQSFHXXNPLXL

SEQ ID NO: 192575 - protein, 74 aa, Triticum aestivum
  unsure (1)..(74): unsure at all Xaa locations
  Clone ID: PAT_TA_86993.pep
LYNXRGLPSSSPSSEGSKHPYVSDPERLIGLYAYELQGCEPLTLRRRVAYIESARPLPPSIMQCLRYIKAGRYW

SEQ ID NO: 192576 - protein, 131 aa, Triticum aestivum
  unsure (1)..(131): unsure at all Xaa locations
  Clone ID: PAT_TA_86994.pep
LKWTNTQLQQQQACVGVGLQVWNQLGSKWDLCAANISFDTLCWCGFAAWNALILFSSGSRRETVERMRXEVIKLIPRLVYADPRSKLETVKDAFDVAVKGIIDRVARARAEAAGEDSSFSHAMEMFRFRRK

SEQ ID NO: 192577 - protein, 110 aa, Triticum aestivum
  unsure (1)..(110): unsure at all Xaa locations
  Clone ID: PAT_TA_86995.pep
DTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGHXRLSCSKVNS

SEQ ID NO: 192578 - protein, 107 aa, Triticum aestivum
  Clone ID: PAT_TA_86996.pep
VKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGEEGLVLGPR

SEQ ID NO: 192579 - protein, 82 aa, Triticum aestivum
  Clone ID: PAT_TA_86997.pep
VVSKGKVPWMSLGASKLCAVHRDAFSFFLCAIGMHNYHYMHLYFLDRFPTCISVVIDKRFNPCLIYKFKIWNKMPVPCLKKK

SEQ ID NO: 192580 - protein, 44 aa, Triticum aestivum
  Clone ID: PAT_TA_86998.pep
QEAGRTPLRVLFAGEATHRTHYSTTHAAYLSGVREADQLLQHYR

SEQ ID NO: 192581 - protein, 112 aa, Triticum aestivum
  unsure (1)..(112): unsure at all Xaa locations
  Clone ID: PAT_TA_86999.pep
PRSDASLVCLVSQRRVLHPYWSRXXFGSHESVASKXIEDLXKLKDXKIXLSGLLFRFSCPXQMLQSPXKXXLPPHPLRDXFPCPPYXKXXSIXGXXKEPXXXXGLXXTQRYF

SEQ ID NO: 192582 - protein, 94 aa, Triticum aestivum
  Clone ID: PAT_TA_87000.pep
GILQALVNTGASTSCIWIVLVTCSCPGFSLKLKMGELLSLLHVLLHQLLRALRWISLRLWRQVLKRHGSYEARLLQLPRGLATSAVTKWTTMLN

SEQ ID NO: 192583 - protein, 65 aa, Triticum aestivum
  unsure (1)..(65): unsure at all Xaa locations
  Clone ID: PAT_TA_87001.pep
AEQRGMRNGVTYRXHTETKIKLCTEKSTMIHPSLLVHHSKGNTQSGASXTKGSXRXRWTXQSCIG

SEQ ID NO: 192584 - protein, 41 aa, Triticum aestivum
  Clone ID: PAT_TA_87002.pep
LPQPTSYSLQSGQGLKRNVLLSSAVHIIRYRNFRHKNFQLD

SEQ ID NO: 192585 - protein, 153 aa, Triticum aestivum
  unsure (1)..(153): unsure at all Xaa locations
  Clone ID: PAT_TA_87003.pep
MAAAGDAGEKKMITLKSSDGEEFEVEEAVAMESQTIRHMIEDDCADNGIPLPNVNSKILSKVIEYCNKHVQAKPADGAAAAAGASDAAAPARPRGXLKNWXTRFVKVDKPPXRLILGCQYXNIKGLWDLXCXTVADMLKGKTRRSSDLTSRRF

SEQ ID NO: 192586 - protein, 85 aa, Triticum aestivum
  unsure (1)..(85): unsure at all Xaa locations
  Clone ID: PAT_TA_87004.pep
NYGGALQVSFLLGILVLGLASWLRGVQXENHHAVASEHSSFDELQKPEAWHGSSSSYYPILPSRYLRDPFTISKMFSKLKSSLLF

SEQ ID NO: 192587 - protein, 60 aa, Triticum aestivum
  unsure (1)..(60): unsure at all Xaa locations
  Clone ID: PAT_TA_87005.pep
TRSSPSLPPXLPRPXPKXXQXAVLDCSXPGRXAEARMSSQXQXPXQXXTSXELYDERLPM

SEQ ID NO: 192588 - protein, 172 aa, Triticum aestivum
  unsure (1)..(172): unsure at all Xaa locations
  Clone ID: PAT_TA_87006.pep
CFSFEATYLXXKYKMPCAPVXXIKYHXXSLQFSCGLXSERKIWMVTTWLFXNLLGVLGGLAPXNIITDQDFSMCAGIEEVFPLAVHRHCRWHIIKKAEETLGPFFAGRLELHKAFELCVDHSLMVEEFEQSWKAMIETYQVRDNETLTSLWEKRMYWVPAYFMQCFFPFLQT

SEQ ID NO: 192589 - protein, 73 aa, Triticum aestivum
  Clone ID: PAT_TA_87007.pep
VDSLFVSFDQFSDRLSSLTVLRQTNHLHAIAVFLFTVHRPLMCVSETAPNPNRSVVTDEFGSSPNVYKTSPFC

SEQ ID NO: 192590 - protein, 76 aa, Triticum aestivum
  Clone ID: PAT_TA_87008.pep
FFFLPFLFIFFFFFFPFFLFYFILFFGPFFFFGLSSFFSFFGQCSNNDDHHTSIDCNIKITTRNLEQDMTLYECLR

SEQ ID NO: 192591 - protein, 71 aa, Triticum aestivum
  Clone ID: PAT_TA_87009.pep
HSATVVLPLLASYGCSNGAGRKFFFPQRTVQDFILCGMSGDLSHDKWLIEKKGYHKASSHKTHSSQSSKKK

SEQ ID NO: 192592 - protein, 61 aa, Triticum aestivum
  unsure (1)..(61): unsure at all Xaa locations
  Clone ID: PAT_TA_87010.pep
SPSPKYRHDLYCHRHDTMISIILISINVSSHGCLANYCSCNYCYRISDNVKQLFWRLXPMQ

SEQ ID NO: 192593 - protein, 48 aa, Triticum aestivum
  Clone ID: PAT_TA_87011.pep
TIQPFFTSSSIKQTLLVTPYLRMHVDDVPMPRGQVQSTLMITFKLAWL

SEQ ID NO: 192594 - protein, 60 aa, Triticum aestivum
  unsure (1)..(60): unsure at all Xaa locations
  Clone ID: PAT_TA_87012.pep
ESLQADGACFKPDTMXSHASYAFNSYWQRAKSTGATCDFGGTAMLITKDPSYDNCHYSVM

SEQ ID NO: 192595 - protein, 77 aa, Triticum aestivum
  Clone ID: PAT_TA_87013.pep
RTRRAALCPEMNLQSVSVPVQSVAACCGSFPISSSLSLGLAGGFSPVIFPFLFVPLPFLLTWSGNHANISLTCSVSQ

SEQ ID NO: 192596 - protein, 92 aa, Triticum aestivum
  unsure (1)..(92): unsure at all Xaa locations
  Clone ID: PAT_TA_87014.pep
IFVVVYFDDIXVFXKSXQEXXTHVRTVLQTLRKERXXANMEKCXXGVXXLXFLGFVVPXKGVQXYEXXIXXIKTWPQPTNLQQVRSFPXLTG

SEQ ID NO: 192597 - protein, 63 aa, Triticum aestivum
  unsure (1)..(63): unsure at all Xaa locations
  Clone ID: PAT_TA_87015.pep
AVGLEVHQSCEXWKDGTSLXVWITLIGDQXDKAIXDRVEENKLGXGTIIMDRVAYIRYLGTHP

SEQ ID NO: 192598 - protein, 117 aa, Triticum aestivum
  unsure (1)..(117): unsure at all Xaa locations
  Clone ID: PAT_TA_87016.pep
QGWISLSVLFCFTFPRSGRKPFLISREIRNSDCAEILTRXFPGYKLPCTRSRDPTDIGGGHNPPGRAWPLGRTLXSCGGCGPPFALIPSPKNHLYSKIILHKFYRVWDFRLDMGFPV

SEQ ID NO: 192599 - protein, 97 aa, Triticum aestivum
  Clone ID: PAT_TA_87017.pep
QFLQNPSLSSPPGARCSASSPSPPRRQAAPPRRRRRLRRRQAGPPHRRRRLRRRQAAQLCRRRRPRRPPHRRPRAPTPPAVLRHPSVSTCLAPLPCL

SEQ ID NO: 192600 - protein, 125 aa, Triticum aestivum
  unsure (1)..(125): unsure at all Xaa locations
  Clone ID: PAT_TA_87018.pep
LRCSIHRFGSITESVIFLRTKLVKDRRYLTTFIYMQNMVLNMPSYPDNVAIKKACEAVPSSITIPSLSPWSLPXIXAQVPPTLNXLQSYIGKTSQXATPVQLAGXSSXXSEVHETKLXSRAARKX

SEQ ID NO: 192601 - protein, 155 aa, Triticum aestivum
  unsure (1)..(155): unsure at all Xaa locations
  Clone ID: PAT_TA_87019.pep
RSQLEAAFLKKNLNTVDMVALSGAHTIGKAQCSNFRTRIYGGDTNINTAFATSLKANCPQSGGNTNLANLDTTTPNAFDNAYYTNLLSQKGLLHSDQVLFXNNDTTDNTVRNFASNAAASTTPSTTAMIXKMGNIAPLTGXTQGQVXLXCSKVNP

SEQ ID NO: 192602 - protein, 71 aa, Triticum aestivum
  unsure (1)..(71): unsure at all Xaa locations
  Clone ID: PAT_TA_87020.pep
VWDPPSHVQGSTACIPAVRLFCLLRGRRRDEITFSTGLLQSGDRATIENVILVKYXNWXDQLCATRAITID

SEQ ID NO: 192603 - protein, 156 aa, Triticum aestivum
  unsure (1)..(156): unsure at all Xaa locations
  Clone ID: PAT_TA_87021.pep
MDASKLKKVAGKKFGGPRKKSVTRSVKAGLQFPVGRIGRFLKKGRYAQRVGSGAPVYLAAVLEYLAAEVLELAGNAAKDNKKTRIXVPRHLAAGPSATTKDSGRLLSGVTIXPNGGSSPNINPVLLPQRKTAXRRPEKTAAKXPKEGTNPPKKAQG

SEQ ID NO: 192604 - protein, 72 aa, Triticum aestivum
  unsure (1)..(72): unsure at all Xaa locations
  Clone ID: PAT_TA_87022.pep
FFFCKSRGHAXHSKLQAXHFXXQXIGRQLVPYSIKLKLEPKEGRRRGTRPRKKELTLCRIQTDVSFIQEQHS

SEQ ID NO: 192605 - protein, 98 aa, Triticum aestivum
  Clone ID: PAT_TA_87023.pep
LIKADVPLKKTLSAAESNHQPKGMAGFLYTISLFVHSEKCSYNTLWLDLDTTHVHSEFFIKEIWSFLSCFYHSLRSTSFSPAGRSPQWRTCGTMRPAS

SEQ ID NO: 192606 - protein, 124 aa, Triticum aestivum
  Clone ID: PAT_TA_87024.pep
EWLSKAERIRCPAPLPEGSPSPAIAKMLGHVLSQVPSGKDEGKNREAELHTLHIQTGGIATSPKEDSRGGESKVSSHRGKKRAASKDLETEVPRQGKKTSPGGPAPKGVFTVPCPQTGQPSVKL

SEQ ID NO: 192607 - protein, 84 aa, Triticum aestivum
  Clone ID: PAT_TA_87025.pep
RKVLRDNIQGITKPAIRRLARRGGVKRISGLIYEETRGVLKIFLENVIRDAVTYTEHARRKTVTAMDVVYALKRQGRTLYGFGG

SEQ ID NO: 192608 - protein, 59 aa, Triticum aestivum
  Clone ID: PAT_TA_87026.pep
FFFFHKYSCCSENAFEERKQTFTRRLNQVALRLDNITEHTDRSYKLAINRGQELIIHDG

SEQ ID NO: 192609 - protein, 194 aa, Triticum aestivum
  unsure (1)..(194): unsure at all Xaa locations
  Clone ID: PAT_TA_87027.pep
AADVTTAKELLELANKVGPXEICMLKTHVDILSDFTPDFGAKLRSIAEEHNFLILEDRKFADMGNTVTMQYEGGIFRISDWADIVTAHVVPGPGIIDGLKLKGLPKGKGLPLVAEMSAPSNLAHGDYTTAAVXFAEQHSDFVIXFLSVNLHLATPSAXPXXVHVVDTGXXXVPGGXXLXSXXNPXLGVNNQXAT

SEQ ID NO: 192610 - protein, 76 aa, Triticum aestivum
  Clone ID: PAT_TA_87028.pep
RRRWRRVRGAGGAVRGQPQGHPAVLRRGLPRRRRRPVRCMHRSSYISLCTYLHTHVCMYINLYVLLVYLYRSIVSA

SEQ ID NO: 192611 - protein, 81 aa, Triticum aestivum
  unsure (1)..(81): unsure at all Xaa locations
  Clone ID: PAT_TA_87029.pep
GXGNMFXXFEXVXSCPSINHNXYXLWPGIFPIXGRPFYRQMXRRSLPCRRDLVKIRTNNAYEATTYVSLEEKNPHSNFRCG

SEQ ID NO: 192612 - protein, 74 aa, Triticum aestivum
  Clone ID: PAT_TA_87030.pep
RVSLCDPFVLLLKNQHIRASGPCDSVFFFFFFFYISHEMYIGFSECERVVLYSNTACACRAVIISGHVVDEKKK

SEQ ID NO: 192613 - protein, 94 aa, Triticum aestivum
  unsure (1)..(94): unsure at all Xaa locations
  Clone ID: PAT_TA_87031.pep
RNRRXRRLPSQLLLEQLLLYLPLRCFLCLPLVFHKRCSPSFLIPYSSSTSCLFARASCISRTCSGTFFMSTFSLGASASFSSSLTCPIRCKTDQ

SEQ ID NO: 192614 - protein, 78 aa, Triticum aestivum; identical to SEQ ID NO: 106977
  Clone ID: PAT_TA_87032.pep

SEQ ID NO: 192615 - protein, 180 aa, Triticum aestivum
  unsure (1)..(180): unsure at all Xaa locations
  Clone ID: PAT_TA_87033.pep
NGVIMAASATATKATGRREERKEKASRLWAMAEFKHLCMAKFKEGVVVDDIIQELTKLAAELDTVKYFGWGKDVLNQGGAHAGLHPRLRHDLRQRRGPGRRAWAMXKHSAFARHLNGRAXQXRRHGTSPWSSSSQRRLPDRLXYLYQAWMCNYPXICXNXGVMXEYRTXSLGLXFXXGXA

SEQ ID NO: 192616 - protein, 137 aa, Triticum aestivum
  unsure (1)..(137): unsure at all Xaa locations
  Clone ID: PAT_TA_87034.pep
VVDHVGFENKGTALNLPGIPIAIGLYGYCYSGHGVFPNIYSSLKNRNQFPSILFTCIGFSTILFTAAAVMGYKMFGEATESQFTLNLPREFGLFPRLPSGATVXNPITKYALTITPLGHGSGRLLPRTSRILQHNFA

SEQ ID NO: 192617 - protein, 138 aa, Triticum aestivum
  unsure (1)..(138): unsure at all Xaa locations
  Clone ID: PAT_TA_87035.pep
FFLVKTDFIYLLIGRPTRPRFSLRKWXHYNSTETIRESHFGYIPSHPSVRSVQTRKMHRKIKNKYLGKIKNSKIFVSRSCLLDHWSIELERKEKLTILAREQHTMDERIKISQRSRHGPDSHLPPLGRSLPHLPALVP

SEQ ID NO: 192618 - protein, 45 aa, Triticum aestivum
  unsure (1)..(45): unsure at all Xaa locations
  Clone ID: PAT_TA_87036.pep
NAKGAVAVVVSILIFKNPVTVMGMLGYGVTIAGVVLYGEAXKRSK

SEQ ID NO: 192619 - protein, 82 aa, Triticum aestivum
  Clone ID: PAT_TA_87037.pep
AIHCHLHIFSVVIFFVFVQCWMLTYIMYTYAEEKGPITLGWVQPNIIMPHYPVWNMSYKIKLPNFASVSNFSICPEFQTRIL

SEQ ID NO: 192620 - protein, 81 aa, Triticum aestivum
  Clone ID: PAT_TA_87038.pep
TLAIDRRIRRTATAPPGPWPPSGFGVHVRMQRDDAEEIWRNMALLGSSPVASDFFLEDDGYVRAAAIGSINWPCRGAGGNR

SEQ ID NO: 192621 - protein, 81 aa, Triticum aestivum
  unsure (1)..(81): unsure at all Xaa locations
  Clone ID: PAT_TA_87039.pep
MIPSGLTWAHVHACSWKQNQHSLHDIYVHGDSYPNMLAFKCWLISNACLMTGCRSPSWVASXPFSSLHLVLSGNTACASTP

SEQ ID NO: 192622 - protein, 86 aa, Triticum aestivum
  unsure (1)..(86): unsure at all Xaa locations
  Clone ID: PAT_TA_87040.pep
RVRNYTVDMTGVYSPVSXIHFRYPCCXFDMFLPPPVNKLHPXISKMVKLAXTRXXAVRRRAIXTXXRXVAXAXGRXRXGXRXXLDP

SEQ ID NO: 192623 - protein, 82 aa, Triticum aestivum
  Clone ID: PAT_TA_87041.pep
RRARHGRASVHGEQQGRLQVGMAATGWNLNRKHGVFAMVLTVRSCGWLMDAGVDERQRIEGDHRRAEEEDNDALVVGDPNST

SEQ ID NO: 192624 - protein, 96 aa, Triticum aestivum
  unsure (1)..(96): unsure at all Xaa locations
  Clone ID: PAT_TA_87042.pep
RVSRVVSRVPTWFHWRRLNAARRHVQPGVQQAAXSDSDVRTPRRSSHLTCGLVGYLAQHVSDPTQAAHSRGAFGXPGLCEAGISQTDDYSSNVREF

SEQ ID NO: 192625 - protein, 47 aa, Triticum aestivum
  unsure (1)..(47): unsure at all Xaa locations
  Clone ID: PAT_TA_87043.pep
KTDSTPPSFPMPNQTDEPILGSLERVDAEKILEPITLSKSVCDCXGF

SEQ ID NO: 192626 - protein, 125 aa, Triticum aestivum
  Clone ID: PAT_TA_87044.pep
TTSSAPTTVRVGRWGQRRGAAPAPPLDTATVVSDTLISSLDTVGFSLPRVALVLWHDQRYVWFVRKVAPSKHWVAKILVEVLVAHDLADIGKKNELELSRVHWHAKEMATIQTKTNLWGHDQNLV

SEQ ID NO: 192627 - protein, 59 aa, Triticum aestivum
  Clone ID: PAT_TA_87045.pep
LDQLAHVINLQWVQFTEEVAVLQEFGSRSRGISPLYRDPRLNVQVVPGVLQSILLSVAA

SEQ ID NO: 192628 - protein, 70 aa, Triticum aestivum
  unsure (1)..(70): unsure at all Xaa locations
  Clone ID: PAT_TA_87046.pep
DPXTWDWDLKIPLDDLVDQTEVTYGAKPIFRALIYFCYCLILVPSMVENKYSPSQMHSSQNLGTAKFQSM

SEQ ID NO: 192629 - protein, 155 aa, Triticum aestivum
  unsure (1)..(155): unsure at all Xaa locations
  Clone ID: PAT_TA_87047.pep
EDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVXGKRVRYRLXDGAKVIKIYLGPERSATTLKYKLETFS

SEQ ID NO: 192630 - protein, 59 aa, Triticum aestivum
  unsure (1)..(59): unsure at all Xaa locations
  Clone ID: PAT_TA_87048.pep
APGCPDEGAAGGAGEGDLMYMRAKFERVVGSXRDSEAFYMMNXPDGSGGPELSIYLLRV

SEQ ID NO: 192631 - protein, 46 aa, Triticum aestivum
  Clone ID: PAT_TA_87049.pep
FRDNRENYMQTEACTYNTAPMVGMFAKLNRMAREEREQRAATAAEM

SEQ ID NO: 192632 - protein, 99 aa, Triticum aestivum
  Clone ID: PAT_TA_87050.pep
TTCTSRASHRLSRRLVQTSRHVRVERLKKLGEYKYDASSRGRPNPFFPLLTWTRRRLLDAPVEPSSRRRPLDARRRGSEAPPSPAPRRGSEAPPSPSSR

SEQ ID NO: 192633 - protein, 75 aa, Triticum aestivum
  Clone ID: PAT_TA_87051.pep
LRSPVCVRQPAIDVWPAWELKRERELRAEQHPRALRRRVPPCHLLGCLHPSLRHCSRPSLRVTRSNVNFPSVNLD

SEQ ID NO: 192634 - protein, 94 aa, Triticum aestivum
  Clone ID: PAT_TA_87052.pep
QKYASTRTTSGASGEIDRWVPRVRRERERVRREAGFHRELTPATRGLGLNERGRFEAGLRGALSPLPRGLARGGRGWVPARTCNFGGGRDSPKT

SEQ ID NO: 192635 - protein, 97 aa, Triticum aestivum
  unsure (1)..(97): unsure at all Xaa locations
  Clone ID: PAT_TA_87053.pep
SICMLYXMFNWSVPGDKTYRNRVSFGHVSPTSLAVCKLDYCATNHLEPSTSKFDPLSVGVACTILFDALSYYFLQLMFTTTIVSPTRGMSRSSLWGR

SEQ ID NO: 192636 - protein, 57 aa, Triticum aestivum
  unsure (1)..(57): unsure at all Xaa locations
  Clone ID: PAT_TA_87054.pep
FNPMNQTXQPQEKIXRILILQNSXEKTLNQRSSKYITNLGLYAAPLVSGSKEKRIMK

SEQ ID NO: 192637 - protein, 98 aa, Triticum aestivum
  Clone ID: PAT_TA_87055.pep
YASGSLSPESKPIGGSRHSRRLMASPSPCTQLTFYYTFQLYNLALTPPTLRISTTEHQIEAERNPCMSETVASLLLHHASSHTYYHTSNVRSSIQSFA

SEQ ID NO: 192638 - protein, 80 aa, Triticum aestivum
  Clone ID: PAT_TA_87056.pep
LRGVCVTSQTLREFRPQGTHHMVNTHTHTYIHRSVSSPFRAAPENILQKGLQNKGEDVGYKTQSPLPVSTRRKIKHKPDR

SEQ ID NO: 192639 - protein, 66 aa, Triticum aestivum; identical to SEQ ID NO: 192566
  Clone ID: PAT_TA_87057.pep

SEQ ID NO: 192640 - protein, 87 aa, Triticum aestivum
  Clone ID: PAT_TA_87058.pep
PPSGPRRHLSLHRRSSLDGRPPIAAAPAAAAETRLGVFFVRRVLFLYFSLGLLSCALSRTSVLCCGTWVCVCGLDFVCVLFGGLLYL

SEQ ID NO: 192641 - protein, 96 aa, Triticum aestivum
  unsure (1)..(96): unsure at all Xaa locations
  Clone ID: PAT_TA_87059.pep
KGNGTGGESIYGEKFADEKFVHKHTKPGILSMANAGPNTNGSQFFXCTVPCNWLDGKHVVFGEVVEGMDVVKNIEKVGSRSGTCSKQVVIADCGQL

SEQ ID NO: 192642 - protein, 82 aa, Triticum aestivum
  unsure (1)..(82): unsure at all Xaa locations
  Clone ID: PAT_TA_87060.pep
ARRRTEKAXAAFLVRCNXNSEATLGTXKGXATLXEGASESLHQGLLIDLPSVLRLGVPLSYHSFGFLPDSSAYTFFNYNVFT

SEQ ID NO: 192643 - protein, 59 aa, Triticum aestivum
  unsure (1)..(59): unsure at all Xaa locations
  Clone ID: PAT_TA_87061.pep
MKKKHTEAKELXVRAIVNNNMLLMLNHPMFEEKLSALQKYADSMRSKHLLEEIVTMDTY

SEQ ID NO: 192644 - protein, 68 aa, Triticum aestivum
  Clone ID: PAT_TA_87062.pep
SISLIRWLTVKWSLLTVCCSLRLYCVNSLVPMIYHYFLLNVNAHCLVNTHLISWQCLISHVSNNCPGH

SEQ ID NO: 192645 - protein, 78 aa, Triticum aestivum
  unsure (1)..(78): unsure at all Xaa locations
  Clone ID: PAT_TA_87063.pep
XXIPXXLXNXXQXWXGYAHXHIKXTLXPREXISQXXKHXTXLMHDXGVGATMKLXVSGTLGSVSSTHEXRXHTQFTSL

SEQ ID NO: 192646 - protein, 95 aa, Triticum aestivum
  Clone ID: PAT_TA_87064.pep
YGSIFITLRTHFASMVSPLLLLRSRTKLEQRYIIEDYGSVTRRKACCCYTWIQMSNMMSVAQEESGMVCASTNSFLSPLESCLNQISATKTKQTQ

SEQ ID NO: 192647 - protein, 130 aa, Triticum aestivum
  unsure (1)..(130): unsure at all Xaa locations
  Clone ID: PAT_TA_87065.pep
AARPDLRYPSFSLTKLWRGMAFATFSLPQYGQIPAAGALLGNIPTTLXYSFLRPYSTAHLPTXAASGSSLLVYLNRISGXXYXPSCXSXVLXPFLIXPXMVAILSHXXXGNXASLFWXGVMXSFKLVVTX

SEQ ID NO: 192648 - protein, 163 aa, Triticum aestivum
  Clone ID: PAT_TA_87066.pep
HTTLGRDAILAAERELGIEVDFLKYAKEIAYSHHEKWDGTGYPQGLAGEQIPVSARLMALADVYDALISCRIYKDGMRHEDAVRIIAEGRGTHFDADIVDAFLRIQDQFQDISSRLCRWRARARRTNSGNRLYRLIEKKKNRGGPGTQIRPNMRYRAQLGRWF

SEQ ID NO: 192649 - protein, 72 aa, Triticum aestivum
  unsure (1)..(72): unsure at all Xaa locations
  Clone ID: PAT_TA_87067.pep
PPXTRQVARRXSGFIXVGGLWRCLXGEVEXEEPXPGSFSRXPXXNGRRRXXXRXPAARRGGDRGLTIGXXAS

SEQ ID NO: 192650 - protein, 105 aa, Triticum aestivum
  unsure (1)..(105): unsure at all Xaa locations
  Clone ID: PAT_TA_87068.pep
MASIAGSAVSFAKPVKAINTNSLSFSGARRGNAFLRLQPXVPMRFXVCCSAXQDYSEXKVCEIXRKQLAVPECTXVCXTTKFSDLGRXXXXXXTXEXAMGLEEEF

SEQ ID NO: 192651 - protein, 95 aa, Triticum aestivum
  unsure (1)..(95): unsure at all Xaa locations
  Clone ID: PAT_TA_87069.pep
VGSVAALLLLXSPFXXPFXXXQTQXARXXAAMXEDXGPLXGGISXSXMGQXXDLXVIALARFVXXPXHNNKANALLEVXNVVKXKNXTXVAXXMH

SEQ ID NO: 192652 - protein, 174 aa, Triticum aestivum
  unsure (1)..(174): unsure at all Xaa locations
  Clone ID: PAT_TA_87070.pep
HFXLPXXHXLXDFGKSTKCVPLSQRXNLRYXFTARAHFLRXGNSKQWETERXESPCTVGSYPLSXRRCRXTKLLLKELRTISFPAGMRADPCAPWPETVKEQQRLPRILFSAESSARRAREAPPAGDSRAGPRSSSSLVELGVQLTGRPGQLREVGQVTAQPVRQQHQQHPAVW

SEQ ID NO: 192653 - protein, 92 aa, Triticum aestivum
  unsure (1)..(92): unsure at all Xaa locations
  Clone ID: PAT_TA_87071.pep
ERKMSRVVLWSLLLGKGLVEEVALGDLLGRNVPLLAELXDALGVVRGSINWMTSESCPVGLLFRGSVGAADCHPAAESVLISCAENKGGARY

SEQ ID NO: 192654 - protein, 107 aa, Triticum aestivum
  unsure (1)..(107): unsure at all Xaa locations
  Clone ID: PAT_TA_87072.pep
GHLFYFLKHKLGVPVLYVNYHQFVKNTYDSTMCVCVQNKTECFYCIIVLHQKVILKRVASVAVVQNVEPTLMQPLMSRGRRTHEHSSNVVFAAGATVRSRPIXEAVQ

SEQ ID NO: 192655 - protein, 84 aa, Triticum aestivum
  Clone ID: PAT_TA_87073.pep
PAHVTVLLHIHHTAHSHWPCINDFLLGITSKTTENLAWEMEEHERVCFSPPQIYHKFRTSQLTSTSSTLWTVGIVAVPTLCTWP

SEQ ID NO: 192656 - protein, 78 aa, Triticum aestivum
  unsure (1)..(78): unsure at all Xaa locations
  Clone ID: PAT_TA_87074.pep
XRXVIKXXXPVRNNKIXXGXXRHIXNLXXGPNIIKLLXXVRXEDSKTPSLIXEYXXNTDFXVLYPTLLGLRXHYTXYL

SEQ ID NO: 192657 - protein, 161 aa, Triticum aestivum
  unsure (1)..(161): unsure at all Xaa locations
  Clone ID: PAT_TA_87075.pep
ARSTYRWLCAGGVTSPFAACIWKSWATLKCKIFAWLAVQHRLWTSDRRARHGLQDHPSPCYTCLQCEENVEHILIQCMYAREVWEGCLSALHLNIPRPSTQDNYLQWWLSSRKHYQKAQKRGFDTXQLWVAWNLWKQRNAGPQSGKSSAAKDLITKAKRLS

SEQ ID NO: 192658 - protein, 121 aa, Triticum aestivum
  unsure (1)..(121): unsure at all Xaa locations
  Clone ID: PAT_TA_87076.pep
AITLGEICVAQRADWLAAVLAIGTANPPHCVPQGIGMRFFHXTDELLATHPDLSLDATSAAVNAIAEWGCTAGDITHLVVITNAGXHALGTDVRLVLPSSCPPPRRPAQLMVYFTRYMVYF

SEQ ID NO: 192659 - protein, 67 aa, Triticum aestivum
  unsure (1)..(67): unsure at all Xaa locations
  Clone ID: PAT_TA_87077.pep
NHLLSDSASSXMTXMLXLIXRVXVQPGGQXXHRSHSPVTXXQWHEXARANXXXLXPXCTSLTGXXXL

SEQ ID NO: 192660 - protein, 34 aa, Triticum aestivum
  unsure (1)..(34): unsure at all Xaa locations
  Clone ID: PAT_TA_87078.pep
INXENXSSXIYWIGKSPSYXXXERTXENILSNSS

SEQ ID NO: 192661 - protein, 51 aa, Triticum aestivum
  Clone ID: PAT_TA_87079.pep
PRKCNAGFRVAAMISLVLFSAGSPNVKVSCTACTSSAGVFQAIPQQKGQPW

SEQ ID NO: 192662 - protein, 48 aa, Triticum aestivum
  unsure (1)..(48): unsure at all Xaa locations
  Clone ID: PAT_TA_87080.pep
VCYLRCSGHLNVSPEDFLIHPGISLYLDVPSSSTNLLIYHRTSRHXSI

SEQ ID NO: 192663 - protein, 154 aa, Triticum aestivum
  unsure (1)..(154): unsure at all Xaa locations
  Clone ID: PAT_TA_87081.pep
GRYQENLGLEHWKMVKKXLRYAQGTKDYMLIYRRSDSLEIKMYSDADFAGDIFTLAGGAISWKNSKQSIVASSTMYAEFIACFEATGQAIWLKKFVPDLKVVDCIHKPLKMYCXDTSPQVFLCSQQQSSNAAKTIEIRYYVVKDEIQGSNYNLX

SEQ ID NO: 192664 - protein, 74 aa, Triticum aestivum
  unsure (1)..(74): unsure at all Xaa locations
  Clone ID: PAT_TA_87082.pep
GSTCFYPXXEANXQTGRARHRHNNQRMAKQTSQARKKXHTGXSFPXGRDMXRRVSGKGGVGPXGVRRXAPAMLP

SEQ ID NO: 192665 - protein, 145 aa, Triticum aestivum
  Clone ID: PAT_TA_87083.pep
KRSSSSFKLIKICSMTDGLMSLAAEEYSLKRPVKSYPKRKLLPQFNDEALEPIPSSRSPADRPPRGRDKAATQAEHQPAPPHRKGRDKTARGHTYDLRQDLDNRAGHTRSIYGSRGRAPTCDGYTFGRDKPSHTRAKNRRRTPSE

SEQ ID NO: 192666 - protein, 113 aa, Triticum aestivum
  Clone ID: PAT_TA_87084.pep
SFSDFDSDQSSIESVKSMGAVKREHYQQSVPPEKHVVRAGTARPPSSSDACGRGAVGLLRSVPAHCSRRQLAPSSSPASGFWGEGANLDRVKRTGKRAGRGGSTPRRMMGWLR

SEQ ID NO: 192667 - protein, 151 aa, Triticum aestivum
  unsure (1)..(151): unsure at all Xaa locations
  Clone ID: PAT_TA_87085.pep
YMAPEWVIHREPITXKADVYSFGMVLLEIVSGRRNYGFRQESVGSEDWYFPKWAYEKVYVERRIEDIMDPRILLAVDDDADSVATVERMVKTAMWXASKDRADMRPSHGQGRQRCSEGHCRDXPTPSKPTIFCVQGRLTNKSSLFALLSSV

SEQ ID NO: 192668 - protein, 83 aa, Triticum aestivum
  unsure (1)..(83): unsure at all Xaa locations
  Clone ID: PAT_TA_87086.pep
QAMTLSLXARPXRGRWXALHXAIAPXXLLXSNXGGCGXSVLYNIGXCQXIDMDFSTPKKDGLFISIKLSDPFLNICLSRDFNK

SEQ ID NO: 192669 - protein, 96 aa, Triticum aestivum
  unsure (1)..(96): unsure at all Xaa locations
  Clone ID: PAT_TA_87087.pep
MRSKANGDTAFKASGKNKTATGGVAKPKRAPTPFFAFLAEFRPQYMEKHPXAKGVXAVTNAAGEKWRSMSXXEKAKYGXKKADAPAXKAVNXKEXH

SEQ ID NO: 192670 - protein, 150 aa, Triticum aestivum
  unsure (1)..(150): unsure at all Xaa locations
  Clone ID: PAT_TA_87088.pep
KKRKCRGRWFSGVGSLLQIRLVCVVGSIFLTVLYSLILGNTLLPRCCTSLDTRSPHGGWRRPTGDDSTCVWLVHHHRGKLCSQFIIQHKFPTKRIXSSPCSQFTSGDCXXXGGRHRRGRQARAEVSVPEXGRPPXXRRRRRCXRRRXLSA

SEQ ID NO: 192671 - protein, 67 aa, Triticum aestivum
  Clone ID: PAT_TA_87089.pep
DLSNSMIKQPLVCKPRDTMTRTRKQRSIWCSYQGIIGVNFICNSPGNAATSHLLLVNLCVSDPPHSI

SEQ ID NO: 192672 - protein, 117 aa, Triticum aestivum
  unsure (1)..(117): unsure at all Xaa locations
  Clone ID: PAT_TA_87090.pep
SSLPLLLRPIRXPPPLRRLXWRPRRTLXRPPPPPLLPLPENXDEENFTXHGIGELTQXXYDXEQLNSFXITXXYNEXPDGNSYNXXPGNXYDEGXGDAYNEVQANLLXEXPXTQVXX

SEQ ID NO: 192673 - protein, 136 aa, Triticum aestivum
  unsure (1)..(136): unsure at all Xaa locations
  Clone ID: PAT_TA_87091.pep
MPQDRQDAIDEMDFTSLQNIKCGHLSNGLNVWLAGLDDLESREVVVPGRGRLPVKEEYVHRVMGVPRGGKDIPYNIPTKADIKLGLDMFGEFGIYPXKMTELLDXITSSDNSDTNFKRMLAYACGQYVNXPTHPRR

SEQ ID NO: 192674 - protein, 84 aa, Triticum aestivum
  unsure (1)..(84): unsure at all Xaa locations
  Clone ID: PAT_TA_87092.pep
LLXTCQAVXSCTLNTQKCPHXERVLIQGPINGLILIKILFNSKSIYPLEVLKTVIAYTGRTSKQEEDHVISATSIHFTISCSTS

SEQ ID NO: 192675 - protein, 89 aa, Triticum aestivum
  unsure (1)..(89): unsure at all Xaa locations
  Clone ID: PAT_TA_87093.pep
CVGGFGWNNVXKNAGMLLHCXHXTWXESVVFPSRQRIQVQLIWSSXXTTTXTHVKLGXQWGKRPXRSAXQVARRHSXFCXLCGXSRRLC

SEQ ID NO: 192676 - protein, 77 aa, Triticum aestivum
  unsure (1)..(77): unsure at all Xaa locations
  Clone ID: PAT_TA_87094.pep
DASCQGCSGXQVGXCCXRTXXSCVXWCHKXPIHLHYQLAXVSLHSXDVVLPFSRHCXAIXDXGSLLAPPPXGDXLTG

SEQ ID NO: 192677 - protein, 108 aa, Triticum aestivum
  unsure (1)..(108): unsure at all Xaa locations
  Clone ID: PAT_TA_87095.pep
NVLTXWDRKGYRLCISFTXLAKSTHCQGHKFAFGIYXXNFFHHVSVPSVLLCCWDHLSYSFILIRLSFVMHSCGIQLQARRRASTSHGAAQASQLKSSTQGVMHRGCV

SEQ ID NO: 192678 - protein, 91 aa, Triticum aestivum
  unsure (1)..(91): unsure at all Xaa locations
  Clone ID: PAT_TA_87096.pep
LDCXRYGLXXXWLXVRXRCVSEVFPKLMRSPSHAPSAFGIXIXPXXMLSGVYXEHXXDYIMFXAXRSVIYXXXSWXFXLHDRVPLQGXCTL

SEQ ID NO: 192679 - protein, 133 aa, Triticum aestivum
  unsure (1)..(133): unsure at all Xaa locations
  Clone ID: PAT_TA_87097.pep
ESYSXGXSWRFRXLPLLELDFRSAAPWVWIFEMGRLWKVSHKDVPVVSSFSSAYSLDEPFVPNDFAXDDSYPMSPELSEDDGNFDRALXXFYMNHELRXSFCDLXXFFASLLVRXFNHADXYXXFTLXIISGL

SEQ ID NO: 192680 - protein, 112 aa, Triticum aestivum
  unsure (1)..(112): unsure at all Xaa locations
  Clone ID: PAT_TA_87098.pep
STXLTDMTHXYTSLSLCLAXSPPLFFMNPPXHPCLPPYIKWCFWKTKRGENKKKKRXDEWMDGWVDGRLTGEQGISPLPXFXFHGSIQTCHLVHSSXSSXVVVVVNLFHXFS

SEQ ID NO: 192681 - protein, 131 aa, Triticum aestivum
  unsure (1)..(131): unsure at all Xaa locations
  Clone ID: PAT_TA_87099.pep
MPQEVDAAASASECAQVFLNNCSCTAYSFGNNGCSMWHNKLLNIRAXPCSGTANSNGETLYLRLSAKDVQSLKNNRRGIVIGIVTGTGVFVLGLFALILLIMIQRNKKKNSGQILSDSQVCTGIIAFGYND

SEQ ID NO: 192682 - protein, 78 aa, Triticum aestivum
  unsure (1)..(78): unsure at all Xaa locations
  Clone ID: PAT_TA_87100.pep
INLNSTLISKKIHRINSSCIYXRFTPSTRTMMARAARHTIAAAAAAHIVVFIIFFFFCCRLCFPRQTRAARGGRRDGT

SEQ ID NO: 192683 - protein, 131 aa, Triticum aestivum
  unsure (1)..(131): unsure at all Xaa locations
  Clone ID: PAT_TA_87101.pep
AQXSIQXLRGSXAXYXXXAQXQXXXRVXSSTXRAGLSXXRXDMXVTXFTLFTRSPHLPSMPIAXLXHHRSRHGLPCSCSLSLKSXHDHTRSIATSDMXSICXDARVSRAACWGANEXTCREGCCSGRRXGG

SEQ ID NO: 192684 - protein, 89 aa, Triticum aestivum
  unsure (1)..(89): unsure at all Xaa locations
  Clone ID: PAT_TA_87102.pep
QELSGLFQYLAAVFATDLHSSXFLRLPKTLGVDFRASCFCHXKTIDMGYVCSXVCLSIFCKYHXKCSTCGSEFSRVSMPDLNSLPDQRQ

SEQ ID NO: 192685 - protein, 105 aa, Triticum aestivum
  unsure (1)..(105): unsure at all Xaa locations
  Clone ID: PAT_TA_87103.pep
YMNRWAHAQKSKTYXTSRLAINTRLHRSHHAHNRLKADRHKPMTTSCIGKVDASPGRPAHQRPEEETTKTSSNLGNNISTHVEDDQLHRQDRQDTRRIQGNGKTT

SEQ ID NO: 192686 - protein, 102 aa, Triticum aestivum
  Clone ID: PAT_TA_87104.pep
SSYDGTEVAIIADYPGLLPASDVSDQETPSSKELPHYGSPTALFRAPKGRCPTPQRAPEASPKRAAPTPSKSSKRKANDNTEEPSSKRYGFLIMPPGSRIKL

SEQ ID NO: 192687 - protein, 149 aa, Triticum aestivum
  unsure (1)..(149): unsure at all Xaa locations
  Clone ID: PAT_TA_87105.pep
MAGRKGGDRKKAVTRSVKAGLQFPVGRIGRYLKKGRYAQRVGSGAPVYLAAVLEYLAAEMLELAGNAAKDNKKTRIIPRHLLLAVRNDQELGRLLAGVTIAHGGXIPNINSVLLPKXSPAAADKEXKSPKKKTPPKXPRRSRRQGVAAP

SEQ ID NO: 192688 - protein, 144 aa, Triticum aestivum
  Clone ID: PAT_TA_87106.pep
IESADSLDEPDLPQVLRDDDQVFLLTDEDIQLVNAAFPNEARQFQEAQRLKEAKSRSRKSKLSQAESMLETPKGPRPSGVQLSIKEFYRSKKAAGDEAGKKPVIEGETSTSRAGRNHHRWTWTKRMPNPCDDLALRLRQPAGLS

SEQ ID NO: 192689 - protein, 127 aa, Triticum aestivum
  Clone ID: PAT_TA_87107.pep
ANWQSLQMRADNLIRGDNPRLECGINKEMREMLPVVIFKESFLIRETQCSVCLADYQADERLQRIPPCGHTFHIDCIDHWFSKNTTCPLCRVSLLTAPKSCKRRSNRSGKHKPKEDCSSNAQHHVGP

SEQ ID NO: 192690 - protein, 183 aa, Triticum aestivum
  unsure (1)..(183): unsure at all Xaa locations
  Clone ID: PAT_TA_87108.pep
MAVGKNKRISKGRKGSKKKAVDPFTKKQWYDIKAPLLFTSRNVGKTLVSRTQGTKIASEGLKHRVFEVSLADLQNDEDQAYRKFRLRAEDVQGMNVLTNFWGHGTSPLDKLRSLGEGSGKTLXEAHVGCXKTTDNYMLRMFAXGFTKETPNXVKRXCYXQASQXRQIXQDGEXMXNKLKLYLR

SEQ ID NO: 192691 - protein, 74 aa, Triticum aestivum
  Clone ID: PAT_TA_87109.pep
FFFSHLSATLSNSCTSFLHATTTNNNVTILDSLYIIRWIGLESSTLSINYLLVYCTTGVLVVAMLLFTEKIKEK

SEQ ID NO: 192692 - protein, 63 aa, Triticum aestivum
  Clone ID: PAT_TA_87110.pep
IYKLIQKSNKQKKITILNIQSTPHGPYVEASDQSCICEQVQRINCHLIRSNSYLSSLQGFALF

SEQ ID NO: 192693 - protein, 42 aa, Triticum aestivum
  Clone ID: PAT_TA_87111.pep
SPQLVAGGRHSSSSSSKRFRSKSKMGIQGDSASLSLIKLELR

SEQ ID NO: 192694 - protein, 188 aa, Triticum aestivum
  unsure (1)..(188): unsure at all Xaa locations
  Clone ID: PAT_TA_87112.pep
LELPVFWTPLRQYRMVSAFPNKLCLDNNNFTGVIPPEIGQLKMLDILNLSSNSLTGGIPQEICNLTNLQTLDLSNNQLTGAIPSALNGLHFLSKFDVSNNKLEGKVPSGXQFDSFSNSSYXGNPKLCGPMINNDCNSTSSQRPQDVEQRRTLLPLDKCVPRGCNPFLLGLCWQKTNSVNKTRYNMHKS

SEQ ID NO: 192695 - protein, 97 aa, Triticum aestivum
  unsure (1)..(97): unsure at all Xaa locations
  Clone ID: PAT_TA_87113.pep
CHALVPAXLLVLVVSLTAIXGVHGICGMSXDEFKLCQPAAAVAXPIDSPXDXCCAALGXANLSXICRYGIAILPDDPHIRRGAGGSAGSLCPCSLGH

SEQ ID NO: 192696 - protein, 194 aa, Triticum aestivum
  unsure (1)..(194): unsure at all Xaa locations
  Clone ID: PAT_TA_87114.pep
ELPAEVIITVYDWDNVCKRKVIGSVTVAILAEDETGAVWYDLDSRSGQICLRISSKKVSSTSDSFFKQYTGAKSQRKIILARQRLAMTEDSSPLHATIEFPHDEIVHHSYSCAPERSFLRYGRMCISSWHLWLXSHXFSKQLNVIIPLXDIXXXXEEQXSLIXQAITKFLHTGASGQGVSQLCCQNSLGVFKKP

SEQ ID NO: 192697 - protein, 177 aa, Triticum aestivum
  unsure (1)..(177): unsure at all Xaa locations
  Clone ID: PAT_TA_87115.pep
RVILLDPPELVXQRDKALELGGVXIQHRRRGIXPYANPTXVIPKRLEPRHGSIVQDTSPADENPLAWLSCSCVLSPKHPLPDKITAAKHKTLAPTLAKIKALLGNGLNGIDLVWVWLAWRIIPLSHRPGLMCTYMGKKDDPLWHSSDDLPDHVIDDMTKSLLNESLADCGKVGLSPF

SEQ ID NO: 192698 - protein, 100 aa, Triticum aestivum
  Clone ID: PAT_TA_87116.pep
EHSHPGQSMPHHRAHARPHVHLIITKQEKRKEKKIHPPIDSYTTPRTRSNPQKRTMHVKRDLGRPIHEELLASLGPERALLRHGREPLAVVAVVVYHEVP

SEQ ID NO: 192699 - protein, 165 aa, Triticum aestivum
  unsure (1)..(165): unsure at all Xaa locations
  Clone ID: PAT_TA_87117.pep
ELESSDRSMHRGRAIRPSKVGSPTSISAEEGEEQQQQIIPTRKKKGLHLPASIAHLRIQTASADGTPTTIARDLXXIRGSPTPLASXRKQKPRXTVNGTREKLIXTRHHRNXLXQASLSNPNPTTHPPSGXXPEVPLPXGXXAAXXRGRKPTXSRXARXGPXSPP

SEQ ID NO: 192700 - protein, 144 aa, Triticum aestivum
  unsure (1)..(144): unsure at all Xaa locations
  Clone ID: PAT_TA_87118.pep
CHLXXCXIVXQLXPPGTPQRNGVSXTCNXTLLDMVRSMMSXTDLPLSFWGYXRXDGXCTLNRAPSKSVETTPXELWFGXKPXLSXFLKVWDCDAYVKKXQXDKXEPXSEKCVFIGYPKETIGYTFYHRSEGKTFVAKFGNFXEK

SEQ ID NO: 192701 - protein, 141 aa, Triticum aestivum
  unsure (1)..(141): unsure at all Xaa locations
  Clone ID: PAT_TA_87119.pep
SGTWRKPRAATPNGQDDGGHQVQGPRGRLAGSTXHRTIGTCWTPDAWENSPARQVPTSERYIGRTSDADRTDRTLPAPGQPSHSGRPLPPVSMKTSEIRRPPDDRRTGCPTSTRNPIDAHQSQNVGNPTLLPNPRKTPDDR

SEQ ID NO: 192702 - protein, 111 aa, Triticum aestivum
  Clone ID: PAT_TA_87120.pep
IEVMLYDQPADMVQNDKLMSSIGECVNLEYLIIYGDYTPSNELPVSPYFRSLERLKVAGRFMKVPRWLAELTMLRKLDIRVCQLDQDDLKILGSPAILGALSALGTGFALF

SEQ ID NO: 192703 - protein, 152 aa, Triticum aestivum
  unsure (1)..(152): unsure at all Xaa locations
  Clone ID: PAT_TA_87121.pep
QFLPAPDAKIWKLIEVFQSRGFDRTDLAALSGAHTIGKTSCPNLASRTGDAAWFVEAIKMNCPGSWDKKQVLDVDTPDDFDHKYYKNIVDGKGVLKHRHGAPQRPLHQRFGPQVGYRQELFPLXIRRTMAKMARLPVGGPSEYRENASSATL

SEQ ID NO: 192704 - protein, 86 aa, Triticum aestivum
  unsure (1)..(86): unsure at all Xaa locations
  Clone ID: PAT_TA_87122.pep
QGNPCRASLGMHAFMTHGCVYMSCIQISHDGDQANKRWENACMHAWGPCKLYVVISTVDLXSNSSGDSYLVLTPLQSVPNFKKRGG

SEQ ID NO: 192705 - protein, 55 aa, Triticum aestivum
  Clone ID: PAT_TA_87123.pep
VCLGSSFITGTWNSNRSPLQLATVVFILALNIVYLMFHQITEKCSSIILKLRGSS

SEQ ID NO: 192706 - protein, 46 aa, Triticum aestivum
  Clone ID: PAT_TA_87124.pep
FHPLPLKRKRKSLNIHLNHKQQIPLQIKSRSKPIRESGVEGRCIHF

SEQ ID NO: 192707 - protein, 54 aa, Triticum aestivum
  unsure (1)..(54): unsure at all Xaa locations
  Clone ID: PAT_TA_87125.pep
CXQVVNTILVMHVKPCTMLGCLGWCLGKINRVFLEASVPISTGETPSYASTLYK

SEQ ID NO: 192708 - protein, 168 aa, Triticum aestivum
  unsure (1)..(168): unsure at all Xaa locations
  Clone ID: PAT_TA_87126.pep
LGVTGSPKFSADWDPNPGRDLEDAEGGEEWQTQLVPSTLRQLMTDDIAGFLAAPVCKFLSSSLTMLQLWGDWCEGMECFTKEQEDALQLLSSLQVLXFVFSRDLQQLPARLHNLTSLKILLVHPCPSISLLPIDGXPGSLQELNVEYCGNNELKQHCKGLGTSLEITL

SEQ ID NO: 192709 - protein, 57 aa, Triticum aestivum
  Clone ID: PAT_TA_87127.pep
DLFLFLCDSILSWTFIVSVLSFSCTYDIILLVLTCNLIQRKAFNILVPNFRLNFFEL

SEQ ID NO: 192710 - protein, 114 aa, Triticum aestivum
  unsure (1)..(114): unsure at all Xaa locations
  Clone ID: PAT_TA_87128.pep
RHFCPANFFLTSSLNDVFCLPLSAQAHQEVAQLQAVAADSYINTATGDAWSYSWGNKYTSAKFYHFCFRRWWCMXSYKWIWKSSCRMKLKMVTWLLLSDRHNTRNMLRRRYFVV

SEQ ID NO: 192711 - protein, 170 aa, Triticum aestivum
  unsure (1)..(170): unsure at all Xaa locations
  Clone ID: PAT_TA_87129.pep
DTFYYYVPLVGLSLGAKRLGVPAASLAIKPDGSGGTIVDSGSTIAYLAGTAFEAVKRAVLEAVRLPVFNGTVEGYELCFALPSGAAMAAVKTPPLXVLHFDGGAAMALPRDNYFQGAEGRADVSRGGPVAGRTSGASISVIGNVQQQNITCSLXCAQPKFSFAPTKCNDI

SEQ ID NO: 192712 - protein, 65 aa, Triticum aestivum
  unsure (1)..(65): unsure at all Xaa locations
  Clone ID: PAT_TA_87130.pep
FFFWHKIFVAEDKTLVYQITEEKKEDETNESAWSEANTTEFQVHVYKHNPAGNSHHXISPRLAIN

SEQ ID NO: 192713 - protein, 148 aa, Triticum aestivum
  unsure (1)..(148): unsure at all Xaa locations
  Clone ID: PAT_TA_87131.pep
SLARISAGDDTQVQVIVEQGILPCLAQLLARNYPKIIKKQACLIVSNITAGSKDQIQXIDADVMNHVIVLLKTSETDLKKEAAWXAISNAASGGSSDQIQYLVSRGCLGPLXCNVLKYQDVVLCIHVREGSKNILXEGDIGKQRNEPR

SEQ ID NO: 192714 - protein, 111 aa, Triticum aestivum
  unsure (1)..(111): unsure at all Xaa locations
  Clone ID: PAT_TA_87132.pep
MSSSEVACTLAALILHDDGIPITSEKIATVVKAAGIKVEAYWPALFAKLXEKRSVDDLIFSVGSGWRWVLQAAAAAAPAAGXAAAAEEKKEEKKEEXKEESDDDMGFNLFD

SEQ ID NO: 192715 - protein, 75 aa, Triticum aestivum
  Clone ID: PAT_TA_87133.pep
YLINQLNSTYLNKHKSELTINRLQALIKSEPYKYYTSPITENSEREISSSKIEEREAAGTWREGAAAVLGREEEE

SEQ ID NO: 192716 - protein, 65 aa, Triticum aestivum
  Clone ID: PAT_TA_87134.pep
SPFNFFIHKLKNKMQHFALHAHMLQTAWYDLSRTVIHTTRSKESRAASGGSSGVGSRAAATTSEG

SEQ ID NO: 192717 - protein, 105 aa, Triticum aestivum
  unsure (1)..(105): unsure at all Xaa locations
  Clone ID: PAT_TA_87135.pep
ATAGDAGIASPVNAGDRSTKDKGGDPADAADSSRPFVCKKLLHGDFKGAIILQFLCTIHGGGDVHLLSSTSGYRCIHSSRILAGEPSLIEKLVSLSMAQAEYSIX

SEQ ID NO: 192718 - protein, 103 aa, Triticum aestivum
  Clone ID: PAT_TA_87136.pep
KFEFSVCEQEKLKKNFEAEKKIWAHEKASLVTRAETAEALLAEATTELSGLKRQISQMVSTIFGPTSTNLKQNMLIKLKAVYTLVEELYSGSQRALAIVALSR

SEQ ID NO: 192719 - protein, 153 aa, Triticum aestivum
  unsure (1)..(153): unsure at all Xaa locations
  Clone ID: PAT_TA_87137.pep
RVDVSKRTDADDDGGGSDDGSDGSDMHSIELNMDGRSKDGGWSYSTGTASKEMMTATAKKAASADSRGTEYADPWAGDQRSLEESEGGXRWDDDEGAATXTRRTXRGTKAIKNSXGANARRPRAGFQFPAREHTKEIIRLKRKHDEIGLAXER

SEQ ID NO: 192720 - protein, 154 aa, Triticum aestivum
  unsure (1)..(154): unsure at all Xaa locations
  Clone ID: PAT_TA_87138.pep
MHQQAMWKPAWLEALSTEKFFVACSFHEHAKKNEKNICCLDCCTSICPHCVSTHRVHRLLQVRRYVYHDVXVRLEDLEKLIDCSGVQSYTINSSKXVFLKKRPQEXQFKGSGNICTSCDXSLQEPYFYCSLXCKVEYILREXKDCHTSSRLELV

SEQ ID NO: 192721 - protein, 83 aa, Triticum aestivum
  unsure (1)..(83): unsure at all Xaa locations
  Clone ID: PAT_TA_87139.pep
QQXFXFPTRYAPTXFTSANVFXXXVXNQCGSYLFLVLYIXHQHTKXILAXYSISFFQXYRXTKIHXQXMGXINTQXCGVXXCQ

SEQ ID NO: 192722 - protein, 85 aa, Triticum aestivum
  unsure (1)..(85): unsure at all Xaa locations
  Clone ID: PAT_TA_87140.pep
KIESIXKFYGANGVEYSEQAXKXIHMYTXQGFSXLPICMAKTHYSFSHVPSXSGXPSDFVLXITDVXXSIXTXFIXPLVXTMSXX

SEQ ID NO: 192723 - protein, 50 aa, Triticum aestivum
  unsure (1)..(50): unsure at all Xaa locations
  Clone ID: PAT_TA_87141.pep
LLSXTXXEITSXAQILQRXKAHEXXVNXHXMVTXPRFXCEYRRXLXLXLT

SEQ ID NO: 192724 - protein, 71 aa, Triticum aestivum
  unsure (1)..(71): unsure at all Xaa locations
  Clone ID: PAT_TA_87142.pep
PAPARRPTSXGTXSTSPEDAYXQXXRXLAQRLPSAXQASPTXQSLXLGRSXSLCIVXXGSIINQXHVEGXY

SEQ ID NO: 192725 - protein, 51 aa, Triticum aestivum
  unsure (1)..(51): unsure at all Xaa locations
  Clone ID: PAT_TA_87143.pep
XSVIIGLSLGVSQXPIXHXXLGGXRASXFHYXRXXXFALGGXISXCSXSLF

SEQ ID NO: 192726 - protein, 148 aa, Triticum aestivum
  unsure (1)..(148): unsure at all Xaa locations
  Clone ID: PAT_TA_87144.pep
QYKQVSSFPPSLILSHNKLIGAILPGFGSLKNLYVLDLSNNNISGIIPDELSGMSSLESLDLSHNNLTGSIPYSLTKLNFLSSFSVAYNNLMGTVPLRGQXSTFTGSDYEGNPTFGGHPLWAYPHVKSNHAPIISANGKEEQGSHIKE

SEQ ID NO: 192727 - protein, 121 aa, Triticum aestivum
  unsure (1)..(121): unsure at all Xaa locations
  Clone ID: PAT_TA_87145.pep
IDAAFESTVTGEAYLFKGSNYALINYYKKELIAITPIAVGFQCLRDSEFEGDIGAAFASHICKEAYLFKGNRYILLHFTPGENKDYIVDGPKDIVXGNWPSLDGVLPCRNIGLDVIGVSPW

SEQ ID NO: 192728 - protein, 144 aa, Triticum aestivum
  unsure (1)..(144): unsure at all Xaa locations
  Clone ID: PAT_TA_87146.pep
VKXXRAPXPFWXGRVIRLAAGYLHGLAKHSDXFFSFEFFLVMLSXTIYKRKAGRERKXVASWXPFLVQNSLGRQDRKPTFPGSFSRSKPSNSAKNAELTERQECHEAPRPASSSDDLVRHRHEPRPFLFLHGGLVGAQRGGRQR

SEQ ID NO: 192729 - protein, 75 aa, Triticum aestivum
  unsure (1)..(75): unsure at all Xaa locations
  Clone ID: PAT_TA_87147.pep
SIPGTAPXVXXHFRLTLLXVFFVWXFAEDLVYCSXCDLXYCRVYILTGILLSXSSNMVTSFNCSSSSLQVLTVGK

SEQ ID NO: 192730 - protein, 73 aa, Triticum aestivum
  Clone ID: PAT_TA_87148.pep
LASVRRRSSSSSSSFLGPSRAERWRSLLCFLSGERGRVFVYMLVLLSPLFLFYFINGLVMIGIINYTFLQKKK

SEQ ID NO: 192731 - protein, 102 aa, Triticum aestivum
  Clone ID: PAT_TA_87149.pep
KRAQLTTDKWLFCERRHAIGAMLVDIVVDLFGDVGVFLTPNHAAAVFAWKSPGVPHAELGARHLTRHAPRLLRCRLSQDGGGYSCFPKFGRGPRWPLVDASG

SEQ ID NO: 192732 - protein, 53 aa, Triticum aestivum
  Clone ID: PAT_TA_87150.pep
AGGGMPFGVDPSGGSTGAGLQFFNLPMGMPPMPVDGHNGWPGAAGGVERPPFS

SEQ ID NO: 192733 - protein, 156 aa, Triticum aestivum
  unsure (1)..(156): unsure at all Xaa locations
  Clone ID: PAT_TA_87151.pep
MAAQGGAPPKAATGPGLYSEIGKKARDLLYKDFTTDQEXTLTTYAANGTAITATSTTKKEXILNEIQTXFKYNNVKVDVKAIQDSQVLITTTSDFGTYQGLEENCDIPLDKQXPAKAELQYFXDYXGSVWVWPTLKTLIKFXSGWNKALAPGAELL

SEQ ID NO: 192734 - protein, 68 aa, Triticum aestivum
  Clone ID: PAT_TA_87152.pep
SFKVLLTFRRPKPLLYTYVRCDVCELSFVCCFSDSHNKNLSLQNHCLHCVYPSLSLLSHPKTHGPNRG

SEQ ID NO: 192735 - protein, 74 aa, Triticum aestivum
  Clone ID: PAT_TA_87153.pep
QLEEVLLLLVEVIINVHKCTIARLPAQIGPSVPNREPWESYALPHWFIMLNDSNCNFRWVCLLIILLLASACKC

SEQ ID NO: 192736 - protein, 134 aa, Triticum aestivum
  unsure (1)..(134): unsure at all Xaa locations
  Clone ID: PAT_TA_87154.pep
MKMCMKGVVLGLGSKHIDHIMGFRRGSPTRQRIQQGSKTTTIKNNYSRLGLIISPGHMEFDTRSCRHQHAKKESQESFPPRILLHHRWRTPLSRNPPCHLLACRLSTPFICASPRRSKKMQNEVTNVDISXSIT

SEQ ID NO: 192737 - protein, 180 aa, Triticum aestivum
  unsure (1)..(180): unsure at all Xaa locations
  Clone ID: PAT_TA_87155.pep
SAFRSTYWNEVYIFIKEKYVLVNYAPGSTNDRILNGPHYIGDSFPFLVGTAFAEYGIDASFGSHSSVEAIIFSXNLCARINFRTKDTGGYIGRGDHNHQDRCSLSLXGTVFXEGDXDAAFGIHRGLVKAYLFQRSKYAPYQTTNKXNQRYNPQYNWGFKCLRXSXFEGRYGAAFASHICG

SEQ ID NO: 192738 - protein, 74 aa, Triticum aestivum
  unsure (1)..(74): unsure at all Xaa locations
  Clone ID: PAT_TA_87156.pep
TLVLQLPDLACTAPINRXTFXNESAPKERLTQFQSPIPIIXISRKNSQXVQYRSWAHMSLQRGICXGHMDMITX

SEQ ID NO: 192739 - protein, 92 aa, Triticum aestivum
  unsure (1)..(92): unsure at all Xaa locations
  Clone ID: PAT_TA_87157.pep
LSNFHEYVLFTIKLCAKCICYIMHDSLFYQSISMCLFCHPVAMHGDLRFDSVLCSTTNREMWTLGYPFLRCQSWVLXLYNTGQXLPATNHVI

SEQ ID NO: 192740 - protein, 111 aa, Triticum aestivum
  Clone ID: PAT_TA_87158.pep
LVVYGVHFLGGNYTTQQELRNRFGEDISSAKLDYLYQDRGERKMFWISWCLALRFIPGIPFWSFFSRIYTFFSFVKLFLSGLIGFVSCALINWVGAIYCERVSFLHWKKKK

SEQ ID NO: 192741 - protein, 112 aa, Triticum aestivum
  unsure (1)..(112): unsure at all Xaa locations
  Clone ID: PAT_TA_87159.pep
QIIVPQNRPDTSVTYKXFSHTETALIASTYYSSKKKNSLATQGRQKFRQQRASHPTGENFQQATRRAAHPYASCQTTQRGPPLPSPAFLPPPPAFPALLLPAAAFAAGALLP

SEQ ID NO: 192742 - protein, 148 aa, Triticum aestivum
  Clone ID: PAT_TA_87160.pep
SGCLCLNPTHLALNTTFGETILGFLPSGRWRRGHSRWILGPCSRVRWGGTCSYISVEAPWSSRVGFTVDVDTLQCERVCASLPKPSHIYCNFPPSLLAAPTVSNGNLLLNARNCSLHITITQLQSNDHNIYLLLNKMFVMQNNTYSFP

SEQ ID NO: 192743 - protein, 68 aa, Triticum aestivum
  Clone ID: PAT_TA_87161.pep
ITGDARAVKKALFAVSTIIYKCPSKETISLETSVPPSIVHPSELPVYPASNFYSVSDAAIPYGMDIQI

SEQ ID NO: 192744 - protein, 78 aa, Triticum aestivum; identical to SEQ ID NO: 106977
  Clone ID: PAT_TA_87162.pep

SEQ ID NO: 192745 - protein, 129 aa, Triticum aestivum
  unsure (1)..(129): unsure at all Xaa locations
  Clone ID: PAT_TA_87163.pep
WKMGSSSFWGVFVCXLLVRCGMLAKHLTDHPHMERXILPNQPFCCSSDCVSPDRTTXXDACAPQPNHDLPASEAELVEFSFSXEVALAAASGLSKRADTPQAQIAAXDGFWLRVSSNNTAXGVDIDEQG

SEQ ID NO: 192746 - protein, 83 aa, Triticum aestivum
  Clone ID: PAT_TA_87164.pep
QLHHHRGVEVEDDGPGSTRAALAGHHVSRSSSIRLRHPVILQLQRRDSVAPPSTSRTPPSLKHRSYVVRNNVLLVDARRGGPV

SEQ ID NO: 192747 - protein, 191 aa, Triticum aestivum
  unsure (1)..(191): unsure at all Xaa locations
  Clone ID: PAT_TA_87165.pep
XFLXPSXFGXGSRXSCESQLXEGAVGVRCAIVSRLIVSLPKRXFHKSSDYGSGSGSISPSPVVPSGRLRPHFDRSPPIQHASWINKGLDWGSVDEVQTLQSRVRSLLEKDIDLINVIQVMLVRRTLPCQRRPLRMWEFNPEGSRTLQHFFGTTHKGMWKLFFGTRKQWPDTTEDISLDYNHPDTAVRTRPP

SEQ ID NO: 192748 - protein, 63 aa, Triticum aestivum
  unsure (1)..(63): unsure at all Xaa locations
  Clone ID: PAT_TA_87166.pep
PPLXFFXFYSSCXSLLILSHLFLNFLIFHFADFIHLTKACIDGVLLIPFSISFVSLNYACIVG

SEQ ID NO: 192749 - protein, 76 aa, Triticum aestivum
  Clone ID: PAT_TA_87167.pep
KRTAAQDSYSYGSHVMQYGSLDLNAQQLFLYIGSNPANNNTTFVEDNSLPSFSRAVNQRDADLVYFWHKVRFIIIS

SEQ ID NO: 192750 - protein, 77 aa, Triticum aestivum
  Clone ID: PAT_TA_87168.pep
TQEPLGTSAFPSQHVKENGQKSLLGLPFVMEERYHKFHFVWLACRVYLTLSGLRLDDGVLKGNGIPNSPIINRVDRS

SEQ ID NO: 192751 - protein, 201 aa, Triticum aestivum
  unsure (1)..(201): unsure at all Xaa locations
  Clone ID: PAT_TA_87169.pep
QFTCPSWFSDGAKRLIPRILDPNPSTRITIPQLLKDPWFKKGYKPPVFDEKHQTSLDDVDAAFGDSEEKQVEEEMEGQPASMNAFXELISLNKGLNLRNFLKLDKKYRRETRXTSQCPPGRNINXRIEEAANHLALDIQKKNYKMRMKNXRTGRKGXNVATEVSKVAPSLFGVXLKKXKGDTLGIQKFXXTLAQIKDVVWF

SEQ ID NO: 192752 - protein, 82 aa, Triticum aestivum
  Clone ID: PAT_TA_87170.pep
DSHASSMMFSMLEVLSVLLCWSFSPLLLGIPPLPLLTITNKLEFAQFGDHLQKLWQFWFYCFPLLSSLQNEGLLVLLIWGMR

SEQ ID NO: 192753 - protein, 148 aa, Triticum aestivum
  Clone ID: PAT_TA_87171.pep
MEEEALRAAMEDAFLEGAVQWRADTILQTLRMDKLDAWIRGEGLSDDIEALKSEIDEVKATVSDVKGRAIGNRRLARSLAALKQKLFDADDAIDELDYYRLLHQVEGGQHLLPSSSNTHNCFASDDSLNVPNCNDYPVTCSLKHEVHN

SEQ ID NO: 192754 - protein, 143 aa, Triticum aestivum
  unsure (1)..(143): unsure at all Xaa locations
  Clone ID: PAT_TA_87172.pep
MSDTDEHHFESKADSGASKTYPQQAGAIRKGGHIVIKARPCKVVEVSTSKTGKHGHAKCHFVAIDIFXGKKLEDIVPSSHNCDVPHVXTAKDYQLIDITDDGYSAFXTENGXNTKDDXELPTDDFCLAXKDXGFAEGKDLICL

SEQ ID NO: 192755 - protein, 178 aa, Triticum aestivum
  unsure (1)..(178): unsure at all Xaa locations
  Clone ID: PAT_TA_87173.pep
RDDHGRAGPHRLGCYAARLQSRSCLGCCGCAKPAPITAVDEPSKGLRIQGRSIRKTNLSEGFWSTSAHGIGNSALQSQRSMSSICTAPQSSDQHGAGSSSNPNEFVNQGLVQWNQTXRQQWVGNKKCKSRLEKXQEPKISWDTTYEXLLXSNKLIYQTNPXAGNVDXXVDVWEQEGLY

SEQ ID NO: 192756 - protein, 161 aa, Triticum aestivum
  unsure (1)..(161): unsure at all Xaa locations
  Clone ID: PAT_TA_87174.pep
PPATTESGDVDSPPAITDSGDVNAPRAITESGDVDAPPVITESGDTEMVAPPGTAGPDEDMEVAASPSITEPDKNMEDVSPPAVAVPVDGPADDATGLIIEHIDGSQEVLQANEDQGDTVEVVPPAFNRTSGQVKDDPPSVATPNSGRXDSMHAAXEKRYG

SEQ ID NO: 192757 - protein, 98 aa, Triticum aestivum
  unsure (1)..(98): unsure at all Xaa locations
  Clone ID: PAT_TA_87175.pep
RRLPPPPPVRLASTVVVKHNPKLAKVNLMNAAQAEDSXDVIMGNLPVNDIPARXLFDTGASHCFMSRPFASKHDFVTQVLSKPLAIVSPARQMTSPRG

SEQ ID NO: 192758 - protein, 52 aa, Triticum aestivum
  Clone ID: PAT_TA_87176.pep
YCVKQAWPTHSLGVAVVRTVDGGLPLWRYYFATYSNDMYLPTIMYNKSWHYM

SEQ ID NO: 192759 - protein, 141 aa, Triticum aestivum
  unsure (1)..(141): unsure at all Xaa locations
  Clone ID: PAT_TA_87177.pep
RXNDNPMIXVLLACICMAXXDRSLFEAERKAAXDDTRTKKNNRHVEYQIIRIDGTHACPPAGHGLTXTGMHARPSPGYXVLGQRRPLHAFVEADPVALGGLQVAVAEAEPDAGHAPGLAGNAEAAGPLDADGAVVGDADGR

SEQ ID NO: 192760 - protein, 148 aa, Triticum aestivum
  unsure (1)..(148): unsure at all Xaa locations
  Clone ID: PAT_TA_87178.pep
QKESTLHLVLRLRGGMQIFVKTLTGKTITLEVESSDTIDNVKAKIXDKEGIPLDXQRLIFAGKQLEDGRTLADYNIXKESTLHLVLXLRGGMHIFVNTLTGKTITLXVXSSXTIYNXKGXXXDKEGXPPDXQRLIXPVSTLGGRTLAG

SEQ ID NO: 192761 - protein, 118 aa, Triticum aestivum
  unsure (1)..(118): unsure at all Xaa locations
  Clone ID: PAT_TA_87179.pep
SDGKRXREGDGLVLRGGDERGRGADTVEALKERRAWLCRWNHHELSRASKHRLSKNEIRFSRPSPGDTSSIIRGRVKVLSYGIXVKRXSXVDTPEFXLPSVRXRVSXGXVIPIXPLLH

SEQ ID NO: 192762 - protein, 82 aa, Triticum aestivum
  Clone ID: PAT_TA_87180.pep
AVLQHPLCTESAMKQIEENNTLTFIVDLKSNKRQIAAAVQELYDIKVVRVNTLIRPDGIKKAYVRLSPDHEALEVANTIGII

SEQ ID NO: 192763 - protein, 73 aa, Triticum aestivum
  Clone ID: PAT_TA_87181.pep
LNLQSNKGLLHSDQALYNATATSGDTEVIVNSFASAQAVFFKAFASAMVKMSNLGPSPGSPQGQIRKECSIPN

SEQ ID NO: 192764 - protein, 62 aa, Triticum aestivum
  unsure (1)..(62): unsure at all Xaa locations
  Clone ID: PAT_TA_87182.pep
XGAKDVAHPVXEERAPRERQAKGPRRLRRAAAGGGAATGVSRDPNHHCRRCIVLRLPTYIGF

SEQ ID NO: 192765 - protein, 87 aa, Triticum aestivum
  unsure (1)..(87): unsure at all Xaa locations
  Clone ID: PAT_TA_87183.pep
XLNNNSCRGXXPLTGREHHWLIIGYQHMSTKLRSARSRMEGTLATCRQTTRIHRSIALIQYDSEDHPHHLKEFKATTEVAPNPEVVK

SEQ ID NO: 192766 - protein, 73 aa, Triticum aestivum
  unsure (1)..(73): unsure at all Xaa locations
  Clone ID: PAT_TA_87184.pep
CTLXVVVTEATADEEAKIXKLRVMNYXKLTRXXXQLMPXRLXXVTPKWARKRKEXEXAGASXVXXISVCTVSF

SEQ ID NO: 192767 - protein, 80 aa, Triticum aestivum
  unsure (1)..(80): unsure at all Xaa locations
  Clone ID: PAT_TA_87185.pep
LRWXRCXRLPLKACSREXPPWPRWTRWRASGQVPSMHDXASADTLPPPXLLYDLLSXILMHALXVCXLRWKYLRESXFVQ

SEQ ID NO: 192768 - protein, 51 aa, Triticum aestivum
  unsure (1)..(51): unsure at all Xaa locations
  Clone ID: PAT_TA_87186.pep
DEFIHASMDEHKTCFXXTIXXMFGMXKVVAXRSAAXKEAEVESALPLQTSV

SEQ ID NO: 192769 - protein, 101 aa, Triticum aestivum
  unsure (1)..(101): unsure at all Xaa locations
  Clone ID: PAT_TA_87187.pep
XGRPPXRRRXXRASXTSCSSSXAPTSSSPPPTTDQXAQRSQPACLXASPPPACPSVRVIYXRSSPSLPSXXXXLXLLPXXDXFVVXSXXCKTVXDTVNLLP

SEQ ID NO: 192770 - protein, 164 aa, Triticum aestivum
  unsure (1)..(164): unsure at all Xaa locations
  Clone ID: PAT_TA_87188.pep
AAKPKAVKADKPKKRKDPNAPKGALTAYILFSNAKRDMVKKENPDIAFGAVAKKISELWKDVTSSEKAKFAKMAEDDKKRYEKEMADYKARXGGAGDEKPAXEGXEPAKAASESDGXDEDDDXEXDTKTHHPPSKLISPSTSSVISPGLRSHFFCSRWNPQRGR

SEQ ID NO: 192771 - protein, 93 aa, Triticum aestivum
  unsure (1)..(93): unsure at all Xaa locations
  Clone ID: PAT_TA_87189.pep
GSRLPAGPRPPILPPPPPPPQPPRPLPSVAAPDPRPSTPXXSVPARXGXLKDDKPFLISRGIRRXMQPTQMGGPXVXKXKSXGIXXSIXYXCG

SEQ ID NO: 192772 - protein, 67 aa, Triticum aestivum
  unsure (1)..(67): unsure at all Xaa locations
  Clone ID: PAT_TA_87190.pep
LNTNTCDAGKVCGHYTQVVWRKSTRIXCSRVVCAGNRXXXINCNYXPPGXFXXHRPFAFLSLDXXSQ

SEQ ID NO: 192773 - protein, 132 aa, Triticum aestivum
  unsure (1)..(132): unsure at all Xaa locations
  Clone ID: PAT_TA_87191.pep
PPFYLANXKNFIXKIXXCCSLQFXXEKKKKFXWXVCSARAXEQGVDRRSQLRQGWRGSRHXSGQPLVRQRRRRRRSPLPQRPPGRSRLATTVASAGDPPYXCVSLCMILQFIXTRRRRRRGLLACSELNGYQ

SEQ ID NO: 192774 - protein, 102 aa, Triticum aestivum
  unsure (1)..(102): unsure at all Xaa locations
  Clone ID: PAT_TA_87192.pep
PDPGHPAEXQRXYXEXXSIXTRAXEXTSXRKXKGALTVVEGXKCLGXGSGREXCAVSXSVRSEPGEWXLEFXRKEWMEEVTVVWDXWMDGCGWMVDGCVPCH

SEQ ID NO: 192775 - protein, 87 aa, Triticum aestivum
  unsure (1)..(87): unsure at all Xaa locations
  Clone ID: PAT_TA_87193.pep
WXLXQLVALYDGXTXSXICVXEIVDYPLKALVFTSTNVNTLVXVVXEXCLEFAXEQYCAXPXGVXQRQKCFXXSPXXXIWXLGAVLS

SEQ ID NO: 192776 - protein, 131 aa, Triticum aestivum
  unsure (1)..(131): unsure at all Xaa locations
  Clone ID: PAT_TA_87194.pep
SSGLASAHLHMSALPLYHTPAXRCLIQPFLCSXIIXFRKCWLFGFLHYLNLVIKRKTFXVNFXWWXPLPLQKSHPLPSXLFFTHRYPLVLSSFGVXPPPGGVPCPIXRLXHCFDGLVQPLYXXTSXRSLTQ

SEQ ID NO: 192777 - protein, 154 aa, Triticum aestivum
  unsure (1)..(154): unsure at all Xaa locations
  Clone ID: PAT_TA_87195.pep
MARGLKKHLKRLNAPSHWMLDKLGGAFAPKPSSGPHKARECLPLILILRNRLKYALTYREVQSILMQRHIMVDGKVRTDKTYPAGFMDIIXIPKTGXNYRLLYDTKGRFRLHSVRDEDANSXXQGQSVKGASLPNTMMANRYTSKHALSHWQQM

SEQ ID NO: 192778 - protein, 63 aa, Triticum aestivum
  Clone ID: PAT_TA_87196.pep
HTSQPGRRRQNHAGEAAVPCDPAEQRCPSYLSLGQRCLLLITHSSTASSMCVFLCIFGWLCAS

SEQ ID NO: 192779 - protein, 103 aa, Triticum aestivum
  unsure (1)..(103): unsure at all Xaa locations
  Clone ID: PAT_TA_87197.pep
EKGNGTMIFNAFVLCQVFNEFNAREIEKKNVFAGVLNNRMFLVIIAVTLVXQVVMVEVLTRFAGTKRLGLXQWGVCLXIAAVSWPIXWARQXSSPVAGTGTPP

SEQ ID NO: 192780 - protein, 85 aa, Triticum aestivum
  unsure (1)..(85): unsure at all Xaa locations
  Clone ID: PAT_TA_87198.pep
FELNLLYALKFLEIVKGLIDQKNHCCFAFALISSGRFVLSVIYVTXAVQFFSFLLLLFSVSLPCAVGSCNLFXFSVATSVEAVAI

SEQ ID NO: 192781 - protein, 87 aa, Triticum aestivum
  unsure (1)..(87): unsure at all Xaa locations
  Clone ID: PAT_TA_87199.pep
SIPGSAXLIXLXIVHXVCSXQLKRXGRXXDEIHXCKGADASNXSXGCRLHXCSLLLLQCYSLLVLXLMLVPIVSELXHVQKYLXSXL

SEQ ID NO: 192782 - protein, 91 aa, Triticum aestivum
  unsure (1)..(91): unsure at all Xaa locations
  Clone ID: PAT_TA_87200.pep
XIRTXDTTDFDSRESEHPXXCGSQGXVDHXPATGGPXCNGELIXSXQDSXXLXXVETXKGXVSDXLPRIXVGTGMVRNNVXXQTVFXWKTA

SEQ ID NO: 192783 - protein, 93 aa, Triticum aestivum
  unsure (1)..(93): unsure at all Xaa locations
  Clone ID: PAT_TA_87201.pep
SVETXKIYIFKVLKQVHPDIGISSKAMSIMNSFINDIFEKLXGESAKLARYNKXPTITSRXIQTSVRLXVLPGXSXXHXVSXGTKAVTKFTSS

SEQ ID NO: 192784 - protein, 144 aa, Triticum aestivum
  unsure (1)..(144): unsure at all Xaa locations
  Clone ID: PAT_TA_87202.pep
SLKLKGHHTAALXLLTTHLWSGSPNAGKGARTLTLLPRRCDRSDCSLNKNHPIRDEVSCINAGSAVGLAQQRKWRKSGTGGRRRSPGAIPRRALKIFNSKNKNKKLNSNAPAASSEGTLLAFSFPRHCRHMPPPLRRHRCSDMA

SEQ ID NO: 192785 - protein, 181 aa, Triticum aestivum
  unsure (1)..(181): unsure at all Xaa locations
  Clone ID: PAT_TA_87203.pep
MSSQMKLYQVVGRKAPTATDENPPAYRMKLFARNEVTAKSRFWYFMHQMRKMKKTTGEILDVNEIVEKEPQXIKNYGIWIKYNSRSGTHNMYREYRDVTXLNNAIXTLYNDMAGRHRFRNQSIQIIKTATVPAKDCKRVSTSSQQQSAPPSHWETSPSKICIRNRLHHSNGCWWLEFMLQL

SEQ ID NO: 192786 - protein, 140 aa, Triticum aestivum
  unsure (1)..(140): unsure at all Xaa locations
  Clone ID: PAT_TA_87204.pep
CKRHFRVYIRYALXALFSFLDTSPAFMRRQHRLVSSLQPVTSSRASVRTSRNASSAVRLPAEFISSTSCWNRVSVCWTLSTRFLICSQSFSFCLTVSTASLILNTISRAFVTLPSASAILVIVSFYHLTGGRELFRSFFL

SEQ ID NO: 192787 - protein, 83 aa, Triticum aestivum
  unsure (1)..(83): unsure at all Xaa locations
  Clone ID: PAT_TA_87205.pep
FFLPPLKVVSXIMLCMHAEVXVYTYDQSYTGVALXYLARLYMHGARMHIYVRVGLLLHWPGHAIYTYLSCMPIYYIYTGGRAS

SEQ ID NO: 192788 - protein, 94 aa, Triticum aestivum
  unsure (1)..(94): unsure at all Xaa locations
  Clone ID: PAT_TA_87206.pep
RRLKPGQGPPPIGEIQGADLSTVRXXXRIXSGMSYXLANVELALAGLLYHXDXWNCPGXAEPGELDMTEEMGVTVRLXRDLLLVPVVXVPXPLD

SEQ ID NO: 192789 - protein, 118 aa, Triticum aestivum
  unsure (1)..(118): unsure at all Xaa locations
  Clone ID: PAT_TA_87207.pep
CTPSPISTVEWYLVFTSLAVILSQLPNLNSIAGLSLIGGATAIMYCTMSWVLSVSXQRPAAVSYEQVRSTSFGSSLFSTLNALGIIAFXAFXGHNLLLNCHVHCMYTCVDDYPVICCN

SEQ ID NO: 192790 - protein, 159 aa, Triticum aestivum
  unsure (1)..(159): unsure at all Xaa locations
  Clone ID: PAT_TA_87208.pep
MARLNSKAVAAAVVLAAVVLMMAGREASAALSCGQVDSKLAPCVAYVTGRASSISKECCSGVQGLNGLARSSPDRKIACRCLKSLATSIKSINMGKXSGVPGKCGXSVPSPSAFHNCNNXTSQYIILPTSSRTPCVELIHLMSHTCSKIFLVIHKSCNN

SEQ ID NO: 192791 - protein, 152 aa, Triticum aestivum
  unsure (1)..(152): unsure at all Xaa locations
  Clone ID: PAT_TA_87209.pep
SSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEXPRPRRPAGRGEHXDXEGQATSTSPPVHNTSVSSQRRMRSRARALNK

SEQ ID NO: 192792 - protein, 136 aa, Triticum aestivum
  unsure (1)..(136): unsure at all Xaa locations
  Clone ID: PAT_TA_87210.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEXLHKHTKPGILSMXNAGPNTTVQFSSERPCXWSTEALVFASLG

SEQ ID NO: 192793 - protein, 72 aa, Triticum aestivum
  unsure (1)..(72): unsure at all Xaa locations
  Clone ID: PAT_TA_87211.pep
PSINPELKTSYLLPNXYXSNPMXTXPXXPSQSGAGGGGGEAVSVQXVXKXSXXXLLRKFSXRXTTTXPPXRD

SEQ ID NO: 192794 - protein, 76 aa, Triticum aestivum
  unsure (1)..(76): unsure at all Xaa locations
  Clone ID: PAT_TA_87212.pep
CGLPLLSGDWRSMGGPANNGEGXIXAKPLGELXAWLATMSSKKTMXIKPLRNAIMDKLRKARXTPDXERQVXQRTW

SEQ ID NO: 192795 - protein, 91 aa, Triticum aestivum
  unsure (1)..(91): unsure at all Xaa locations
  Clone ID: PAT_TA_87213.pep
PRFLLLFLPLTPEAKPREVPMASTTFSSAFSILSLPSSSTSPSASGPKEPNPSPXRXRRAXPVXXXAXEXPKXLXXGXPIXGXTFKXXXXF

SEQ ID NO: 192796 - protein, 142 aa, Triticum aestivum
  unsure (1)..(142): unsure at all Xaa locations
  Clone ID: PAT_TA_87214.pep
MAPTVMASSATSVAPFQGLKSTAGLPVSRRSNGASLGSVSNGGRIRCMQVWPIEGIKKFETLSYLPPLSTEALLKQVDYLIRSKWVPCLXFKQGWVYLPXEHNASPGYYDGRYWXTMWKLPMFGVHRRHASDQQVEESRRST

SEQ ID NO: 192797 - protein, 195 aa, Triticum aestivum
  unsure (1)..(195): unsure at all Xaa locations
  Clone ID: PAT_TA_87215.pep
FFLKNHRKSAVKKLCAYFPSDICYHPSGPLFNPIEIVVLVAQIKDGHHRLRKLQLLEPKPSSYLSSHSNEGGRRRTMDTRFSGRRTKRRHGAHTRWPTQTAEAPALRYCLLXGLNAXQYRAIHMDNLXNXDFDTQGVXNTLXCHGCXNPDXQGCXXVPWWNPXXHYFRRXXMFXXIRXPIXXGQLTXTRXXVEST

SEQ ID NO: 192798 - protein, 39 aa, Triticum aestivum
  Clone ID: PAT_TA_87216.pep
LAVTLAVVRMYLGWAYVGNRLLSATVEYEETGWYDGQML

SEQ ID NO: 192799 - protein, 127 aa, Triticum aestivum
  unsure (1)..(127): unsure at all Xaa locations
  Clone ID: PAT_TA_87217.pep
MSNTSFTRAITPVDSKSMQRSPNLHVLALARIKCVTLAGATHIGLLKLARSRSPRSAGDTFAPVRTGRGFRRCGSWALWALCRLRGQITAAPSGQGVHXINKMLLLSHCRNTRFATKNXPXLSXKGG

SEQ ID NO: 192800 - protein, 152 aa, Triticum aestivum
  unsure (1)..(152): unsure at all Xaa locations
  Clone ID: PAT_TA_87218.pep
MSLIAGEEFQHILRVLNTNVDGKQKIMFALTSIKGVGRRFSNIVCKKADIDMNKRAGELSAEEMDRLMAVVHNPRQFKVPDWVLNRKKDYKDGRXSQVVSNPLGHELKXDLXEVKKXKEHXWSAHYWGVXCPPVKHTKXTGKRGKLLXVSKE

SEQ ID NO: 192801 - protein, 96 aa, Triticum aestivum
  unsure (1)..(96): unsure at all Xaa locations
  Clone ID: PAT_TA_87219.pep
MVFALDQGYAPKLIAKLKKYSMLDHVPVLSLCIVITSLPSFNAKPGYERLCCLRCIQXRDHNFATTCVCRVPKHLREETVIECVXHCGCKGCASGD

SEQ ID NO: 192802 - protein, 73 aa, Triticum aestivum
  Clone ID: PAT_TA_87220.pep
YRMETDIICFLQNNLVVLKGFTDTANKKTWDSPIVHCFQLLCLKKITLSRALGSCLFQQVPVVFLCQQELQPG

SEQ ID NO: 192803 - protein, 48 aa, Triticum aestivum
  Clone ID: PAT_TA_87221.pep
WLASCSQSLAIEATQAYTCKKGIMLALPRFVSYFKLFYGPAICKLPES

SEQ ID NO: 192804 - protein, 136 aa, Triticum aestivum
  unsure (1)..(136): unsure at all Xaa locations
  Clone ID: PAT_TA_87222.pep
PSQTKPLPLATHTYTACRAPARPLASIHGAASHSPPSPPSSASASAXAPPRSRRPTSXXFRPRGDPXXYASQRXQVPAPAAAASSQARLPQGVRGPVRQQXEXGRCAXKGAXVCCQALXLRAPREPGXXPAXSAPX

SEQ ID NO: 192805 - protein, 93 aa, Triticum aestivum
  unsure (1)..(93): unsure at all Xaa locations
  Clone ID: PAT_TA_87223.pep
MVGVYAGQCLGLSQGIGVHCIDIWSKXCXQLEGWQKXYLSDGLHLXTPEGNALVPPRRSCRPLRGAGLEXEDMPXDFPHHSXIDGIHPEKAFQ

SEQ ID NO: 192806 - protein, 155 aa, Triticum aestivum
  unsure (1)..(155): unsure at all Xaa locations
  Clone ID: PAT_TA_87224.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKXVISAPSKDAPMFVVGVNEDKYTSDVNIVSNATAH

SEQ ID NO: 192807 - protein, 67 aa, Triticum aestivum
  Clone ID: PAT_TA_87225.pep
NCKEKETESTPRWRMLLARTTPMTSTDVVAFVIHQQTSEYLLPDVPSNTHSRLQFLPSPTATLELLL

SEQ ID NO: 192808 - protein, 69 aa, Triticum aestivum
  unsure (1)..(69): unsure at all Xaa locations
  Clone ID: PAT_TA_87226.pep
FLVFQTLRPCXGISAWVCTSVLNYLSQIWMYLVLDIXDVSKXYLXVSSDSIQXRXLSXNIQXXRYLNLD

SEQ ID NO: 192809 - protein, 80 aa, Triticum aestivum
  unsure (1)..(80): unsure at all Xaa locations
  Clone ID: PAT_TA_87227.pep
MSCCGGNCGCGTACKCGNGCGGCNMYPEVXEAAGATLLVSATATHKASSGGMEMXGRRTXGCGCTQVQVRTSCGCSCCSC

SEQ ID NO: 192810 - protein, 98 aa, Triticum aestivum
  Clone ID: PAT_TA_87228.pep
APGTTKGSSSAVDTVPTSANNYPSSKFANKASGASITKGHLPSSKFVVHTNQGKGSLYQSKGINLNESGRNCNGNEKLKARSKLNELVTVTYQDKHNG

SEQ ID NO: 192811 - protein, 78 aa, Triticum aestivum
  unsure (1)..(78): unsure at all Xaa locations
  Clone ID: PAT_TA_87229.pep
MSCCGGNCGCGTACKCGNGCGGCNMYPEAEAAGATLLVSATATHKASSGGMENGGRXGGCXCTQXKCGTSCXCSCCSC

SEQ ID NO: 192812 - protein, 126 aa, Triticum aestivum
  unsure (1)..(126): unsure at all Xaa locations
  Clone ID: PAT_TA_87230.pep
MARGTAATAAAAAKGKKKGSVSFVIDCTKPVEDKIMEIASLEKFLQERIKVAGGKAGNLGDSVTVTRDKSKVTVTSDXAFSKRYLKYLTXKYXKKHNVRDXIRXIAXNXDRXXXLXYXNIXENKAM

SEQ ID NO: 192813 - protein, 135 aa, Triticum aestivum
  unsure (1)..(135): unsure at all Xaa locations
  Clone ID: PAT_TA_87231.pep
MARTKQTARKSTGGKAPRKQLATKAARKSAPATGGVKKPHRFRPGTVALREIRKYQKSTELLIRKLPFQRLVREXAQDFKDRPPLQSSAVSALQXAAEXYXVRLFEDTTCRIQXKGSHHAESSPADRGEPPSLAR

SEQ ID NO: 192814 - protein, 33 aa, Triticum aestivum
  Clone ID: PAT_TA_87232.pep
IQPSIQLPFSMEFVIVFFLERVCHIYIERRHVE

SEQ ID NO: 192815 - protein, 92 aa, Triticum aestivum
  unsure (1)..(92): unsure at all Xaa locations
  Clone ID: PAT_TA_87233.pep
GKFPRSLQLNLPYPNFSKLQLPPFFYKQQLQHTSIHPSIHPSIQRGEKRVIEXEXRXXGAASESKPSLGRQMRECVLANXTTSRGPXXXELR

SEQ ID NO: 192816 - protein, 104 aa, Triticum aestivum
  unsure (1)..(104): unsure at all Xaa locations
  Clone ID: PAT_TA_87234.pep
VHRSTLHTPPASAPPQPWSPPASPPPPSPVSPLPRLPTVPPSLPQLPPPRRRQPQPASPXPPNLPVGRSRARRTLHPSGPPSPLPKAXPPATSSPAXAPHXPSR

SEQ ID NO: 192817 - protein, 80 aa, Triticum aestivum
  Clone ID: PAT_TA_87235.pep
KEQQVSNTPSSLIIYHHHLFEPHHHCLSPSGYATRKDSLHIFIGQNCLHEPHDPPFQQGLQASSVKLICGSSGMLEHLHA

SEQ ID NO: 192818 - protein, 137 aa, Triticum aestivum
  unsure (1)..(137): unsure at all Xaa locations
  Clone ID: PAT_TA_87236.pep
SSSSSLARPPAAPHHEYRGRCLAGWSSHTCEALTRGAFRFASADWRDXGMDFPGRXPXGRTSIXXTTTTAAPMTXAAADAQGSXVXRSSSTSSKXLGGRAKDLGQEHDELLXKIGRRGSKXWXGPXXGLSRGGEAXG

SEQ ID NO: 192819 - protein, 127 aa, Triticum aestivum
  unsure (1)..(127): unsure at all Xaa locations
  Clone ID: PAT_TA_87237.pep
RRRRPRWRRPSPPRRPRRRRRSPRRRRPRSRRLSPSRLRRPRRRRRQPLRRRRPRSPSQASCRRAGRPXRPKSXRRQTVVGRDQRRPWLEKPESEEEGPAQAKVPASRKQRVQRGAARKRTAARCNV

SEQ ID NO: 192820 - protein, 69 aa, Triticum aestivum
  Clone ID: PAT_TA_87238.pep
ASSWKKCPHSKQVHLQTLNLLYEHQVDTLFAMFWAQRARHQVLRVHNQQDICQTRPAHDRICSPNVASC

SEQ ID NO: 192821 - protein, 67 aa, Triticum aestivum
  unsure (1)..(67): unsure at all Xaa locations
  Clone ID: PAT_TA_87239.pep
PSIFCENIHDXVLKKIQNLKIMLISWKTLMNLEKITNYLKRFTIVFKCHDLGKFIIRKKKLVHFKKI

SEQ ID NO: 192822 - protein, 105 aa, Triticum aestivum
  unsure (1)..(105): unsure at all Xaa locations
  Clone ID: PAT_TA_87240.pep
RNQRWADKAYKKSHLGNEWKKPFAGSSHAKGIVLEKIGIEAKQPNSAIRKCARVQLVKNGKKIAAFVXNXGCLNSTXEXNDQGAXLLDXGXKGXXRGXNFPGXRV

SEQ ID NO: 192823 - protein, 97 aa, Triticum aestivum
  Clone ID: PAT_TA_87241.pep
FFVCPRMGAYTIPINDKHNKKNSKGTIEWEPNFLFQYCLQLCFRKIQFCNFFMSHLKVSASKRLYILPIPFLIGMNPLCFGQLRLHACVHIIIMYQF

SEQ ID NO: 192824 - protein, 43 aa, Triticum aestivum
  unsure (1)..(43): unsure at all Xaa locations
  Clone ID: PAT_TA_87242.pep
NXXXPXRYNTVVTFSIAITLLEKQQPSSNRKGNLSIVSTYILY

SEQ ID NO: 192825 - protein, 91 aa, Triticum aestivum
  unsure (1)..(91): unsure at all Xaa locations
  Clone ID: PAT_TA_87243.pep
DQPSFEQKLDESFAFDDCEAVIVDRLAEEHSEFEKIIGVKGPCDSEIVQSACRSSIDRLSLRGSPLARGASERXSRXXSHLXKXXPXXKGT

SEQ ID NO: 192826 - protein, 127 aa, Triticum aestivum
  unsure (1)..(127): unsure at all Xaa locations
  Clone ID: PAT_TA_87244.pep
EAVGSACPLLKRFRLSKNQFCKWNTKNIDQEAMAIATMGGLRSLQLFANPLSDDXXXAILDGCPRLESLDIRHCFNVGMSAAAIRARCPGIETLRLPDDSTIDYDLKFSPPDMTRWTRTSISVIGTS

SEQ ID NO: 192827 - protein, 71 aa, Triticum aestivum
  Clone ID: PAT_TA_87245.pep
GGGARMCPGNEFTRVETLVAMHYIVTRFEWKLDESCDGSFSRYPMPSPARGLLIDIEPIDTTTTGAAGISK

SEQ ID NO: 192828 - protein, 72 aa, Triticum aestivum
  unsure (1)..(72): unsure at all Xaa locations
  Clone ID: PAT_TA_87246.pep
HETLMYFNPLLRGLAGALASSYISTPSXGKKGFGTPGXLXHISYRXPPGXXRKKXKENXRGGAGYQFALXXS

SEQ ID NO: 192829 - protein, 69 aa, Triticum aestivum
  unsure (1)..(69): unsure at all Xaa locations
  Clone ID: PAT_TA_87247.pep
XQAGYXXEVPGXVHRXLLXREKTTGGXRCXAGXXSXXCWXXLXYQVSPQISPFSLSLLLXLXNSVFYXL

SEQ ID NO: 192830 - protein, 114 aa, Triticum aestivum
  unsure (1)..(114): unsure at all Xaa locations
  Clone ID: PAT_TA_87248.pep
FVGIAGRRRPMPSVWLTSSPALPQRPQSLPFCWIQRSWVRGRCHPPTASVAPPTPSRRGDSGATWTFSSSIPDSGVMGLLKLQARERSLLGFPXAGSDGRXAGVGSFLXGTSXA

SEQ ID NO: 192831 - protein, 79 aa, Triticum aestivum
  unsure (1)..(79): unsure at all Xaa locations
  Clone ID: PAT_TA_87249.pep
IYGGDHYYCTKTCSRFQACMPHDLRICKTVLVSFQYSLFLPELLLLVSCCKTSWCAGFILSKWNRGGEPPCSSKXGXKK

SEQ ID NO: 192832 - protein, 54 aa, Triticum aestivum
  unsure (1)..(54): unsure at all Xaa locations
  Clone ID: PAT_TA_87250.pep
PVIQVHQNKLGFTSVYGRLSAISEFVITMVGATQASQVLPWXVKKSFDNYNSNV

SEQ ID NO: 192833 - protein, 64 aa, Triticum aestivum
  unsure (1)..(64): unsure at all Xaa locations
  Clone ID: PAT_TA_87251.pep
CKRVLVFPFRGAHVIGPLHFTKVSSISSNLRWSSFIPELQLHQIAIYHVWLLNSSSFXNEKNLL

SEQ ID NO: 192834 - protein, 79 aa, Triticum aestivum
  Clone ID: PAT_TA_87252.pep
LGASEFVKEVSGTYGIYDADQHNIIMSLKFITNVKAYGPFGEANGTPFTIPVENNSSIVGFFGRSGIYLDALGVYVRPL

SEQ ID NO: 192835 - protein, 52 aa, Triticum aestivum
  unsure (1)..(52): unsure at all Xaa locations
  Clone ID: PAT_TA_87253.pep
ALNVFFXNSXFRMHFNXXGSSSFXKKKIMAMLSLCIFIFKYYYCSRMIRLEV

SEQ ID NO: 192836 - protein, 105 aa, Triticum aestivum
  unsure (1)..(105): unsure at all Xaa locations
  Clone ID: PAT_TA_87254.pep
MSCCGGNCGCGTACKCGNGCGXCNMYPEAEAAGATLLVSATATHKXASSGGMXCXGXXNGXGCGCTXCXCGXPXCGCSCXSCYIIDICMHRCVASVHISTTTIPM

SEQ ID NO: 192837 - protein, 77 aa, Triticum aestivum
  unsure (1)..(77): unsure at all Xaa locations
  Clone ID: PAT_TA_87255.pep
PPPLXRFFXFKRCTVLLDSDTFVQGCLERKQQKMSGGLSGYSSPAITLVTAKSNSMLSFCNKKNRLRHTQSIKCSVN

SEQ ID NO: 192838 - protein, 53 aa, Triticum aestivum
  Clone ID: PAT_TA_87256.pep
TRFRLARFHLMIQVYMWRPKLPPSVSSQRWSSGDVSLELSTYRIYFSHASQLR

SEQ ID NO: 192839 - protein, 52 aa, Triticum aestivum
  Clone ID: PAT_TA_87257.pep
ALGWLYFYAFVPETRGQPLEDIGKLFGMKDAAVEDDDTATKDKQVKAAVEMN

SEQ ID NO: 192840 - protein, 87 aa, Triticum aestivum
  unsure (1)..(87): unsure at all Xaa locations
  Clone ID: PAT_TA_87258.pep
SPHLVSAPRPPNQPTNSHSPLPFECLGEGYEIRLPVASWDHLVLGRSNVLGHMKLKSTHGQVKTADMTIQVYWVQNFDFPXVDSSST

SEQ ID NO: 192841 - protein, 119 aa, Triticum aestivum
  unsure (1)..(119): unsure at all Xaa locations
  Clone ID: PAT_TA_87259.pep
PPPXGIXFFSXIKRNILXFVKYQXHSSLLHPLRCXKTSRMXYLAXFIXXTANERRQKQTPXQIVLXTXCWLDHKLXSNDGDETXREXXGXXAHGGRXQGGGXRRXDGGXLPXYXXLVVR

SEQ ID NO: 192842 - protein, 169 aa, Triticum aestivum
  unsure (1)..(169): unsure at all Xaa locations
  Clone ID: PAT_TA_87260.pep
XXWAXWLRPPXVFXFXFXLLATPFHYPXQLHNLFRPNAISSTPKLGXNFGWAQXCLAXKLGNLLDPCLGWXLMQPLATXPHQMLPIFFGQQEVKDLSNRIFCGLTNGRADLGRALLWHVPRHAPKARMLSESHPNAPIVDYKISRYLVHRTAHLVLVLIDWASRLAGMH

SEQ ID NO: 192843 - protein, 60 aa, Triticum aestivum
  Clone ID: PAT_TA_87261.pep
GVRLRLMDVTRIMLRRPDGHPDRYGHGAGDHGGFDIDCLHWCLPGPIDVWNELLLQIMAG

SEQ ID NO: 192844 - protein, 61 aa, Triticum aestivum
  Clone ID: PAT_TA_87262.pep
VPLLVLVCSPAMISSRSSSSARSTAQAVPRGDEMMTNKRSLFPVLPFEDLVNFYLFNVGRQ

SEQ ID NO: 192845 - protein, 80 aa, Triticum aestivum
  unsure (1)..(80): unsure at all Xaa locations
  Clone ID: PAT_TA_87263.pep
ITVTAFYHLLCTHRRRRKIPTRLIVRRWWVYLRDGMAAAALEEHLGVGGSLGAELLQPGLGGRAHPEERVEPXDAAREXP

SEQ ID NO: 192846 - protein, 59 aa, Triticum aestivum
  Clone ID: PAT_TA_87264.pep
DTSFYTVGSEIQWLGSILCNYPQFPNSPKVFLQIKHSGLVCAAASSIQRLPGAHIRCSP

SEQ ID NO: 192847 - protein, 87 aa, Triticum aestivum
  Clone ID: PAT_TA_87265.pep
EGWIDVLGEQCEEACDSPAATKGPADVSSRAPSKVLGSPAAPAEDAAVVGTLSSDELDAEDEPFGDDIILAADPLVDRQIQVCWSSR

SEQ ID NO: 192848 - protein, 170 aa, Triticum aestivum
  unsure (1)..(170): unsure at all Xaa locations
  Clone ID: PAT_TA_87266.pep
EYRLETNENGPPQEEGWVVCXVFKKRLPTTRRDLDHDAPCWYVDDDGPFMHDLNSPMRGMPPHHSMALQEQHLQMLNSTYKRELKLQYQMPNHHHVLNTIPHELESPSSFHSLLVSPDDXQINVHHAQHHHVQLXXHAVDDQSATDWRXLDKFVASQLSNDAARCYLMIS

SEQ ID NO: 192849 - protein, 104 aa, Triticum aestivum
  unsure (1)..(104): unsure at all Xaa locations
  Clone ID: PAT_TA_87267.pep
SLTGTIPPLFSKSTLLPVLLLSDXHLSGSIPAEFAXVXFLQVDLSHNALTGDAXVFFXRTXELQSXLSHNALSFDXSGVEFPEEMXXMXASHKAIRGGIPAQVE

SEQ ID NO: 192850 - protein, 63 aa, Triticum aestivum
  unsure (1)..(63): unsure at all Xaa locations
  Clone ID: PAT_TA_87268.pep
KTIRNRIHSXSLTFFXKGSCXLLPPLVIPHSRGERVSEPTVHGMADQISLHYLLSCFKSPMYF

SEQ ID NO: 192851 - protein, 120 aa, Triticum aestivum
  unsure (1)..(120): unsure at all Xaa locations
  Clone ID: PAT_TA_87269.pep
LGAGFGWARRLGIFFKVGGRESVGACAGLRAGRSPPANHVASLGPKRACQPTSTTRRRCRSGAQHXVRPRAKHGFSAAKAVRTSSRXGFRXRXGAIPRDLGXPXSNPRPAQASLSXCGSG

SEQ ID NO: 192852 - protein, 49 aa, Triticum aestivum
  Clone ID: PAT_TA_87270.pep
LRWNTTVLFYFSARARAHAAAGDQTDTLGGGELVMVLASPPHPRARLCR

SEQ ID NO: 192853 - protein, 44 aa, Triticum aestivum
  Clone ID: PAT_TA_87271.pep
SCCYLLFFRVLQIWAEARGIYLCLDPNSAAVAPFPGEVAGGGLR

SEQ ID NO: 192854 - protein, 76 aa, Triticum aestivum
  unsure (1)..(76): unsure at all Xaa locations
  Clone ID: PAT_TA_87272.pep
PRVRLLTRSGRRRDXLXAIAVLCTPKSPKDXPTMRDVXTMLAEAKPRRKSSSATVVATVVDKDKPVFSTSPDSGYL

SEQ ID NO: 192855 - protein, 82 aa, Triticum aestivum
  unsure (1)..(82): unsure at all Xaa locations
  Clone ID: PAT_TA_87273.pep
PHQVGQXXSXSLGQPRAXFXARGTLLTEXPIXQXKSRGEVKEGIIXCGRWRWRLSLRELGHEERRRGRGRGRRRWGTGGAPW

SEQ ID NO: 192856 - protein, 154 aa, Triticum aestivum
  unsure (1)..(154): unsure at all Xaa locations
  Clone ID: PAT_TA_87274.pep
VFSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDXPAKEAAT

SEQ ID NO: 192857 - protein, 64 aa, Triticum aestivum
  Clone ID: PAT_TA_87275.pep
SSSANFVISMYLCHVPLGSMIYVAYECTHILLSCSPYPCSTEQCCQTDVPLLHVTHCHLFCRAY

SEQ ID NO: 192858 - protein, 184 aa, Triticum aestivum
  unsure (1)..(184): unsure at all Xaa locations
  Clone ID: PAT_TA_87276.pep
SHMPPTTLKTIPITWPFAVRGLDMVGPLKGGTHKQKYLLVMVDKFTKWIEAKPVKTAESGPVIDFIAGVVHRYGVPHSIITDNGTNFTADEVKSWCKNMGIKLDYASVYHPQTNGQVERANGLIMSGIKPRLSXSLTGSNTHWVEELXSVLWGLRQHQYYGVTQFHGYTRSLPANHHTHSGGAG

SEQ ID NO: 192859 - protein, 103 aa, Triticum aestivum
  Clone ID: PAT_TA_87277.pep
LYLKLVILSFMFFILYGLYLSGMFFNEKGMLAGLFVSRVEPTPRSKSLVSLGQTFHLPTTGPAAFRRRSTFLTLLTEAGTRWVRSPRFIPLLPRLRPSLALVP

SEQ ID NO: 192860 - protein, 107 aa, Triticum aestivum
  Clone ID: PAT_TA_87278.pep
QKGFMGEPNEIKPGKGEFHEHPMDCICARTKRRTGHSKPNLSNRAVEAPGNHTSDAEFDWSDLDYGENTPLGGDSSNETDPDYGRIAGPDIPELGGHTLRLKLIAII

SEQ ID NO: 192861 - protein, 94 aa, Triticum aestivum
  Clone ID: PAT_TA_87279.pep
MAETAIAAVLSKLGEFATKEARLLLQVGDDIMLLRDRLEWLQAFIRDADRKRRIGADDLTRVWVRQTRDVAFEAEDALDDFFHKQHEQCWAGPL

SEQ ID NO: 192862 - protein, 55 aa, Triticum aestivum
  Clone ID: PAT_TA_87280.pep
ARGARRPVLLRRQRRRRAQLPRLRRAPVESVRQGPDIWVTRETCSTTVFPLEKKK

SEQ ID NO: 192863 - protein, 83 aa, Triticum aestivum
  unsure (1)..(83): unsure at all Xaa locations
  Clone ID: PAT_TA_87281.pep
FISSKINXVCKKTILRFMGLCIVKVKTKGDNQFXKKVGAIKDMXRSXRTNEKCWCLRPCISLSXPWSSRCQVXDRXNVMXPRH

SEQ ID NO: 192864 - protein, 99 aa, Triticum aestivum
  unsure (1)..(99): unsure at all Xaa locations
  Clone ID: PAT_TA_87282.pep
RHHCLGPRDKFLILASDGLYEYFTNEEVVGHVEAFTARFPDEDPAKYLSHEILLRAARQAGMGFHELLEVRQGERRQYHDDVSIIIISLXEGKIWRSSA

SEQ ID NO: 192865 - protein, 155 aa, Triticum aestivum
  unsure (1)..(155): unsure at all Xaa locations
  Clone ID: PAT_TA_87283.pep
MAPVKLYGATLSWNVTRCVAALEEAGVEYELVPINFGTGEHKSPDHLARNPFGXVPALQDGDLYVFXESRAICXXACXRNXPKLLKEGDIKXXXXGDXWSRVXXQSVNAGLSPSLRXLXHPMXGGXTDKKALXKLGXIKXWKVATEQILVELGLN

SEQ ID NO: 192866 - protein, 70 aa, Triticum aestivum
  Clone ID: PAT_TA_87284.pep
NFLLYGTFKHRLSIPYSALENIKDPGIQLFLFFRDIIIILNLSRIYFSPSEMWQELFCHNFKKPFITLGE

SEQ ID NO: 192867 - protein, 55 aa, Triticum aestivum
  unsure (1)..(55): unsure at all Xaa locations
  Clone ID: PAT_TA_87285.pep
DSHRXMTTYTHTYIYMCKCNTHXACMQSKPLAIYLXERSMDPLQRKRWPELPTSS

SEQ ID NO: 192868 - protein, 107 aa, Triticum aestivum
  unsure (1)..(107): unsure at all Xaa locations
  Clone ID: PAT_TA_87286.pep
PLRXXGFPAPPPWXFFXPCLYYCCFGLFVDLCNLFAFCWCAACCAILNMNYLTRYIRIGVDSLFGSLDSWGLAVKNEAMRHKTCDKCPECEVSCSGMVAQSDPRQRN

SEQ ID NO: 192869 - protein, 87 aa, Triticum aestivum
  Clone ID: PAT_TA_87287.pep
LCWNINVGHYLLIEQLCGSVGLAVNIYTGQKQNFDPVSKTRNCYMCTIGSMPDPCKRTPNRSIEKVSLFPCLFTETESLPLQVRATI

SEQ ID NO: 192870 - protein, 135 aa, Triticum aestivum
  unsure (1)..(135): unsure at all Xaa locations
  Clone ID: PAT_TA_87288.pep
PXARRPHAAPPRHGRXRXRWPHGHDATXSSDREAWWRQRRCCRHETRAVARPEPPTLRRXRRQLRXRRRVRPRCSCRRVHVPPVPGISAPWRXGLRLATPFSTYYRVFARIVQYFSFXALLXVTSFLPFSSXFPF

SEQ ID NO: 192871 - protein, 108 aa, Triticum aestivum
  Clone ID: PAT_TA_87289.pep
MTMRPLVLLALAAVLAAGIGSAEGAGECARAIARVPQLARCAPAGRNPQSAPTAICCVAVRKVSMASPDCVCAVFLNDAFKLLGVKPEVALTIPKRCGIADCGDNTFP

SEQ ID NO: 192872 - protein, 93 aa, Triticum aestivum
  unsure (1)..(93): unsure at all Xaa locations
  Clone ID: PAT_TA_87290.pep
SSSWDHSQYKSEDRFCPCPKCRLPLKAXVLWRKSFGIDALLGADLGVPELENVVFYRGADREGHPVCYNVYSEFQDKDLYEKAFGDDEKRVLD

SEQ ID NO: 192873 - protein, 74 aa, Triticum aestivum
  Clone ID: PAT_TA_87291.pep
STSKTYHGVRTGWSRYLKYTESQTSNQNLLQDEHRVAFIQIGEQSRADLHHAWRFFLRYYYPLIMSLVIDHEWI

SEQ ID NO: 192874 - protein, 67 aa, Triticum aestivum
  unsure (1)..(67): unsure at all Xaa locations
  Clone ID: PAT_TA_87292.pep
ARSAGSWARLRRKEGRSSPCRXRLPVXTPXAWPPSXKAQGLARXATGCXXEILQLCXXXXQGXSWYY

SEQ ID NO: 192875 - protein, 169 aa, Triticum aestivum
  unsure (1)..(169): unsure at all Xaa locations
  Clone ID: PAT_TA_87293.pep
XXVLKIHPILVDMSXQVXSPRGPSXCXTCXYLNLXQXXPPPSXXXTTXPCNDSERESGTLSLLTSCPXLFLFXPFSTVSAAALGLRLSCNXGAHPFSSAAADVFVFLASAPMLVSSVALAGVLGTPCFGSKSGEPASHVXTGSEDDVVLPVXPLGWQPLLPAAPRHLNG

SEQ ID NO: 192876 - protein, 103 aa, Triticum aestivum
  unsure (1)..(103): unsure at all Xaa locations
  Clone ID: PAT_TA_87294.pep
PLESLQSNXKXFSNLHNSFRQTLRSYSXYMNSSRQIKRSPLKKKGSTCCNSTKIASTPVSGLVITSTHHKRLQHSSSTKTKACSLSSTIIRSCLHYTEDGLHN

SEQ ID NO: 192877 - protein, 61 aa, Triticum aestivum
  unsure (1)..(61): unsure at all Xaa locations
  Clone ID: PAT_TA_87295.pep
ATWSSPEVSGRAERVRRYKEKRHARLFSKRIRYEVRRLNAVRRPXLKGRFIKENEGVAMAD

SEQ ID NO: 192878 - protein, 80 aa, Triticum aestivum
  Clone ID: PAT_TA_87296.pep
FFFFRITRFTTCIVVLQQLRRRASNVQQTVFEPTIQPRAPPEKRRTHATYYNNPDLDRVLTPASPEAANLLHVTARLRPG

SEQ ID NO: 192879 - protein, 99 aa, Triticum aestivum
  Clone ID: PAT_TA_87297.pep
FFFLTTTQRNAPNPPSSLSTNMNRKLFERITESVWIARSGCQTDRSSHRKQAHTPCTTSVLRPELELLADVLVPVQLGARKEVAQVDGDEHGEQPVEVL

SEQ ID NO: 192880 - protein, 74 aa, Triticum aestivum
  unsure (1)..(74): unsure at all Xaa locations
  Clone ID: PAT_TA_87298.pep
FDEVVNWKNMPKLYRKGYNRTSLMXLMKNIAMLFAIIRDKGVTSERMKCCSMCKYLQNSKQRPRISFFGQTSCN

SEQ ID NO: 192881 - protein, 77 aa, Triticum aestivum
  Clone ID: PAT_TA_87299.pep
YNHYKNAASIGVHESNSRFMSPPDPMDYEQESIMRNPEIRAIGGCEGVTRADDGNRSRDLNIRKDKEKSILHQRKLP

SEQ ID NO: 192882 - protein, 115 aa, Triticum aestivum
  unsure (1)..(115): unsure at all Xaa locations
  Clone ID: PAT_TA_87300.pep
TARGCRGDGAGGARLPGSSGAGPSRRPWRRCLPRCRCRSHEVFVKLPVIRFLLACSCPVQAPVSTVSSSDPSXTLSVSTPVRSTSLCSPCHWRIFLIDLCPRSFVLGLLKIIMHF

SEQ ID NO: 192883 - protein, 74 aa, Triticum aestivum
  Clone ID: PAT_TA_87301.pep
VLPQTKLSTPKDLYNHCITLFHRVETMVVKNPLRKGKKSHTPKRVTMPIWHHGKKLAELFVRKKWSTLLLTRET

SEQ ID NO: 192884 - protein, 41 aa, Triticum aestivum
  Clone ID: PAT_TA_87302.pep
LFWIVTTCSRRFSSAYSAFFSSFSCSCEDTLVATKVSRFSI

SEQ ID NO: 192885 - protein, 111 aa, Triticum aestivum
  Clone ID: PAT_TA_87303.pep
REKRSKEEGRWREQEQEQVPDPSATAVLDLVELHPYSNRQRPCVRRGITVCGDLISFVAIYSCRLTIVVIYLGKLKRLCHACCCPMIICLLFCTKWILTTSVFIIYIYMVK

SEQ ID NO: 192886 - protein, 152 aa, Triticum aestivum
  unsure (1)..(152): unsure at all Xaa locations
  Clone ID: PAT_TA_87304.pep
MAPKVAVAKKGDAKAQAAKVAKAVKSGSIKKTAKKIRTSVTFHRPKTLSKARDPKYPRISTPGXRNKLDQYQILKYPLTTESAMKKIEDNNTLXFIVDLKXDKKKIKXAVKEMYDIXAKKVTXLIXPDGKKKATADTRLHLLTWQQDRIIQR

SEQ ID NO: 192887 - protein, 172 aa, Triticum aestivum
  unsure (1)..(172): unsure at all Xaa locations
  Clone ID: PAT_TA_87305.pep
VKPAIYHRDIKATNILLDNEMRARVADFGLARRSREGQSHLTTRVAGTHGYLAPEYALYGQLTEKSDVYSFGVLVLEILSGRHVLDMTASNGPVLITDWAWTLIKAGQSREVLDDALSTCESPRGEAIERLFLLXILCAHVMVAXRPTINXAVKMLEGTWYKRYKGAAIGTF

SEQ ID NO: 192888 - protein, 52 aa, Triticum aestivum
  Clone ID: PAT_TA_87306.pep
KEIIIRSGNTASVHCCYSSGEQPRQDSVSGAVKKNYPRSMNGLHPSAAPSPC

SEQ ID NO: 192889 - protein, 73 aa, Triticum aestivum
  Clone ID: PAT_TA_87307.pep
KEDIEKKPFTQFTFLFCSTDISVLLLVPKPMINLMHQVFFLSKKTPDLRIERCTQSSLLNYSIKFWQKHTSNN

SEQ ID NO: 192890 - protein, 55 aa, Triticum aestivum
  unsure (1)..(55): unsure at all Xaa locations
  Clone ID: PAT_TA_87308.pep
KKKXFVXLXKXXPAELVXNXTKLXGXXYQILHLXXLNDNXRPCRKTFKDXQXAST

SEQ ID NO: 192891 - protein, 127 aa, Triticum aestivum
  Clone ID: PAT_TA_87309.pep
SLSSGSPSQGDLSIKTSSKFKTVDQLERLKKMDGLRDQLNRLSSNKGLEKRYQKKDLEYQPQQLNTYDVEQQFRSVDTDSIPSSCTLRLLLWSWKATKVPPAKSFLTTPFMCTLPFWTCASAHPAQL

SEQ ID NO: 192892 - protein, 95 aa, Triticum aestivum
  Clone ID: PAT_TA_87310.pep
SCEVLLVLLLALIMRRLYACCLIESLLSVMQTNTTGEEKRSDRLACCQEHSVREREGNTAIRPSLSMAFTPRARSSPTTPTPKRGPTDPAQAGVR

SEQ ID NO: 192893 - protein, 82 aa, Triticum aestivum
  unsure (1)..(82): unsure at all Xaa locations
  Clone ID: PAT_TA_87311.pep
LQLTEWKGKXYAPLIASKCRRNALVKHRIASNGPAHYTKSSQLVLILFLLGFFGFWFSFFFXPLFCFLFFFLFFFFLFVFSF

SEQ ID NO: 192894 - protein, 71 aa, Triticum aestivum
  Clone ID: PAT_TA_87312.pep
KRIDSYRLAIVISYNDSLLAYFDATTVDFAKLEPTFLNSYFSLICSLSSSRLCTLMSSHLRCCIICLSLHS

SEQ ID NO: 192895 - protein, 151 aa, Triticum aestivum
  unsure (1)..(151): unsure at all Xaa locations
  Clone ID: PAT_TA_87313.pep
VVXEYXKSGXLFDYIVEXGXLQEEEARRFFQQIKSXVXYCHXNMXIHXDLXTXNLXLDXKCNVXIAXXGLSNXXRDXXFLKTRCGXPNYAXAPDXISXKLYAXGPEVDVWXCGVILXGLXXXTLPVXDXNXPNLFKXLKXGIYNLPXHLHP

SEQ ID NO: 192896 - protein, 49 aa, Triticum aestivum
  unsure (1)..(49): unsure at all Xaa locations
  Clone ID: PAT_TA_87314.pep
XSSMHLCNTSSTILPRRWTQVVITASSAHHARIRCLGQRNMPNNGLWQX

SEQ ID NO: 192897 - protein, 64 aa, Triticum aestivum
  Clone ID: PAT_TA_87315.pep
KKSVSLYQRHFIETPSSYRFHFRRPCCVCYCSIYCYVVTYAWYLEIVRRVEYLVFTSMSSFRRD

SEQ ID NO: 192898 - protein, 38 aa, Triticum aestivum
  Clone ID: PAT_TA_87316.pep
FFFLYKGLIFRNRGNTIVLKGVILTDNIITLTHMQPAD

SEQ ID NO: 192899 - protein, 78 aa, Triticum aestivum; identical to SEQ ID NO: 106962
  Clone ID: PAT_TA_87317.pep

SEQ ID NO: 192900 - protein, 58 aa, Triticum aestivum
  Clone ID: PAT_TA_87318.pep
LWRIVSLLEMPVALSFKRCCERCFFLQASAFSLMVLSSMVCVVMSFGLFQLLLENRRG

SEQ ID NO: 192901 - protein, 170 aa, Triticum aestivum
  unsure (1)..(170): unsure at all Xaa locations
  Clone ID: PAT_TA_87319.pep
ERRDRVEEFVENYRASHEGKFPSATYVRKQVGGSYYVLWALLQELEYNSKLRSDVSDASFNSTRDARTSFEGIKEETDLPEVHKRMTREERMARVEEFVENFRASHEGKFPHATYVRQQVXGSYYTVLALLQELEYXSRLKNDVRNASFSSSRKIRAHNIDLSQECCYNF

SEQ ID NO: 192902 - protein, 29 aa, Triticum aestivum
  Clone ID: PAT_TA_87320.pep
HVILIERRDSLVLNPRRKDKMTQIRRHKV

SEQ ID NO: 192903 - protein, 126 aa, Triticum aestivum
  unsure (1)..(126): unsure at all Xaa locations
  Clone ID: PAT_TA_87321.pep
DNVKAKIQDKEGIPPDQQRLIFAGKQLEDGRTLADYNIQKESTLHLVLRLRGGMQIFXKTLTGKTITLEXESSDTIDNVKAKIQDKEGIPPDQQRLDLCWQAVEDGRTLADYNTGIHPSLGPPVGG

SEQ ID NO: 192904 - protein, 39 aa, Triticum aestivum
  unsure (1)..(39): unsure at all Xaa locations
  Clone ID: PAT_TA_87322.pep
GGTTWVYWVGPLXGGGLAGVIYELLFXSXTHEXLPTTDY

SEQ ID NO: 192905 - protein, 60 aa, Triticum aestivum
  Clone ID: PAT_TA_87323.pep
VGVYKISHPEVGKVQATIMVRILIYTYYRRALTPHTTYPTTVQLHRRIRNSSKSRPADAD

SEQ ID NO: 192906 - protein, 81 aa, Triticum aestivum
  unsure (1)..(81): unsure at all Xaa locations
  Clone ID: PAT_TA_87324.pep
LCAISXTYXHXVHFMTXKMXMSTXQAFPSGXVHMNPSPKVSQKINNQSVSSHLRTWLRKVRKPGAKISTPNHFVRSFFQYS

SEQ ID NO: 192907 - protein, 90 aa, Triticum aestivum
  unsure (1)..(90): unsure at all Xaa locations
  Clone ID: PAT_TA_87325.pep
XXYXPPXAPLXIXXWCCXTNATXLXAXDLLNXXXYRLDCXCKLLYLXSQXSITXXXTSCXTXRVKLXVATIATGFVXNCFYIYVDTLYTS

SEQ ID NO: 192908 - protein, 135 aa, Triticum aestivum
  unsure (1)..(135): unsure at all Xaa locations
  Clone ID: PAT_TA_87326.pep
MVSGSGVCAKRVVXWDARHHMLGRLASIVAKELLNGQVVWXVRCEGRFCMXXGGSSXRKMKYLXRFLRKEDETKASQGPIHFRRPAKDLXGXPXXGMIPHKPXGXRAAFXKSXVXXGLXXPXDKTNDGTPDRSSF

SEQ ID NO: 192909 - protein, 115 aa, Triticum aestivum
  unsure (1)..(115): unsure at all Xaa locations
  Clone ID: PAT_TA_87327.pep
AELLELAGNAAKDNKKSRIIPRHLLLAVRNDEXELGKLLAGVTIAHGGVXPKINPVLLPKXRREKGGQGSPSLLRKTTKSPKKDHQRLSSMRSMSLVSSVRLCSTGFRSSCYVHV

SEQ ID NO: 192910 - protein, 62 aa, Triticum aestivum
  Clone ID: PAT_TA_87328.pep
SGEWVQEVSLKGGGDRLVPLISTISRFCPFFFLVLLGVFSLSLFVVVLLRCQVQILPKKKIW

SEQ ID NO: 192911 - protein, 76 aa, Triticum aestivum
  unsure (1)..(76): unsure at all Xaa locations
  Clone ID: PAT_TA_87329.pep
PNGTGLGAQAPPNWVGAGGGRQASHASLDSDLEAFSHNPAHGSFAPLAFQPSAMTNCVNQRFLSYXVELLSRHCHQ

SEQ ID NO: 192912 - protein, 115 aa, Triticum aestivum
  unsure (1)..(115): unsure at all Xaa locations
  Clone ID: PAT_TA_87330.pep
RFLLXGRLTRWPSQISXTVLPXLINYAVPSPQGSAXKGTDQTIFSPPKIVRTVRSANSRSVSVMSHLSRALQYQVTAIIHRPRLRRLDIRSKNMGNMSMLNRMSCTFIHFKAISS

SEQ ID NO: 192913 - protein, 84 aa, Triticum aestivum
  Clone ID: PAT_TA_87331.pep
TTRHHSISQPEPLPLVFGKRKQFTTGNGKNAHQKHYRNRISDLGQIIKLPHVSFQKTISTFFFDNLQQERLPLFYIKKKACTWH

SEQ ID NO: 192914 - protein, 106 aa, Triticum aestivum
  Clone ID: PAT_TA_87332.pep
WDHVLSYWRASTAMPDKVLFLRYEELLRDPAKNVRKLARFIGMPFSAAEDEGRHRRQHRPALQLPGTSRAWTPTPGTWPLPVPRDALFRDGGVPIGGPDPMRRESS

SEQ ID NO: 192915 - protein, 120 aa, Triticum aestivum
  unsure (1)..(120): unsure at all Xaa locations
  Clone ID: PAT_TA_87333.pep
QSHGLYMPLPIPYHPWEDISMDFVLGLLRTQNGKDFLFVVLDRFSKMXHFIPCNKINDASHVANLFCXEILXLHXLPKTIXTXRDVKFLSXFXETLXAKLGIXXLXSSGXHQXXXXRRRT

SEQ ID NO: 192916 - protein, 105 aa, Triticum aestivum
  unsure (1)..(105): unsure at all Xaa locations
  Clone ID: PAT_TA_87334.pep
DVGGQDKIRPLWRHYFQNTQGLIFVVDSNDRERVVEARDELHRMLNEDELRDAVLLVFANKQDLPNAMNAAEITDKLXGLHSLRQRHWYIQXSTCATSGEGCTRG

SEQ ID NO: 192917 - protein, 51 aa, Triticum aestivum
  unsure (1)..(51): unsure at all Xaa locations
  Clone ID: PAT_TA_87335.pep
HKQXIFMQYIGHKLIRSLSLVXXYSXSSHYLGVAKFLGXLALLRKSXWXNX

SEQ ID NO: 192918 - protein, 109 aa, Triticum aestivum
  unsure (1)..(109): unsure at all Xaa locations
  Clone ID: PAT_TA_87336.pep
LLLTPHVSLXXXLSSLXRPSLSLSSDRNRQTAAXGGXXREREPXGXTAGRXXAAAXGXCSACXCPCLRXXXSGXXGXXPPPXTXXVLGCWXHFLSRXCGPWAAXXAFXR

SEQ ID NO: 192919 - protein, 161 aa, Triticum aestivum
  unsure (1)..(161): unsure at all Xaa locations
  Clone ID: PAT_TA_87337.pep
IRKGLRGDSIVLMGKNTLIRRCIKVHSEKTGNKDFLELSNLLVGNVGLIFTKGDLKEVREEVAKYKVGCXPLRVGLVAPVDVVXVPLGNTGLDPSQTSFFQXVSTFPPKINKGLWKYYPVELIKKGDKVGXSDPALLANFGTALLLRGNLQVETVILNPES

SEQ ID NO: 192920 - protein, 76 aa, Triticum aestivum
  unsure (1)..(76): unsure at all Xaa locations
  Clone ID: PAT_TA_87338.pep
TLNEPYETLVPMSLYQAHGIDHLVIATRDYLFAPSLEDICRAIDFIHRNASQGGTTYVHCXAGRXRXTTIVLCYLI

SEQ ID NO: 192921 - protein, 52 aa, Triticum aestivum
  unsure (1)..(52): unsure at all Xaa locations
  Clone ID: PAT_TA_87339.pep
IPLLLQRLSQLPDADXVTIAFPDDGAWKXFHKSLXNFPVSLLCLDGYFAFFN

SEQ ID NO: 192922 - protein, 61 aa, Triticum aestivum
  unsure (1)..(61): unsure at all Xaa locations
  Clone ID: PAT_TA_87340.pep
AFKXYCXHIXQKVXPLVQSIXKYCIPTPNXITKQQRSQHSAGLIVAQLEIDSYLNIDLQRK

SEQ ID NO: 192923 - protein, 36 aa, Triticum aestivum
  unsure (1)..(36): unsure at all Xaa locations
  Clone ID: PAT_TA_87341.pep
VAGMXYFIVADKTILSMARKHSFDDAPEHLXNXSFH

SEQ ID NO: 192924 - protein, 72 aa, Triticum aestivum
  unsure (1)..(72): unsure at all Xaa locations
  Clone ID: PAT_TA_87342.pep
CPRGAVVGLVPCAQGGTPIANWSRGSEMYERMVTRARVAGAGTGRIAALLWXQGXXXDAXRXEDALAYTGXD

SEQ ID NO: 192925 - protein, 60 aa, Triticum aestivum
  unsure (1)..(60): unsure at all Xaa locations
  Clone ID: PAT_TA_87343.pep
RXXIYXSNLXXXHXIXWXXLNXHDQEXXKVASXHLGLQVLCREKLCELLVLLAFSLECTQ

SEQ ID NO: 192926 - protein, 140 aa, Triticum aestivum
  unsure (1)..(140): unsure at all Xaa locations
  Clone ID: PAT_TA_87344.pep
WNPDSEYSQPTGGFSVAFSLSVVQSECQQLLCEILRATPEAATADAAVQTARLANKDPVKEKRDGSEXGLSFAFRVTDAAISVQNEGQGVEXXTQLYPKTGYGTVSIIPDQXXFLAASVXRPVFXFRXKXXXXLPXKXHN

SEQ ID NO: 192927 - protein, 127 aa, Triticum aestivum
  unsure (1)..(127): unsure at all Xaa locations
  Clone ID: PAT_TA_87345.pep
VLSSVVPETSTTDVAEAPAADDDDDSDVDLFGEETEEEKKAAEERAAKAKASTKKKESGKSSVLLDVKPWDXETDMVXLEEXSEASRWRGLLWGAXKXMPXXYGXRXPXXXAXIXDXXSXKPLXKTI

SEQ ID NO: 192928 - protein, 51 aa, Triticum aestivum
  Clone ID: PAT_TA_87346.pep
FFFFFFHHKVTVELSKLQYISNKLCFQQVESSNKECSVQYRASTPKINEQG

SEQ ID NO: 192929 - protein, 68 aa, Triticum aestivum
  unsure (1)..(68): unsure at all Xaa locations
  Clone ID: PAT_TA_87347.pep
IAXFXVREPTSLGHFVFHTINLXGQFNCKTTTLXLPKRSCNYSRLLQNTXLGGVHLIQIDWTPSDPHG

SEQ ID NO: 192930 - protein, 121 aa, Triticum aestivum
  Clone ID: PAT_TA_87348.pep
ICEGLQYLHDNHIIHLDLKPANILLDDNMEPKITDFGLSRCFDENQSRDITKTILGTIGYLAPEIREGGVIARSADLYSVGVIILEILTGQKGYQDIGDVRTNICHCYKDKSSISFLERLT

SEQ ID NO: 192931 - protein, 67 aa, Triticum aestivum
  Clone ID: PAT_TA_87349.pep
SNKVTKHPVTVITNITRAEPYETGWHVRACEQINPMRVDQGPASNVVRTYCQLRANQLKQAKKKKGK

SEQ ID NO: 192932 - protein, 79 aa, Triticum aestivum
  unsure (1)..(79): unsure at all Xaa locations
  Clone ID: PAT_TA_87350.pep
FFFFENXXNLXXXLISFRXKSYXSKKVSIXHTTXLXXEILMLLXIKEIFGEQLRFDQVISVSGCQLIHXISKFCLDLVX

SEQ ID NO: 192933 - protein, 119 aa, Triticum aestivum
  unsure (1)..(119): unsure at all Xaa locations
  Clone ID: PAT_TA_87351.pep
AFLRTKCPADGSSDPMVLMDQATPALFDNQYYRNLQDGGGLLASDQLLYNDNRTRPLVNSWANSTAAFSRGFXDAITKLGRVGVKSGSDGNIRKLCDSSTDDERDRMRLIYTGVAILPV

SEQ ID NO: 192934 - protein, 93 aa, Triticum aestivum
  unsure (1)..(93): unsure at all Xaa locations
  Clone ID: PAT_TA_87352.pep
ILXXXXXLXPEFKSNLFLPMIXSQXAEHXQKASPYSDIWVXXCATCSLHRLAGAPKXNLDRRKVDHHLSNLVQTLCILCYLIARXFISTXAQI

SEQ ID NO: 192935 - protein, 165 aa, Triticum aestivum
  unsure (1)..(165): unsure at all Xaa locations
  Clone ID: PAT_TA_87353.pep
RERPSFAIDFVLLLPSSTSTSNGEARSAVSGKGSAGVRLLVQQITLCKNNLPIQRCSSTVACAQPSSLAPAGSSSSAPLGGLLGGFLPRVPSADLGGNRERRTEKSALGQAAVPQVGLNAPSAVHSVXKEAHALLTCHLSPVGDXAWWHPVXLIPGINCXNXKKK

SEQ ID NO: 192936 - protein, 113 aa, Triticum aestivum
  Clone ID: PAT_TA_87354.pep
DPLELILKAGTLISPEVCKLIWCKFMVEVDPIVTAALDAEKAHKWKKRMRRIHIGLIVLNVAASTAVFRDDWGSNTDFLMPRQNCSAFNSAGLGLYSSNELLNLFSTEVINPV

SEQ ID NO: 192937 - protein, 82 aa, Triticum aestivum
  Clone ID: PAT_TA_87355.pep
PQETSSPERSPPSGDLLPDLSFSLPTADVVVYRRRHGAETGEILRPHRGPDSLCHQVHRTPQDRYVKGGAWEKRCQSCVSGV

SEQ ID NO: 192938 - protein, 182 aa, Triticum aestivum
  unsure (1)..(182): unsure at all Xaa locations
  Clone ID: PAT_TA_87356.pep
MAGRKGGDRKKAVTRSVKAGLQFPVGRIGRYLKKGRYAQRVGSGAPVYLAAVLEYLAAEVLXELAGNAAKDNKKTRIIPAPPASPPVRNDQGVGKCSAGVTIXAHGGVIPKHQSVLSPKXPPAAAEKEAIPKKKTAPPQEEALHQGYRPILLVFLIHSHGQDNPACMLYLSLNKIMSVICRW

SEQ ID NO: 192939 - protein, 93 aa, Triticum aestivum
  Clone ID: PAT_TA_87357.pep
GAAESRIRALACPASALPDWDSDEGWIDVLSGPTEAPVAAPAKVTTGTTVEDVITSDAESGALDITVDVEHSSVLNAGQEADDDEDESSSRAH

SEQ ID NO: 192940 - protein, 135 aa, Triticum aestivum
  unsure (1)..(135): unsure at all Xaa locations
  Clone ID: PAT_TA_87358.pep
KPKEKKEKESFTAPKETQELAACLVTFRDTFYQSILNTVGALLEISGHNFQQASCRFFCTVSMVEVTQVAVVFSALLFKGFLIYLSXLSXVEVNTNPTIADEXKNGNDCLQWSNGSCGRVELDQSLLKDGDMSAF

SEQ ID NO: 192941 - protein, 135 aa, Triticum aestivum
  unsure (1)..(135): unsure at all Xaa locations
  Clone ID: PAT_TA_87359.pep
LLSQKTPSANFVCSFLQLPTRRARESXTQWAPNGFXGPILPGSXALAPAALPTCSALVRDFNGTPVTQCHQWXRALPKPXRSKARRNHNTXAXXTQAXGCXHARXSGXTXTXXXCXLXXIXRFXXRGPXXPXGLT

SEQ ID NO: 192942 - protein, 60 aa, Triticum aestivum
  Clone ID: PAT_TA_87360.pep
GKIRFTYKYTILEIFCDCEPSSKYYMPKLLTLDKEDNFMVYVCLYSNRSHIVMDPLTCGA

SEQ ID NO: 192943 - protein, 56 aa, Triticum aestivum
  Clone ID: PAT_TA_87361.pep
RVTRTESYREWSWRITLVDPGPNSYTREISSGVMYEVPPSALDGKSAESSNKRGVM

SEQ ID NO: 192944 - protein, 93 aa, Triticum aestivum
  Clone ID: PAT_TA_87362.pep
DFFPAWIPNQVLISKVSALDRLLNCFQIHLPCAYIWMKTRLVYRQSSQLIINIPLGLQRCPFISDLKHTPLGVPLPSMVPDQVFLSKERHWEK

SEQ ID NO: 192945 - protein, 139 aa, Triticum aestivum
  unsure (1)..(139): unsure at all Xaa locations
  Clone ID: PAT_TA_87363.pep
VMAAAYSHELPRYGLEVGLTNYAAAYCTGLLLARRVLKNRDLDEEYEGNVEXTGEGLSVDLLMERRLSXXLGCWALLRTTTGEPRVWVPXKELLDGGLXDIPQQWTRICWVFKKDENPLEXEXNRKXTFXXXVADYMXH

SEQ ID NO: 192946 - protein, 60 aa, Triticum aestivum
  Clone ID: PAT_TA_87364.pep
SLLRNITGNPEVRVNKMGRAAGVLENHEEGRRYAEHGLRAYVQDKTPRSCQEQQFFTSPK

SEQ ID NO: 192947 - protein, 71 aa, Triticum aestivum
  unsure (1)..(71): unsure at all Xaa locations
  Clone ID: PAT_TA_87365.pep
QRCANDLLKNWISNNTLXYIGYAFFXEXKSXLKLFTTTXXVNPTYIXNYXYIXIFTDMXXTHIXLPWRTIS

SEQ ID NO: 192948 - protein, 93 aa, Triticum aestivum
  unsure (1)..(93): unsure at all Xaa locations
  Clone ID: PAT_TA_87366.pep
LHXEYCMHLHIHQKNLYPFXLLPYTCYAPKGSPTCPXHKXXXXISPFTXATIKEEEXLXINKDTQLXVQIXHAXHXIRCSYHHXHLGHHNXYH

SEQ ID NO: 192949 - protein, 84 aa, Triticum aestivum
  unsure (1)..(84): unsure at all Xaa locations
  Clone ID: PAT_TA_87367.pep
SGVTAGNNAVREGVGKATLIVKVTCQTLIRRRRIGFLEHCXTSGSGRXVEGVRDMIYLLVGXGXGLWMXHFKHTFLQTTFSCFV

SEQ ID NO: 192950 - protein, 104 aa, Triticum aestivum
  unsure (1)..(104): unsure at all Xaa locations
  Clone ID: PAT_TA_87368.pep
AHRYGIKRVILPERNLKDLAEIPAPILAGIEILLVKRIEEVLXHAFENGIPFGGYTPVYSTGNLKWALMWVFPPVMYLWKSSLSTALDIYKWSVQRKLITSESP

SEQ ID NO: 192951 - protein, 178 aa, Triticum aestivum
  unsure (1)..(178): unsure at all Xaa locations
  Clone ID: PAT_TA_87369.pep
GRSKLSKLGAAFSALFSSPPWRFTVCKRRRAGACDVCRHGEVQFVCLFPDCGCCCCLAGFLSAGYFPTSSPSTSLEEKTCIAPGPRLRGSSLGGLYILSGLNIATWGGXTPFSXTLSLSRPTECTNKLQRPGLIYTAAGLAPLPREXISTRRHRERNNXSNPETSTAMTTQGKPSWRY

SEQ ID NO: 192952 - protein, 65 aa, Triticum aestivum
  unsure (1)..(65): unsure at all Xaa locations
  Clone ID: PAT_TA_87370.pep
CVHVVIXXSRXXXQHTGNVHTKLQXVCCPISMGVNXTLTEXFGAGQSQXAXXPCVLTPMEXGXLX

SEQ ID NO: 192953 - protein, 64 aa, Triticum aestivum
  unsure (1)..(64): unsure at all Xaa locations
  Clone ID: PAT_TA_87371.pep
XXFSLLRNITXNPXXRVNXMXRASVVLENHEEGRRYSXHXLRSYVXDKTPXIMXXINXFFTSPK

SEQ ID NO: 192954 - protein, 145 aa, Triticum aestivum
  unsure (1)..(145): unsure at all Xaa locations
  Clone ID: PAT_TA_87372.pep
YTVRTLQRTVPAAVPAIVFLSGGQSEEEATLNLNAMNKLQTKKPWXNLSFSFRACPPSKSTLKAWSRQDGRTKRKPRTGSWVRCKXANPEATLWNXQGQPTLWQGXSETSKLRIHRNFRTLAFWVPLQMLFQTPKTLETNFLKEC

SEQ ID NO: 192955 - protein, 112 aa, Triticum aestivum
  unsure (1)..(112): unsure at all Xaa locations
  Clone ID: PAT_TA_87373.pep
PPXGXPFXXFXCWXLWKVKLPMYLLGHGXICSSHSLANSPFQCXSQAWKXGAPSSHLAYVRIQKIHLYLHWHFINRPKNGRTKEELVQEKSTILPARSCPLAFCSYRVWKFN

SEQ ID NO: 192956 - protein, 91 aa, Triticum aestivum
  unsure (1)..(91): unsure at all Xaa locations
  Clone ID: PAT_TA_87374.pep
LDVPDXFPPGKVRLPPMPSQLLCFXAXGNCXSVXSYLHPXPXCXXPFXTRDQGHVKGANCNQGAXQSLMILXPCVXNSXETWYTILRTLPL

SEQ ID NO: 192957 - protein, 114 aa, Triticum aestivum
  unsure (1)..(114): unsure at all Xaa locations
  Clone ID: PAT_TA_87375.pep
EVDLSSIEPGSTVTVKWRGKPVFIRRRTDDDIKLANSVDVASLRHPEQDAERVKNQSGWVVIGXVCTHLGCIPFPTPGRLXWWVCPFHGSHYDTPXRXRKGLPXYNFEXPLFLG

SEQ ID NO: 192958 - protein, 90 aa, Triticum aestivum
  unsure (1)..(90): unsure at all Xaa locations
  Clone ID: PAT_TA_87376.pep
XAVSRQRXFXKXRVAMSSDAVXHCLMFVCWAXSLXAVVPLLVLVNVCGKASCXRVPIFKLKKMAKKPSGEYHWVHLFCHXLLPPXNTXXD

SEQ ID NO: 192959 - protein, 88 aa, Triticum aestivum
  unsure (1)..(88): unsure at all Xaa locations
  Clone ID: PAT_TA_87377.pep
LLLLLALRFRGELVQECRKEKYVAIEAYMPFKLKHQKKNNLETIYLLDWCTYPLPKYFLWGHPDQXLPPKRKYLTDSFIYXSPQFSWY

SEQ ID NO: 192960 - protein, 69 aa, Triticum aestivum
  Clone ID: PAT_TA_87378.pep
HADAGHRGAGSSAAAAGASSGAAGASSATAGASGSAGGAASSFTSSGAAGSASATASLVSVSTTAGASV

SEQ ID NO: 192961 - protein, 79 aa, Triticum aestivum
  unsure (1)..(79): unsure at all Xaa locations
  Clone ID: PAT_TA_87379.pep
QHXGSMDVSGYPFGVLLEFWGNLVLPSLSSGITSLSLRGVRPVFFFTRCMRSGAMLRTRFPTPSTASFSRSATSVPKDG

SEQ ID NO: 192962 - protein, 109 aa, Triticum aestivum
  unsure (1)..(109): unsure at all Xaa locations
  Clone ID: PAT_TA_87380.pep
PQRPGSRAPSPVPGFHPLPLIQRHAEAPRPELYTVPDSDHHPPSSLDLGGASSSSPLCFTAPATYLTRPCPNPPRTVPXHNWXNKIPSPFPSFCVTXMGXSYFWMITXF

SEQ ID NO: 192963 - protein, 108 aa, Triticum aestivum
  unsure (1)..(108): unsure at all Xaa locations
  Clone ID: PAT_TA_87381.pep
XEEIQGNMKTTYTQRHXRXEIGGDEGVTTRNEXATLXGLHQIXARYXTYTLTPSHVRTDGTECMQLNSCRGCTCSCRRSCSPRRTGRRPPRTDLPCSQAPRRGRPRRR

SEQ ID NO: 192964 - protein, 147 aa, Triticum aestivum
  unsure (1)..(147): unsure at all Xaa locations
  Clone ID: PAT_TA_87382.pep
LILVLSAQQNLEEAESVADIALDEAEQEDQMGILRLKALIQSSRGQFKSAVESFRILLAIIQSXKKETGKFDPYDKVKPCMXXEMEAWVKFWHPIYTKLEAWNDSNIXLGQSKPMIPYSKSAGCQKAGYWSPLHQEASQDILLSNQD

SEQ ID NO: 192965 - protein, 90 aa, Triticum aestivum
  Clone ID: PAT_TA_87383.pep
FRLHREVHFAVQGIEDERCRPKIPRRRGQEDVMAGGSGKVLPAGSAMTLDFKDQPCPHHPSDTVADHSFHWASYFSEPKRHIDALCMLDE

SEQ ID NO: 192966 - protein, 109 aa, Triticum aestivum
  unsure (1)..(109): unsure at all Xaa locations
  Clone ID: PAT_TA_87384.pep
GLNPXTXPRGFSXPXTPKPXRTFSXLTWIHXVTIAVPVAFRHRXRRSPYRRASLSPPWIQRGLDAQLLAPPPCRSAVSSSTSSCLTQLSLFFLSSLKNTHTHTTKVETD

SEQ ID NO: 192967 - protein, 45 aa, Triticum aestivum
  Clone ID: PAT_TA_87385.pep
KDYDENDLAYLQKKKDEQKALKELKAKAGQKGALGGSGLKKSGKK

SEQ ID NO: 192968 - protein, 67 aa, Triticum aestivum
  unsure (1)..(67): unsure at all Xaa locations
  Clone ID: PAT_TA_87386.pep
SPAAAATAPTSGRRCRRWACRRRRRRSTRSLLGCFAGIGIIILAGSWASLLQLHYSSSWGYYPRXSR

SEQ ID NO: 192969 - protein, 93 aa, Triticum aestivum
  unsure (1)..(93): unsure at all Xaa locations
  Clone ID: PAT_TA_87387.pep
AEVLELAGNAAKDNKKTRIIPRHLLLAVRNDQELGRLLAGVTIAHGGVIPNINSVLLPKXSAAAEKEANPPKKKAATNPPKKKAVATKELGAP

SEQ ID NO: 192970 - protein, 131 aa, Triticum aestivum
  Clone ID: PAT_TA_87388.pep
VNHSIFWKNLKPISEGGGEAPHGKLGWAIDEDFGSIEKLIKKMNAEGAALQGSGWVWLALDKEAKRLSVETTPNQDPLVTKGSNLHPLLGIDVWEHAYYLQYKNVRPDYLTNIWKVVNWKYAGEEYEKVLA

SEQ ID NO: 192971 - protein, 123 aa, Triticum aestivum
  Clone ID: PAT_TA_87389.pep
CVFFRDHIYNDTNIDPAFAAELQRNCPAPAGSGDTNLTPLDAQTRFVFDNAYYPNLVARRGLLHSDQELFNGAAQDDLVRQYSSNSALFFADFVAAMIKMGNISPLTGSAGEIRRNCRVVNSS

SEQ ID NO: 192972 - protein, 60 aa, Triticum aestivum
  unsure (1)..(60): unsure at all Xaa locations
  Clone ID: PAT_TA_87390.pep
SXXAAALTAAGAAAAVGIGGPAPAASDGRHRQLLRARRRPMWGTTWGGGDGALWCASLPT

SEQ ID NO: 192973 - protein, 128 aa, Triticum aestivum
  unsure (1)..(128): unsure at all Xaa locations
  Clone ID: PAT_TA_87391.pep
XXRXNFKXKEIXXDXNRCFAKSMERKXASWRGIQALNXRXGXCLWTXKPLGXGSSPXLEVHSSLDFLVSGASADISSSASESSGRECCFVHHGASSRTAGPSFTMEHTGACTGVGASVLPISAAATQV

SEQ ID NO: 192974 - protein, 45 aa, Triticum aestivum
  unsure (1)..(45): unsure at all Xaa locations
  Clone ID: PAT_TA_87392.pep
XDXLREXKLRIFKPPQIYXXTFYRXRDXXSSRCYSFDLNPNNRMF

SEQ ID NO: 192975 - protein, 58 aa, Triticum aestivum
  unsure (1)..(58): unsure at all Xaa locations
  Clone ID: PAT_TA_87393.pep
FFWRRXIGEXNVPIRCITRWAASVQXDTGXTKARGMTPPQRVLSALRPRSQLSVFNLA

SEQ ID NO: 192976 - protein, 89 aa, Triticum aestivum
  unsure (1)..(89): unsure at all Xaa locations
  Clone ID: PAT_TA_87394.pep
LLVLCFFLCIQVSRMIGHTYLISSEFNHEPLLAXFHIPRPFHNPILCPEPSIEEHRVCRXQFVIFASNELWEHLNNQELWDIVIGQLRM

SEQ ID NO: 192977 - protein, 130 aa, Triticum aestivum
  unsure (1)..(130): unsure at all Xaa locations
  Clone ID: PAT_TA_87395.pep
GGCSKKTKTCKAACSVRSVEGNHITAIGETSVSVQPPANQGEGAPTSKDMASEGSCPNADSYNSDFSEAASRFTVNLDESLLAPKRKKKRGRPTTSRDKVHMRREATKVKVCSICKGKGTINHXPDLVTP

SEQ ID NO: 192978 - protein, 116 aa, Triticum aestivum
  unsure (1)..(116): unsure at all Xaa locations
  Clone ID: PAT_TA_87396.pep
ELQDMINEVDADGNGTIDFPEFLNLMARKMKDTDSEEELKEAFXVFDKDQNGFISAAELRHVMTNLXGEKLNDXXVDEMIRXADVDGDGSXTMCQGHDGQMTPTVLPQEENHCILI

SEQ ID NO: 192979 - protein, 119 aa, Triticum aestivum
  unsure (1)..(119): unsure at all Xaa locations
  Clone ID: PAT_TA_87397.pep
ILFVLSKIRGASSTLSYQIVSSRAILFIHPEYFRSCFFRLDHPEAIIPEEFFVLTFQATVIQLSRCFVQMLVNQLEFFPVILSLSSVISEFLWWSVQDLFPWIIIXIHPFFFQIPPGGQ

SEQ ID NO: 192980 - protein, 78 aa, Triticum aestivum
  unsure (1)..(78): unsure at all Xaa locations
  Clone ID: PAT_TA_87398.pep
FFFYGGKQRPVFNLLKTVRSTTDKQDTKVSVRVEANQIKEYNDHDLTGNENHIKIRSIMYAGTHRVSHXRHKRVDSSI

SEQ ID NO: 192981 - protein, 67 aa, Triticum aestivum
  unsure (1)..(67): unsure at all Xaa locations
  Clone ID: PAT_TA_87399.pep
QIRKSLMPYILDQVCFQQVLEQRARCKCDSGISCLGFSYSFLQCTSKLSHSPRVLVGNSHSPGSTXR

SEQ ID NO: 192982 - protein, 146 aa, Triticum aestivum
  unsure (1)..(146): unsure at all Xaa locations
  Clone ID: PAT_TA_87400.pep
DTVAQAFFDLENGNQELKSDLKDLYINTAIQMDVVGNRKAVVIHVPYRLRKPFXKIHVKVXRDSEKNFNGKMFXLVCNKKIXLSNPRKVLLFKRPXTKTLNTVXXXTXEDVLYPTEFXGKPFXXLLDXAKAQITLTRTQHLILGTL

SEQ ID NO: 192983 - protein, 70 aa, Triticum aestivum
  unsure (1)..(70): unsure at all Xaa locations
  Clone ID: PAT_TA_87401.pep
VCMISNSTSVVEVFSRIDHKFDLMYAKRAFVHWYVGEGMEXEGEFSEAREGPGCXLEKDYEEAGAEGGNE

SEQ ID NO: 192984 - protein, 73 aa, Triticum aestivum
  unsure (1)..(73): unsure at all Xaa locations
  Clone ID: PAT_TA_87402.pep
VVNLVSAVAVETSWSHRGVDFSMVKVSNMSHNALLVDDRALEIIIREINGLINYGLIHLGQRWFKSMLEXRVL

SEQ ID NO: 192985 - protein, 107 aa, Triticum aestivum
  unsure (1)..(107): unsure at all Xaa locations
  Clone ID: PAT_TA_87403.pep
LLDSQSHRLDLRFGDLRMPSLRQCSTLAVATKMKMSKAPVLLKKAVTMCKEQDRRAPQPSSSSSASLRAQGWAPSALCLNKDTRAQWXPPRXGGKGGXCQKVCPFPQ

SEQ ID NO: 192986 - protein, 118 aa, Triticum aestivum
  unsure (1)..(118): unsure at all Xaa locations
  Clone ID: PAT_TA_87404.pep
RCRCRCCSLAAQARAGRRRRTGKDSPGAGAPRQCLTPTGISPSVHHQGSLYQVLPEEXSHPVHRRSSHCXEPLLSNPRYVVXFKRITLXPPDGXNFFQPFLSPYFXLCYAWPFTNNPF

SEQ ID NO: 192987 - protein, 129 aa, Triticum aestivum
  unsure (1)..(129): unsure at all Xaa locations
  Clone ID: PAT_TA_87405.pep
MARTKQTARKSTGGKAPRKMASKSAKKSXPPLGGVKKRTGQGPGTVALREXKXYQEXTRXLLKEXPXPXLXLRETLQDLQTVLXVPKXLAVAALXRSCLSYSXVSFXRHYFCXSKXKXVISSPKXQLSP

SEQ ID NO: 192988 - protein, 103 aa, Triticum aestivum
  unsure (1)..(103): unsure at all Xaa locations
  Clone ID: PAT_TA_87406.pep
PGSPARAAAAATTASATPATVKLHALVRTCVGVRVYVNNERLILMESEQGAFAVCVGCLLVSXAPAQGVLCVYVLFSCSPXISSTYPHLWDGVDEYVXNEKFT

SEQ ID NO: 192989 - protein, 165 aa, Triticum aestivum
  unsure (1)..(165): unsure at all Xaa locations
  Clone ID: PAT_TA_87407.pep
SSKPFEGMGRAKSMRFQTEGAGTFGGFGGGTESKFRLYNDPVGASSSQPRKPPPVETKLTCTLPELYSGSXTRKMKISKEHCQXNGATGALNPEFLTIRYKTGWXKKGPSSHFPDKGNEQPEPLSAISLPHRRKPHDXYMXEXNTADLPEIRLVDHLARTHDLKP

SEQ ID NO: 192990 - protein, 94 aa, Triticum aestivum
  unsure (1)..(94): unsure at all Xaa locations
  Clone ID: PAT_TA_87408.pep
XGFPXALFXSTCIFTFVLTATHENPXGNLDKVXSPFXRIXLLKRLTIPGGXFGISTPIPHGDXTLEPQHYTKGXQTRRFNTSQSATLXXTIXPP

SEQ ID NO: 192991 - protein, 124 aa, Triticum aestivum
  unsure (1)..(124): unsure at all Xaa locations
  Clone ID: PAT_TA_87409.pep
XWPCLXLLRMVIKXFPARCSXPXXTXSXMGXIKLCSGFSXNSKGNDVXFGXPIYFRXFXVMXVFSSSSPIVFSRXDMGYVSXYLXTSGLWSVALLPFQXWVFIFLVGVALSPFHPGSHWILLNT

SEQ ID NO: 192992 - protein, 92 aa, Triticum aestivum
  Clone ID: PAT_TA_87410.pep
WRRCSARASGQKPRRRSAKPRVVIPCVVSSVACGVSSGLSLSVRSVTEYYRKWPSCTAAVLQSTRAVARPAWAGSNGAVKCIKQLDGNKKKK

SEQ ID NO: 192993 - protein, 98 aa, Triticum aestivum
  unsure (1)..(98): unsure at all Xaa locations
  Clone ID: PAT_TA_87411.pep
VTFHRPKTLSKARDPKYPRISTPGRNKLDQYQILKYPLTTESAMKKIEDNNTLRLHPSDLKAXDKKKIRPAVKKMYDIKAKKVNTLXSKPDGKKKLRS

SEQ ID NO: 192994 - protein, 87 aa, Triticum aestivum
  unsure (1)..(87): unsure at all Xaa locations
  Clone ID: PAT_TA_87412.pep
KFSEKSDVFSFGVLILEIVCGRRNSSLIDHEWSMNLXGHAWTMWQEGRASXELIDTLMGHHRTLKDXVCRCIQXXLLCXKGKKRREI

SEQ ID NO: 192995 - protein, 170 aa, Triticum aestivum
  unsure (1)..(170): unsure at all Xaa locations
  Clone ID: PAT_TA_87413.pep
RGQSLHSLLRGVRIQVNXGKPVKTXQIKXGNXPTGXLXKXKRVPHTPRXGXFDLMKSLGREICRVARDGXXAEGRWXLSFVTXLEQSTVVGTPTNNQATTGRAHWNAGIAGYPKPVPRTPNHLGAIIIAPTDIVAPGLDEPATNNHRSPSCSPLQEDAPEEKGASTPPSR

SEQ ID NO: 192996 - protein, 103 aa, Triticum aestivum
  unsure (1)..(103): unsure at all Xaa locations
  Clone ID: PAT_TA_87414.pep
GPVRGISLKLQEEERERRMDFVPEKSALEVDXIRVDKETMGHAXSSGMADLPRRLSAPPEATSCRCPLPPSLTAPWDPRLGPPDPPPYPITLHVLIINPLLCG

SEQ ID NO: 192997 - protein, 88 aa, Triticum aestivum
  unsure (1)..(88): unsure at all Xaa locations
  Clone ID: PAT_TA_87415.pep
AIXXKXXIIAIQPGXHTTYFXLEXXCXIAKFLKLKXAXXIPCXWGIHPKXEXXLRCGFXKSXXGGXVHXHXKVXXKPCRIKLKXGVKL

SEQ ID NO: 192998 - protein, 82 aa, Triticum aestivum
  unsure (1)..(82): unsure at all Xaa locations
  Clone ID: PAT_TA_87416.pep
XXCNRGSKXKKKPXXWALTGXGXHXGHLLQGTSXELVSFRTSPFPITPRLISGEFLVWRDXAPGLSSTVXLLMTPRHLRYCR

SEQ ID NO: 192999 - protein, 154 aa, Triticum aestivum
  unsure (1)..(154): unsure at all Xaa locations
  Clone ID: PAT_TA_87417.pep
ENGTSDSDGDKHGKDRYDDGQHDDANPEEPGPGQATPTSSTETIRDPKRVKRILANXQSAQEXLRVXKXQYTPDSXRCVNAARTCPCCLPWISGAAASSVNTSHGHSLRKTTFPTARSLHIRIKVHPSCMTWRTNPFYLHQSGGLNEGAECTDS

SEQ ID NO: 193000 - protein, 110 aa, Triticum aestivum
  unsure (1)..(110): unsure at all Xaa locations
  Clone ID: PAT_TA_87418.pep
KPXPCFALKLCFLWCLEQASYPKSYPSLCPXLDAALYMSXSXLLSSLXECGXPKXILPSSLCLXQKTLNXVXNSXWXSRXTTINXRHXPGXFTHHRXSLISXAXXXSXKH

SEQ ID NO: 193001 - protein, 111 aa, Triticum aestivum
  unsure (1)..(111): unsure at all Xaa locations
  Clone ID: PAT_TA_87419.pep
WPLLRVGNRAAGACVASSPDSDLEAFSHNPAHGSFAPLGFSTKRDDQCANQRXLSVLVELLLRRGHQXGKTNLSHDGLXPXHFPXGGVEHPTLGXFCLTMXGXXXIQGXKT

SEQ ID NO: 193002 - protein, 76 aa, Triticum aestivum
  unsure (1)..(76): unsure at all Xaa locations
  Clone ID: PAT_TA_87420.pep
XXEPLXISLNGTGHILYTLGFCDEMNLNSWISKCKMKVLGKSFYSXSFNFQKVSISTQFHTINHTKKSNKQSQLFI

SEQ ID NO: 193003 - protein, 91 aa, Triticum aestivum
  unsure (1)..(91): unsure at all Xaa locations
  Clone ID: PAT_TA_87421.pep
KGFSXGXLKHALGXVSPGLXVDPXVLREFPLDXPFVGPGVKLXGXCKFXPRSGGQLXRLFGXSCRRXFXLXXXPLWVPSPCLLGPIPAIFP

SEQ ID NO: 193004 - protein, 82 aa, Triticum aestivum
  unsure (1)..(82): unsure at all Xaa locations
  Clone ID: PAT_TA_87422.pep
LLELRQKFHYRIYPLEWIPKICCYSAKLASPCNIIYCRFTVNILWSCSSVFLGLIPSFLRLPFFPGAWEEXFCKTSTHTTCA

SEQ ID NO: 193005 - protein, 60 aa, Triticum aestivum
  Clone ID: PAT_TA_87423.pep
VESATKYLLSKLKDLQFFVGESMHDDGGVVFAYYKEGAADPTFLYFAHGLKEASANPTVC

SEQ ID NO: 193006 - protein, 47 aa, Triticum aestivum
  Clone ID: PAT_TA_87424.pep
YSRFFKGKCPDAYSYAKDDQTSTFTCPAGTNYQIVLCPARNDLHMDQ

SEQ ID NO: 193007 - protein, 59 aa, Triticum aestivum
  Clone ID: PAT_TA_87425.pep
SYLDFIRYLVLSTGKRTFSPSRRRSRETTAEVACCRSTPPPRASAVPTARGWPAHPRRQ

SEQ ID NO: 193008 - protein, 81 aa, Triticum aestivum
  unsure (1)..(81): unsure at all Xaa locations
  Clone ID: PAT_TA_87426.pep
DKKQFISHMKRYIKNLSAKLEGDDLDVFKKNVESATKYLLSKLKDLQFFVGEXSMHDDGGVXCSAYYKGGSAGFNFPGTLG

SEQ ID NO: 193009 - protein, 49 aa, Triticum aestivum
  Clone ID: PAT_TA_87427.pep
VIFSWAQRRQTAPFLPGDHLVFFMLNVFTVIGLMLTFRPFYARNGTSNH

SEQ ID NO: 193010 - protein, 130 aa, Triticum aestivum
  unsure (1)..(130): unsure at all Xaa locations
  Clone ID: PAT_TA_87428.pep
KSLSAPRSESRRVRRKEGKPERVLAEAEGGREREGKGLLAAKTTAAKTAEKXKGKKAPISRSSRAGLQFPVGRIHXRQLKQRIKANGRVXGATXAVYSAAILXYLTAEXLEXAGNXTRQGQALTLQIGIL

SEQ ID NO: 193011 - protein, 112 aa, Triticum aestivum
  Clone ID: PAT_TA_87429.pep
TGMQRTTRTSGSTPLPCKNKRTYFGKVWLRFCRHLSIMWFYFGGEKHCIEFMIFNECVSHCRYRFHHTKYAANVDHYQNIAIVNIHSAYKVYNGPWQIAASSKQAKSMLGRC

SEQ ID NO: 193012 - protein, 145 aa, Triticum aestivum
  unsure (1)..(145): unsure at all Xaa locations
  Clone ID: PAT_TA_87430.pep
RTGLDMLAKHYGDASGFEIVFFLPDSEDDFVSYTEFLRYLXSKSRAGVVKVDAGTTLFLGPPSGFLTNVLQVGWSRSAFMRGTAIPQMSQCCCPNCTDWPKITAYGGENPKYWPAGTHKSRYGTYLENHRTSIPISTGPTEGNGN

SEQ ID NO: 193013 - protein, 84 aa, Triticum aestivum
  unsure (1)..(84): unsure at all Xaa locations
  Clone ID: PAT_TA_87431.pep
RGLLSESQTLRFSSMRVSMRQASVKEREREQERPHSLVWARVLNLEPWGLGLKRLNSMQSAARHLKGPAQDGRFXKGKESTRQP

SEQ ID NO: 193014 - protein, 97 aa, Triticum aestivum
  Clone ID: PAT_TA_87432.pep
EADGFRCLTQFVLGADSPGQVVFQPGALPKAEYVELRTGLLVAKEEAAGNNGGDWVDTGHQEPAVPSPARVRILYFRYCDRRPEKANLHSTAPRAHP

SEQ ID NO: 193015 - protein, 170 aa, Triticum aestivum
  unsure (1)..(170): unsure at all Xaa locations
  Clone ID: PAT_TA_87433.pep
AIPTKRDKRSDSPISSTTPLTRSGSLSKKPSLLKTSSVRVQTPSDPKRLAPLRSYADRYNDDPKESEQTPKKSKNSSKSLLKLGASQRKKNTALLLWMTTGLPGHQDGTTFPEYFCSLNLSNGQSAIXPXDIKFFNGYXNTIQSVXVIIYXQDXDSREIPVPLTGSPKKK

SEQ ID NO: 193016 - protein, 119 aa, Triticum aestivum
  Clone ID: PAT_TA_87434.pep
GFSSQAGSNPSRGFNSGFSSQDGSNNIPPGFSSAFSAGFSSQNGSNQAYGSTFSETRLLDNLFGSHTNQYQPQISRHTSDIEFIDPAILAVGKGRMPGVSDSGLDLKNAPFPSTIADIK

SEQ ID NO: 193017 - protein, 86 aa, Triticum aestivum
  Clone ID: PAT_TA_87435.pep
ELLIRKLPFQRLVREIAQDFKTDLRFQSHAVLALQEAAEAYLVGLFEDTNLCAIHAKRVTIMPKDIQLARRIRGEEGLSCPLRRRR

SEQ ID NO: 193018 - protein, 150 aa, Triticum aestivum
  unsure (1)..(150): unsure at all Xaa locations
  Clone ID: PAT_TA_87436.pep
KTKGMDLVPPVPWTTHNRNSMLWCSLDHTKLSRRMEASSFKLIPVPVQLRQLIHPGTNLGMLVRPCSGMAMLNTHGVTXSWRTTSPRAPHHNIEVTYAVLTNAXGGQSSYPVQQQXPGSTTANLPGSMVKXHTXXGGPGTNXPKMILLPP

SEQ ID NO: 193019 - protein, 81 aa, Triticum aestivum
  unsure (1)..(81): unsure at all Xaa locations
  Clone ID: PAT_TA_87437.pep
SIEYISSEKQLLCAEYISSENVLLCINFNEVGSGXPVNSPTPGPSNSLLCVEGHVHLWANSTASSVRTCARSNFLFFSWGV

SEQ ID NO: 193020 - protein, 76 aa, Triticum aestivum
  unsure (1)..(76): unsure at all Xaa locations
  Clone ID: PAT_TA_87438.pep
DSSSDDVAKGWAGIHAIPRTIWLDSHGKQLLQWPVEEVESLRGNEINHQGLXLKKGGCFEIXGADISXADVEIXFC

SEQ ID NO: 193021 - protein, 60 aa, Triticum aestivum
  unsure (1)..(60): unsure at all Xaa locations
  Clone ID: PAT_TA_87439.pep
APFXGNWXXGPPPPXXXXFYLAQGIQRXXPINPGSDPSXLQHXXVQLCSSSVNFKXXXKN

SEQ ID NO: 193022 - protein, 136 aa, Triticum aestivum
  unsure (1)..(136): unsure at all Xaa locations
  Clone ID: PAT_TA_87440.pep
RASWRIISSIEQKEESRGNEAYVASIKEYRTRIETELSKICDGILKLLDSHLVPSATAAESKVFYLKMKGDYHRYLAXESKXGAERKEAVEKXLVAYXXTQDIPXADXPTNQXIXLGFQFQTRIPQTLNPRIYELC

SEQ ID NO: 193023 - protein, 69 aa, Triticum aestivum
  unsure (1)..(69): unsure at all Xaa locations
  Clone ID: PAT_TA_87441.pep
VLDGXTGFTXGKXPGTAVQHIRFGARQTHTGGVLFDAGVLREQASXQPVRHAPAARPAMHDVATKALAT

SEQ ID NO: 193024 - protein, 131 aa, Triticum aestivum
  unsure (1)..(131): unsure at all Xaa locations
  Clone ID: PAT_TA_87442.pep
LIWXIATSLLGXKCPLQNKTXMGAHXQXXVTLSGYCTYLVSLISGAASKTIRTGRPTCXKEMQXHLKNALGGVWRYHLSFXMHQXXTTGLXFPKEQXGDXDVQEGXHFGDXVPGRWTKEESFGTNGALADS

SEQ ID NO: 193025 - protein, 115 aa, Triticum aestivum
  unsure (1)..(115): unsure at all Xaa locations
  Clone ID: PAT_TA_87443.pep
RWRCSRASGSSATSARRRGTRSRPSSADRSIHRISPDVCFRSFRSSPLSCFMXYCLDRIPSGLCSFFFPVVVVIWLFXSXLRHFLMHVXNVCHXIXIYLVXNPLDXNIYXXSWFL

SEQ ID NO: 193026 - protein, 104 aa, Triticum aestivum
  unsure (1)..(104): unsure at all Xaa locations
  Clone ID: PAT_TA_87444.pep
MGSDTETEKKKTPVALAPIAKPLAGKKXSKENLKSFRRAPEAXALKRGVKEWSKRSAVWNKGLCFISREXFSXRLCLHNFPXFFXEXXSQXIXXPQXVKGKGNF

SEQ ID NO: 193027 - protein, 80 aa, Triticum aestivum
  unsure (1)..(80): unsure at all Xaa locations
  Clone ID: PAT_TA_87445.pep
ALLNNMMVVHAYNCGCSKEPDVTLFLXFSFLDVFCSNMLAQLLFLGVLHLCVFLQGIFPCVIATSXYLKIKVSYIIATLV

SEQ ID NO: 193028 - protein, 152 aa, Triticum aestivum
  unsure (1)..(152): unsure at all Xaa locations
  Clone ID: PAT_TA_87446.pep
MAPKADKKPAAXNKVEKATEKTPAGKKPKAEKRLPAGKTASXEAGGEGKTRGRTKGIXXNXGVDXFKXYIFXVXXAXXPDIXISSKAXXIMNSXIXXXLPXXPRGILPSXAXXTXNLXHSRXXXSXVXXXLRGNLSLATLYLRLFNAVLFKP

SEQ ID NO: 193029 - protein, 72 aa, Triticum aestivum
  unsure (1)..(72): unsure at all Xaa locations
  Clone ID: PAT_TA_87447.pep
KXSSSXAYXSILLAYKXXXXTXQVQRKHXXQALHTGQMNGXRXNXLQARTXGFXSKSXXEQELXQLSSYQPS

SEQ ID NO: 193030 - protein, 119 aa, Triticum aestivum
  unsure (1)..(119): unsure at all Xaa locations
  Clone ID: PAT_TA_87448.pep
MAVGKNKRISKGRKGXXKKAVDPFTKKXWYDIKAPLLFXXRNVGXTLVSXTHGXNIAXXGLXHRVFEXSLADLHNXEDXAYXXITLRAXDVHXXNVLTXNFXGMXLHIXKLRSLLRVYI

SEQ ID NO: 193031 - protein, 68 aa, Triticum aestivum
  unsure (1)..(68): unsure at all Xaa locations
  Clone ID: PAT_TA_87449.pep
GXPAXEXQMXXDVVXFLSWAAXXEMEERKLXGVXWXFLLSXALLQAAXXRRMXWXVLXXXKLXLDVXX

SEQ ID NO: 193032 - protein, 136 aa, Triticum aestivum
  unsure (1)..(136): unsure at all Xaa locations
  Clone ID: PAT_TA_87450.pep
QTPVFFFLWKTFCGVICLGVRSANQLSKNKFMFNHGVRSIWRPIESTLHALLQDQGGHRSAASCTQQVSIQLTFFKKRFTGMXDLLCCLMHDNTNEGPAQLPGRVSKRFPSFFPFFLFFGDKAFLFSTXTKDFIFI

SEQ ID NO: 193033 - protein, 67 aa, Triticum aestivum
  Clone ID: PAT_TA_87451.pep
ALVHRRAGAGAGAGRRRGPSIQALLLRRISRCVRRRGWGQGRRHGAFQALITCRLNFLYTHVFWIIL

SEQ ID NO: 193034 - protein, 97 aa, Triticum aestivum
  unsure (1)..(97): unsure at all Xaa locations
  Clone ID: PAT_TA_87452.pep
XLXCMHCISVQGSYXAGFXSXSILPSIILIVPVPFCKENKCTHXRQEDSTLLLYTYITKQQAASSSSSLLLTPTVKICLIIQFHDSSLTSSSSLPSD

SEQ ID NO: 193035 - protein, 58 aa, Triticum aestivum
  Clone ID: PAT_TA_87453.pep
LLCARPRPPRLWTSCDHGRGTEPSTSSAGADLNLPGDACAARASCPVCHCKLECFFRS

SEQ ID NO: 193036 - protein, 50 aa, Triticum aestivum
  Clone ID: PAT_TA_87454.pep
GTPNVIKKSCAIEGLCVCSSDLHCAPEQGYLCKPGKVYKEARVCSFITDY

SEQ ID NO: 193037 - protein, 97 aa, Triticum aestivum
  unsure (1)..(97): unsure at all Xaa locations
  Clone ID: PAT_TA_87455.pep
PNHAINRGAWEISDSQQESGDXHRSCRLYXGIRIPIFTHAFFLLWLIHSHTLGAPSALIHAFLXHSQTCSKSKDACGWLXRGRRSICQLRAAXTXXK

SEQ ID NO: 193038 - protein, 87 aa, Triticum aestivum
  unsure (1)..(87): unsure at all Xaa locations
  Clone ID: PAT_TA_87456.pep
XFMNAHPNIGSIKLLSKKIARIYIIWFTIPNKLRHCTYYIVLHCRRAAPSCIFTCICQDITTCDAVKLTKLDNTILIVGRSPRLVST

SEQ ID NO: 193039 - protein, 125 aa, Triticum aestivum
  unsure (1)..(125): unsure at all Xaa locations
  Clone ID: PAT_TA_87457.pep
FTRYAHFIPLSHPYTVMSVAQAFVDNIIRLHGPPKLIIYDRDRIFTSKLWKDIFTALKSELRYNTTYHPQTDGQTERVNQCXETYLRCMTTDQPKKWALGISLAESWXYNTTYHTAPGRCLPSKL

SEQ ID NO: 193040 - protein, 83 aa, Triticum aestivum
  Clone ID: PAT_TA_87458.pep
QLYQEYGGHHQTKCVMNMEVSYIRCLIGWIAKKFDYINRVTQLFRFQSTRVHGHTLPSRCYASPRYILHDHRKILKLLRSPTI

SEQ ID NO: 193041 - protein, 65 aa, Triticum aestivum
  Clone ID: PAT_TA_87459.pep
NMSTYIHLSDKYFRTKGVKKKIETNTTSPWQHIFIYSAPNIHVINQLWLQASCPRVSPYSSRPVS

SEQ ID NO: 193042 - protein, 72 aa, Triticum aestivum
  Clone ID: PAT_TA_87460.pep
PFLERIQNKIRTVYEAITCTRRTDVVQHQQEQPRHSMHRHQPRPRLAHQPTTRPPRPDQPGSSTWHPQHYGP

SEQ ID NO: 193043 - protein, 78 aa, Triticum aestivum
  unsure (1)..(78): unsure at all Xaa locations
  Clone ID: PAT_TA_87461.pep
MCARXGMTVRINQHCAERTDGANLPKNLELDGIFLSICNLLPGNITVAGILGGMKLLPLLWHRRKNVLAPWGCTISKS

SEQ ID NO: 193044 - protein, 92 aa, Triticum aestivum
  unsure (1)..(92): unsure at all Xaa locations
  Clone ID: PAT_TA_87462.pep
SDLSKSXSADQAEAEAANSXLPVXIGVLSRLLNNGIPDESITGXKKHQISFNPLKLRMISNXRXFKGMXFCXPEDQKLXGGXLPLINNQXVI

SEQ ID NO: 193045 - protein, 56 aa, Triticum aestivum
  unsure (1)..(56): unsure at all Xaa locations
  Clone ID: PAT_TA_87463.pep
GNXIXPXRSLGAXXIYXNKQAWDDXWIFWVGXFIXAXLVAIYHVXVIXEIPXKRRD

SEQ ID NO: 193046 - protein, 42 aa, Triticum aestivum
  unsure (1)..(42): unsure at all Xaa locations
  Clone ID: PAT_TA_87464.pep
XXVLNEKNGEENDTCATNEXESXFRRKVRTELLKKSTTKRIS

SEQ ID NO: 193047 - protein, 103 aa, Triticum aestivum
  unsure (1)..(103): unsure at all Xaa locations
  Clone ID: PAT_TA_87465.pep
QKSXVXPESXVXXQGXXXKARPGTPVSSRGLXLVRXASGQALRQASVXWIPXALDPSXGMXXXDPLXVXSRASXGSRPLDPIDRRSRERXVGFIPSXCGXSVA

SEQ ID NO: 193048 - protein, 118 aa, Triticum aestivum
  unsure (1)..(118): unsure at all Xaa locations
  Clone ID: PAT_TA_87466.pep
FASMTPFLIGSVVLDSTQGVLSGVSRGCGWQHLXAWTNLVAFYIIGLPLSLLXGFKLGFHTKGLWMGQDMRLLCQNASCSSPPEQSGKRLLGDKHKEGDLIRLEIYKLVSLTNMGLKF

SEQ ID NO: 193049 - protein, 110 aa, Triticum aestivum
  unsure (1)..(110): unsure at all Xaa locations
  Clone ID: PAT_TA_87467.pep
LVLSAYKSLLVPSLRIPVHYESSLLIRFVHIHGEEKDPVGLDWSAIEQSIRDGDLPFDGQSLKFDLHSVKYSECSICSFAIARSTHSFTSRXLFENYTMIVSEYLGLPSG

SEQ ID NO: 193050 - protein, 69 aa, Triticum aestivum
  Clone ID: PAT_TA_87468.pep
VFTAGEHSGSTLAMLGPVLSFTGAIERAVVGGTGAFRMARGYCVMMAAGNPTPDSIVYEVDLFVKMDYA

SEQ ID NO: 193051 - protein, 67 aa, Triticum aestivum
  Clone ID: PAT_TA_87469.pep
SPIPRLPNLGVVLLGNKDWDRFFLLAHDLCYRLIWILIAGVQNCCYVMDLVAHGSITFALGLVFSSA

SEQ ID NO: 193052 - protein, 135 aa, Triticum aestivum
  Clone ID: PAT_TA_87470.pep
QLQLRTSIAGCLMVSDNLEGSSRPLHGSGTIATSGEAGARWVTSAAVRENQALRAGMDSMRLRLAELERECSGMRQDIRKLGGAAGKDGWAARVQRMFSLKMKLQMCSTEGKMNDRHASAKLVSCPRCPVTRSTH

SEQ ID NO: 193053 - protein, 80 aa, Triticum aestivum
  unsure (1)..(80): unsure at all Xaa locations
  Clone ID: PAT_TA_87471.pep
MARRSGGGRSSRPAPRAAPVRNPPAPARQAPPPATTQXSGGGYHXXGFXXXMAQGXGFGNXIXXXQKGXXXKRXPLQLNF

SEQ ID NO: 193054 - protein, 50 aa, Triticum aestivum
  Clone ID: PAT_TA_87472.pep
LFFLVRERCFFCPVSCSWSTMLHFLSDHVKFLVTMAWRNYFFFATRQKKK

SEQ ID NO: 193055 - protein, 99 aa, Triticum aestivum
  Clone ID: PAT_TA_87473.pep
NSSSTERYPLVVDLHPAPSLMSRLISSSLRPLLPLQAWRMPAICCSPKMPPLPLMLLKRVCMSSSVAPAVGPSAAKAETTIRQARRNRDTRVDAFMFCW

SEQ ID NO: 193056 - protein, 132 aa, Triticum aestivum
  unsure (1)..(132): unsure at all Xaa locations
  Clone ID: PAT_TA_87474.pep
MAPKVAVAKKGDAKAQAAKVAKAVKSGSIKKTAKKIRTSVTFHRPKTLSKARDPKYPRISTPGKEQIXDKYQXLKYPLXTTXSAMKKIEDNNTLSHVDLKATRRKXKGAVKEMYDIQAKEVNTSIKXDGKKK

SEQ ID NO: 193057 - protein, 66 aa, Triticum aestivum
  unsure (1)..(66): unsure at all Xaa locations
  Clone ID: PAT_TA_87475.pep
RPTASRXSCRATLEADSWCFRGAGNWNAGAEXCAFDQLVVLVWHHRXKSWFCFKLLYXIVIHLIGY

SEQ ID NO: 193058 - protein, 108 aa, Triticum aestivum
  Clone ID: PAT_TA_87476.pep
LLPSSCPTQNPLGTLWCRLASPISGESPGKELQRVNMERLHHIADLAQSHSQQLFRLIPSFRLVATKGRPNHLRPPSETDHRVKSQSLRCGYCEDWLCISCKMTWRAR

SEQ ID NO: 193059 - protein, 90 aa, Triticum aestivum
  unsure (1)..(90): unsure at all Xaa locations
  Clone ID: PAT_TA_87477.pep
YHXFPFRGSYLQFCXHGFIXIPVLXISXQFLLPQLRRXPPLPGKTPVRQAAQKEQAGNNAPPQPTSLCSAILHKIGGCFIHLPLENDYSC

SEQ ID NO: 193060 - protein, 91 aa, Triticum aestivum
  unsure (1)..(91): unsure at all Xaa locations
  Clone ID: PAT_TA_87478.pep
SSLAFASSGLWHIQCFPPCRHDFSLHCLLXAPWMSLYSLFWSAKYLRRLGLVCFVLAILHFGLLKCDLTCNLSVFLQALPCNNQHHGILTG

SEQ ID NO: 193061 - protein, 52 aa, Triticum aestivum
  Clone ID: PAT_TA_87479.pep
YEETRGVLKIFLENVIRDAVTYTEHARRKTVTAMDVVYALKRQGRTLYGFGG

SEQ ID NO: 193062 - protein, 103 aa, Triticum aestivum
  unsure (1)..(103): unsure at all Xaa locations
  Clone ID: PAT_TA_87480.pep
TWXFVXXLVTCXDXXAVXARXGVVGKGIYXLVNXVLPCWGXSHCWIYSIXSLXIXLDRPXVKYILHLYQGHNXNRDKNYYSLLSSXWLNFKISPTKVDGKWWN

SEQ ID NO: 193063 - protein, 158 aa, Triticum aestivum
  unsure (1)..(158): unsure at all Xaa locations
  Clone ID: PAT_TA_87481.pep
VILRALGYTRETQIYVASGQVYGGKNRMAPLRNMFPNLVTKEELASTAEMEHFRKHVTSLAALDFLVCLKSDVFVMTHGGNFAKLIMGARRYSGRHRLKSIKPDKGLMSKSLGDPYLGXWASFTXDFVISQQXPRRLPEXNFPGYDSGRTPHPCMCKA

SEQ ID NO: 193064 - protein, 146 aa, Triticum aestivum
  unsure (1)..(146): unsure at all Xaa locations
  Clone ID: PAT_TA_87482.pep
LMETSIAESTDFLPEVQTLSKVHHKNLVTLKGYCQNKKCLALVYDFMPGGNLQQLLRGGDIXYLHELCTPSISAQEMLKTPNILLGQEPXVGIIXDLGFRRXFNDAHTHISTVAAGILGTRPDTSNFQPTSRQTWDLLWGIRQPQY

SEQ ID NO: 193065 - protein, 118 aa, Triticum aestivum
  unsure (1)..(118): unsure at all Xaa locations
  Clone ID: PAT_TA_87483.pep
RDPCFWCSCHMQYWTARQMLITHLEGLXCSHPQQTMHGXTDVXVPPXNSALRSXMEIPAENPFLIAANQIRVRHSINFCWRSTRPASNFPFKSRHRSSKSEVEKDTAEEAREDWRRQT

SEQ ID NO: 193066 - protein, 78 aa, Triticum aestivum
  unsure (1)..(78): unsure at all Xaa locations
  Clone ID: PAT_TA_87484.pep
RPRADFGNALIFFQLTXNSAIKDHMMGLAEGSITNGTMVHFNEHGSISXXTVXVAPRHRLNNXMGXKRPLHDXVSXRS

SEQ ID NO: 193067 - protein, 110 aa, Triticum aestivum
  unsure (1)..(110): unsure at all Xaa locations
  Clone ID: PAT_TA_87485.pep
LVTYPTFRTSASLSLAPPPPSPXPPVRTPRPPKPVKPHAPPSASRPSPXPETLPRLRRPPQQLAVPHPPHRMRIRCRSHXPPDQPPRPPPPRSCPDVRLVYRATAITAPS

SEQ ID NO: 193068 - protein, 57 aa, Triticum aestivum
  unsure (1)..(57): unsure at all Xaa locations
  Clone ID: PAT_TA_87486.pep
CXGGXTGYVPXGLVACXLRXLLLRYQPLNXELLCRRNLIRDSTKAGLQIKHSELELQ

SEQ ID NO: 193069 - protein, 104 aa, Triticum aestivum
  Clone ID: PAT_TA_87487.pep
HFVSEQTASGGLRISENKPDVVRLTFAPGAVPALRRLRLYLNPMEMASDFFVDLGVQHLSGLAQLEFKINCNRAARGRVEALGVFRLKKQSTCTPTVKPCPQDP

SEQ ID NO: 193070 - protein, 167 aa, Triticum aestivum
  unsure (1)..(167): unsure at all Xaa locations
  Clone ID: PAT_TA_87488.pep
DPRKSELQNRLRFFSCGIALGNGCVLLDGGFAANCTERDVFASXLFIAEQRAALXHREHDIGIRAFEPEERNLAAIKTGDVAYAPYRLRNAAASVSDRWIAVSQEQAISNYLRWPHEQRSDRLVVTVNRPTALLDLVRAGAGVAVLPCFVGDADAQLMRDGGEIEEL

SEQ ID NO: 193071 - protein, 38 aa, Triticum aestivum
  Clone ID: PAT_TA_87489.pep
VERLAGEEGLAVGEGYFTDFSQEKIVELYMEKSAQAEA

SEQ ID NO: 193072 - protein, 87 aa, Triticum aestivum
  unsure (1)..(87): unsure at all Xaa locations
  Clone ID: PAT_TA_87490.pep
FLDSKXXEGHFLRLSGLXXELXXAHCFIDLALXSGDQSDILLDWMQKADKFRYPDLTEAFEMWCYRSKTAIRRLNGATDKGCNPISL

SEQ ID NO: 193073 - protein, 91 aa, Triticum aestivum
  Clone ID: PAT_TA_87491.pep
MAGQLKAKILAAAAVAVVVASSLVGTASAADAPAVAPTSGATGAAPAFAACRRRRSATSARSNAPVGAVRAAPFRGISCCGLSGIPFPWFF

SEQ ID NO: 193074 - protein, 136 aa, Triticum aestivum
  unsure (1)..(136): unsure at all Xaa locations
  Clone ID: PAT_TA_87492.pep
LRQSVEAMAQVGAEAEQGHSQERTVRFQMDSVRTWASAALTDGDMCMEXGFRGXAAGGGGVXEAVRGHVAGLLHLTGNALCIVGAMATKRRRHPGNIHALCVSLLSLFLFNCMCYNSKCTCSGFPCIQYLQVLKKK

SEQ ID NO: 193075 - protein, 34 aa, Triticum aestivum
  unsure (1)..(34): unsure at all Xaa locations
  Clone ID: PAT_TA_87493.pep
FFCCTSILSTSATCFKLTPCCIIGTSFQSGXXFX

SEQ ID NO: 193076 - protein, 82 aa, Triticum aestivum
  Clone ID: PAT_TA_87494.pep
IKVVPLCYHGRVNSPSYFIPTDQLHYLSSLNTGPFDTSMMCGSASHGQVGDLKKKGSPVHVAPACAGSREGPDHFGSIKLAM

SEQ ID NO: 193077 - protein, 93 aa, Triticum aestivum
  Clone ID: PAT_TA_87495.pep
PLRPISPLSCIPTVYVTSTIVQSDLRLNTNVLPADSPVQDATEPNDDTSRELNSASAIKADTTPQTSMINAAGITPRILPRPAALAAGVHDAL

SEQ ID NO: 193078 - protein, 118 aa, Triticum aestivum
  unsure (1)..(118): unsure at all Xaa locations
  Clone ID: PAT_TA_87496.pep
EAEAETPACKDCPTYCSSRCGRGIPSLASSENWYACKGPCGSAPDCMETCKSTGPARCTGRCRRSCSHVDYEATCRKNAAFHASSANEQLNSIIQXALPAAPPVQHNLRQHLNGPTGR

SEQ ID NO: 193079 - protein, 135 aa, Triticum aestivum
  unsure (1)..(135): unsure at all Xaa locations
  Clone ID: PAT_TA_87497.pep
FPXDRSHMPXXYPXYHMGISGXXIPLTEIXTQKQLYEKLLASSNXGITEHIESVSVIFPILFGEPIERLSDGFHSLQGGVFLQSSPYHQMNSLMNQLMNHQLAHHNPCRDPMNQLMNHQMNSLMNQLMNHQMNSL

SEQ ID NO: 193080 - protein, 85 aa, Triticum aestivum
  unsure (1)..(85): unsure at all Xaa locations
  Clone ID: PAT_TA_87498.pep
ARCAPKCEKTVQALLCRNLNVKSATLLNATSSRRIRLQDDIVTGFHFSVSERFVSGSTFKASTIDLIREGLIVLXKVXVGGSIEE

SEQ ID NO: 193081 - protein, 126 aa, Triticum aestivum
  unsure (1)..(126): unsure at all Xaa locations
  Clone ID: PAT_TA_87499.pep
PAPSWPSEGKINLENLRVKYRENAPTVLRGITCTFAAGNKIGVVGRTGSGKTTLLSALFRLIDPSGGRISSDDVDIXTIGLKDLXRMKLQHHPXQEPTLSXGSXTDNVDSPGLFTDLXIRGSIGXX

SEQ ID NO: 193082 - protein, 124 aa, Triticum aestivum
  unsure (1)..(124): unsure at all Xaa locations
  Clone ID: PAT_TA_87500.pep
MAPVKLYGATLSWNVTRCVAALEEAGVEYEIVPINFGTGEHKSPDHLARNPFGQVPALQDGXLYVFRSRAICXYACRKEQXXLLKEGDIKDQQWVVCGPSGXHQYTAVXTHLFQCLIXPILGEH

SEQ ID NO: 193083 - protein, 124 aa, Triticum aestivum
  unsure (1)..(124): unsure at all Xaa locations
  Clone ID: PAT_TA_87501.pep
KVLFLRYEDMLQDPTDNTKNLAAFMGCPFSXPEXEAGVVQEIVQLCSFEKLKSSEVNKNGSSAMMGVNNDVYSXKGAVXDWXKNYMTPEMAARLGQDRPRPSRSSLTLGSPMLKGWGSELLHEA

SEQ ID NO: 193084 - protein, 73 aa, Triticum aestivum
  unsure (1)..(73): unsure at all Xaa locations
  Clone ID: PAT_TA_87502.pep
NGFEINAILTGFAHWXDLLSGXVXLVFCNFMLELFGLXSPVLVXFAQHCPNGLAIYRWKLWHGYHAQVNFGKM

SEQ ID NO: 193085 - protein, 174 aa, Triticum aestivum
  unsure (1)..(174): unsure at all Xaa locations
  Clone ID: PAT_TA_87503.pep
MAPKVAVAKKGDAKAQAAKVAKAVKSGSIKKTAKKIRTSVTFHRPKTLSKARDPKYPRISTPGEEQLHSISXLKXPXLTTDSAMKKXXDNNTLLFIVXLKADKKKLRPCQXMXDIXAKKLTXLIRPDGXKRVRLTQTTSLIGQKFHYRACIALFWYGIVLYYKGQWCNLNFINQ

SEQ ID NO: 193086 - protein, 79 aa, Triticum aestivum
  unsure (1)..(79): unsure at all Xaa locations
  Clone ID: PAT_TA_87504.pep
MSCCGGNCGCGTACKCGNGCGGCNMYPEVEAAGATLLVSATATHKASSGGMEMAAENGGCGCTQCKCGTXSCXCSCCSC

SEQ ID NO: 193087 - protein, 107 aa, Triticum aestivum
  unsure (1)..(107): unsure at all Xaa locations
  Clone ID: PAT_TA_87505.pep
LRRCTTVGYHKWETSRVKXAKRGVHGAAIIPCRAFTMLSXISSIVSFMRSDVTLLPQRCPYLYVLRARALRTVEGARVDWVPAGRQPCVVVRDLVRLREKGDSAWLR

SEQ ID NO: 193088 - protein, 99 aa, Triticum aestivum
  Clone ID: PAT_TA_87506.pep
GMDYRKFCCIMAPYFQSTICFARALCNALNKSSADLSRVNLQKLQPKSYPYMLVTSLMVSFGREHVCPSVNPGRGMNSVSISSLVEPEDSLPGTHKSFA

SEQ ID NO: 193089 - protein, 93 aa, Triticum aestivum
  unsure (1)..(93): unsure at all Xaa locations
  Clone ID: PAT_TA_87507.pep
LQLFVGPLKSFXVLPVNTIFSRQDLIHEVLLFPIAGXFLPPCSVRCPVFGPSLLQPTPLASWPFPCSLPSDAVPGSTGAENNLQCHAAYIVAP

SEQ ID NO: 193090 - protein, 58 aa, Triticum aestivum
  unsure (1)..(58): unsure at all Xaa locations
  Clone ID: PAT_TA_87508.pep
YFXXXIAGGKETGCVALPSNTPNFLMKYHDRHRQXQQEEENGKCRLHDRGXTNKNQPN

SEQ ID NO: 193091 - protein, 139 aa, Triticum aestivum
  unsure (1)..(139): unsure at all Xaa locations
  Clone ID: PAT_TA_87509.pep
PNRTFLPXQDVLSRIKTMVSTLRSLNIPIRVSIGDRTNMCPSXGLDGSLYFGDYKTFXXDNENKRXVLLPTQAVFSLTPIASMVDELTIQYPADVPXVSGWLRAXKRPTPAEVGSHATRNDWLETFWAAMXPSSRTSXX

SEQ ID NO: 193092 - protein, 91 aa, Triticum aestivum
  Clone ID: PAT_TA_87510.pep
RASVKMALQSIVASNRDDALYRCKMPRILTEVKGCGRHQHEGAKSELEATYSRNSYTPSSFYPKALKYNVGITQLLKKPLKKTQWLLMEQT

SEQ ID NO: 193093 - protein, 143 aa, Triticum aestivum
  Clone ID: PAT_TA_87511.pep
LQYARHELHGNTHTTAQRRLTRYLVLPNTVSNRSDLSTTTLGKVDGGAAAAAVGAGRAGGDVVVVFAAASAPAPSVFLLLGDGVQASLRCTAKAEPLQPHDVEGLRRGRLVGGEAEDGAGRCGRSHDRRVSCCAISWGDAETE

SEQ ID NO: 193094 - protein, 198 aa, Triticum aestivum
  unsure (1)..(198): unsure at all Xaa locations
  Clone ID: PAT_TA_87512.pep
RQGSLVRLLAYCNEGKERILIYEYMQNKSLNFHIFGNVNLRASLNWARRLELIQGIAHGIAYLHGGSGDNVIHRDLKPGNILLDDEWKPKIADFGTAKLFAVDQIGAXIKTIVVSXGYAAPEYARQGNMTLKCDLXSSELSLGDTNGQRNVDQGPLRLGIWKQMMQNLANKVHHNQLCQLNITNWAPGQEITTISITS

SEQ ID NO: 193095 - protein, 180 aa, Triticum aestivum
  unsure (1)..(180): unsure at all Xaa locations
  Clone ID: PAT_TA_87513.pep
TVPLGRRDSTTASASLANSDLPGPSSSRSQLEAAFLKKNLNTVDMVALSGAHTIGKAQCSNFRTRIYGGDTNINTAFATSLKANCPQSGGNTNLANLDTTTPNAFDNAYYTNLLSQKGLLHSDQVLFNNDTTDNTVRNFASTRRLXSAFTTXMIKMGKCAAHRDQGKLGNCSESGYARTT

SEQ ID NO: 193096 - protein, 200 aa, Triticum aestivum
  unsure (1)..(200): unsure at all Xaa locations
  Clone ID: PAT_TA_87514.pep
AYLPKTETEEGYPPQVSKSSSGRFSNGANLADTVATSIGFEQSPPAYMSLNGGLNIWGANYASAGAGIKISTNGERSISLPKQLENFKVTRGQMENKLGGDAKMRELLSKSIFLISIGGQDLDXRWNSSPDIRGSRPSSXXHSLYGDLSLLYDMGARNWNRQLGSSVHAHLQYNATLNSTLHRLPKVLKIGSKRLHALQN

SEQ ID NO: 193097 - protein, 80 aa, Triticum aestivum
  unsure (1)..(80): unsure at all Xaa locations
  Clone ID: PAT_TA_87515.pep
TXSXXXTXAXLSNRRIMXMCLXRXISVLLNLPXKXLISVVLRLDIDGFXIXSXWVLXSXKQFTLXTXXXTXXSIXSXTXT

SEQ ID NO: 193098 - protein, 79 aa, Triticum aestivum
  Clone ID: PAT_TA_87516.pep
LYFPKSKKIGLQHIYTCRQTIQLTRIEPRNNKKKRQQRWMLKQANFTEVTRMKTSNGDGVILHHACTSWTHMHALSCTS

SEQ ID NO: 193099 - protein, 47 aa, Triticum aestivum
  unsure (1)..(47): unsure at all Xaa locations
  Clone ID: PAT_TA_87517.pep
MGNPEKLMAQIFDLKFTSKSLQRQARKCRKXEKEQKLKVXKAIXKGX

SEQ ID NO: 193100 - protein, 154 aa, Triticum aestivum
  unsure (1)..(154): unsure at all Xaa locations
  Clone ID: PAT_TA_87518.pep
VSQGFLKDTSDAGNLGLVGREATAAGAADLTSGAQWLGHYQQQIAAAAIDTHQHGQQIVPAAYMPIQFVPQPLNVVGPGATLGSAYSDGQXTSPMISPISDSQTPGRKRGVSRDVPNKFVERKQXXMIKNKXSAARSRAKKXAYNNXLXNXVSV

SEQ ID NO: 193101 - protein, 139 aa, Triticum aestivum
  unsure (1)..(139): unsure at all Xaa locations
  Clone ID: PAT_TA_87519.pep
MSDTDEHHFESKADSGASKTYPQQAGAIRKGGHIVIKARPCKVVEVSTSKTGKHGHAKCHFVAIDIFNGKKLEDIVPSSHNCDXPHVDRQDYQLIDITDDGYVXLLTESGNTKDDXKLPTDDVLLGXLRRISDGRTDLS

SEQ ID NO: 193102 - protein, 127 aa, Triticum aestivum
  unsure (1)..(127): unsure at all Xaa locations
  Clone ID: PAT_TA_87520.pep
XXGNXGSNPGVDTXTKWHPGDAFEIKARIITLEHKHGWITSDPLRYXGHNNSXNINAEAMKYLNTLVSVVNLAQRNIRTRGKGFASASDCLKTWDDSDSITDVNARKDLRNPTKWWHNHSIITISRI

SEQ ID NO: 193103 - protein, 69 aa, Triticum aestivum
  Clone ID: PAT_TA_87521.pep
ERRKQRGRQLRGALRCRRRAPWLSAWRGQAARWSGGWAGPARWAGWWASRLVPSLSFHFCFFIYFCSFV

SEQ ID NO: 193104 - protein, 98 aa, Triticum aestivum
  unsure (1)..(98): unsure at all Xaa locations
  Clone ID: PAT_TA_87522.pep
RYIVSIYDVQLAALDGAAEAEAPGAAGVGGGEVLPVPVPGGAACPTDGAASLYSFXLWTMAAPTLLLHACSARASSVSASRISVSRSSPRSSPASRLL

SEQ ID NO: 193105 - protein, 106 aa, Triticum aestivum
  unsure (1)..(106): unsure at all Xaa locations
  Clone ID: PAT_TA_87523.pep
ATGGVKKPHRFRPGTVALREIRKYQKSTELLIRKLPFQRLVREIAQDFKTDLRFQSSAVSALQEXAAEAYLVGLFEDTNLCAIHAKRVTIMPKDIQLARRIRGERA

SEQ ID NO: 193106 - protein, 92 aa, Triticum aestivum
  Clone ID: PAT_TA_87524.pep
KAEVGRKMVDSFFNCEDVLLNFLFANASSMSMVEYVKPAWAIDMSKFSGVAISRNTQAHYHVRSKCLAKFSEVYGNLSAKRLFSSRGDDWDV

SEQ ID NO: 193107 - protein, 66 aa, Triticum aestivum
  Clone ID: PAT_TA_87525.pep
FRLSMSCMQQRSLHTLQLSDSAIILWQSRKLGVLSLRLLPSLRLQLHREQMKKQKLPLVLKLTRGL

SEQ ID NO: 193108 - protein, 150 aa, Triticum aestivum
  unsure (1)..(150): unsure at all Xaa locations
  Clone ID: PAT_TA_87526.pep
IAGALNGSSLVVMSKGTPYTQQSYKVSESFPFKWINKKWKEGFHVTSMATAGNRWGVVMSRNSGYSGQIVELDFLYPSEGIHWRWEHGYRITSSAATGDQAAFILSKPKREPIERDTRXLRTSTFPSNHVKDKWXKNLYIXSICYGRTVS

SEQ ID NO: 193109 - protein, 55 aa, Triticum aestivum
  Clone ID: PAT_TA_87527.pep
PNWTHTYGMKIYAEDKDPSLQSLGKLGKCNLFMEKCKTCQPSTLAEGQALFICNV

SEQ ID NO: 193110 - protein, 124 aa, Triticum aestivum
  unsure (1)..(124): unsure at all Xaa locations
  Clone ID: PAT_TA_87528.pep
YYNXSXXXYCNRTKLGALCYSDHSVXRPXTQTHQKTIHARTISHTKQFRKLMPASATPEXYVVFMLAQSGRNXFIGVDTKAAGRRRASPGLHPVSMSETHDRRGLDGFAPHSNQILSIGPAALN

SEQ ID NO: 193111 - protein, 100 aa, Triticum aestivum
  unsure (1)..(100): unsure at all Xaa locations
  Clone ID: PAT_TA_87529.pep
LSVVLRYPCVLQWCVFRWCVLRWCVSSLCVLQWSSPRDPCHCSLRVHHHTRKESSPKSIFSSMWNVSLKVCXFQKSLTSLSHESRCLPQFNXRXNPEYST

SEQ ID NO: 193112 - protein, 59 aa, Triticum aestivum
  Clone ID: PAT_TA_87530.pep
YFSRIYPPICTPRIFPRVPISPTCGLRASGFVVHARLGAYAGYFTFQTSRITCKPPVEE

SEQ ID NO: 193113 - protein, 88 aa, Triticum aestivum
  unsure (1)..(88): unsure at all Xaa locations
  Clone ID: PAT_TA_87531.pep
SYVYVYVYVSFRPPLXTLVTPLSQTALSASLRSARGCSFGQTVARSSTNKSSMSPFPRKLPARLGEIPQNPNAYRPAIETLTAGESWV

SEQ ID NO: 193114 - protein, 86 aa, Triticum aestivum
  unsure (1)..(86): unsure at all Xaa locations
  Clone ID: PAT_TA_87532.pep
SESCLQLRISQIAATRYSFYRRSCGHPTHTISPLIPVKDVRHGNCLKTEXALPENFPXSTAKAPLLXLYMFIKQXFGPHILWLFXD

SEQ ID NO: 193115 - protein, 160 aa, Triticum aestivum
  unsure (1)..(160): unsure at all Xaa locations
  Clone ID: PAT_TA_87533.pep
MATVSDSLVWELVRKNNCFLIKQFGNSNAKVQFXSKEPNNLYNVHSXYKYSGLXANKKTVDGCSQLAEKEMTVASPTTKXKKPEQAAAFNHKTVMRKXFRQXMPRLFKDQSXDNYXQPDFTXPVLXRLSXFTALQVAXPVSKKKTALRAMTVCGLWVKFL

SEQ ID NO: 193116 - protein, 103 aa, Triticum aestivum
  unsure (1)..(103): unsure at all Xaa locations
  Clone ID: PAT_TA_87534.pep
MGAYKFVXXLWXRXQSDLMRFVXRVRCWEYRHXPAIXXXTXRPTRPXRAHRLGXKAKXGYVXYRXRXRXGGXXXPVPKGIVYGKPXXXXLPNSXSXRNKTSVA

SEQ ID NO: 193117 - protein, 81 aa, Triticum aestivum
  unsure (1)..(81): unsure at all Xaa locations
  Clone ID: PAT_TA_87535.pep
MSCCGGNCGCGTACKCGNGCGGCNMYPEVEAAGATLLXVSATATHKASSGGMXEMAAENGGCGCTQCNCGTXSCXCSCCSC

SEQ ID NO: 193118 - protein, 75 aa, Triticum aestivum
  unsure (1)..(75): unsure at all Xaa locations
  Clone ID: PAT_TA_87536.pep
LNLNLNLMGAAEALAEEATQENFDKGLIFPPFTNIRKISGQHXAAKVAAKAYDLGLASRLPRPDDLGQSTPESAC

SEQ ID NO: 193119 - protein, 120 aa, Triticum aestivum
  unsure (1)..(120): unsure at all Xaa locations
  Clone ID: PAT_TA_87537.pep
WTNVVVAYEPVWAIGTGKVASPAQAQEVHANLRDWLKTNVSPEVAESTRIIYGGSVTGRKLQGVGAQPDVDXFLLGGXSFEPDSTDIINAATVNLPKQSTGPFRRGSKTTKMKNPFFPCL

SEQ ID NO: 193120 - protein, 54 aa, Triticum aestivum
  Clone ID: PAT_TA_87538.pep
HAEDHHHHHGHHHHHHHNDDDCCLGFLKGWLAALCCCCCLEECCCCFLGDVACL

SEQ ID NO: 193121 - protein, 64 aa, Triticum aestivum
  Clone ID: PAT_TA_87539.pep
AESTRIIYGGSVTGASCKELAAQPDVDGFLVGGASLKPEFIDIINAATVNLPKQDLDVVLSALE

SEQ ID NO: 193122 - protein, 125 aa, Triticum aestivum
  unsure (1)..(125): unsure at all Xaa locations
  Clone ID: PAT_TA_87540.pep
KVLEEVSILQSKRLRNKVAGFTTHLMRRIQRGPVRGISLKLQEEERERRMDFXVPEKSALXEVDEIRVDKETMDMLXSSGMADLPGVRAAPPRHSSAAPTVKRSTGPFVATAPSPPASRLPYIML

SEQ ID NO: 193123 - protein, 67 aa, Triticum aestivum
  Clone ID: PAT_TA_87541.pep
AALVRCKIFGRLNVCTLDCNCVSKCCTFKQTCNSVMVRHCFQTALYAVMKIFASNQEQSHVGIQKGG

SEQ ID NO: 193124 - protein, 55 aa, Triticum aestivum
  unsure (1)..(55): unsure at all Xaa locations
  Clone ID: PAT_TA_87542.pep
TAXQLPDPASAARRGTXPPVTSSSLPXPRNLASPATRSSRRKPVAISRQRRGGQS

SEQ ID NO: 193125 - protein, 101 aa, Triticum aestivum
  unsure (1)..(101): unsure at all Xaa locations
  Clone ID: PAT_TA_87543.pep
VPDPEARLVAALHITPDWTVPYLAYMTRGELPEDETLARQITWRSKSMIIINGELHRRSVTGNFQRCVSPEEXKXICRGIHEGDCGHHAGQNPCGQVFLMF

SEQ ID NO: 193126 - protein, 95 aa, Triticum aestivum
  Clone ID: PAT_TA_87544.pep
NVTFSFTRLLESRLLGTHLPRYINNQKYHVRLCFGLLIKQPTLWVYRISGINKLRGGRCLVQPMTATTRLDHWKQGPYMGNWKKHLSLPTGRDFP

SEQ ID NO: 193127 - protein, 85 aa, Triticum aestivum
  unsure (1)..(85): unsure at all Xaa locations
  Clone ID: PAT_TA_87545.pep
NVHLPFFATLVMYPCSPLHFYICNHFYWKKKRCLPTFGVCXCTVGDHDLSTLSTGNGGWVQSLSYRLSIKGXMDXGXNCWVYTRX

SEQ ID NO: 193128 - protein, 128 aa, Triticum aestivum
  unsure (1)..(128): unsure at all Xaa locations
  Clone ID: PAT_TA_87546.pep
RLIFAGKQLEDGRTLADYNIQKESTLHLVLRLRGGMQIFVKTLTGKTITLEVESSDTIDNVKAKIQGQGGHSPGTKQRLIFAGQAVEDGPTLXADYNIQEGXTFTGVPPLAIALRLSPLKGPFVGCGL

SEQ ID NO: 193129 - protein, 104 aa, Triticum aestivum
  unsure (1)..(104): unsure at all Xaa locations
  Clone ID: PAT_TA_87547.pep
RQRXSTGTRGGLNTKCVMFMPKVXXGKFXESMPVGVFYXIAPQRRKWGPTLAFNLALCPQLASWVNKGLDWGSLDDVQTLQSRIRDLNEKDINLVKVIQVMLVR

SEQ ID NO: 193130 - protein, 81 aa, Triticum aestivum
  Clone ID: PAT_TA_87548.pep
SPQFQLLFHPSRSQYQQLSLPFLGSRCHLFHSCPHLHKPPAHEGCHSMRLLVRGLIRTHSYYQCFVSLFCWMFYYWLAFGC

SEQ ID NO: 193131 - protein, 123 aa, Triticum aestivum
  Clone ID: PAT_TA_87549.pep
MKGPPTLVPSVCVTRAQASRKPSPLSSSRLTKPATMAAAAARSMLRSSASLLRAAPARASSSAARPSLRRALGAPPRLLRSPVEASSAWSPLLPLHSATAAARMTSKLAVPGPPGGSTEGKRR

SEQ ID NO: 193132 - protein, 123 aa, Triticum aestivum
  unsure (1)..(123): unsure at all Xaa locations
  Clone ID: PAT_TA_87550.pep
MSSSISPIRGEAGMAFRVPTVDVSVVDLTVXLAKPATYDQIKAAIKEESEGNLXGILGYXXXDXXSLXXXGDNXSSILXAKAGCSERQLVKLSPGRQGIRPWLIVQYMADGKCCRGQSPLELL

SEQ ID NO: 193133 - protein, 95 aa, Triticum aestivum
  Clone ID: PAT_TA_87551.pep
SNINKDMATYSGINKTPLTKFCRTMFLHQMRVHLQVHAQYTFFRDRRGRNLHTLPGRRGRIHHVRGRRGRTIHFIFSLRLDLYPLFDLVHESINF

SEQ ID NO: 193134 - protein, 98 aa, Triticum aestivum
  unsure (1)..(98): unsure at all Xaa locations
  Clone ID: PAT_TA_87552.pep
DARVVVAHLPRVGEGVAAAVTPLDRRWRCRRYSSDSQERHKHGRTRPPQPQQLSRFAQEVTIISWVINQKGVDPPPLVLLSKAGIPKNLFMGXXNYNV

SEQ ID NO: 193135 - protein, 52 aa, Triticum aestivum
  unsure (1)..(52): unsure at all Xaa locations
  Clone ID: PAT_TA_87553.pep
XLCXKLVGSQLXLKKIGTHVHHNTEEAISCTRIFCNFLLPFLLGSAVFVLET

SEQ ID NO: 193136 - protein, 63 aa, Triticum aestivum
  unsure (1)..(63): unsure at all Xaa locations
  Clone ID: PAT_TA_87554.pep
LKTFWSGGDEIRRKWKIMYIQGDEVYAIVLDRHHQHXSSTCELRWDFPEEERMIQYSRDKYFP

SEQ ID NO: 193137 - protein, 86 aa, Triticum aestivum
  unsure (1)..(86): unsure at all Xaa locations
  Clone ID: PAT_TA_87555.pep
SVLLSYSCSCANYVQFSVKIREMYLIPSFGCSKYTYLSMHLSYSQYGIIAASWIVTNGLXHNLRFPSKFCFSXNKWXMKKXTVMRM

SEQ ID NO: 193138 - protein, 114 aa, Triticum aestivum
  unsure (1)..(114): unsure at all Xaa locations
  Clone ID: PAT_TA_87556.pep
MSDTDEHHFESKADSGASKTYPQQAGAIRKGGHIVIKARPCKVVEVSTSKTGXKHGHAKCHFVAIDIFNGKELXGYLPSSHNXDVPMFDXRKDYQLIDITDDXYFSLLTXNGNT

SEQ ID NO: 193139 - protein, 190 aa, Triticum aestivum
  unsure (1)..(190): unsure at all Xaa locations
  Clone ID: PAT_TA_87557.pep
MALKLPEDLKKETMKSLQILSGIEIIEGPATVVADLHHLTDLKKLAIYKLNXQTGGKLFEELNSSIEYLGGYSLHTLIIDDESSGFVNSLSALSSPPKFLKALELSGXLVVLPEWITELGCSHEVDTSVTALXXDALQRLEXLPKLFLRSFNKARSRNSCHRCGKPDGETSTTGLKLSLSFVASFNNELT

SEQ ID NO: 193140 - protein, 89 aa, Triticum aestivum
  unsure (1)..(89): unsure at all Xaa locations
  Clone ID: PAT_TA_87558.pep
XFIXXWXDQXGQLKLAXQFLXPLDEEEXQVDXXXEIDAENSGHDXAAEAXRRRRGXAXPPRSGQHXSFSGTXILRXSXXNTLSXTPXXX

SEQ ID NO: 193141 - protein, 86 aa, Triticum aestivum
  Clone ID: PAT_TA_87559.pep
NGWEEEEEEHLTSHHSHRRMKAAARPRTDPATMEEAAESSSSSGPGESEGSASDGAAAGGSAESALSAASSSADGLSSFPSAPGTS

SEQ ID NO: 193142 - protein, 96 aa, Triticum aestivum
  unsure (1)..(96): unsure at all Xaa locations
  Clone ID: PAT_TA_87560.pep
NPFQDKQELDSRFLNNYLPFIQVNRLKPTSHQFMNFNSHTNISXRCLNLLNYVQSPTLSWSLHAFTHHGXNKGANHITSXSMKVLQVXSXLVXVEN

SEQ ID NO: 193143 - protein, 115 aa, Triticum aestivum
  unsure (1)..(115): unsure at all Xaa locations
  Clone ID: PAT_TA_87561.pep
ANDSREANAMSGTLRALVNNMVNGVTKGFEKKLNLIGVGYKAQAQGDKLNLSLGFSHPVVHAMPEGVTVVTATPTEIVIKGIXRQKVXPSGCRXRGLPRSLEPYKGKGSLFRRNG

SEQ ID NO: 193144 - protein, 182 aa, Triticum aestivum
  unsure (1)..(182): unsure at all Xaa locations
  Clone ID: PAT_TA_87562.pep
VQGAVDVDIGANPSAEGGGDDEGVDDQAVKVVDIVDTFRLQEQPAFDKKQFISHMKRYIKNLSAKLEGDDLDAFKKNVESATKYLLSKLKDLXFFVGESMHXDDGXAWVFAYYKEGLLIQLSLYFAHGLKESANRMPSRLHNFALKVSIDQCWSNCQILENFCGILKKKKPRGPYQSLKEYR

SEQ ID NO: 193145 - protein, 184 aa, Triticum aestivum
  unsure (1)..(184): unsure at all Xaa locations
  Clone ID: PAT_TA_87563.pep
PEFFVRRPSPHSRTRRPIFLARLVPWFLYDSSPPLIYMLKLSGSTTMMELEIELKKASDKLKSWDATSISLSAACDLFMRFVTRTSHLXEMRNLDAAKSRLIERGEKFXXIXXKGRXTIAMLSQDFISXGCTMLGHGXSRMVLGILKLAASNXKXFRVXXTEGRQDXTGYXMSNELHIXIPVKG

SEQ ID NO: 193146 - protein, 141 aa, Triticum aestivum
  unsure (1)..(141): unsure at all Xaa locations
  Clone ID: PAT_TA_87564.pep
MADVDVDTEVAAGAQPKKRTFRKFSYRGVDLDALLDMSTDDLVQMFPAPRPQKVKRGLKEEAMGAPSRSAQGEKGRSCWXEAEPXEDTSPLHDHLSLEMIGNLIXVXNGQDFNKFEIXPEMIGITCKFPKSNTRRVQSVIP

SEQ ID NO: 193147 - protein, 75 aa, Triticum aestivum
  unsure (1)..(75): unsure at all Xaa locations
  Clone ID: PAT_TA_87565.pep
RIPSDVVRAICLQLASVRMLPWARAHLNPTGQALIISTVAGMAYFIXADKTILXSMARKHPFXGRAGQLQEHSFN

SEQ ID NO: 193148 - protein, 178 aa, Triticum aestivum
  unsure (1)..(178): unsure at all Xaa locations
  Clone ID: PAT_TA_87566.pep
FFFFVVXDXDAXLEGXSXAGRXAXLDEEXXPEXGPHGRARXCGNMRGQTKSVVVRXXGRWRXRKASHXRAGSCFPSKTRCALPCPSRCLPLSFESPSWRRLVVLFLCRRPSSAARFLVVFCLGFAVMCGRRWWWGGTRWGVLCVVLPWDTDGRTRAALFLTPTSPSPRRGCPQPSRAS

SEQ ID NO: 193149 - protein, 133 aa, Triticum aestivum
  unsure (1)..(133): unsure at all Xaa locations
  Clone ID: PAT_TA_87567.pep
RRNRGRRGRSRRRSSGLSCTSATGDQITSKQISHQSSVLHLLRWPEWCTVHKLHQFRLAGSECVGTHHAHSPSLCKDTPTEPITSNTSTRTQENWITKGPLSCPCFSSFILFFXFSXVLHNSTTVHIXSLKKK

SEQ ID NO: 193150 - protein, 78 aa, Triticum aestivum
  unsure (1)..(78): unsure at all Xaa locations
  Clone ID: PAT_TA_87568.pep
REIGLLRRTPNSXQXNXVXPVVXAGGGRNGDQHXXRXFXXAQYRAAPXRQVQAPKPRQSASSSSVQLAPWKXNTSPLN

SEQ ID NO: 193151 - protein, 82 aa, Triticum aestivum
  Clone ID: PAT_TA_87569.pep
TNGRYKSVEHRVLVDAERDRTTIATFQDACVAGMVKPLPELAEVARYISIEKHDYVHRQFQALTERANMSDSLKDIAQVHCL

SEQ ID NO: 193152 - protein, 75 aa, Triticum aestivum
  unsure (1)..(75): unsure at all Xaa locations
  Clone ID: PAT_TA_87570.pep
MSCNCGSGCSCGSDCKCGKMYPDLTEQGSAAAEVAAVVVLGVAPENKAGXFEVAAGQSGEGCSCGDNCXCNPCNC

SEQ ID NO: 193153 - protein, 79 aa, Triticum aestivum
  unsure (1)..(79): unsure at all Xaa locations
  Clone ID: PAT_TA_87571.pep
EYMPNGSLEEFIFGVRAKKSWPVRRGIIEGISEGLLYLHDYAHECIVHRDMKPSNILLXHEMNPKXPDFGDCKDMPLQP

SEQ ID NO: 193154 - protein, 93 aa, Triticum aestivum
  unsure (1)..(93): unsure at all Xaa locations
  Clone ID: PAT_TA_87572.pep
KVCAVIASGSVGLIXRSVHSFRIXDSTPFPPTLHPSAVFSXRRNYGIILXPSHFLAVGXLKVSHNXXIAPLTNCTRNNXSNDVKXHPGPWSQK

SEQ ID NO: 193155 - protein, 106 aa, Triticum aestivum
  unsure (1)..(106): unsure at all Xaa locations
  Clone ID: PAT_TA_87573.pep
IXTGPRDMPLCFPLVAMFWSFKTGGKPXIHASFXKFQKPDMHLRGTRCGQAQPSRSCPRVLGHAAGRCDALDWTFAEAPRDGLLDRLVLGGSTAGGALGFSVLFFW

SEQ ID NO: 193156 - protein, 62 aa, Triticum aestivum
  unsure (1)..(62): unsure at all Xaa locations
  Clone ID: PAT_TA_87574.pep
RFLLQFTCRGDNYILXVLPIXSKAGRHWLNSRRANPLAVVRXGGAFLDXSRALMCGTPDADD

SEQ ID NO: 193157 - protein, 54 aa, Triticum aestivum
  Clone ID: PAT_TA_87575.pep
SIPACGRVVGGDFLHQKVYTPSFWKGWWGLTPNSPIVTKVSNNYTYATNYESVR

SEQ ID NO: 193158 - protein, 65 aa, Triticum aestivum
  unsure (1)..(65): unsure at all Xaa locations
  Clone ID: PAT_TA_87576.pep
EEXPVXXHLXISXPXNTYTWRYTXTHAAQPXKNXHXDXXXTIVPTEXTXSLXXSXSARHTPSPWR

SEQ ID NO: 193159 - protein, 148 aa, Triticum aestivum
  unsure (1)..(148): unsure at all Xaa locations
  Clone ID: PAT_TA_87577.pep
GXVGSQXHGRFXXXPITXXXLQTLPXSLAQRXXXLSIFXQXRKTVGSEEVPLDATWIXRXEAPXEVHXPXIENPPRELFDDKGLLQDLHHTXDKSXPCCAPXHSPHSFGVMKEVRHKTTKKKTRRSPEYATQAFHHLGIIRNLGYDSV

SEQ ID NO: 193160 - protein, 80 aa, Triticum aestivum
  unsure (1)..(80): unsure at all Xaa locations
  Clone ID: PAT_TA_87578.pep
KYPTSPLPPWXTEDDIDYFVTSFEXTXFTXAINYYCNFDNNCELAAPWADAKVXVXTXYIVGDGDITYNFXGXPIHPWAV

SEQ ID NO: 193161 - protein, 130 aa, Triticum aestivum
  unsure (1)..(130): unsure at all Xaa locations
  Clone ID: PAT_TA_87579.pep
MKFIAAYLLAYLSGNASPSAEDLTSILESVGCEIDNEKMELMLSQVKGKDITELLAAGREXXAAVHLGGGGVXAVSTAAPAAXXGAAAPAAEXKKEEKRXRRRDDDDMGSSVLIVGHLCLNINLARNRSR

SEQ ID NO: 193162 - protein, 109 aa, Triticum aestivum
  unsure (1)..(109): unsure at all Xaa locations
  Clone ID: PAT_TA_87580.pep
MVSSKNARCTALLFLAVLLLSCVGMGRAARRLKEAAPEDNYPAEAPESSPEDDYPSEAPEPSPEHELLPPFPEFPSSPKXELPPMPKMPTSRVQLSRLEPEPMSMSHDQ

SEQ ID NO: 193163 - protein, 90 aa, Triticum aestivum
  unsure (1)..(90): unsure at all Xaa locations
  Clone ID: PAT_TA_87581.pep
EARTLGNIVSHLSLVTLDLRHTVRDPYPRSVDFDTDMVXSFESPTVLSAEGSMARLIIDNDAVSGETFLPGQLFVFGGFALRANSTGHLE

SEQ ID NO: 193164 - protein, 86 aa, Triticum aestivum
  unsure (1)..(86): unsure at all Xaa locations
  Clone ID: PAT_TA_87582.pep
FFFFAPQDPKXPITVYYNNTQQLQFINNNTXXFLQLWHKSKRTEDRRQELSCPSEESDVYPPTTLKSVGEQSTPPSAAQHRRTTTR

SEQ ID NO: 193165 - protein, 68 aa, Triticum aestivum
  unsure (1)..(68): unsure at all Xaa locations
  Clone ID: PAT_TA_87583.pep
HNVEDGIIRLNXSFSLTXLSFCFFLHVHDSSYICVNAIXKQDTISIVPYISIIIYRPYNYEPYSSLSH

SEQ ID NO: 193166 - protein, 110 aa, Triticum aestivum
  unsure (1)..(110): unsure at all Xaa locations
  Clone ID: PAT_TA_87584.pep
LAYDYFHDSGNSPHGPYYLCIYDSKTQVWTRKPAAIPQPLLPFDYICDIDMVITIGGPAVDHGLGPLWNGYNLLTCLQTXTLXPASXXXLSETQGXXNCXXIPLXIGGPF

SEQ ID NO: 193167 - protein, 160 aa, Triticum aestivum
  unsure (1)..(160): unsure at all Xaa locations
  Clone ID: PAT_TA_87585.pep
FPNAARWYDTVAAAVASRFPGQSSGVSASSAPAAAAPAASKDEDDDDDMDLFGXMKTEEDKKAAAERXEAGQPAKKKEXWXPLXSMDIXHGDXETDMKXLEEAVRXSVQMGGLTWGASXLYPVXLMDQELQXMLTIHXDTPSXRTLIREXSCXXPTNXYP

SEQ ID NO: 193168 - protein, 101 aa, Triticum aestivum
  unsure (1)..(101): unsure at all Xaa locations
  Clone ID: PAT_TA_87586.pep
QVXLXSVTDPXXFXLXKFSXQXLTXXIYPKXXLXQXXSKRNRXVQGFEHFXSVSEHXXQHTGWQFLGXFKTIDDMHLXDXTCQRQYLLSQLKXKEKIDRRC

SEQ ID NO: 193169 - protein, 103 aa, Triticum aestivum
  unsure (1)..(103): unsure at all Xaa locations
  Clone ID: PAT_TA_87587.pep
XVLPGVPGNXTKAMRQRXFRFALAHPPATGYXDPPFGDCGVNSMLPRCAGRITVPSFSAGILQQLSCSVVSHFVLGTTSSCRGEYSSSLSSSSLGVGASTMMW

SEQ ID NO: 193170 - protein, 68 aa, Triticum aestivum
  unsure (1)..(68): unsure at all Xaa locations
  Clone ID: PAT_TA_87588.pep
NRPKXLTAXELQXEXXKVGHITPGNHACNXSGKRKRXRVEERLLFTRRSTLWDLEYWKDLDLRHNLDV

SEQ ID NO: 193171 - protein, 132 aa, Triticum aestivum
  unsure (1)..(132): unsure at all Xaa locations
  Clone ID: PAT_TA_87589.pep
MSKKIVIRADLVGKKCTSGILSIVSKLEGIKSMVVDEDKCTLTVVGTVDPVCVVHQLRNPASPRPSVSVEDDXPKEKKTPCXEACEKPGRKITRSLQGECEKVARTLRHCAQGPLRRYGTLTLINPAAPTQY

SEQ ID NO: 193172 - protein, 153 aa, Triticum aestivum
  unsure (1)..(153): unsure at all Xaa locations
  Clone ID: PAT_TA_87590.pep
MARAQVMLMAVALVLMLAAVPRAAVAIDCGHVDSLVRPCLSYVQGRPRPSGQCCDGVKTSITSAIPDDFQXAFNCLKGIPPWIHNLNXDNARXSPQCGVNSHTHHLNIDCTGVMGTFVNWCQLTITGFNATSTLCIGTISILNMIRSSTGCWL

SEQ ID NO: 193173 - protein, 99 aa, Triticum aestivum
  unsure (1)..(99): unsure at all Xaa locations
  Clone ID: PAT_TA_87591.pep
YPTRLXFAVLGLDMVGLLRMAGWIYXHVLVAFGQVYLNXSEAQAIKNLEASKTVSFIRELIFRYGVLHSIIMDNGSNFNSDEFRAFCASQGTRVDYASL

SEQ ID NO: 193174 - protein, 133 aa, Triticum aestivum
  unsure (1)..(133): unsure at all Xaa locations
  Clone ID: PAT_TA_87592.pep
MARTKQTARKSTGGKAPRKQLATKAARKSAPATGGVKXPHRFRPGTVALREIRNYQKRRSXVIPQXPXXRSFREFAQDFXNRLPFPSSAXRGXKGPPQGYSXGSXXGHNFCAIHAXAXIMPKNQXARRIPGTR

SEQ ID NO: 193175 - protein, 107 aa, Triticum aestivum
  unsure (1)..(107): unsure at all Xaa locations
  Clone ID: PAT_TA_87593.pep
XHYRGIGTGPPFLKKCSDALISIRNHEELGKGRSPKKWKKIRGVEKNIGIIIAPPPSWERILYLSLRKIIGCSKKSRKWGNLLEKSTPRAAIRTTLAVAILQQFSRR

SEQ ID NO: 193176 - protein, 117 aa, Triticum aestivum
  unsure (1)..(117): unsure at all Xaa locations
  Clone ID: PAT_TA_87594.pep
PFLVAHKKVALSRPKPGVERLAVSLDLYNQGSATAYDVAINDDXWPKEAFELVSGEARKTLXERLEPGCHCLAXFVLGEQNTGXFXVXPLLSXXFCHKGAFKRXXSNPPPGILLKTQ

SEQ ID NO: 193177 - protein, 114 aa, Triticum aestivum
  unsure (1)..(114): unsure at all Xaa locations
  Clone ID: PAT_TA_87595.pep
XIPLRMGXEIVKVSHXKXVTXGDXFXTDLLAXATHXERIRGINELTLRXFFFFFLCSTFIIRTXLNGXHFCLLXILARHRASVAPSHLSXCENVRTVQKDQISQLSRQILRWRP

SEQ ID NO: 193178 - protein, 81 aa, Triticum aestivum
  unsure (1)..(81): unsure at all Xaa locations
  Clone ID: PAT_TA_87596.pep
VCVAWCDRKTSRDVYHGMVIEDTXALERLLVVDQEGPTRINVISAPKLTVVGYSSDKYSELVIGSTPIEVQQPPXTSXSTN

SEQ ID NO: 193179 - protein, 89 aa, Triticum aestivum
  Clone ID: PAT_TA_87597.pep
SALQQNKLSLGLSLKGAHNNYIYTRLRGERHCSPVVSRSVLQAPIHAITQRRLTARPSSSVFYFYWHRIPSLSLTCPRWVACCSSIWHP

SEQ ID NO: 193180 - protein, 63 aa, Triticum aestivum
  unsure (1)..(63): unsure at all Xaa locations
  Clone ID: PAT_TA_87598.pep
FFNHPERNWSALYKTTXTAIGVKSNIHHQDXEREEQRLGVQYHQCRXFLPGINRXRSSCHXPH

SEQ ID NO: 193181 - protein, 121 aa, Triticum aestivum
  unsure (1)..(121): unsure at all Xaa locations
  Clone ID: PAT_TA_87599.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLXIDITDDGYVXSLLTESGNTKDDLNSH

SEQ ID NO: 193182 - protein, 62 aa, Triticum aestivum
  Clone ID: PAT_TA_87600.pep
NAVARALRVGTVWVNCYDVFDAAIPFGGYKMSGVGREKGAYSLGNYLQTKAVVAPLRDPAWL

SEQ ID NO: 193183 - protein, 84 aa, Triticum aestivum
  Clone ID: PAT_TA_87601.pep
NEVYGKLQELQTLDASVVVSWLSRATGWIIVSRIRTSVRIIYSGWDNRISVNLRAKVSSEDHVSKPVLTRVLLHDRTMSVSSKV

SEQ ID NO: 193184 - protein, 63 aa, Triticum aestivum
  Clone ID: PAT_TA_87602.pep
QTCAPLIEKGVDVFDAELLLNGMVTQKLDYERHRLFLDRVKQTRSTRWLKDGAHGRFVPISKS

SEQ ID NO: 193185 - protein, 77 aa, Triticum aestivum
  unsure (1)..(77): unsure at all Xaa locations
  Clone ID: PAT_TA_87603.pep
KACSPSXPLPAATPLPAAILLLRRRLRPLHHRVSDRGDHRPGADRXCWCKXXXSSXXGTPINSXXRXVXXSRXFXAC

SEQ ID NO: 193186 - protein, 120 aa, Triticum aestivum
  unsure (1)..(120): unsure at all Xaa locations
  Clone ID: PAT_TA_87604.pep
THGTXTILLTIMHQPPCSSWKLGKINSCWHPLRMSRSEVEPRLGWASDSTESGGGDGEGGGPEGVRRVAGRSPLARMTWPSGLQSPASGTGWLGGRELARLRRAGAGWPPRLLGPVSRRG

SEQ ID NO: 193187 - protein, 158 aa, Triticum aestivum
  unsure (1)..(158): unsure at all Xaa locations
  Clone ID: PAT_TA_87605.pep
MNNHIAINMIKSYSCSMQTPNNIYLGLTLIPKVYXECAMMIISILEPLPTHIVTSPSTSLCLFCNSCFELLIISNRTSIXYSGATINTSKVHINNVYITFXLVHFAILXSTKXFXALPFPVTISFEVYHSVQALXQXWASSGSENCLSSSXVXCXLXP

SEQ ID NO: 193188 - protein, 81 aa, Triticum aestivum
  unsure (1)..(81): unsure at all Xaa locations
  Clone ID: PAT_TA_87606.pep
KSVVPTSLCNCYLDLLLVXLGTYVIGKDPRFDPFCVWGNEISMNQHQVRKLIKIVSKMGPKMEIKLFVYTLSKTTENCMMV

SEQ ID NO: 193189 - protein, 72 aa, Triticum aestivum
  unsure (1)..(72): unsure at all Xaa locations
  Clone ID: PAT_TA_87607.pep
GKNLVLIRPLEICDCMGPDISLDSTANSYHVNXAFSSFXXSSSTTTKLLILSTAXKTGXXFFNGXVTVXPXR

SEQ ID NO: 193190 - protein, 74 aa, Triticum aestivum
  unsure (1)..(74): unsure at all Xaa locations
  Clone ID: PAT_TA_87608.pep
NISLXGXGVSTIYSACQPNIHSNFQCINSIQEDYGEGNGSDFGNMTFLIVLTPLCDPDAGCFPPQCYICLAWPL

SEQ ID NO: 193191 - protein, 51 aa, Triticum aestivum
  Clone ID: PAT_TA_87609.pep
CNCLFLLELYYVPCVACIFSLLYEGFPAYLPSIYVYMYWPLAPRKDKLHIS

SEQ ID NO: 193192 - protein, 64 aa, Triticum aestivum
  Clone ID: PAT_TA_87610.pep
RHLLLAVRNDEELGKLLAGVTIAHGGVIPKINPVLLPKRTAEKEGKEPKSPKKATKSPKKTTKA

SEQ ID NO: 193193 - protein, 197 aa, Triticum aestivum
  unsure (1)..(197): unsure at all Xaa locations
  Clone ID: PAT_TA_87611.pep
FIGEGKFGKVYLGREKQSGYVVALKVTYKAKLQKYRFHAHLRREIEIQHGLDHPNVLRLFAWXFHDAERSSSVLRVCRPAESLQVLRSVGHSPERTAATYVASLAXALAYCHKKQVIHRDIKPENLLXLDIQGRLKLQTLDGXSXNAKLTXCGTIDYXAQEMVXKRSRLPLTLDLGICHNFVGELRKIPDYQMARPK

SEQ ID NO: 193194 - protein, 120 aa, Triticum aestivum
  unsure (1)..(120): unsure at all Xaa locations
  Clone ID: PAT_TA_87612.pep
MSWQTYVDDHLCCEIDGQHLTSAAILGHDGSVWAESPNFPKFKPEEIAGIVKDFEEPGTPCTNWVFSLGGTKYMXVIQGEPGVVIRXKKGTGGITIKEDRHGLIXGIYNDPYPGQCIWVR

SEQ ID NO: 193195 - protein, 87 aa, Triticum aestivum
  Clone ID: PAT_TA_87613.pep
SFSDLKTEEEFLFNLAPFSSRFVILACCHPLIIIFDCGNSFHLFGANQESSQFVIRSSSIQGYSFSAFSSRSPNLTGASFKHSLISS

SEQ ID NO: 193196 - protein, 62 aa, Triticum aestivum
  Clone ID: PAT_TA_87614.pep
TRSVVQCICRCFFLDEQVMVAVRIGIILKDLHCIEGTLALGKTALVGACQFLETFKSSGENH

SEQ ID NO: 193197 - protein, 182 aa, Triticum aestivum
  unsure (1)..(182): unsure at all Xaa locations
  Clone ID: PAT_TA_87615.pep
MASKRILKELKDLQKDPPTSCSAGPAGEDMFHWXQATIMGPPDSPYAGGVFLVNIHFPPDYPFKPPKVSFKTKXFHPNINSNGSISLDILKXENXSLAFDXSKXLLLXLLPXLNRSQXDDPLVPXIAHMXKTDXXNYKRPQLGPRIPRGLRNCILMKVLKKIYGMVSIVRWCIVQDEIGSAT

SEQ ID NO: 193198 - protein, 142 aa, Triticum aestivum
  unsure (1)..(142): unsure at all Xaa locations
  Clone ID: PAT_TA_87616.pep
MAKSSFKLEHPLERRQAEATRIREKYSDRIPVIVEKAGKSDIPDIDKKKYLXVPADLTVGTFRVXFVRKRFKLNAGEAIXSLLVKNTXLPPTSALMSAILXKENKDRDGSXNMTYSGETLSAPKMALVTESLMLLVIVPSTG

SEQ ID NO: 193199 - protein, 47 aa, Triticum aestivum
  Clone ID: PAT_TA_87617.pep
NKLSVSANMPIMGGTASYVTSDIFSTDCKVARFGRASGISMVTGIAT

SEQ ID NO: 193200 - protein, 138 aa, Triticum aestivum
  unsure (1)..(138): unsure at all Xaa locations
  Clone ID: PAT_TA_87618.pep
DITNDSPIVGLAAGGLVHAADRTPQASTAGAKNRPRPRCTPGSGEALLRGQVKTLLQKVDEEGAAAAVIRPVRIHALLGVTRSPAXVLAPTPFNTPQLWADPPPVXSALPDGRTVLPCVLEQXELIPKLQVPISVLTP

SEQ ID NO: 193201 - protein, 107 aa, Triticum aestivum
  Clone ID: PAT_TA_87619.pep
LISPYPDTAAYMAHMSLAISNLSSLEAFVRQADALRLQTLHRLPQVLTARQAARCFLAVADYSQRLRALSSLWLARPRQDQPAPPGAGGRLFIHEILHASSPGRPTS

SEQ ID NO: 193202 - protein, 184 aa, Triticum aestivum
  unsure (1)..(184): unsure at all Xaa locations
  Clone ID: PAT_TA_87620.pep
PWGYXXFGNXTGPQXXLIXQFICCXCKSIXIFVVXHRPINDPPFLCFHHPGSAAGPNVNRCFKQCLKQIXRIEKLSKXNNNNNNICRFGQPNLIPNVRDHALGCSSASLDEDARNQKCVMSPHQATSIGAWTVGGNRGPALLNLPNVSCQVKIAWGRRVGFPRPQDVCCRCSWCGRSAGRGSRA

SEQ ID NO: 193203 - protein, 140 aa, Triticum aestivum
  Clone ID: PAT_TA_87621.pep
ARSCVGVYSALFSPSLVSGHTHGYRSRTTAVNRGFAFLCLELTSGSPVETVRLVCSRPRHSCPDHSPVSFGFVWFTCCSTQSTSEKAEKATTRAVMLVAPRNSRKEFTAAARARIIEPCWYALLSLNLNILATPGSLRCL

SEQ ID NO: 193204 - protein, 79 aa, Triticum aestivum
  unsure (1)..(79): unsure at all Xaa locations
  Clone ID: PAT_TA_87622.pep
EEKEAELDRQDDLDXLEEEHDVAKARSTFYQQQARRFQSREVRAKIYNVGELVLCLPEKKRDKLKPKWEGPFIIDEVLT

SEQ ID NO: 193205 - protein, 117 aa, Triticum aestivum
  unsure (1)..(117): unsure at all Xaa locations
  Clone ID: PAT_TA_87623.pep
KEEIERMVREAAEFEEEDKKMREKVEARNQLESIAYSLRSQINDKDKLKDKLEDDDKEAVEAAVKEAIEFLDEXNPNAEKEEYEXARQEAPEHHQPIIQKVYGSRLGRRRRRILNRL

SEQ ID NO: 193206 - protein, 104 aa, Triticum aestivum
  Clone ID: PAT_TA_87624.pep
VHTWILLRESCVIQTTVLGNSGDRRVYCSYRSRFRPPINTTLLMSSRLHSHLHPPLARPLSLSLKSLPWRRRSAHVPTTSRRPPRTLTRRAVTRTHTCRRTRLR

SEQ ID NO: 193207 - protein, 71 aa, Triticum aestivum
  unsure (1)..(71): unsure at all Xaa locations
  Clone ID: PAT_TA_87625.pep
GCYDXLXXSEAHQXXXFIISHYVFYPMSAKXXLADNFQVFFDXQNNQRPTDDGRHLLLRLDSCTQKLWIVL

SEQ ID NO: 193208 - protein, 36 aa, Triticum aestivum
  Clone ID: PAT_TA_87626.pep
MQMISSVLALKCYPGQSQNKGQAAKLQLRCPFLKKK

SEQ ID NO: 193209 - protein, 101 aa, Triticum aestivum
  unsure (1)..(101): unsure at all Xaa locations
  Clone ID: PAT_TA_87627.pep
XLVYPPYCSLCWFQEIDLSLPMGMPIPGRNVMDIHXWKVTSRYLTIMGTVLLIYLCWKQLKEXLSSTVRRVCCEINLRVXWHTKGLVICVLVDKGKYLLRK

SEQ ID NO: 193210 - protein, 172 aa, Triticum aestivum
  unsure (1)..(172): unsure at all Xaa locations
  Clone ID: PAT_TA_87628.pep
HNVLSSEIPSSLGRCTKLVSLGLSTNQLTGSIPPELGELRSLQTLTLHDNRLTGTVPTSLDELVNLDIPVRSSNNPCXPVPEKSGXSGISXKSSIQQKSLSXQFPGXRITNXTLXXKREXFNXXNFXRNLXAGLANXRXXFFXRGKNPENKDCQVNSEGLTTNTGCGKCLKS

SEQ ID NO: 193211 - protein, 118 aa, Triticum aestivum
  unsure (1)..(118): unsure at all Xaa locations
  Clone ID: PAT_TA_87629.pep
FFFFARTIHHNENNCCYVILVSDISFKEKALQLDSSIAVLTLSTRKTLYEVTKHGSLTNGVGPEEAMNSITFHLIPGASKHINDPHKSTIGDGGLLKKWRSHNALPFNPNSRGRXXVI

SEQ ID NO: 193212 - protein, 66 aa, Triticum aestivum
  unsure (1)..(66): unsure at all Xaa locations
  Clone ID: PAT_TA_87630.pep
NFQVRQFMRKILPQLFXSTTNLRLLRLRAMYNNGIDTENQLGNDGIXKXXXVWKIICGXHPXXELG

SEQ ID NO: 193213 - protein, 63 aa, Triticum aestivum
  unsure (1)..(63): unsure at all Xaa locations
  Clone ID: PAT_TA_87631.pep
QSCTVGVTLYPSFYQYPRXCACCSFPVSPWDFFPXHSMGFNQXNHWFLPTRLQTRFPNEHIHL

SEQ ID NO: 193214 - protein, 98 aa, Triticum aestivum
  unsure (1)..(98): unsure at all Xaa locations
  Clone ID: PAT_TA_87632.pep
KAKKGVETYKIYIFKVLKQVHPDIGISSKAMSIMNSFINDIFEKLAGESAKLARYNKKPTITSRXEIQTSVRLVLPGELAKHAVSEGTKPSPIHLLLD

SEQ ID NO: 193215 - protein, 92 aa, Triticum aestivum
  unsure (1)..(92): unsure at all Xaa locations
  Clone ID: PAT_TA_87633.pep
MASSKLQAFWNHPAGPKTXHXWAPTFKWGIXSIANVADFAKPXEKIPIHSXYYAXTGINWARYTWHTGKITSRLKRKALAAHGNGNLQRDRT

SEQ ID NO: 193216 - protein, 91 aa, Triticum aestivum
  unsure (1)..(91): unsure at all Xaa locations
  Clone ID: PAT_TA_87634.pep
LAXFAPGDXVRVLPTCGHGFXAACVDVWLLSNSTCPSCRRALVVAAAQFASGHRSPPPQTCCSRRRRRRRTSLRPYNKHYAPNVHIRHTML

SEQ ID NO: 193217 - protein, 130 aa, Triticum aestivum
  unsure (1)..(130): unsure at all Xaa locations
  Clone ID: PAT_TA_87635.pep
VISLEDGTLKFLSLPTIANDVPVTGRPFAGTKTQGIHTYQLSEYLIWDVHVSXEITGQAAYCVGXMGTAVRFQLTKRXWEKKPGRNVYLNSSVGHXQEEGTIIKDWWHIAKSPLSNVPLVTKKGQNMPRC

SEQ ID NO: 193218 - protein, 160 aa, Triticum aestivum
  unsure (1)..(160): unsure at all Xaa locations
  Clone ID: PAT_TA_87636.pep
KMNKNKKLVKRLAKKYHAFLASEAIIKQIPRLLGPGLNKAGKFPTLVSHQESLEAKVNETKATIKFQLKKVLXWGVAVGNLSMEEKQSSKNIQXMSVNFLVPCSRRTGQNVXCLFIKTHGGKPXRVFPAPAALYNATYNTGTPYKFNLNSLSFYRICRSW

SEQ ID NO: 193219 - protein, 166 aa, Triticum aestivum
  unsure (1)..(166): unsure at all Xaa locations
  Clone ID: PAT_TA_87637.pep
SKRAFAYFVLSGGRFVYASLLRLLVLKFVLSMSASKDVLALASLEVDLSSIEPGSTVTVKWRGKXVFIRRRTDDDIKLXANSVDVASLRHPXEQDAERFENQEWLVVIGVCXHLGCIPLPNSWELGWLVCPXHGPNYXISGQIRKALPPFNXXCQLNSLGNTNLNS

SEQ ID NO: 193220 - protein, 115 aa, Triticum aestivum
  unsure (1)..(115): unsure at all Xaa locations
  Clone ID: PAT_TA_87638.pep
LVECETYRFRGHSLADPDELRRPDEKSHYAARDPITSLKKYIIEQNLASEAELKSIEKKIDDVVEEAVEFADASPLPPRSQLLXENVFAXPKGFGIGPDGNYRCEDPIHSRHGAI

SEQ ID NO: 193221 - protein, 107 aa, Triticum aestivum
  unsure (1)..(107): unsure at all Xaa locations
  Clone ID: PAT_TA_87639.pep
XRMGNLXLTPXWXFFIHSSXXPFKKNXXRNXSCKXVCKVTICVPVXGXXNLPSWXSLXIEDGEAKFVCWSFVISSCQGAKVISFSVVSCTMSSCLTVRRXVGMDIVE

SEQ ID NO: 193222 - protein, 141 aa, Triticum aestivum
  unsure (1)..(141): unsure at all Xaa locations
  Clone ID: PAT_TA_87640.pep
PSRLPFIPVTDVAGVIVDVGPGVNGLTAGDQVVAKLNSLNGGGLAEYAVASANLTVKRPAKVXAAEDAGFPLAASTALQXAEAIXSQFXQHXAALKVLITAAXVGLACYPVQLSKLXPSXLPQLAGPKXXLLKTLXQTSDG

SEQ ID NO: 193223 - protein, 92 aa, Triticum aestivum
  unsure (1)..(92): unsure at all Xaa locations
  Clone ID: PAT_TA_87641.pep
ASEAESAAPDEGHDGELGGXXAVGIEQEVGVTXALGLVEXELAGPPAXLDPFRVRARPLHEPAQLRRGDQHAAGPELAPLLRRRRRVDVRVI

SEQ ID NO: 193224 - protein, 166 aa, Triticum aestivum
  Clone ID: PAT_TA_87642.pep
GARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGVDHYNTARVSRRSQNYKNLRICNLGMSG

SEQ ID NO: 193225 - protein, 70 aa, Triticum aestivum
  unsure (1)..(70): unsure at all Xaa locations
  Clone ID: PAT_TA_87643.pep
AGRPXXRRXWWARWAWRRRRXTAPVEEVAPPADPFAMPXEVLHGANPELVVTYNGLEELFRLIHESXLDL

SEQ ID NO: 193226 - protein, 105 aa, Triticum aestivum
  unsure (1)..(105): unsure at all Xaa locations
  Clone ID: PAT_TA_87644.pep
KPXWGRYAFSXFLATILCSTGNHVRCLIISSHXLXHLQRSFEGKLHLLPGGSIVQFLKMANEKSHIKEERGLRSILLLKYLRTFMLGTAHPLRKIRISARCAFRG

SEQ ID NO: 193227 - protein, 100 aa, Triticum aestivum
  Clone ID: PAT_TA_87645.pep
EQDQRRVRDPDAADLGRSRRGHKRITHQQPGRGGGCRAPAVQRQPQRPRDLRSGEAGPDAAVVGDHCGELLPFRVSCDFACFLLLPTSWAAFKWGARQHT

SEQ ID NO: 193228 - protein, 164 aa, Triticum aestivum
  unsure (1)..(164): unsure at all Xaa locations
  Clone ID: PAT_TA_87646.pep
GRSGFTHVLVAVDXFTKWIEAKPXKSLDTGTAVSFIRELVFRYGVPHSIITDNGSNFDSEEFRTFCNSQGTRVDYASVAHPQXNGQAERANGLILKGLKPRLDAXISNTRLGAWVDELPSVLWGLRTTPNRSTGXSIXLVYGAEQSCQAIFSTSLKGGARVPIL

SEQ ID NO: 193229 - protein, 103 aa, Triticum aestivum
  unsure (1)..(103): unsure at all Xaa locations
  Clone ID: PAT_TA_87647.pep
EHIGANTIGXEVQAXLGAPXPXGPXRAPPSLIXAPXTLRLPPRKNHHTAQTRVLASFCCDFXIALLKASFTETVLGDCSSVCDSSNGPISCCSSALFIEXLCC

SEQ ID NO: 193230 - protein, 106 aa, Triticum aestivum
  Clone ID: PAT_TA_87648.pep
PSLYWQEVKDGVDDNTNHRRARMVFLLKNSIDILEQGSILMVITTHFVERLYEDAIEQQRHQAKGMMKQRLLEPRTTQARLQACCSRWNDKMRKIDVSFAHRQKVV

SEQ ID NO: 193231 - protein, 139 aa, Triticum aestivum
  unsure (1)..(139): unsure at all Xaa locations
  Clone ID: PAT_TA_87649.pep
AVELDVAAGGSAVXXAVXRAWDAXXRIDVLINXXGLRXGVHXSLDWXXDXWDKFIKXXLTGLWFXAXHVCXHMRDAKXKGXXFNISSVAXLXRCNLPGXXGYXSXKSAVHSXTKIMAFXLRXILXXXEXVXPGXXVRKL

SEQ ID NO: 193232 - protein, 116 aa, Triticum aestivum
  unsure (1)..(116): unsure at all Xaa locations
  Clone ID: PAT_TA_87650.pep
FTKXKTQXNMLAWXLSAMNQKHAKALNHMTTLTYXIKYILESATLTTPKQAGEVGLXSISKTRGQRYTFLXKXPSQNFXENDPLKEVGTQFEVVXNNLVQHTXTNINPXTKDLGXX

SEQ ID NO: 193233 - protein, 180 aa, Triticum aestivum
  unsure (1)..(180): unsure at all Xaa locations
  Clone ID: PAT_TA_87651.pep
GSPLNAIARYLKHWVINPYNTIPSAYIHKRAYSTSAFDVTAELRILHVVGPEPNVTVGGVHGIWFPGCCMLPENGTAPTPDPPTQAIIRRRPSPTTVLARSSSAALPPEVXGTXERXARIPXGVHFTGGGRYNPLXDLYPPXXXLXXDXKPGTXTLKXPFNXKTKAXXXSNXPMNDPVAY

SEQ ID NO: 193234 - protein, 95 aa, Triticum aestivum
  unsure (1)..(95): unsure at all Xaa locations
  Clone ID: PAT_TA_87652.pep
CPVVVFNRQLGGSPVIPKCQRVFRITAQVLXGXTSRXVNAAGYIPGTSCLGCSVGVIATNCLAPSFXXSLPXIQFSFFEAXTSKXERHRIKCYAT

SEQ ID NO: 193235 - protein, 77 aa, Triticum aestivum
  unsure (1)..(77): unsure at all Xaa locations
  Clone ID: PAT_TA_87653.pep
MSKPCDAKTEWPELVGRTIKEAEEKIKRDRPDLKSSLSRVRIFVTTDVXXNRLRXWVHTVAEVPKDLAKLTFTYQLG

SEQ ID NO: 193236 - protein, 151 aa, Triticum aestivum
  unsure (1)..(151): unsure at all Xaa locations
  Clone ID: PAT_TA_87654.pep
KAKIQDKEGIPPDQQRLIFAGKQLEDGRTLADYNIQKESTLHLVLRLRGGMQIFXVKTLTGKTITLEVXESSDTVDNVKXKXKTRKASPPGQQRLIFAXKHXQDWKTLXDYNIQEGXXFNLSSALXGXINFSXKPQPGRHHTLIGSGHIST

SEQ ID NO: 193237 - protein, 59 aa, Triticum aestivum
  Clone ID: PAT_TA_87655.pep
KQRCRSIIVLFHPFALSFELLLSSSHGVAASTGKAYSIPAQVATWVSRIWLKLESPMSW

SEQ ID NO: 193238 - protein, 98 aa, Triticum aestivum
  unsure (1)..(98): unsure at all Xaa locations
  Clone ID: PAT_TA_87656.pep
MGRYDDVNRYDERAPYGKVAHPSPEHFHPLHVALGAAEEGSKAELIHRSWTNTNXPYASYRFTAKNWMAASCAARSMPCHLHLTVAGCNQRQLLQDRA

SEQ ID NO: 193239 - protein, 131 aa, Triticum aestivum
  Clone ID: PAT_TA_87657.pep
YRKIGQIMRGVANRHSDGQMLIVQEGGYHISYSAYCLHATLEGVLNLEGPIAGTTQIRILSPKDEEITPWEAVRRQRKKRWERTIPFLERHFGRLTLLPANGQTTNLSPHVMVYPPGLNRTGPRKDDALNV

SEQ ID NO: 193240 - protein, 124 aa, Triticum aestivum
  unsure (1)..(124): unsure at all Xaa locations
  Clone ID: PAT_TA_87658.pep
XASKEGGGEKRGRKKGKKSVXTYKIYIFKVLNXXXPDIGISXKAMXIMNSFINDIFEKLAGEAAKLARYNKKPTITSREIXTSVRLXVLPGESAKHAVSEGTXPXTNSLLLIPLYPILFALIAN

SEQ ID NO: 193241 - protein, 79 aa, Triticum aestivum
  unsure (1)..(79): unsure at all Xaa locations
  Clone ID: PAT_TA_87659.pep
MHLVFSSLDSGLVXSCCLXTGPTLYVVGHIFGRVRSLACIPGXLLSSFIQSKDDFLFYNLIPHADMLVIECHKLHAYYH

SEQ ID NO: 193242 - protein, 108 aa, Triticum aestivum
  unsure (1)..(108): unsure at all Xaa locations
  Clone ID: PAT_TA_87660.pep
MSCCGGNCGCGTACKCGNGCGGCNMYPEVEAAGATLLVSATATHKASSGGMEMAAENGGCGCTQXKCGTKLRCSCCSASSSSIMHAPPVHNDCILLLHTCYRNLIRRL

SEQ ID NO: 193243 - protein, 65 aa, Triticum aestivum
  Clone ID: PAT_TA_87661.pep
AVPQDLLRQASMLIQRVWPSIDRSLTAWISKTVTIALFCSGGLRHPHPSEHAFLPPKKWVNFTYY

SEQ ID NO: 193244 - protein, 138 aa, Triticum aestivum
  unsure (1)..(138): unsure at all Xaa locations
  Clone ID: PAT_TA_87662.pep
RLRGGMQIFVKTLTGKTITLEVESSDTIDNVKAKIQDKEGIPPDQQRHLCWASSWRMGPHPPLDYNIQEGXTLHLVLLCXGGMQIFVXKTLNRKDIILRXXSSGHIDNFKARFKTRRIPPGNTHLFWETLXDGPPLKI

SEQ ID NO: 193245 - protein, 135 aa, Triticum aestivum
  unsure (1)..(135): unsure at all Xaa locations
  Clone ID: PAT_TA_87663.pep
YRSWAQRRGYRVTIIEEIPGELAGIKRATIKVDGEYAXGYAKSEIGVHRLXVRISPFXDSGKRRHTSFAAVXAVIPILGEALARYQDXQSVLPVXFRSGXTWRQHPTPTEVLFRLFTSPTGYNGTFSKXKXPXFN

SEQ ID NO: 193246 - protein, 104 aa, Triticum aestivum
  Clone ID: PAT_TA_87664.pep
SQQFSVEVSIPCSDDIMSRSGSHCNCPVHFTFTVELGNNNDEAHDIDLFHDPISWSSSESFQSHGKPSCVAFDQLNITSALVQEESRWNLDRLSDEIDLFKRFT

SEQ ID NO: 193247 - protein, 51 aa, Triticum aestivum
  unsure (1)..(51): unsure at all Xaa locations
  Clone ID: PAT_TA_87665.pep
XLVXIIDCXXTVXGCKCMPXYPENPLFTAHGRSTHVYPGPRVPQITANVIY

SEQ ID NO: 193248 - protein, 79 aa, Triticum aestivum
  unsure (1)..(79): unsure at all Xaa locations
  Clone ID: PAT_TA_87666.pep
WIIIRTLIVLPSPYFGCTFQPMFNCVCFPRVFFFFLEQHVLLMRLSSGEQRGXKGVLALGQVSTAXASSPAVGMQRSEA

SEQ ID NO: 193249 - protein, 103 aa, Triticum aestivum
  Clone ID: PAT_TA_87667.pep
QLRPARQLRRHAPILNTDGRPVQPPSHVAAPPRRSSSHSQPRCRPASACGDAARRSTILLSHSLLLIESSRRIDGDATSVQNIFYCYTTGYCILSIYPCQKKK

SEQ ID NO: 193250 - protein, 117 aa, Triticum aestivum
  unsure (1)..(117): unsure at all Xaa locations
  Clone ID: PAT_TA_87668.pep
LPPTPAPASGLISCNDCYSQCYFSCDASIPSKCSALCNVEVPCNSCKTSAIEECRTSKNCTDSCDECNDAPNFKCAFSCTTRNCIGCHYGMGQMCNKRCKKGLLXTXMRTLKGLETS

SEQ ID NO: 193251 - protein, 71 aa, Triticum aestivum
  unsure (1)..(71): unsure at all Xaa locations
  Clone ID: PAT_TA_87669.pep
QKCIFIXRGTLQGWDMCXPLNLGKLGSTCVYILYLDQESFQECISRKEHGISCMSSSEKWRGHLQLYSTTL

SEQ ID NO: 193252 - protein, 107 aa, Triticum aestivum
  unsure (1)..(107): unsure at all Xaa locations
  Clone ID: PAT_TA_87670.pep
HKGHXXVXQXSQLKCIWKHGTXTKTLEIKXDKVSHVTKMSADGSAKYILSRLCVWYLCCKPRHFVASGXYPRVFGKREPALQCRKTICAPDTSSLKPASGAAEGVLD

SEQ ID NO: 193253 - protein, 86 aa, Triticum aestivum
  unsure (1)..(86): unsure at all Xaa locations
  Clone ID: PAT_TA_87671.pep
MSDWKXEXNAAELKXGXEFLKAKCLMXCEVXIILXHKWEQLQHMXDXGAXQVSXVFEXSXAYVKRXKPLQXPDXVXQXRXXLSRYS

SEQ ID NO: 193254 - protein, 133 aa, Triticum aestivum
  unsure (1)..(133): unsure at all Xaa locations
  Clone ID: PAT_TA_87672.pep
MAKSSFKLEHPLERRQAEATRIREKYSDRIPVIVEKAXKSDIPDIDKKKYLXVPADLTVXGXSVYVCPKAVQVNAXKXIFTLVKEHLPTDSAXMSAFMRRTRRRRFLYITYSGEETFSIGVATSSLMLVRATV

SEQ ID NO: 193255 - protein, 129 aa, Triticum aestivum
  unsure (1)..(129): unsure at all Xaa locations
  Clone ID: PAT_TA_87673.pep
QHGFLVPDRSNPSVVRQFIKSRTASKIRLIYQVIKENYNKKCEEPNTIPTEXSGEFRCIXNIEVGGMLEKIXPQSLXARSLQRTQTRLEQRYVLGKYXRXLNGSHIXXCLSTXFLGXAXVQXHPNYKGG

SEQ ID NO: 193256 - protein, 136 aa, Triticum aestivum
  unsure (1)..(136): unsure at all Xaa locations
  Clone ID: PAT_TA_87674.pep
PARSRWSTSNDLCRARAVPRPRKRRRPGRYNCGSVNTTVVGARPASWAAKYPAIQCQRPTGXXVSTEEARXLHSXGETPRERFWIQLXKTWXEIYXTSSXYGKAFGNLXLPXIWMILXTKQXLHGKQLNSFFLRDX

SEQ ID NO: 193257 - protein, 141 aa, Triticum aestivum
  unsure (1)..(141): unsure at all Xaa locations
  Clone ID: PAT_TA_87675.pep
THTHTFITSRSIRQLASHGRREEGDDEQRRRWPPRWWRCWSWRRRPGATGYHVCNVDTDSWVNNCXPTARRAVRRHPSGACAGRCAAVTSTAPANYKGVLPKEHRRQPRHAIXRQXGTGGSWLSXTTTTXXXAVPVDYNXT

SEQ ID NO: 193258 - protein, 52 aa, Triticum aestivum
  Clone ID: PAT_TA_87676.pep
AYKYLYTRSILQKRRFIQRDDEILKRSRVSRAVRQGQVDRMEPPPRVARSAP

SEQ ID NO: 193259 - protein, 92 aa, Triticum aestivum
  unsure (1)..(92): unsure at all Xaa locations
  Clone ID: PAT_TA_87677.pep
ASSLLHPARSDXDXNQLLXGIXIYXASLNVPALTXNSNAXCLXXXSSIEFKGQECTNXTGXQHRXXDTEPQFPDXPVLXXCXVXXSVTDDXK

SEQ ID NO: 193260 - protein, 92 aa, Triticum aestivum
  unsure (1)..(92): unsure at all Xaa locations
  Clone ID: PAT_TA_87678.pep
RVAKWAIDLPPYTIYYQPRTAIKSXVLADFLVDWAETQYLPPTPXTPPIGRMHFDGQXMRTGLGAGSSSLLPKGDKFKYLLXSXXQLPNNIA

SEQ ID NO: 193261 - protein, 118 aa, Triticum aestivum
  unsure (1)..(118): unsure at all Xaa locations
  Clone ID: PAT_TA_87679.pep
PFXLXPKLWXIYTXKXRRCXNTAXDRKEEPLSFWHXTGLGKKAQSGNGMGXNSPXILISTRSVIMYXQLSLLLACRTLICLLGSCRLGRSPAVETAESRLGLGRKPPARLRCCDCCAA

SEQ ID NO: 193262 - protein, 75 aa, Triticum aestivum
  Clone ID: PAT_TA_87680.pep
SARDLFRSHVFTFCQVSLFRFLTLPGDPSLSFIHFQSLRWSVKDTFSYVLNINYPWFNPTGGPLEDFPSLRYISS

SEQ ID NO: 193263 - protein, 105 aa, Triticum aestivum
  unsure (1)..(105): unsure at all Xaa locations
  Clone ID: PAT_TA_87681.pep
VECXNXMTSWRPVYSILCATSLXMVSGQLXRYAFXLIYLLNNPCCSTSFLCXKHCPFLRLXNSSLAKCCKLISXILHFSWLPKIQGXLSNXSXXWDLFXNXFKXK

SEQ ID NO: 193264 - protein, 91 aa, Triticum aestivum
  unsure (1)..(91): unsure at all Xaa locations
  Clone ID: PAT_TA_87682.pep
GDQAEMKRRGRVASYKAYAVEGKVKASLRRGLRWIXKAKCSHIVHRYPPARRLPLPPPWVVNAGGRPDGGEERMRGMQAQTPSNPLRNSLM

SEQ ID NO: 193265 - protein, 69 aa, Triticum aestivum
  Clone ID: PAT_TA_87683.pep
LRAAAVEHAQERRWLEASFHVAQSSVLYSQIALFFTRIVVCKHSLHSSEFVGFATLCHYITIKKKKKNS

SEQ ID NO: 193266 - protein, 58 aa, Triticum aestivum
  Clone ID: PAT_TA_87684.pep
EIWRSMLRALRCGGGAATRGLLLAASASASGGSFTASIAAAAGGAPVVRLDRPEAEAV

SEQ ID NO: 193267 - protein, 107 aa, Triticum aestivum
  unsure (1)..(107): unsure at all Xaa locations
  Clone ID: PAT_TA_87685.pep
YKIYIFKVLKQVHPDIGISSKAMSIMNSFINDIFEKARRRSAKLARYNKKPXITSREDXASRPLXLPRASSAKHAVSRREXKAVTKXQLHPKSSLVLILGPFPLPPS

SEQ ID NO: 193268 - protein, 80 aa, Triticum aestivum
  unsure (1)..(80): unsure at all Xaa locations
  Clone ID: PAT_TA_87686.pep
ATYLPPLLAPDHALPEGDEGEEDDDSDSGSDEQHRGKNVGKAPALPPLRSALNTQDRRRXRKEGAXXFRSPKISITVSFT

SEQ ID NO: 193269 - protein, 121 aa, Triticum aestivum
  unsure (1)..(121): unsure at all Xaa locations
  Clone ID: PAT_TA_87687.pep
NTHTHSSQAKLAGEGSVEDVGXEKGRERGLGKGGAKRHRKVLRDNIQGITKPXIXXXAXXGXVXXHLXGSSXXXTRXVLKIFLXNVIRDAVTYTXHAPPQRPXTAMDXSXAXKRQXTTSYD

SEQ ID NO: 193270 - protein, 85 aa, Triticum aestivum
  unsure (1)..(85): unsure at all Xaa locations
  Clone ID: PAT_TA_87688.pep
DQLTELALLLLLCPYCSLLSLPXLIPSSRCSLPLLCLAXVQSAHCRCCSSSPTPLAAALLPRNCCSSLLSTLPGYSFSSNLLMLS

SEQ ID NO: 193271 - protein, 50 aa, Triticum aestivum
  Clone ID: PAT_TA_87689.pep
VRVAERVRMVMLGEEGDRAREKVRDLKLQADQCVAASLAVDNLVRYVLSL

SEQ ID NO: 193272 - protein, 158 aa, Triticum aestivum
  unsure (1)..(158): unsure at all Xaa locations
  Clone ID: PAT_TA_87690.pep
EYEIYKATNTLRKYCQVSRLNPEKSIPSSILKGAKGLAVLTVAKAGAVLTYKMGTGXLVVSRRXDXSWSAPSAILSVGXLGWGVQIGGELTDFIFVLMIFKLSKDLSNRXLSLGGRLNXAAXPIXKPXKQIFDKKVWESHLYSQAFLLKFDTVCTTRD

SEQ ID NO: 193273 - protein, 149 aa, Triticum aestivum
  unsure (1)..(149): unsure at all Xaa locations
  Clone ID: PAT_TA_87691.pep
GTGDAPNYIWHXPXMVRFRKHVASXPIRMFLAMDVGPDLGEQACGEFLSLWLCVHTWEPEVDVPDTVTWSWETNGRYSVRSAYAVGFWGREVAXMAELTWTSRAPSNCKFFTWLPXRDRCWTSDRLARRGLPHQDACPHYKDSGLLQQK

SEQ ID NO: 193274 - protein, 39 aa, Triticum aestivum
  Clone ID: PAT_TA_87692.pep
YHAHVIRLLCDMYVVLSAAGFSHHLFSFPTDKSPTVLDS

SEQ ID NO: 193275 - protein, 97 aa, Triticum aestivum
  unsure (1)..(97): unsure at all Xaa locations
  Clone ID: PAT_TA_87693.pep
MATRIQFXENNCEVXXVFSKLTNAYCLXVAIXGLRDFYSNXESXELAXVIPVGKTLSGXTRIIGXSGVWKQXXFSCQNTTTDQEFRSEEILINGCQH

SEQ ID NO: 193276 - protein, 66 aa, Triticum aestivum
  unsure (1)..(66): unsure at all Xaa locations
  Clone ID: PAT_TA_87694.pep
AVSLLCKIAALRSFSLXRLQYLXEXESGMXTLAYFLARDTIDHFNTALKPIIYLSMFYYFNNPRSS

SEQ ID NO: 193277 - protein, 53 aa, Triticum aestivum
  Clone ID: PAT_TA_87695.pep
AHMRRWKRTDKKFFGKARKVFDIEVLHKDPPPEGWRHGPVVYRFTVKKQRHNK

SEQ ID NO: 193278 - protein, 107 aa, Triticum aestivum
  unsure (1)..(107): unsure at all Xaa locations
  Clone ID: PAT_TA_87696.pep
AKVTFRHPFRYKHQKELFVAAEGMYTGQFVYCGRRATLSVGNVLPLRSVPEGGVICNVQHHVGERCVFAXXLPGDXAIVXXXNPXNXXXRFKXPPXAXXIXPXSASF

SEQ ID NO: 193279 - protein, 116 aa, Triticum aestivum
  unsure (1)..(116): unsure at all Xaa locations
  Clone ID: PAT_TA_87697.pep
TGFSCYCICPRNRLNKPNRWLVKSCRQAMEMGNESGERSNTMYKPGSESTLMMPLHQPWIETVFYSYWHQXLEXHXTRLPRYRLLGGAFLMLRPAVQRTRDXQRDREYXLLSKTRX

SEQ ID NO: 193280 - protein, 43 aa, Triticum aestivum
  Clone ID: PAT_TA_87698.pep
ELSRLLGSVTIAAGGVLPSIHTTLLPKKAGKGKGDIGSASQEF

SEQ ID NO: 193281 - protein, 59 aa, Triticum aestivum
  Clone ID: PAT_TA_87699.pep
HILIEKLHLKQSSMCLEQSIKCNCSSQLLTTFSARKNKHFEKGRSSDKLQFESLTSLHL

SEQ ID NO: 193282 - protein, 124 aa, Triticum aestivum
  unsure (1)..(124): unsure at all Xaa locations
  Clone ID: PAT_TA_87700.pep
PDPPPRVHREPATRPSINQVVEVLTHISKRESFDLPASLAYTIATRSAHNMREAILALEACRANSYPFVDGQAIPLGWDGVLEELAAEILEDSSPKRLXLGTRQAPKTLGESVPPKLVLQKPCS

SEQ ID NO: 193283 - protein, 151 aa, Triticum aestivum
  unsure (1)..(151): unsure at all Xaa locations
  Clone ID: PAT_TA_87701.pep
QTGLRRRHDRLPACSPPHGTSCVRGALSLPAGFDGVGRGAALPQIRNRVVRPVCRLLSTSTALCSSVFSPSAGCGGATPLSASSSYKSDGQTEPCGKQLHQLSDVQRFSSLRFFALLKSKHEATARCKFHQQCLFSWXRLNPPLIKYTDYC

SEQ ID NO: 193284 - protein, 66 aa, Triticum aestivum
  Clone ID: PAT_TA_87702.pep
LARRGGVKRISGLIYEETRGVLKIFLENVIRDAVTYTEHARRKTVTAMDVVYALKRQGRTLYGFGG

SEQ ID NO: 193285 - protein, 72 aa, Triticum aestivum
  unsure (1)..(72): unsure at all Xaa locations
  Clone ID: PAT_TA_87703.pep
LPPPSLVASLSMFTISLAMQAQSSIRVDVEAEWVKCQQCRRALLLRRNCXLXCXXXSNXRKRRXNLHKKDQG

SEQ ID NO: 193286 - protein, 147 aa, Triticum aestivum
  unsure (1)..(147): unsure at all Xaa locations
  Clone ID: PAT_TA_87704.pep
MLKLVLGTGNVEAARKLYERMQELQCKPNVVTYNLLMKLFNKEKSMDMVLRIKKDMDAQGVEPNVNTYGALIESFXWEGETGXRAHATPXGKWSKEKXLKPTKPVYDMVLMLXRXAGQLXKHEXLXESMADRGFIKRPSDALWEIAS

SEQ ID NO: 193287 - protein, 59 aa, Triticum aestivum
  Clone ID: PAT_TA_87705.pep
RGQFEHNCPPTNYSRFFKGKCPDAYSYAKDDQTSTFTCPAGTNYQIVLCPARNDLHMDQ

SEQ ID NO: 193288 - protein, 78 aa, Triticum aestivum; identical to SEQ ID NO: 106962
  Clone ID: PAT_TA_87706.pep

SEQ ID NO: 193289 - protein, 163 aa, Triticum aestivum
  unsure (1)..(163): unsure at all Xaa locations
  Clone ID: PAT_TA_87707.pep
DDKTLLFGEKPVTVFGVRNPEEIPWGEAGADYVVESTGVFTDKDKAAAHLKGGAKKVXVISAPSKDAPMFVVGVNXDKYTXDVKIVLKMXXEQIXXXVPLAXINXXQLPVIMKGXXTXVXASIAXKKXFYXPPXXRTXKGQXPSFYXIPXTIXAAKGVXKGLP

SEQ ID NO: 193290 - protein, 88 aa, Triticum aestivum
  Clone ID: PAT_TA_87708.pep
ARLSNSLPGHTIFSSWLNMANGTTWFTVSDFLKLTVTTSRVTDIEHMHASVTHLQNVSSWKHPKVENLIAYEYHCHFQQECSQLNDFT

SEQ ID NO: 193291 - protein, 63 aa, Triticum aestivum
  Clone ID: PAT_TA_87709.pep
RRPQCRSSRSTKLVLKIKHQVAGKAKTRQVPYRQAPTTCPPLDLSDTLTRLELCRYFPKEEGM

SEQ ID NO: 193292 - protein, 55 aa, Triticum aestivum
  Clone ID: PAT_TA_87710.pep
TAITFNASDKPKFRTALTPAALVLSPIVDGFRLTKVLMDEGSGLNLIYEETLHKM

SEQ ID NO: 193293 - protein, 73 aa, Triticum aestivum
  unsure (1)..(73): unsure at all Xaa locations
  Clone ID: PAT_TA_87711.pep
XTLALXKNAKVXDXXVGFDELGGKDDFSTXDLEERIAKAQVIFLDGQGPANPSKQAAAKLKRSLKILATQDSN

SEQ ID NO: 193294 - protein, 101 aa, Triticum aestivum
  unsure (1)..(101): unsure at all Xaa locations
  Clone ID: PAT_TA_87712.pep
TKAARKSAPATGGVKKPHRFRPGTVALREIRKYQKSTELLIRKLPFQRLVREIAQGXSKTDLRFQSSAVSALQEXPEGYWWGCSKDTNFCASSKLTLLXSS

SEQ ID NO: 193295 - protein, 102 aa, Triticum aestivum
  unsure (1)..(102): unsure at all Xaa locations
  Clone ID: PAT_TA_87713.pep
LINQERRAVEPCLINPELPSASSHQGRPMAFLGGSLGVTRSIGSRXXXRGKKAXAGPGRXRASAPRPXSSCSGRLKARCAXGQKRPAVKFGVXPQRVPLXIX

SEQ ID NO: 193296 - protein, 72 aa, Triticum aestivum
  Clone ID: PAT_TA_87714.pep
FFFLELLPVNPIYLIVTIQERSTNTSRIAMAKIHRVAIPVRRASSCRVNEGHDPVEHLLGLVAVGLEEVEDV

SEQ ID NO: 193297 - protein, 102 aa, Triticum aestivum
  unsure (1)..(102): unsure at all Xaa locations
  Clone ID: PAT_TA_87715.pep
DMELLMRPLLNHSDPICADMLSEATVGFSLQNANFVHLPCFNDKQWIVITANFDSGKSLDIMNPDGSGKQQITSNYQHCYIQLKEPVCENIPQLHPHSTXKI

SEQ ID NO: 193298 - protein, 152 aa, Triticum aestivum
  unsure (1)..(152): unsure at all Xaa locations
  Clone ID: PAT_TA_87716.pep
DPENGNADGQSDCKPGYTDVSSSPPEPSSGIEQRCRSLDESRDLQQKHQAPEELEFNDQLKAFDYAQARKNTSFGEVRXERRKDNAVASAINVDSGDKRKXLKQTPVPVAAKXDEGNFQESTKAQLPTFWXQECYVHXLFXNVYPXXXLYCT

SEQ ID NO: 193299 - protein, 138 aa, Triticum aestivum
  unsure (1)..(138): unsure at all Xaa locations
  Clone ID: PAT_TA_87717.pep
FADEKFVHKHTKPGILSMANAGPNTNGSQFFICTVPCNWLDGKHVVFGEVVEGMDVVKNIEKVGSRSGTCSKQVVIADCGXSSARARVAFRRRRRRPCPVCLNKKFLCVCLPWSVDKFRGWLRGLGPLGCGRRLVTSG

SEQ ID NO: 193300 - protein, 162 aa, Triticum aestivum
  unsure (1)..(162): unsure at all Xaa locations
  Clone ID: PAT_TA_87718.pep
RKSGVEGRACVPASSPPPTYSLRATKPRGGHGNMGLTVPTTPHPHLYRVNIARINSTEKPNRLPRPPRICSLPEARWWRARPTVASHHARWAWXAYPAKPTPRCMPATDGKXRSYQARQLIPTNAXKIPXRINWINRFRPAILIXRXXFXXGPQXETXRSPA

SEQ ID NO: 193301 - protein, 92 aa, Triticum aestivum
  Clone ID: PAT_TA_87719.pep
AKDNKKTRIVPRHLLLAIRNDQELGKLLAGVTIAHGGVIPNINPVLLPKKALEKAEKESQSPKSPKRKGPPPPHPPPRKTPKKKAADKKTAA

SEQ ID NO: 193302 - protein, 119 aa, Triticum aestivum
  unsure (1)..(119): unsure at all Xaa locations
  Clone ID: PAT_TA_87720.pep
RRXEPXIDSXRXIGTGPPFLQFWLINSTXVIGRHWQCSGHSRXTTXQKAINILAHKLQFXYDVLXLSREINXIKLKLWHFLHTATIFLTNMWILGGCAREEFTNQLGHASADLLNGVLC

SEQ ID NO: 193303 - protein, 109 aa, Triticum aestivum
  unsure (1)..(109): unsure at all Xaa locations
  Clone ID: PAT_TA_87721.pep
GSGWRRPSSEGSGVNSGSGDDRSIDFDCTSLLSRSCCSPTRLTLHVAYRXEHASSCIFTRLWDRSLEQTDXPSPPPTASLIIPPLLRLCXVNKTEGVTXDKDPXXGQTH

SEQ ID NO: 193304 - protein, 134 aa, Triticum aestivum
  unsure (1)..(134): unsure at all Xaa locations
  Clone ID: PAT_TA_87722.pep
ILCTRNPKIAITKLKIRFVLMPHVSLTIGRSVARAMATQKVGAAXFEIITXKAYTDCSPADLLQFANQXNILLVLSQXXLLDSSACCCAIXSLGNLTSTTSXXLQTLXXFAXNQCDSRIXLCCKXXMLSWFSLR

SEQ ID NO: 193305 - protein, 142 aa, Triticum aestivum
  Clone ID: PAT_TA_87723.pep
PSEGPGLLRLHSTYRHDLKIYSSDEGRVQMSAAAFAKGLLDLEGDLTPILVSLVSKDSSMLDGLQDGTIEISEAKAQLHDIIISSKVANGGDPAGFPWMVDGADVSTNAAQLLTNLAELTKKTPGGPGTNSPKILLRSMGLV

SEQ ID NO: 193306 - protein, 156 aa, Triticum aestivum
  unsure (1)..(156): unsure at all Xaa locations
  Clone ID: PAT_TA_87724.pep
LNSLNIGFDDRYNNSEVRDFNPCSYAFVAEQDWFRFEASYLDDDKFRDKFKDXVPAVLDWVVXHESCDEAVKNTTPYACISKNSHCIMSANATGYLCTCNNXSQATPTWKEGCQRFNSAASKLTLPRRNLGTHLLSNLDYNIQREKLQTIKFKKDL

SEQ ID NO: 193307 - protein, 112 aa, Triticum aestivum
  unsure (1)..(112): unsure at all Xaa locations
  Clone ID: PAT_TA_87725.pep
STLVTARTSEGAWQAFRGISWEQTDIIFSTKVICASSDRKEVHVFVPPRSTSXEQKPSYILRRKSISKXHARLLRGNSIVAQDKSPXTNSNKPSIPRRXFKSDDLPQETIHS

SEQ ID NO: 193308 - protein, 160 aa, Triticum aestivum
  unsure (1)..(160): unsure at all Xaa locations
  Clone ID: PAT_TA_87726.pep
LEQGNLDQGELEKAKEGQKKDFPDGIPECGTDALRFALISYTSQSDKINLDIKRVHGYRQWCNKLWNAIRFAMIKLGDQYTPPSXLAVHTMLPICNWILSXLSKAVGKTVSSLEAYKFSDXTSSIYFWXQYXLCDVXIEXIKPYXNGSXXFESQKXFRHA

SEQ ID NO: 193309 - protein, 76 aa, Triticum aestivum
  Clone ID: PAT_TA_87727.pep
MEAMNSFREACEHLGLIEHDRTLDDCMTEAATFQMPSALRRLFATILVFCEVTQIRQLWDKHLPSMAEDYRRTESN

SEQ ID NO: 193310 - protein, 77 aa, Triticum aestivum
  unsure (1)..(77): unsure at all Xaa locations
  Clone ID: PAT_TA_87728.pep
KPFCNAILSFWCSEDKVLDHRVDEVHSLTMHGHSCSVSCGCASTGRIFGYICMLLQVSAAAMMEKQYSKHNIIXPTY

SEQ ID NO: 193311 - protein, 113 aa, Triticum aestivum
  unsure (1)..(113): unsure at all Xaa locations
  Clone ID: PAT_TA_87729.pep
GGPFGENIFWGSGQSWTAADAVKLWVDEKQNYHLDSNTCDAGKVCGHYTQVVWRKSTRIGCARVVXRGNRGVFITCNYNPPGNFNGEXPFAFLNLXAQPIRVSVIIHAYYCVC

SEQ ID NO: 193312 - protein, 93 aa, Triticum aestivum
  unsure (1)..(93): unsure at all Xaa locations
  Clone ID: PAT_TA_87730.pep
DYXXXVQYHPIYIFCETLGKLRITVKCNRKVLARVSSSQQFFSIIKPPCKTFSIPTTANFLILLKIVCNSXESNGVANPCCFYLPPRLILVDR

SEQ ID NO: 193313 - protein, 98 aa, Triticum aestivum
  unsure (1)..(98): unsure at all Xaa locations
  Clone ID: PAT_TA_87731.pep
FKSSDRYWQTTGGLTRRGAFIDWVNPLPPIEEECAPVPRGVLKTCPFAVFVVNINRCVCYPSIYYVVEICAMVKFWVQLSEHLLQLIWFNNYFNPXNL

SEQ ID NO: 193314 - protein, 82 aa, Triticum aestivum
  unsure (1)..(82): unsure at all Xaa locations
  Clone ID: PAT_TA_87732.pep
WFLRDVANEQDAADNLVVEHSGTIELAGLRSGEAPAVAGTAIGKLAVSKGRQGREAQXNIVRLYLANIRLKNATTDVXINRI

SEQ ID NO: 193315 - protein, 112 aa, Triticum aestivum
  unsure (1)..(112): unsure at all Xaa locations
  Clone ID: PAT_TA_87733.pep
VASLVEGPCAKAYMSVPFGQPSSGGLGRTLSXEPTHESRVVLSNNSSVLSCAPHSHGTLCNGSFVQCHKIFLQSRCCYTTNLPCQXLLSXPAYTFTPYTLCDFAFDLPXACX

SEQ ID NO: 193316 - protein, 124 aa, Triticum aestivum
  unsure (1)..(124): unsure at all Xaa locations
  Clone ID: PAT_TA_87734.pep
TIHVPFAERAAPKGSRKLRVITVVDEAQVGQPIQPGLNILKMAWVGQAPSYGTCSRIGESASWKTCYPXDQRXEGKNGWPSLSKTIDQXGXIAVXKTNLKQRKFXGYHGLGTKRXQLXPKFPMV

SEQ ID NO: 193317 - protein, 74 aa, Triticum aestivum
  unsure (1)..(74): unsure at all Xaa locations
  Clone ID: PAT_TA_87735.pep
FLRRCXGPRSLXKSXGACKKAIGPGIREXAXLNCAVGAPWSWVEVRGSGRRXSRGEVIWRLSWFVNGRCPSGKD

SEQ ID NO: 193318 - protein, 74 aa, Triticum aestivum
  Clone ID: PAT_TA_87736.pep
MGQSPYKEDVSSTTMPLGTVRCGGKSCSPPHTHTPKIDKWGKVHTRKMCQLQLCPSGTVGCEGQSCFPPPPPIR

SEQ ID NO: 193319 - protein, 144 aa, Triticum aestivum
  unsure (1)..(144): unsure at all Xaa locations
  Clone ID: PAT_TA_87737.pep
MAEKTAPTNPMKDLKIEKLVINIAVGESGDRLTRASKVLEQLTGQSPVTSKARYTVRSFSIXVRNEKIACHVTIRGPRPXRFWERAFEVKEYDXKKRNFXETGTWSVXMTHHXGTTPRYRLPFTPYGHPYPPQDTRRSQHKQEE

SEQ ID NO: 193320 - protein, 143 aa, Triticum aestivum
  unsure (1)..(143): unsure at all Xaa locations
  Clone ID: PAT_TA_87738.pep
VVQGAVDVDIGANPSAEGGGDDEGVDDQAVKVVDIVDTFRLQEQPAFDKKQFISHMKRYIKNLSXKLEGDDLDFFKERMFSLXKLLLNKLKGLQFFXLAKCNNNALPRELFQSNFAKAKKGNPGNTGNILPPPRGQNPFPGQK

SEQ ID NO: 193321 - protein, 80 aa, Triticum aestivum
  unsure (1)..(80): unsure at all Xaa locations
  Clone ID: PAT_TA_87739.pep
RFHYGPHTDVCRCILEFRFTHFALYVVHSGISTKTYLGTEGVHILPLFVCLCVAARSFDAVAASXTLLCLHQPRLMALNQ

SEQ ID NO: 193322 - protein, 159 aa, Triticum aestivum
  unsure (1)..(159): unsure at all Xaa locations
  Clone ID: PAT_TA_87740.pep
RPQTLDEESASCREKRKFALPGATHSAQASYHTPKYRKLSGLKLDLSDCEVESPPQRSGVRKGSMQTEPTRKPGHHVATSSHNKDKHHGRSDAICNAIQQYAICIAEAVKDIYVDSIQENQDRRFLFISTAELPNXNTIIKGAXXESWVKGPQXAPKTI

SEQ ID NO: 193323 - protein, 135 aa, Triticum aestivum
  unsure (1)..(135): unsure at all Xaa locations
  Clone ID: PAT_TA_87741.pep
LVPAPXGFWVDALRISKKKDDALDVVWPAHFTVFLSFFPSFLFSFXTFIFMXXVFIXIFIFKKIHVFLRILXPNSRTFFSSSHSKNVHQCKKIFIEFIFCSSYLKNFYQNSRYVHRIHNLFIILKNIFINFYNCS

SEQ ID NO: 193324 - protein, 58 aa, Triticum aestivum
  Clone ID: PAT_TA_87742.pep
WVEKFNITRRPVEYRHDVRFYQAGCFDGYITAHYQSPQHMICLWRKLQSGSTHCCNVR

SEQ ID NO: 193325 - protein, 64 aa, Triticum aestivum
  Clone ID: PAT_TA_87743.pep
LRFDLIILKYEDKMSEILVSKERSLRGILFFFNLRFKKGLHERISRLTNYYTFFYRTSYVTYIH

SEQ ID NO: 193326 - protein, 64 aa, Triticum aestivum
  Clone ID: PAT_TA_87744.pep
VFQSEILVCRGHMRRPEFRDASWSAGGCPKQLGLWVTRLCGVVIQEKAASYRGDGLGRLCVWTM

SEQ ID NO: 193327 - protein, 140 aa, Triticum aestivum
  unsure (1)..(140): unsure at all Xaa locations
  Clone ID: PAT_TA_87745.pep
DTVDEGIFWLVQEKLTHFTDSCMGYIYVMSTPNTYTSDMKMVDSSDTKATGYKGSNKWCTTTCTKNMASGLDEANKMISNRMHSNGIILLFSDGLINKGDFFDXTKKFISKVPSTRLLSADTHXTCSPLRFRKSPGGKFT

SEQ ID NO: 193328 - protein, 67 aa, Triticum aestivum
  Clone ID: PAT_TA_87746.pep
VYKSYATLLAMDAHFYMIIALFTICFQSIALGLSHDADATFPLQEAQSARVQPKILIAHWYMFVFQG

SEQ ID NO: 193329 - protein, 143 aa, Triticum aestivum
  unsure (1)..(143): unsure at all Xaa locations
  Clone ID: PAT_TA_87747.pep
EIYDVHGVRVILENKADCFTTLEVVHHLWPRIPGKFKDYVSSPKSNGYQSLHTVVLSEETLPLEIQIRTADMHLQAEFGIAAHWRYKEGVRNCSSSLPEMVEWVRCVVTWQCETXHIDNLRLLDLVSPRATCXFPSDSNXVLL

SEQ ID NO: 193330 - protein, 139 aa, Triticum aestivum
  unsure (1)..(139): unsure at all Xaa locations
  Clone ID: PAT_TA_87748.pep
FLLPSTLDAQFGTPYPRSAGLDTDIGAFIESFTVPLSHRSMARLIIKENIILGGALASVQTLRLGGFTMIARSASEPXRMTSRVIEKCIYLDSEYTKRMDXAXLSSLNELLDCIAPLGVTTDYNRIGLKPDKREINSPX

SEQ ID NO: 193331 - protein, 55 aa, Triticum aestivum
  Clone ID: PAT_TA_87749.pep
RRRVQGARAARPAARRNRYRYQHHYRPAGGASWDPCSPMIISCSCAYKMKLTLWL

SEQ ID NO: 193332 - protein, 72 aa, Triticum aestivum
  Clone ID: PAT_TA_87750.pep
MTFKAYFMNAIHLATCSSIWHTVVYSILNTIVFFFSFLRFICRSSKLFSSIESCDSVYGMNIHIMTRMPHIL

SEQ ID NO: 193333 - protein, 98 aa, Triticum aestivum
  unsure (1)..(98): unsure at all Xaa locations
  Clone ID: PAT_TA_87751.pep
LPLTALLHIRSPPRRGRRGGAPPAPSTXQPHLTPPPAPPALPSATAPPPHLVRPIRRASGPPCDSTPSPSLSATFLPLPPLLPAVSPRLPQPSAAPPI

SEQ ID NO: 193334 - protein, 132 aa, Triticum aestivum
  unsure (1)..(132): unsure at all Xaa locations
  Clone ID: PAT_TA_87752.pep
LEPSAAAATSALSFLLRSKMKFIAAYLLAYLSGNASPSAEDLTSILESVGCEIDNEKMELMLSQVKGKDITELLAAGREKFAAVPSGGGGXAVSAAAPAAGRCCCPCSLSQXKERSXEKGRDDDDMGXXLSD

SEQ ID NO: 193335 - protein, 74 aa, Triticum aestivum
  unsure (1)..(74): unsure at all Xaa locations
  Clone ID: PAT_TA_87753.pep
ENMYRDDQCGLLCVQQTFDDTFPQPPHTVIIVILSPGDSHMHPFIHYFKLRNPCDYLSSESHTIKFQRERPXWF

SEQ ID NO: 193336 - protein, 65 aa, Triticum aestivum
  Clone ID: PAT_TA_87754.pep
HVARISIHANIGPDFFSLYIECSSLLLGRCHLIYFIMIFSSEEQQASLISRGSFRIFDRGEIGQR

SEQ ID NO: 193337 - protein, 43 aa, Triticum aestivum
  Clone ID: PAT_TA_87755.pep
PATLPKTVVVANGHVKKTELETQKSVTEAWKKFVLAKKTNGVC

SEQ ID NO: 193338 - protein, 76 aa, Triticum aestivum
  Clone ID: PAT_TA_87756.pep
TTRNYKPYILTCLQPRKVDAEWKPEYVYTLIFGKTNQIKDHQLPRKLKDYKPETTNLFSPMKGNITIFIFTISQHY

SEQ ID NO: 193339 - protein, 122 aa, Triticum aestivum
  Clone ID: PAT_TA_87757.pep
CLYIACMYKHRFSPFWHYNCIVLVVLLVHSSYNLFLCLLMAMANTMLHGKIVTHLRLVPPQDQCALLSSAFICAQLCVSHHGLPLLLLGTVKFVIGFEDVPRSPTTCIRHVLQRCSVKFYYC

SEQ ID NO: 193340 - protein, 118 aa, Triticum aestivum
  Clone ID: PAT_TA_87758.pep
DLSVIDGFNTPMSFQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 193341 - protein, 97 aa, Triticum aestivum
  Clone ID: PAT_TA_87759.pep
KIEQTLYASSRGSKKLGSSQRLLSSSFEAFRSSGFEAFRSSGLLSSGFEAFRSSGLLSSGFKAFRSSGFEAFRSPRLLSSGFEAFRSPRLLSSGFEA

SEQ ID NO: 193342 - protein, 103 aa, Triticum aestivum
  Clone ID: PAT_TA_87760.pep
SVTVNQKHGPTFLHHIPLIKKRKTRLKTRIGREIIRDLNTKNQIMDHIVAVFAHPLIHAPWRQCKKRENLQKQSNQTRRRLTIAKNQHRGPDWHWEPRRGGGY

SEQ ID NO: 193343 - protein, 95 aa, Triticum aestivum
  Clone ID: PAT_TA_87761.pep
PPNTSNPSSCAGVRGETKARWWTPPSLSDPGLRERERGGSPARESTRTLARHQGAATIAATPWASSDLCQPVRLKRDLAVDCWCFPSPDDQHDLG

SEQ ID NO: 193344 - protein, 173 aa, Triticum aestivum
  unsure (1)..(173): unsure at all Xaa locations
  Clone ID: PAT_TA_87762.pep
EIDKAELIAFYSKFIAPWSIKILVALLIFFVGQLVAKFVARILGKVLGRTKLDRILVEFIQSLVNALLLVFVIVAALDQLGVNTNSXSSAVLGAAGWAIGLXIARPLQNSAAGFMLLIFRPVQKAGXLVEQXGTAGVIEKLGFFKRPARRYKEVIIPNASTAAISITKTPTPA

SEQ ID NO: 193345 - protein, 30 aa, Triticum aestivum
  Clone ID: PAT_TA_87763.pep
ECLLVTAAWGFFFRILFYFSLVLGSKNKRR

SEQ ID NO: 193346 - protein, 122 aa, Triticum aestivum
  unsure (1)..(122): unsure at all Xaa locations
  Clone ID: PAT_TA_87764.pep
WDAERAAVDDSGGRRRRRQALLLLSQSTTDGGLPYWVSKRFAKVNGLGFTSHPDLGLGSKTPTWQLSFPVXQTPFXCPALKPANGLCIKMRTXCXRCXQQEXXSVQEGTKEXPKHKDXEGQA

SEQ ID NO: 193347 - protein, 159 aa, Triticum aestivum
  unsure (1)..(159): unsure at all Xaa locations
  Clone ID: PAT_TA_87765.pep
RVKLTEKFPGIKFVVAKKADSLYPVVSGASIVAKVTRDRALRNWVFDETAQNMHMNTGSGYPGDPNTIQWLKDHKHPVFGFPNFGCVLSWGTCTAYFXEWSLKHMGGRSMKMQLATEAPSDHVVQLRFTGFKRPRRFSWKRRCSSQRLLINSNGLALHT

SEQ ID NO: 193348 - protein, 109 aa, Triticum aestivum
  Clone ID: PAT_TA_87766.pep
SGFKEGTTNLEAVAWCCSERDRSPRLGRPSLNKAVGASSFDSSTLVDADRGIDKAVDITRLEGRSASILHQSKLTFVVNDIVAAIAGCLEEGKELIVEAGGLVVEVRGV

SEQ ID NO: 193349 - protein, 64 aa, Triticum aestivum
  unsure (1)..(64): unsure at all Xaa locations
  Clone ID: PAT_TA_87767.pep
KRHXLCFNQYVYLCTTYPLKAXXEXSGSFFVTKPHLILLSLXVFWQTTRFFRNYECSLLDRSPF

SEQ ID NO: 193350 - protein, 57 aa, Triticum aestivum
  Clone ID: PAT_TA_87768.pep
LLQTFPPGCETQKKVMIVKPITSQIFGCETFSSRVSLCAVARENLQHLTGCSGQYSL

SEQ ID NO: 193351 - protein, 111 aa, Triticum aestivum
  Clone ID: PAT_TA_87769.pep
LHHHASFLATVCHVPIIADKWFLATVCQAAHMVCVVESYVLFQLIALRSLIKLCVPYHTCIFFLNRVRWIGHRTLFFLADGSIFLPFVMVTSHTLQFKSVQLVCLHSMIVH

SEQ ID NO: 193352 - protein, 102 aa, Triticum aestivum
  Clone ID: PAT_TA_87770.pep
EALPPAMKHAFSVVVADPPYLSQECLEKVAKTVSFLARPQGSFLLLLTGEVQKDRALELLNVRPCGFKPQHSNKLGNVFRLFTNYDPVDRLGGWDQSDGAPI

SEQ ID NO: 193353 - protein, 135 aa, Triticum aestivum
  unsure (1)..(135): unsure at all Xaa locations
  Clone ID: PAT_TA_87771.pep
GGXGARVILPDGXVRRVSLXXTAAXLMXDAPGHFVAETRHARVGTRLEALHADEDLEMGVVXATFPMNRIGTKAGXADMARLAAAXXREARRSAKVSSVXVRAAAXKGAATKPGITGRGSGVKPVDKLLNRGPGI

SEQ ID NO: 193354 - protein, 63 aa, Triticum aestivum
  Clone ID: PAT_TA_87772.pep
ASHSTCLVDVYGYKRPVLPMELMGKHALMIFVLVACNVAPILLQGFYWRVPNNNLLKLIGRGD

SEQ ID NO: 193355 - protein, 76 aa, Triticum aestivum
  Clone ID: PAT_TA_87773.pep
PICTSNVGHAEYQKNLLQHAIYTCTQNHKLSRGCLPKRDRAELEPSELIPDALSIKIQPSLQHLRQAPDSNLGEKH

SEQ ID NO: 193356 - protein, 84 aa, Triticum aestivum
  unsure (1)..(84): unsure at all Xaa locations
  Clone ID: PAT_TA_87774.pep
LGRTVRGNXNEYCRFSRXKKQXQXTDDIKRXDXXLTXHIFLCAIPKYQXLTPXXRXHGDXETLLPXKXKEXXXPXXNXXRQQQE

SEQ ID NO: 193357 - protein, 82 aa, Triticum aestivum
  unsure (1)..(82): unsure at all Xaa locations
  Clone ID: PAT_TA_87775.pep
MSCCGGSCGCGSACKCGNGCGGCNMYPEVEAAGATLLVAATATHKASSGGMEMAAEDGGCGCTQCKCGTXACRCSCCKLLNH

SEQ ID NO: 193358 - protein, 57 aa, Triticum aestivum
  Clone ID: PAT_TA_87776.pep
TVEVMLANLVYCFDWELPHGMREEDVDMTEEFGLTTRLKEKLLLVPTIPPQHAHHTS

SEQ ID NO: 193359 - protein, 64 aa, Triticum aestivum
  Clone ID: PAT_TA_87777.pep
REKKYSYHLKQDSSEEKINNELSGGEPCGSIFVTINSHAKLVILDSCYWLQELVKTRRRMRGRC

SEQ ID NO: 193360 - protein, 135 aa, Triticum aestivum
  unsure (1)..(135): unsure at all Xaa locations
  Clone ID: PAT_TA_87778.pep
SRSVEPSAAAPPSALSFLLRSKMKFIAAYLLAYLSGNASPSAEDLTSILESVGCEIDNEKMELMLSQVKGKDITELLAAGREKFAAVPSGGGGVAVXAAAPAAGGAAAPAAESXKEEKSXEXEESDDDMGFSLFD

SEQ ID NO: 193361 - protein, 133 aa, Triticum aestivum
  unsure (1)..(133): unsure at all Xaa locations
  Clone ID: PAT_TA_87779.pep
LLCASLGLAVLKLGKVCTFAFDVVGHKNRYLALPLPLLGSFLGSQDLEGCHADGDQSRQIDRTRSSRSRLAGPIGKLDLNLHVCTILNIVSSKFDPSASRSICMHSCVAAICNVDTCEGGRGKFTXGLIADGR

SEQ ID NO: 193362 - protein, 120 aa, Triticum aestivum
  Clone ID: PAT_TA_87780.pep
SGGLVATEVAGEADGGDVSRDTNHQNSESNNINEDLDQTFHGNVSKVQASNIDLTKPYASGSMLLDGIRKMLQKSDERKQRRNVLKEQSRKRSRAQMGVCIKEEQEKERLLPLSFFGKLV

SEQ ID NO: 193363 - protein, 67 aa, Triticum aestivum
  unsure (1)..(67): unsure at all Xaa locations
  Clone ID: PAT_TA_87781.pep
ISADALSSVFFSSALAYVIYIVXLIQRTVVKQIVIHFLYEKCTLMNLQLADDKMCGHLLTSVWPMWY

SEQ ID NO: 193364 - protein, 64 aa, Triticum aestivum
  unsure (1)..(64): unsure at all Xaa locations
  Clone ID: PAT_TA_87782.pep
WTDPXRRCGRGSSXDPPPVKHNSXNISLSFSLELLDFCFMLYDXSLPSLLFHQMDSPHACEIEI

SEQ ID NO: 193365 - protein, 55 aa, Triticum aestivum
  unsure (1)..(55): unsure at all Xaa locations
  Clone ID: PAT_TA_87783.pep
VLFIWLTVQFSLXWMRKYSLFEYRVMCNAYLIYLFXWVNLGLFDKCHCNFCQKKK

SEQ ID NO: 193366 - protein, 110 aa, Triticum aestivum
  unsure (1)..(110): unsure at all Xaa locations
  Clone ID: PAT_TA_87784.pep
MSCCGGNCGCGTACKCGNGCGGCNMYPEAEAAGATLLVSATATHKAKLRRHGEWRRENGGCGCTQCKXAAPSCGCSCCSCFDHRPYACTVPCVHHRSYRSTNYQYNVTAT

SEQ ID NO: 193367 - protein, 129 aa, Triticum aestivum
  unsure (1)..(129): unsure at all Xaa locations
  Clone ID: PAT_TA_87785.pep
MKFIAAYLLAYLSGNASPSAEDLTSILESVGCEIDNEKMELMLSQVKGKDITELLAAGREKFAAVPSGGWWVAVSSRCXPAAGGAAAPAAESKKEERXWRKEXMMNDMGFIXFRFLGLVSAIIPWAKKL

SEQ ID NO: 193368 - protein, 86 aa, Triticum aestivum
  unsure (1)..(86): unsure at all Xaa locations
  Clone ID: PAT_TA_87786.pep
SQGQTLSHCLPVKKRILVIIGAVRIRRKQNQLLKYVLTGATKTACLTMFWCDASPNSSIFSLGIIXVPNSGKSVIKXXIGRKDCAP

SEQ ID NO: 193369 - protein, 75 aa, Triticum aestivum
  Clone ID: PAT_TA_87787.pep
WWPLSPQECWTYCQLASTKTETKLSLAQDQTNINACCIHQQSCITKQCAKQRGWCVLPVCVLDLDGCAVLGEDGG

SEQ ID NO: 193370 - protein, 147 aa, Triticum aestivum
  unsure (1)..(147): unsure at all Xaa locations
  Clone ID: PAT_TA_87788.pep
SLEPSAAAATSALSFLLRSKMKFIAAYLLAYLSGNASPSAEDLTSILESVGCEIDNEKMELMLSQVKGKDITELLGCXGREKFAAVPSXGGGXLAVSSCCPCCXGGAAALAAXXKKEEKPLEKEESDDDMGSICSICGLPIYLGQRN

SEQ ID NO: 193371 - protein, 59 aa, Triticum aestivum
  Clone ID: PAT_TA_87789.pep
ALMVGGLYNVLWGKRIEQVTLSKQGGIETNAASFDLEEQESGAPVPLTRDSIKQCERED

SEQ ID NO: 193372 - protein, 66 aa, Triticum aestivum
  unsure (1)..(66): unsure at all Xaa locations
  Clone ID: PAT_TA_87790.pep
GGKGVESCTCTLTNRALLSLXYTTDSIVTYMLLLLQYQSSRTIECPSLKYFSFLHLMRVERNGLLD

SEQ ID NO: 193373 - protein, 58 aa, Triticum aestivum
  Clone ID: PAT_TA_87791.pep
FFFFAGEFTVLQKQIDRVGRPRSRSSTLLQLHARTHHKLTRLLADRSTQGWMDSFKAN

SEQ ID NO: 193374 - protein, 141 aa, Triticum aestivum
  unsure (1)..(141): unsure at all Xaa locations
  Clone ID: PAT_TA_87792.pep
KIIRSFIKSECEVAAAPLGSAYEVQEDYSCDSLVQVLSGTGTAELTSCLNMSILAMGNVKKFRDGLPIGLQQHQTLHVHQRQDEFTCVRSVLNAIIDDLSGPSKKXIESVSLTLLMNALGKCWXGHKRLTDGXAKLCCQNF

SEQ ID NO: 193375 - protein, 78 aa, Triticum aestivum
  unsure (1)..(78): unsure at all Xaa locations
  Clone ID: PAT_TA_87793.pep
MNKLQTKKPWNLSFSFGRALQQNTLKAWSGKTENEEXAKAAFLVXCKANSXXXLXXYXGXAXLAXGAXEXLXVKDYXY

SEQ ID NO: 193376 - protein, 64 aa, Triticum aestivum
  unsure (1)..(64): unsure at all Xaa locations
  Clone ID: PAT_TA_87794.pep
LLCXRIXKSSSFSRSHIILXQHLVTXXXNXHVLSPPFSGFXHLRQISKMQGQTKIHILSYLRLS

SEQ ID NO: 193377 - protein, 144 aa, Triticum aestivum
  unsure (1)..(144): unsure at all Xaa locations
  Clone ID: PAT_TA_87795.pep
MASTTFRRFGVXAAAAAFXTLXXFGXXXASKTXFVKSXVXGHDVVIFSKSXXXYCKXAKAVFXELXLXKXPXVXXLXXRXEDGGEXQDALSXMXXKRXVPQXFIXXKHXXXSDDXXVDXYKMGNWENSHQCQRWRTFTNPPVLG

SEQ ID NO: 193378 - protein, 93 aa, Triticum aestivum
  unsure (1)..(93): unsure at all Xaa locations
  Clone ID: PAT_TA_87796.pep
MNLTISINCLQLRESRMSAVAPRSLAGEEKKTSWPEVVGKSAEEAKEIILKDMPDADINVLPAGSGXTLDFKXTNRVRINRRQPLRTIPSNWV

SEQ ID NO: 193379 - protein, 140 aa, Triticum aestivum
  Clone ID: PAT_TA_87797.pep
DDDDYEAPPAAASAAAALGSSRRRVAGVNSTKYRRVRRRLSGRWAAEDTQQRQRVWLGTCGGDAEEAAPSYDSETRRVRGKSARLDSPNEGCSRRRSLPGIIDLNHPPAVSGDHVISAHADACMTKMRLNAGPTSGWRPV

SEQ ID NO: 193380 - protein, 169 aa, Triticum aestivum
  unsure (1)..(169): unsure at all Xaa locations
  Clone ID: PAT_TA_87798.pep
DNVKAKIQDKEGIPPDQQRLXFAGKQLEDGRTLADYNIQKESTLHLVLRLRGGMQIFVKTLTGXTITLEVESSDTIDNVKAKIQDKEGIPPDQQRLIFAXXQLEDGRXLXADYNIQKESXLHLVLRLVANKLAMERFVGSVCAFIFPNGVLSPRISVWDHLCSVVLKCS

SEQ ID NO: 193381 - protein, 152 aa, Triticum aestivum
  unsure (1)..(152): unsure at all Xaa locations
  Clone ID: PAT_TA_87799.pep
QIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESTLHLVLRLRGGQ

SEQ ID NO: 193382 - protein, 153 aa, Triticum aestivum
  unsure (1)..(153): unsure at all Xaa locations
  Clone ID: PAT_TA_87800.pep
NDGMVLEAIIYRLLKKYFDEQPFYVNLLEIFLETTYQTELGQMLDLLSQPQGEGNVDLSTLNHKAYXKIVIYKTAFYSFYLPVALGMLLTGYQFKKDRAXSTKPLYSHTMGEFFKIXDDYLDCYGDQRXLARPSHIEEKKCGGWPHCIARARR

SEQ ID NO: 193383 - protein, 73 aa, Triticum aestivum
  Clone ID: PAT_TA_87801.pep
LEEREEEREGKRALREEPALARAPRHFVRMRSGPHNKKVVHSFDLLLYMLAIRWAVDDMALAYSQQLAILLTI

SEQ ID NO: 193384 - protein, 67 aa, Triticum aestivum
  Clone ID: PAT_TA_87802.pep
GGEVHGDTLSFFGVHQLAAPESRIAVIGGTGKYETAKGFAAIRTLHPGDQHAADGVEGLLQFDIHLS

SEQ ID NO: 193385 - protein, 100 aa, Triticum aestivum
  unsure (1)..(100): unsure at all Xaa locations
  Clone ID: PAT_TA_87803.pep
SFXRQPSDRDERDGERLEEARGEEKKRKERRNWTGRXNGXATXAPFXLXHWRFDFQGKQSXVXAASQWQVEKQAFSCRGDNDRPRSSVCLSNTRRRRHDN

SEQ ID NO: 193386 - protein, 135 aa, Triticum aestivum
  unsure (1)..(135): unsure at all Xaa locations
  Clone ID: PAT_TA_87804.pep
MAAWLQDLVAVGYRQPRLMSLEIDRPRAAIGHGDKQEFGPKKLPSVHLGVEEIGEVSTEIGNLIKWRKHFGDVVXIVHCTXPVDRTALEWRLLYGXRIFRAXXXPSKQGNQXSLLXIHNLHIIQVXPKXFDXFKR

SEQ ID NO: 193387 - protein, 157 aa, Triticum aestivum
  unsure (1)..(157): unsure at all Xaa locations
  Clone ID: PAT_TA_87805.pep
APRKQLATKAARKSAPATGGVKKPHRFRPGTVALREIRKYQKSTELLIRKLPFQRLVREIAQDFKTDLRFQSSAVSALQEGAEGYLVGLFEDTXCAIHAKRVTSCQGHQXARRIRXEKAKAHHALKLLLEVCVLMFKCCVVLSWWLCLSMLLVATME

SEQ ID NO: 193388 - protein, 75 aa, Triticum aestivum
  unsure (1)..(75): unsure at all Xaa locations
  Clone ID: PAT_TA_87806.pep
KRNIPNKKNIGMWTRMKMTGSRERFGNDKPLWKQRRGHLLQFPDHKATKKKNSXKNLGKTKEKERAKIRLSQTLP

SEQ ID NO: 193389 - protein, 64 aa, Triticum aestivum
  Clone ID: PAT_TA_87807.pep
PVIAVQTPCIFRLGVHIYMMVLVTPYSVSVWLMLVSAVTSSKRHHPWQSFIRAYGFRSSLNFLG

SEQ ID NO: 193390 - protein, 95 aa, Triticum aestivum
  unsure (1)..(95): unsure at all Xaa locations
  Clone ID: PAT_TA_87808.pep
LXPSGLGCWXNWLKXXQPKISIFPILGGXVGNXXXALIXIETPDTNLVVLVPSQHPPPTTVYPLGPTVHIKWHLWNHIPNRNSSKVTREIKAWIF

SEQ ID NO: 193391 - protein, 63 aa, Triticum aestivum
  unsure (1)..(63): unsure at all Xaa locations
  Clone ID: PAT_TA_87809.pep
HPHALFLCKVFTCISSFFLSLINTSIVNHIKSFRNXXXQXKNSRGGARTQFPPIXRXIXXAQX

SEQ ID NO: 193392 - protein, 71 aa, Triticum aestivum
  Clone ID: PAT_TA_87810.pep
DQKERRRRFRKLQNQANNSCNIKQFLTVPKLCEFGLIRKFRSRASICKKNQLKRSYETQVMIKQSLNSNLL

SEQ ID NO: 193393 - protein, 61 aa, Triticum aestivum
  Clone ID: PAT_TA_87811.pep
MCPGMGVAMLHLGYFVANLVREFEWTEAEGDLAVDLEPQVGFLNVMERPLRALLKLRNKRA

SEQ ID NO: 193394 - protein, 79 aa, Triticum aestivum
  unsure (1)..(79): unsure at all Xaa locations
  Clone ID: PAT_TA_87812.pep
MSCCGGNCGCGTACKCGNGCGGCNMYPEAEAAGATLLVSATATHKASSGGMEIAAENGGCGCTQXCKXGTSCGCSCCNC

SEQ ID NO: 193395 - protein, 54 aa, Triticum aestivum
  unsure (1)..(54): unsure at all Xaa locations
  Clone ID: PAT_TA_87813.pep
ITNAPLLSQKLPFWXAGTDXXXDIIVNGKEXXXLTGSSQVXRIXGKXCXTXXAP

SEQ ID NO: 193396 - protein, 179 aa, Triticum aestivum
  unsure (1)..(179): unsure at all Xaa locations
  Clone ID: PAT_TA_87814.pep
SPLTSEKHEVIDLQGHVAPCVKHEGNFYEGFYRTHVSTLAVKNNLLVAGGFQGELICKFLDREGISYCSKSTHDDNGITNCLEIFEKPSGXVHFXASNNXCGLRDXDMENFKCATFHFDWGCEHTXLDPDXKTMXVVGDNPDVFWLMLFREMITTHGHLDIRCXAWDQTAYIATGTRQK

SEQ ID NO: 193397 - protein, 149 aa, Triticum aestivum
  unsure (1)..(149): unsure at all Xaa locations
  Clone ID: PAT_TA_87815.pep
KDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVXETGVIKPGXMVVTFGPTGSDN

SEQ ID NO: 193398 - protein, 157 aa, Triticum aestivum
  Clone ID: PAT_TA_87816.pep
PQPDPNPQPLPDPNTKPLPDPQPNPNPQPLPGPQPDPNPQPFPDPNPKPLPNPQPNPNPQPLPGPQPDPNPQPLPDPNPKPLPDPQPNPNPQPLPGPQPDPNPQPLPRPKPTTTARTAGPRMHNQNHHLGHKRKRKMWHTSKRSAGMSVRVHQPRQI

SEQ ID NO: 193399 - protein, 85 aa, Triticum aestivum
  Clone ID: PAT_TA_87817.pep
QNKDHTSYLVLQRTSNTQVKQRLHFLIIIRPNHDTETKNRSSHSCQITVSQIQLLSPLPHRPQLIHMAFFLTHLFGQTKKKCLKN

SEQ ID NO: 193400 - protein, 109 aa, Triticum aestivum
  unsure (1)..(109): unsure at all Xaa locations
  Clone ID: PAT_TA_87818.pep
PGAHSSHATQKRSTRRLSSRRRGATHRPRGLRHTSAAAHGRTAHRHTAHSSRASRSRPAYDSTRPQVHPATTGNTVGRYALRDATLGLELKDEFLGXKHKLWQENPTFY

SEQ ID NO: 193401 - protein, 90 aa, Triticum aestivum
  unsure (1)..(90): unsure at all Xaa locations
  Clone ID: PAT_TA_87819.pep
LNSHLALFNSVXKEVAAVKQILXDVECLVGEKENVVSDLKCKVQRISVLXKDFVEKLSFLGDKISSYQLELRNXARIIYGLKEQLDAEEA

SEQ ID NO: 193402 - protein, 88 aa, Triticum aestivum
  unsure (1)..(88): unsure at all Xaa locations
  Clone ID: PAT_TA_87820.pep
HKFYHGRTGRVCNVTKRAIGVEXNKQVGNRIIKKRIHVRVEHVQPSRCNEEFLQRKLNNDKLKEGKGARRGHQQQEGANKGQTRGFKG

SEQ ID NO: 193403 - protein, 173 aa, Triticum aestivum
  unsure (1)..(173): unsure at all Xaa locations
  Clone ID: PAT_TA_87821.pep
GGLRAATSLSDIQLFDCPSLDLAHGANFLPLSLGKLRIQRCMVTTNFFSCDLPFLMNLSMFGCRSSASLSIGHLTSLESLSLGGIPDLCFLEALSSLQLRYVHLTDVPKLXRECISQFRVQKSLYVXSLMMLKHMLSAEGLQXSTILSLEXCKEXSVSFXEQQIHTVKCLRYV

SEQ ID NO: 193404 - protein, 46 aa, Triticum aestivum
  Clone ID: PAT_TA_87822.pep
CSGASAMRFSAYLRSTNHSFFATCSILCSERFIFPFALGLIWGGGC

SEQ ID NO: 193405 - protein, 155 aa, Triticum aestivum
  unsure (1)..(155): unsure at all Xaa locations
  Clone ID: PAT_TA_87823.pep
HAPRDAASFDEETRALIAPDAGSLPAAPPSAVEANFARYFAADYLNPGHDQYVYRHPNGLCVVGLATAHVALKEEGGITAIDFNVGKTDRSEIKVTGKRKRNAQHLQENSALCKVCTKDKTXVVRCCVKGQLLEINDRLXKQPDLLNXSADREXT

SEQ ID NO: 193406 - protein, 103 aa, Triticum aestivum
  Clone ID: PAT_TA_87824.pep
HFVQHLPPVSNNEPKGPVSLFSLLSFSQTKERKVPSHTSLPGEGEDNGVDQASFKEDLHCREADDRKAKLPKSEQLVLIFKSYLPRTTVLCMENLCAEEPTRS

SEQ ID NO: 193407 - protein, 75 aa, Triticum aestivum
  Clone ID: PAT_TA_87825.pep
RGNTMKLPSRSNSMAPPSTMAGHASLQMNMFLRAWKQRPSKVMLSDDYSWKMFSRSSRRSASQFHYLNEIWKNER

SEQ ID NO: 193408 - protein, 103 aa, Triticum aestivum
  Clone ID: PAT_TA_87826.pep
PVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 193409 - protein, 70 aa, Triticum aestivum
  unsure (1)..(70): unsure at all Xaa locations
  Clone ID: PAT_TA_87827.pep
CVFGLHMVMEPFXASLTTVXSVHPCSYMIQXAKSFCSGTXKXASVISPHVTXNEXTXXLKLXTWXXXVXX

SEQ ID NO: 193410 - protein, 53 aa, Triticum aestivum
  unsure (1)..(53): unsure at all Xaa locations
  Clone ID: PAT_TA_87828.pep
VALAYECVLPHRLCPRSLRPPESGLQLHGRFQACLVVHLHSHNLASVXPPXAV

SEQ ID NO: 193411 - protein, 150 aa, Triticum aestivum
  unsure (1)..(150): unsure at all Xaa locations
  Clone ID: PAT_TA_87829.pep
RHRRRVIFSVIVTAVVAGVSLQNFPVGTAAFLGTAKGFRVGLNLVIAIALHYIPEGIAVALPAYFATCSKWQAFKLATLLVFRNNXXNYPPILXXSNFNPKILEGHLXKGRXXDFLTRLRCHFIPTQAFPFPKFELSSRDFLPKGIALLT

SEQ ID NO: 193412 - protein, 88 aa, Triticum aestivum
  unsure (1)..(88): unsure at all Xaa locations
  Clone ID: PAT_TA_87830.pep
FNYFELVLVTNIAMSGSIKSMSVKGTNTAWIPMSXNWGANWXCLTGLKRXALNFSXXSSGGXYKXLQEVXXXWWXFGKXXQPGKIQPF

SEQ ID NO: 193413 - protein, 83 aa, Triticum aestivum
  Clone ID: PAT_TA_87831.pep
YSSGRSVSPSSRMIVFCHAEILICAIVLQHHLSIAIVFLSFQIQDNEYEFMGTAQYGPMLSHLYCLMCLLQMCHHQLQDEAAS

SEQ ID NO: 193414 - protein, 92 aa, Triticum aestivum
  unsure (1)..(92): unsure at all Xaa locations
  Clone ID: PAT_TA_87832.pep
GWVXXKXTGXXGXEXPRXXXLKSCFSPGXDXDXXFXXASXXGKVIWXKNINFQNLXXLGNQNXKKNLSLFTXFLSYQKAILYPKIFLSFLIT

SEQ ID NO: 193415 - protein, 75 aa, Triticum aestivum
  unsure (1)..(75): unsure at all Xaa locations
  Clone ID: PAT_TA_87833.pep
APPTPSASPPDXPRLLSFSTNGKLSKRKNXMPRSCGGYGXAHWCSPCERHGSERPGTKXCCQXLVVSSTXFFSGL

SEQ ID NO: 193416 - protein, 72 aa, Triticum aestivum
  unsure (1)..(72): unsure at all Xaa locations
  Clone ID: PAT_TA_87834.pep
MRHWNLGRCKEHVTAHKWVPIERLVSRFLKHLXGSKDVAGVGLSSECLKSLECLDAETYDAVMQTYVLAGRT

SEQ ID NO: 193417 - protein, 163 aa, Triticum aestivum
  unsure (1)..(163): unsure at all Xaa locations
  Clone ID: PAT_TA_87835.pep
MGRVIRAQRKGAGSVFKSHTHHRKGPARFRSLDFGERNGYLKGVVTDVIHDPGRGAPLAKVTFRHPFRYKHQKEXFVAAXGMXTGXCLMAGRRARSPFXKVLPXLRSXPEGSVICNVXXNNFGERCVFAKGSGDYAIVINXNXDNGLKVKXPLXLKXVQTXSC

SEQ ID NO: 193418 - protein, 63 aa, Triticum aestivum
  Clone ID: PAT_TA_87836.pep
ARVSFHVPAGRLDGRRSLANDTLLFLPGPTSNLSTLVSGFAAKGLSAEDMVVLSGAHSIGGSN

SEQ ID NO: 193419 - protein, 52 aa, Triticum aestivum
  Clone ID: PAT_TA_87837.pep
FFFFMRSTLIIFLLAKQAEFHMNDTPALEAWKRKGKDTPVLHIHRITSFCLG

SEQ ID NO: 193420 - protein, 141 aa, Triticum aestivum
  Clone ID: PAT_TA_87838.pep
PADVGRQLAEVQKQFALLNQLTAAPATQTALVVAASEQADRTLLIAQAVTESIEKMAQAPSARLVNLAGRQRMLSQRLAKNYFLHAAKVDSKVVQAQLAADAADFRQALQTLKATPVSTTASATNWSADQWLFSLRRPKKK

SEQ ID NO: 193421 - protein, 113 aa, Triticum aestivum
  unsure (1)..(113): unsure at all Xaa locations
  Clone ID: PAT_TA_87839.pep
VTDCAASVTAGMTDFYCVSCPPAGTASGTTTYANIXXNKCVAASATCGSTXKANTWXTNADCALCNGTAANANQYAASNXSACQATAAKVQRCSPRCLRFSLFYLKTNNNEYL

SEQ ID NO: 193422 - protein, 169 aa, Triticum aestivum
  unsure (1)..(169): unsure at all Xaa locations
  Clone ID: PAT_TA_87840.pep
SVKDLEEGSMSSVVDCLLVLRDNLNPGVVDDNSQDVSKIPSRKKWRVRETDESLVAAAPQGKTPSGENRGNGVPYPKSQQENSCLQWKKXREIFQLKRGSYADLPAAKXSXEMMHSNSLXDYASTQSLLTVXNGIXGRXIEKKKGRNPHRGIFLLRKXCKKLTSRVPDT

SEQ ID NO: 193423 - protein, 99 aa, Triticum aestivum
  Clone ID: PAT_TA_87841.pep
THGCFWSGSSNQRWTACTQCKRSPAPWMFPKDSASCCSPPPLPSPPPTATVLEVSWTAVTPGQEPWRLARPPSRSCATVHGLKACEEYPLLAVRCSQQW

SEQ ID NO: 193424 - protein, 58 aa, Triticum aestivum
  Clone ID: PAT_TA_87842.pep
GPCSRWGRSSALRGTGRDQAQLQGHQTPPTSLVPAPFTIIFSPDHQLLQDPTRWPQAD

SEQ ID NO: 193425 - protein, 109 aa, Triticum aestivum
  Clone ID: PAT_TA_87843.pep
QEKIHRQKERTSAGDPGAREGSHFLLGCQSAMDVYISEEYVIQRRAEKRAAARRAAMADGDKEEAGRSRWTASWADAEQKKGNADANANAIANAAGWELQGAANEVIPA

SEQ ID NO: 193426 - protein, 46 aa, Triticum aestivum
  Clone ID: PAT_TA_87844.pep
PVNKMTLTLALLTATKHKFSTTVAKHKFSTAVQNSETKNKGREEVT

SEQ ID NO: 193427 - protein, 81 aa, Triticum aestivum
  Clone ID: PAT_TA_87845.pep
KEEVDRFPSEVPSGDAAMAAGEKPSSDASLMASLRGIAPTGVLFVAGVMSALIMFFLLYKSKLRPHVTTQQNQPSCPASFD

SEQ ID NO: 193428 - protein, 112 aa, Triticum aestivum
  unsure (1)..(112): unsure at all Xaa locations
  Clone ID: PAT_TA_87846.pep
FRKVSNWRAFXLKVTNXFGKGIFRXKYLRQPSKVLXXLSNKKDYLKLESHSSEHYKXXKQTDIASTPYQLTVQKRAIRIKKYNIYWQHREYSQLKYFTMVKDVIKKYNVVNY

SEQ ID NO: 193429 - protein, 123 aa, Triticum aestivum
  unsure (1)..(123): unsure at all Xaa locations
  Clone ID: PAT_TA_87847.pep
STVDVLFSSRXGWSLVXNXLRRXGEXVRGXLAAVVXERRRRLPWPCHAVTLGFAVEVALEGHGVVPDAQMRLEAARGPCRTAPTPTRATSSAYSWSCGWPIYMKLIPSVVVANIIHIIHIVMY

SEQ ID NO: 193430 - protein, 120 aa, Triticum aestivum
  Clone ID: PAT_TA_87848.pep
ADKVARMCSFETLTGLEVNQVGGGSLGNKVHIDNSVFYRKGEVGDWVNHMSREMGEKLRRHPSKEKLQGSRVVFLSKHLLCVVFSFVFPVKTLICFFNSKTLNPTFSITTLQHVSPNFKK

SEQ ID NO: 193431 - protein, 113 aa, Triticum aestivum
  unsure (1)..(113): unsure at all Xaa locations
  Clone ID: PAT_TA_87849.pep
VSKSSEENFITVVGGHWLMPTPSNKVRRLSMQSSGSKHGNSTKGMNLSQVRSLTAFGKXNRRLPFHSFNNXIIQVLNLXGLEGLTNXHMNDIXKXQAXXFCPKTVFRSHFEQF

SEQ ID NO: 193432 - protein, 120 aa, Triticum aestivum
  unsure (1)..(120): unsure at all Xaa locations
  Clone ID: PAT_TA_87850.pep
MQIFVKTLTGKTITLEVESSDTIDNVKAKIQDKEGIPPDQQRLIFAGKQSRTGATFADXNIQKESTLHLVSASGGGAKKRKEEXYTKPKEAKDKTRSXTXVLQFYKTTHRKVTSEGCPNP

SEQ ID NO: 193433 - protein, 63 aa, Triticum aestivum
  unsure (1)..(63): unsure at all Xaa locations
  Clone ID: PAT_TA_87851.pep
KMDFVXCKLXRXWVWFXNNPPIXXISCXSXYFXVPXAXPLLLRETGXPNWICLLFLIGXVPCF

SEQ ID NO: 193434 - protein, 81 aa, Triticum aestivum
  unsure (1)..(81): unsure at all Xaa locations
  Clone ID: PAT_TA_87852.pep
PRXTSXXIXNWATXKYKRKTXTRXQYSCKKTAKVIVRXEXKYXXMDXKILYXSXSNHPRRPXXLSGIVLPFPAYDHXPVPG

SEQ ID NO: 193435 - protein, 73 aa, Triticum aestivum
  unsure (1)..(73): unsure at all Xaa locations
  Clone ID: PAT_TA_87853.pep
XXFTIXRXRHHLNRHAQEPAALLFTAKQIDTKIQPSERISPGRRTHACLRATSSLCCPALGTQLGRGAPRVRT

SEQ ID NO: 193436 - protein, 115 aa, Triticum aestivum
  unsure (1)..(115): unsure at all Xaa locations
  Clone ID: PAT_TA_87854.pep
EGKTRGRKKGSKAKKGVETYKIYIFKVLKQVHPDVGISSKAMSIMNSFINDIFEKLAGESAKLARYNKKPTITSREFQTSVRFFFPGQXAKXXXSEGTKASISVQLMALTFFGFK

SEQ ID NO: 193437 - protein, 118 aa, Triticum aestivum
  unsure (1)..(118): unsure at all Xaa locations
  Clone ID: PAT_TA_87855.pep
PFQVPTSSSDHDALREANPAAASATAAVGTDHVDVMSTRLEIVISDEPASSHPPCQSAAPAPSASEEHPCAETRRRSSQGIATVDALPTHDIRALVKFPQKTKKLXEINMVKCFPRXA

SEQ ID NO: 193438 - protein, 88 aa, Triticum aestivum
  unsure (1)..(88): unsure at all Xaa locations
  Clone ID: PAT_TA_87856.pep
LXSRKFFXXVEKAXNLGRRVCCHQLRLXVXTRWELXNDXXFHXFLRILSXXSNQLECPPAPLANGIXXGXTSCNXVXKDLPXXNSDXD

SEQ ID NO: 193439 - protein, 114 aa, Triticum aestivum
  unsure (1)..(114): unsure at all Xaa locations
  Clone ID: PAT_TA_87857.pep
EIFVEMKAIIQELQVALRKDDDAATQAKIQSYTRLVKKSKNLFKKTAKKAPADCSMVMLLAKAREISMSLLESTLHLFSKQIEMPKHLLFPRHFTRRRQMSCPISXGGPVPIRL

SEQ ID NO: 193440 - protein, 70 aa, Triticum aestivum
  unsure (1)..(70): unsure at all Xaa locations
  Clone ID: PAT_TA_87858.pep
FPXNGAASWARTSFSLSRSRCWNPATCFYHPLTVSIHVRXRPVAFRPVVYPPARPSVPLAVDLLILSSET

SEQ ID NO: 193441 - protein, 104 aa, Triticum aestivum
  Clone ID: PAT_TA_87859.pep
ISSPPSNLRNLKLEVGRYNIQGMPKLPEWIKKLENLVKLKIGFRTSGQVEQDGAIGALGNLPNLAVLRLDVISFNGEELHFGAEEFRSLVVLELSRTRKTSWLI

SEQ ID NO: 193442 - protein, 57 aa, Triticum aestivum
  Clone ID: PAT_TA_87860.pep
LRDSSVCDANGLKLWHPKTFLKRRRTYEIFQRLKLGFQTSAHVKRYEASDKFLKPTN

SEQ ID NO: 193443 - protein, 114 aa, Triticum aestivum
  unsure (1)..(114): unsure at all Xaa locations
  Clone ID: PAT_TA_87861.pep
FYHGRTGRVWNVTKRAIGVEINKQVGNRIIKKRIHVRVEHVQPSRCNEEFLQRKLNNDKLKAEAKARGEVISTKXRQPAXPKPXFMVGXEQQSXTXTPIPXKSSKFSRGGYKFS

SEQ ID NO: 193444 - protein, 110 aa, Triticum aestivum
  unsure (1)..(110): unsure at all Xaa locations
  Clone ID: PAT_TA_87862.pep
XGLTNYKVIGNXRISFASCPRGMVIPLQTQILGRRCLRSFSGYLFLTPNLCIVMVGYRCPLELMKVNRSRFLEDFLAPGKQEGLNLATLPTVRNCKAHSIISMVIVAHQT

SEQ ID NO: 193445 - protein, 125 aa, Triticum aestivum
  unsure (1)..(125): unsure at all Xaa locations
  Clone ID: PAT_TA_87863.pep
GGQAALXELIGLGAEEFPNMTXDXAAXRCGRAVEXXXTPXAEKPFSXRXQGATSRTPTYGQNPRAARERAGCQPKPNPNLQGHPRAVEWRGNPPLPRPRGERYPTLPHVVHPTLSGRLGRPEGVG

SEQ ID NO: 193446 - protein, 60 aa, Triticum aestivum
  Clone ID: PAT_TA_87864.pep
ITRCSELFSVNVLNPRLVHIFGELYYPKTSRVFPPVCFSIRLLINTARFDDGPCSLSGFG

SEQ ID NO: 193447 - protein, 144 aa, Triticum aestivum
  Clone ID: PAT_TA_87865.pep
LLEDLVLFSGYGCSRGIGKNSAIFSAALLRIFRFREKHKSRCSQNSPSTLFCLVSILGHSCLSFGLPLRSPVMESSQITGDGGEECNSNESGWTIYLTSPTSSYEAKENGSEGSNVEDGSGTSRRGGKERREQPDDDGDMIPGV

SEQ ID NO: 193448 - protein, 77 aa, Triticum aestivum
  unsure (1)..(77): unsure at all Xaa locations
  Clone ID: PAT_TA_87866.pep
KKQXKSHKPEXNGLKIDXIHEXNSWEIXNKTFNRICXMLLKTVILVNKKGIQCQXCAGXEFLHXRDFXXXTLAXNKL

SEQ ID NO: 193449 - protein, 115 aa, Triticum aestivum
  unsure (1)..(115): unsure at all Xaa locations
  Clone ID: PAT_TA_87867.pep
EIKGHRGQIKAKVSKQKGEVYFFLRLPSVYGLRIFLWCQNHGYWWLRMGSVWCFCAFCPNFFGVFWGDMNSSVLSWELCIYMWXVLCSSRLLKTXNAINCPNSANGELNLVHGGS

SEQ ID NO: 193450 - protein, 61 aa, Triticum aestivum
  unsure (1)..(61): unsure at all Xaa locations
  Clone ID: PAT_TA_87868.pep
FFFYCXXYFDYTAVQXDKNQANPNIGXLAGLSTRGLSFQLYIXQFDSIYYNVFVTRLPXXS

SEQ ID NO: 193451 - protein, 106 aa, Triticum aestivum
  unsure (1)..(106): unsure at all Xaa locations
  Clone ID: PAT_TA_87869.pep
RKVSVIPYASAHCSIMYADVVHKPDVSLAISMAGRFQSXPGVDHWTVVKNILKYLKRXXKEMFLVYGGDQELVVKGYVDTSFDTDPDDSKSQTGYVYVLNGGAVSW

SEQ ID NO: 193452 - protein, 87 aa, Triticum aestivum
  unsure (1)..(87): unsure at all Xaa locations
  Clone ID: PAT_TA_87870.pep
XQEXVCDCFVLXQSIKWGRGGNPFXSKKNCTFFSSEKEGLILIAQTDRQGVPHRPLINSHNKATFSAYLANLCSDLNSHKYTSSSRS

SEQ ID NO: 193453 - protein, 96 aa, Triticum aestivum
  unsure (1)..(96): unsure at all Xaa locations
  Clone ID: PAT_TA_87871.pep
LDDREPPVAKEAIVELTKFACTENHLHVNHCRAIVDEGGARHLVQLVYLGDELQIEALILLCYIALHVPENQEVXQGXVLXXLXWRXKQTQFVSRR

SEQ ID NO: 193454 - protein, 44 aa, Triticum aestivum
  Clone ID: PAT_TA_87872.pep
EIKVDLSKNIIMQHTKHECSLFFFPIYPNYNIHGSYFCTNFVFS

SEQ ID NO: 193455 - protein, 70 aa, Triticum aestivum
  Clone ID: PAT_TA_87873.pep
FFFLNTKGNGTFIGTSLECMHCGWEYLTHVYGIRRYYYPYVRWLLHAYTCYICSAAHHGQKTIWSRLPAA

SEQ ID NO: 193456 - protein, 174 aa, Triticum aestivum
  unsure (1)..(174): unsure at all Xaa locations
  Clone ID: PAT_TA_87874.pep
XPLXSIXXXVPXGRPXXVLXACXGFLRGTFXSIPPGGPASXPVGLWGKETPLCVSQAKIFRWWGGRESRGTKEVQEQMQLXYNKLDRDRALVRGCRSKRLVQENKDQTHVVLIEGKFSTHLLKGRLIFRFKRKINPSTKMSTPSICSSPTPMISFSPKLRISLPASAGLFRGPA

SEQ ID NO: 193457 - protein, 142 aa, Triticum aestivum
  unsure (1)..(142): unsure at all Xaa locations
  Clone ID: PAT_TA_87875.pep
FFFSXPFWQXXFKAAGXQXYSARPTHPQTDGQXERVNQCXETXLRCFTSSFPXRWSFWIPLAQFWYNKSXHSAIGMTPFKAMFGYEPRHWEITAENSCSVPALQSWIEERDTVQELLQQHLNRARQLMKNQADKKRSFRTYE

SEQ ID NO: 193458 - protein, 93 aa, Triticum aestivum
  Clone ID: PAT_TA_87876.pep
CSKINQEKTKVKENSFSLAILAPLVANNLLRGRRCNLELRPPQRVWPAPATRPSHPSSSWQPPPWPLSSLSLRIYAQPYNISVGHRRPQRRIN

SEQ ID NO: 193459 - protein, 148 aa, Triticum aestivum
  unsure (1)..(148): unsure at all Xaa locations
  Clone ID: PAT_TA_87877.pep
SVTRSVKAGLQFPVGRIGRYLKKGRYAQRVGTGAPVYLAAVLEYLAAELLELAGNAAKDNKKSRIIPRHLLLAVRNDEGARQVLAGVTIAHGGVXPNINPVLLPKKRREKGRQGAQXPKKXPAQRSRHPKKLKRIHLYFKCVCVCSEY

SEQ ID NO: 193460 - protein, 70 aa, Triticum aestivum
  unsure (1)..(70): unsure at all Xaa locations
  Clone ID: PAT_TA_87878.pep
GEWVXGPPXFNVNDSFFCHALLKENASPITXXPGKFGKIHPFLVSGSWKQKKHLPRRWRYMSTPGDMVGF

SEQ ID NO: 193461 - protein, 155 aa, Triticum aestivum
  unsure (1)..(155): unsure at all Xaa locations
  Clone ID: PAT_TA_87879.pep
MATQISKKKKFVSDGVFYAELNEMLTRELAEDGYSGVEVRVTPMRTEIIIRATRTQNVXLGEKGPQIKELTSVVQXRFNFPGRTAFDFYAEKVVKXVGFXXIRQSRXLPXXXPSGGLAFXKGXKGXLPLVMENWGQRFLXHXNWELXGQXSKSXN

SEQ ID NO: 193462 - protein, 60 aa, Triticum aestivum
  unsure (1)..(60): unsure at all Xaa locations
  Clone ID: PAT_TA_87880.pep
XAPIFPFRNIIIRLWMVLRPRFRACTSGISSSSSSDSPKETELLIFDKAIQDLHSLSVFL

SEQ ID NO: 193463 - protein, 50 aa, Triticum aestivum
  Clone ID: PAT_TA_87881.pep
QEHFRIRRISWLSLIRLSLFSPALRVHSSAIPVPLGDISTSFNKVVRRGG

SEQ ID NO: 193464 - protein, 44 aa, Triticum aestivum
  Clone ID: PAT_TA_87882.pep
NCFVVAWVLVVGFGFGGWASTVNFVRQVNTFGLFTKCYQCPPRH

SEQ ID NO: 193465 - protein, 43 aa, Triticum aestivum
  Clone ID: PAT_TA_87883.pep
CRPSRYSDFFKSECPQAFTYAHDSPSLTHQCSAPRELKVIFCH

SEQ ID NO: 193466 - protein, 77 aa, Triticum aestivum
  unsure (1)..(77): unsure at all Xaa locations
  Clone ID: PAT_TA_87884.pep
AKQTICPAPLPEDPADARLTGLLAPSPHVVLEKKAKKKATGTRKSSRFQVLSDDDSEANSSQGEXGRKKKVXPGGEK

SEQ ID NO: 193467 - protein, 83 aa, Triticum aestivum
  unsure (1)..(83): unsure at all Xaa locations
  Clone ID: PAT_TA_87885.pep
GSLCPSSSHQPGTNGVGQERGPLVPVCPTNRDQRVMTNRDQCPHEARQAXSLTNRDRWPHGSWFWTEPGLMGHLGMDQSPIFY

SEQ ID NO: 193468 - protein, 101 aa, Triticum aestivum
  unsure (1)..(101): unsure at all Xaa locations
  Clone ID: PAT_TA_87886.pep
PXGDCTAPRVAXLXLYPSGXAVITCLQFFGEIIGSTYYXXCIMILXRIXPRSWXGPSHXRMRAVYQWDHXESPNRWTIGTSSVLRGRVLXTVGLNXLGPKP

SEQ ID NO: 193469 - protein, 147 aa, Triticum aestivum
  unsure (1)..(147): unsure at all Xaa locations
  Clone ID: PAT_TA_87887.pep
XLCKCWSPYQFLLDKVHLFNALRIIPCLQIXPCISNVLDISSSTIDKYYHRAXYKMHQIHLTFELCPVMKKLGCICLMRWNLFRSPSFNFFLVSHFQVTQLIPDPFSCVITHEIQQVLQYRQMFTWHGNRVNFIASGWCRVFIILNW

SEQ ID NO: 193470 - protein, 92 aa, Triticum aestivum
  unsure (1)..(92): unsure at all Xaa locations
  Clone ID: PAT_TA_87888.pep
XIGPPPXXPFLGXLGATXNYXLKGXIFPMXIMWFGISLAGNFSQVRIVKLXVXGLLEMQFMGKSLKLFFXRSPLGRGPSTTFTEGKGNAVSH

SEQ ID NO: 193471 - protein, 111 aa, Triticum aestivum
  unsure (1)..(111): unsure at all Xaa locations
  Clone ID: PAT_TA_87889.pep
ACFRRANNGGRGSSPQDFVAATSTIYLIHWVKRAAAATPRQDATLEAKCTNYPKEGSIHLFRXKSAQEFSQYRTVFFLNLWRHVHKKRNPTKILISVVNMVXVSFAYXHGK

SEQ ID NO: 193472 - protein, 95 aa, Triticum aestivum
  unsure (1)..(95): unsure at all Xaa locations
  Clone ID: PAT_TA_87890.pep
RPCRPPFSSSVASRRQPPKETXPRSSRSWPRPRQNSAGGAARCRCCCCRTRPGAGRLTPRRTRPRRLXNCPPHHFXRXEGPSTQFXPKVSPIXXA

SEQ ID NO: 193473 - protein, 190 aa, Triticum aestivum
  unsure (1)..(190): unsure at all Xaa locations
  Clone ID: PAT_TA_87891.pep
GCLQVTPYGDAGILSLAVLSWLSPLLSVGTKRPLKLAHIPLLAHKDCAKFCYKAMSRHYERQRMECPDRQPSLAWATLKSFWREAGINGAFAAXNTAVSXLGPGLISYFVGXLSYKNFXPHEGXINCLPIFVSKXIETXTAXLWXWAWTHGDHVKSRLTARCKERKCMLKTKHTTVCERMYLLGGPVIIY

SEQ ID NO: 193474 - protein, 91 aa, Triticum aestivum
  unsure (1)..(91): unsure at all Xaa locations
  Clone ID: PAT_TA_87892.pep
NTNRXSKDIHLASPGCRTQEPIPKIDEEVEEELPKQGNIALASDHHITCTCNWNRARKKNVSMVKMIPRSRTNHHSRNETGTWSLPRTVER

SEQ ID NO: 193475 - protein, 113 aa, Triticum aestivum
  unsure (1)..(113): unsure at all Xaa locations
  Clone ID: PAT_TA_87893.pep
EIPPGPTPLAHLCISRLTTVAPFRSDAKLVRKVSFHLRSDGSRPSHCQQPSSSTRIPVLPSSAPICARQLSYVYPMLGSSAPSPLMLNIKKDLIEXVLTQEGPYGRVVSWERX

SEQ ID NO: 193476 - protein, 119 aa, Triticum aestivum
  unsure (1)..(119): unsure at all Xaa locations
  Clone ID: PAT_TA_87894.pep
MFPNNIIIDNGSNFTADEVKTWCTNLGIKLDYTSVYHPQXNGQVERANGLIMKXGLNPRLMRYLKESDKHWVEGARLRTXGGCRTTPITLTGYTPFSXXVGAKAVLPCDIIMTHPXGGR

SEQ ID NO: 193477 - protein, 79 aa, Triticum aestivum
  unsure (1)..(79): unsure at all Xaa locations
  Clone ID: PAT_TA_87895.pep
RIQQGAMVHLISLQLXCAESPSYSXQKEESPPYCTANGEFESLIGVKIXHLPYLSEVILHPTTDSGIINAWKTALGSHK

SEQ ID NO: 193478 - protein, 99 aa, Triticum aestivum
  unsure (1)..(99): unsure at all Xaa locations
  Clone ID: PAT_TA_87896.pep
GXIXXCYQIIXKVARAFXGNPGWGHRTRIFCIPVXVCGNHPIRCLSYLGGSSYLRHQPSNSEIETTYKCRXDNARDFMTIIERRQLSSXAXGXLSRSXK

SEQ ID NO: 193479 - protein, 171 aa, Triticum aestivum
  unsure (1)..(171): unsure at all Xaa locations
  Clone ID: PAT_TA_87897.pep
KTFRAYLIIFPDSESRLIELAHALFTNRYETVRGALKERIPSTDLLAMLRGLWEDATAIDEVISEAALPAFSLETTRDIIKQHIATAFLHLQNEISDVXGHTFNIKXRIRRAQLQTAMEKSKIKXXQGCIXSXXEFRHXLIXWNTELLXKXKXLIMMGSXRFQDSFXKLXG

SEQ ID NO: 193480 - protein, 108 aa, Triticum aestivum
  unsure (1)..(108): unsure at all Xaa locations
  Clone ID: PAT_TA_87898.pep
IACADGNNKRAXVGCTKXCAGHRLVRCTVQMPHTQPKDVCPRYAIRESCRTLKLEPSINFELETHHISNYYHAIFNCKPVHTDQNLNGFPLRSILLLSYKYYLLQDDC

SEQ ID NO: 193481 - protein, 110 aa, Triticum aestivum
  unsure (1)..(110): unsure at all Xaa locations
  Clone ID: PAT_TA_87899.pep
LFFXGNXXGXRNWAPKLTRRRVAGRWNRARQGVXHRPARPNRTGHPXIQGRPNCKPSRPVCRARGIRIISDEIYXRPELRRAGAHHPHLRTAGAGGEQLLRNISAWPDGG

SEQ ID NO: 193482 - protein, 105 aa, Triticum aestivum
  unsure (1)..(105): unsure at all Xaa locations
  Clone ID: PAT_TA_87900.pep
RLAVFVSGGGSNFRSIHEAVLGGKVNGDVVALVTDKPGCGGAEYARCNGMPVVVFPKSKSAPXGVSTDELLNVLRILXVNFIXLXGYLXPXPGXLFSQFPXFKPK

SEQ ID NO: 193483 - protein, 116 aa, Triticum aestivum
  unsure (1)..(116): unsure at all Xaa locations
  Clone ID: PAT_TA_87901.pep
MTVPAPAAETAXSTVRTVKDXNPHEFVKAYSAHLKRSGKMELPEWVXDLSKTARFXELPPSDADXXYXRAASKGXEIYLRQDSEXGGXQKXXGGXQKEGXXNGIXAXTXGFSRNSP

SEQ ID NO: 193484 - protein, 186 aa, Triticum aestivum
  unsure (1)..(186): unsure at all Xaa locations
  Clone ID: PAT_TA_87902.pep
APMFVVGVNEDKYTSDVNIVSNASCTTNCLAPLAKIINDNFGIIEGLMTTVHAITATQKTVDGPSXSKDWRGGRAAXFNIIPSXTGSAKAVXKVSXXXKWQVTGCPSRVPTXDVXVVDPTVXNPRRCTYDDIXKXPXSTXGKLQGIYXYFXEDLGPTDFFGNTSQHLYPGCNDNSSWPWKDNKGVT

SEQ ID NO: 193485 - protein, 67 aa, Triticum aestivum
  unsure (1)..(67): unsure at all Xaa locations
  Clone ID: PAT_TA_87903.pep
XSXLKKXXTNWIQIERGAGLLPGILLTTPGRRQRPARSSRHLQSSSRHRRWRLDPGLQRLVAASGCS

SEQ ID NO: 193486 - protein, 78 aa, Triticum aestivum
  Clone ID: PAT_TA_87904.pep
VRSPLAPLFVMSYIMMLLFALYLLFLPLFSLADTETDAAPGYDYASDVQPLAAELPGKQPPPPRSFLYHPFHSLSCLH

SEQ ID NO: 193487 - protein, 137 aa, Triticum aestivum
  Clone ID: PAT_TA_87905.pep
VTQSSTFISTKRKPTPGIWKIKHEHCYFCRQDRERLLSSRRVGGSAAGFASLRRWPARSGRPRRRRSPFTTLLSHSRSVPKQLDGGAASSKTSPAENARRWAQRAAGEDCTVNTGDMDDAVDDEDDQEMEEEEHGDV

SEQ ID NO: 193488 - protein, 98 aa, Triticum aestivum
  unsure (1)..(98): unsure at all Xaa locations
  Clone ID: PAT_TA_87906.pep
WRSLXFHCQTLSLPFEVFSIVTIGGTYRKKNNQSNRRENIQPKSRIDQGLGPANTLLASGDQSAPTWPWHTNPSPPSAVAVRRHETWSGRRRLASQGA

SEQ ID NO: 193489 - protein, 80 aa, Triticum aestivum
  unsure (1)..(80): unsure at all Xaa locations
  Clone ID: PAT_TA_87907.pep
LWFAKSMNHVVKMCIMRSTILHQEXRLTLYSTXRSLSCSLIRXNTFCXXMXISFGIXPCVXNXKNDDSFXFKGGSKXKXK

SEQ ID NO: 193490 - protein, 57 aa, Triticum aestivum
  Clone ID: PAT_TA_87908.pep
NYTMIVKNEKHAKWSEESRKAPVNSSGPFTIHKIRSGYSLSSLDCRLPSSTPLQLLQ

SEQ ID NO: 193491 - protein, 49 aa, Triticum aestivum
  unsure (1)..(49): unsure at all Xaa locations
  Clone ID: PAT_TA_87909.pep
HIVRKYVEKGYVKILKIHTDLNVSDPMTKALPXAKHEQHRIAIGVKETM

SEQ ID NO: 193492 - protein, 78 aa, Triticum aestivum
  unsure (1)..(78): unsure at all Xaa locations
  Clone ID: PAT_TA_87910.pep
FEXSLLEDNKLIIGCHFGFLCWIYLDSWQCLGITEEILFAVVRKTVDLLFLTSWHAGVLLILLEPLCKSYMVCHRHKK

SEQ ID NO: 193493 - protein, 93 aa, Triticum aestivum
  unsure (1)..(93): unsure at all Xaa locations
  Clone ID: PAT_TA_87911.pep
PLLGDRECMSVLMGIATTTIXRXCXQVQDXFLGGKNXAVVCGACTVVAKDVHALLTXGALQGSVYVPQLQGXDTVPLATTTMQWSDALVLTID

SEQ ID NO: 193494 - protein, 71 aa, Triticum aestivum
  Clone ID: PAT_TA_87912.pep
VEFLRTEFGLEPSYIARRPSILTCSLERRLIPRHYVIYVLKEKGLVKRDIDLFGVFCMSHKKFVETYLDRQ

SEQ ID NO: 193495 - protein, 94 aa, Triticum aestivum
  unsure (1)..(94): unsure at all Xaa locations
  Clone ID: PAT_TA_87913.pep
MAEQTEKSFLKQPKVFLSTKKADKAKRPGKAGNRFWKSVGLGFKTPREAIRWDLHXQELPFTGTVSIXGQNHSLELHXCQDXQXTXFSXXYFIL

SEQ ID NO: 193496 - protein, 96 aa, Triticum aestivum
  unsure (1)..(96): unsure at all Xaa locations
  Clone ID: PAT_TA_87914.pep
WTPLFFIQNPITFYMSLDYPKIRKLSWAIIKNKRETHKLCRGVXRRIKGNFGNVSMKKTDILVXIVVSKYLPXLKXYPKXKERIFGTXKKRSVXTN

SEQ ID NO: 193497 - protein, 110 aa, Triticum aestivum
  unsure (1)..(110): unsure at all Xaa locations
  Clone ID: PAT_TA_87915.pep
SQXXNXKLIQALHSTQVPXILSNLHLEGVGVGVGVGPVAPSGRRRRIGRCLSGVTRARRSNDWHRRRGLAILLAHGHTTETFWSIPSSHKCRVVQQAQVNQVPRDEIHIN

SEQ ID NO: 193498 - protein, 63 aa, Triticum aestivum
  unsure (1)..(63): unsure at all Xaa locations
  Clone ID: PAT_TA_87916.pep
PPLXDYNSGPFPRESLVVQSKRFQRRGLVELNFISLLIICCVMKTLVFIIYHRCCCGLMTCSM

SEQ ID NO: 193499 - protein, 63 aa, Triticum aestivum
  unsure (1)..(63): unsure at all Xaa locations
  Clone ID: PAT_TA_87917.pep
FDGRNVVXAXKLKXMXFNXXSNXKPPXGWVKGXARRGLSSHXXPPXDXRKSKKWFDHHTQYLD

SEQ ID NO: 193500 - protein, 98 aa, Triticum aestivum
  unsure (1)..(98): unsure at all Xaa locations
  Clone ID: PAT_TA_87918.pep
XTHSIIHFVRYYHNSLDRHYHSTTHSPVNGHTVGPAYYSWLEILASLNPDETVHRTTFTRNVHVHVRIQTHDMMTVDNARWACTKVRCMQHLSSSPAS

SEQ ID NO: 193501 - protein, 134 aa, Triticum aestivum
  unsure (1)..(134): unsure at all Xaa locations
  Clone ID: PAT_TA_87919.pep
AVSSLRMLSILCCDKLNLSDSPQGCCSFMLQELRIDCQALLFVEPLQSLRYTKELYICNDCAMESLAEGWLLQNATSLHSIKIGIAELCNLAISRWISLKRYKVCTLKRPLLMNYSXNCLPQLNKLKIXGXTQC

SEQ ID NO: 193502 - protein, 58 aa, Triticum aestivum
  Clone ID: PAT_TA_87920.pep
MFLCWTEKPLGQFNHSKEVMGLRRTILRASLFFFGVLASSMRTIGELMSANEVASLKS

SEQ ID NO: 193503 - protein, 132 aa, Triticum aestivum
  unsure (1)..(132): unsure at all Xaa locations
  Clone ID: PAT_TA_87921.pep
DXSXRRXLRVCAHNVSVXRGGXLPNGFXFVLPPDXVGGELSGVSRKLVEXHXTQTAGAALXTAGXCGNPRKAIPSYIYSLHAVVPKSYTQTECILFXIHSGMLKLHVLALPHTITIYHWHTFLWSSRRVRLR

SEQ ID NO: 193504 - protein, 82 aa, Triticum aestivum
  unsure (1)..(82): unsure at all Xaa locations
  Clone ID: PAT_TA_87922.pep
LLMAWSLLLILPQAMKDGRASCTCAAGKAAEELRQLTGHARRRPFPSLHVRGSGSERPMACCHRXNQINHPIIKPLTRDVTT

SEQ ID NO: 193505 - protein, 57 aa, Triticum aestivum
  Clone ID: PAT_TA_87923.pep
AERSARYPRWRVSGTGDTVRSKTLKSDLLIPGTKISLMQRLDHQKSQVSLKGKWVQV

SEQ ID NO: 193506 - protein, 49 aa, Triticum aestivum
  Clone ID: PAT_TA_87924.pep
LDPLLPVPRDALFRNGASGDWVNHMTPEMASRLDKIVADKMRGTGLTFQ

SEQ ID NO: 193507 - protein, 103 aa, Triticum aestivum
  unsure (1)..(103): unsure at all Xaa locations
  Clone ID: PAT_TA_87925.pep
XSVQGFPGLEDQXWRXFLTMGMRDXKVVISGGNPLCLYXIRXNRRNLDEXLTGNXFQAGSHHLHGPLAVRQPWKTCYHNHAQGHLPFLISHVMRTRHNEVSVE

SEQ ID NO: 193508 - protein, 86 aa, Triticum aestivum
  unsure (1)..(86): unsure at all Xaa locations
  Clone ID: PAT_TA_87926.pep
MVKAVAVLTGSEGVKGTIFFTGREKGPDHRDGNVTGLKEGXHGFHVHALGDTXNGCMSTGTXXNPXXHXHGAPEDESPSWDFWNTT

SEQ ID NO: 193509 - protein, 52 aa, Triticum aestivum
  unsure (1)..(52): unsure at all Xaa locations
  Clone ID: PAT_TA_87927.pep
YGSEAVAKSAYMMFXIAHMIMXYDVPAAGILHGPLGTENXFXGPLLILPMCH

SEQ ID NO: 193510 - protein, 85 aa, Triticum aestivum
  unsure (1)..(85): unsure at all Xaa locations
  Clone ID: PAT_TA_87928.pep
TTSLISSLCLPLXSINLSLHHSLDLMSSPIDYIFGEPLDNIGHEHHQHFDSFQDINGILDDKCHPRSLVIWVTIDNNLSFLSSQT

SEQ ID NO: 193511 - protein, 57 aa, Triticum aestivum
  Clone ID: PAT_TA_87929.pep
GGKHLSVHGLNKDAITVNWTGHKLPSTALTLYPALSQPKRTLSIRLIRNRLTTDEQS

SEQ ID NO: 193512 - protein, 69 aa, Triticum aestivum
  unsure (1)..(69): unsure at all Xaa locations
  Clone ID: PAT_TA_87930.pep
PPCLLKRSXVIFEPKCEPFXPGVNFSSGKSATXVFRXRFSXXFLNRLSGLRCVIXGLKSYGIRAQLXTC

SEQ ID NO: 193513 - protein, 69 aa, Triticum aestivum
  unsure (1)..(69): unsure at all Xaa locations
  Clone ID: PAT_TA_87931.pep
FPELNDMGPLNWHIXLSVAGCYADSPPCFXXQYMFLGTVVIXPVDILDNXHSTXSIQXPPXXRNXKQHE

SEQ ID NO: 193514 - protein, 74 aa, Triticum aestivum
  unsure (1)..(74): unsure at all Xaa locations
  Clone ID: PAT_TA_87932.pep
PLNXCXLRMFSHFKIVXDFGKTCYXNVNLVCVISPNISHHSKXCLWHLTNIHAFQKNHDIXGKCLCNAERCCII

SEQ ID NO: 193515 - protein, 83 aa, Triticum aestivum
  unsure (1)..(83): unsure at all Xaa locations
  Clone ID: PAT_TA_87933.pep
STLSSLQVLDPQQIGRGSTSTPLRHQVCVHVPAXGXNNEHXVHSSTGELSSPRAIYNFNPLXPTGXKGVYIHDRFLCXNNXSK

SEQ ID NO: 193516 - protein, 118 aa, Triticum aestivum
  unsure (1)..(118): unsure at all Xaa locations
  Clone ID: PAT_TA_87934.pep
KQMKAFADNITDWKNVVIAYEPVWAIGTGKVASPEQAQEVHAAVRDWLKTNVSADVASTVRIIYGGPVXCXTXAEXTKKGDIQXSXXRGXPXKGPXFSTXXTXLSPKKFXCGLQRGKN

SEQ ID NO: 193517 - protein, 63 aa, Triticum aestivum
  unsure (1)..(63): unsure at all Xaa locations
  Clone ID: PAT_TA_87935.pep
SNPIRLSKLAETDNLIPRKQHPSIQPTITQIPFHHXHFSPKSQSKSKMGRLIDTLRNLRXTKF

SEQ ID NO: 193518 - protein, 103 aa, Triticum aestivum
  unsure (1)..(103): unsure at all Xaa locations
  Clone ID: PAT_TA_87936.pep
STSRPSKGTIKSQRSTPSSCARIGRXTXTLSRRXPSKPIFVLGTQXXGXXHXPXTXXPQGDNXXXLXXGXXXHXQXXLLDPGXFHKMGQXXTXKGRSKKILIT

SEQ ID NO: 193519 - protein, 92 aa, Triticum aestivum
  unsure (1)..(92): unsure at all Xaa locations
  Clone ID: PAT_TA_87937.pep
MSCNCGSGCSCGSXCKCGKMYPDLTEXGSAAAEVAAVVVLGVAPENXAGHLXWPPGHSGQGXATCXDNCKFNPCNCAALLRILLKLKYTTPI

SEQ ID NO: 193520 - protein, 130 aa, Triticum aestivum
  unsure (1)..(130): unsure at all Xaa locations
  Clone ID: PAT_TA_87938.pep
MXPHFWLQFSRRCGSVHLWSVDXXQIDTSLLQGHLXNGXPLLGAWLGLNCWRKNTLQRKRGSRRSCTGGSSRPKHLQNLDLAATSPGSSTRRRSTHSAAMVGGLDLFASIFLLMQATASSSSGSRDGRRE

SEQ ID NO: 193521 - protein, 116 aa, Triticum aestivum
  unsure (1)..(116): unsure at all Xaa locations
  Clone ID: PAT_TA_87939.pep
VIKARPCKVVEVSTSKTGKHGHAKCHFVAIDIFNGKKLEDIVPSSHNCDVPHVDRQDYQXLIDITDDGYVSLLTESGNTKDDLKLPTDDVPAWANLRLDLLMRFPVISPWENNFPL

SEQ ID NO: 193522 - protein, 139 aa, Triticum aestivum
  unsure (1)..(139): unsure at all Xaa locations
  Clone ID: PAT_TA_87940.pep
KPGAKAVIPGCKGXVRRGKXGGDRAPLFRRKGNPANRPLRGNCLVRRPWPKLPRKKGDSAKDSAKERTXQRKSPRQSVPQTRQXNQLMPNPLQPSKXNSKKWXXXRPNPSTSXXKKLAXPRXPKANSKNRXRTGKKXGS

SEQ ID NO: 193523 - protein, 158 aa, Triticum aestivum
  unsure (1)..(158): unsure at all Xaa locations
  Clone ID: PAT_TA_87941.pep
LNTLNLXMCYLDQTTXILLRGPKYAYESVRHFGKSPSVPHSHTKPXLRSKGRKFDKALVRWKGHGFKCEAVSPTSILSLPCCGCLLHRGTEEARRGEHRMAKLASSVLQLMGPETANVDSPQQGLLLPWVATTLSGKCSSLHVNPGFPSQNFWNKISN

SEQ ID NO: 193524 - protein, 79 aa, Triticum aestivum
  unsure (1)..(79): unsure at all Xaa locations
  Clone ID: PAT_TA_87942.pep
LTQXYTAVMHIDLRTQXSNTPVSSFASSASXDYFXXWACCFIGPIELITTLXAHXPGVRTEPLTTVNRLPYILMFYFSE

SEQ ID NO: 193525 - protein, 64 aa, Triticum aestivum
  unsure (1)..(64): unsure at all Xaa locations
  Clone ID: PAT_TA_87943.pep
XCQGLXISSPFDXVQRRLLPGXSCIRRSLDPVKLLREGPLXAXDIRCPEXYXESVLEXFPLSGR

SEQ ID NO: 193526 - protein, 109 aa, Triticum aestivum
  unsure (1)..(109): unsure at all Xaa locations
  Clone ID: PAT_TA_87944.pep
KYFCRRSNLCAPVITALSIVLWHEHGSFPDLGVLLERVCQPNQPPGXYPLNPTKQEXKWHPILPYPGGTDIPACQQWRTPRMHXRWASRRHLAVPLNNFSXPMXXNFXS

SEQ ID NO: 193527 - protein, 116 aa, Triticum aestivum
  unsure (1)..(116): unsure at all Xaa locations
  Clone ID: PAT_TA_87945.pep
TTKPISPEKEASTMSGRGKGGKGLGKGGAKRHRKVLRXNIQGITKPAIRRLARRGGVKRISGLIYXETRGVLKIFLENVIRDXVTYTEHARRKTVTAMDVVYALKRXGRTLYGFXG

SEQ ID NO: 193528 - protein, 54 aa, Triticum aestivum
  Clone ID: PAT_TA_87946.pep
LVMVQTMLKMVQVLPPTEYFTDPWFMPVHKRLIGSTFTVNRLEQGLVPVCSGRF

SEQ ID NO: 193529 - protein, 42 aa, Triticum aestivum
  Clone ID: PAT_TA_87947.pep
AVPIPVNSSCVYSTLLSLPFPFPRQIQKLPALPLSSNSFFLL

SEQ ID NO: 193530 - protein, 107 aa, Triticum aestivum
  unsure (1)..(107): unsure at all Xaa locations
  Clone ID: PAT_TA_87948.pep
SSATMSGRGKGGKGLGKGGAKRHRKVLRDNIQGITKPAXRRLARRGGVXRISGLIYEETRGVLKIFLENVIRDAVTYTEHARRKTVTAMDVVYALKRQGRTLYGFGG

SEQ ID NO: 193531 - protein, 34 aa, Triticum aestivum
  Clone ID: PAT_TA_87949.pep
QSSFGTEESGWRSSSGYQDCEDLQSVAYAYLNRS

SEQ ID NO: 193532 - protein, 55 aa, Triticum aestivum
  Clone ID: PAT_TA_87950.pep
YLHYEGKERKTEVAKVELNFLGLPLRPGGKECPYYMRIGSCKFCHQLQISHPDSY

SEQ ID NO: 193533 - protein, 53 aa, Triticum aestivum
  unsure (1)..(53): unsure at all Xaa locations
  Clone ID: PAT_TA_87951.pep
KLKDXRERVGDFIVFIFEFYPILKRRFFVLIIFLSQKYFILKYMRGDNMNSPK

SEQ ID NO: 193534 - protein, 69 aa, Triticum aestivum
  Clone ID: PAT_TA_87952.pep
QGPEGSSKKEYHPSLSHNRVQQQPTWILKGFPHLVLNLGSVLVHNLIFVDTLNCTTCSLLKTNYTSLNA

SEQ ID NO: 193535 - protein, 170 aa, Triticum aestivum
  unsure (1)..(170): unsure at all Xaa locations
  Clone ID: PAT_TA_87953.pep
FESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTGEXGNTKDDLELPTXDDXCLGRXKTGIADGKTDPVRDSPWVKEFACRPWWNNTCVVPTAILVSMLWVLYTS

SEQ ID NO: 193536 - protein, 127 aa, Triticum aestivum
  unsure (1)..(127): unsure at all Xaa locations
  Clone ID: PAT_TA_87954.pep
SCXVLACSMXHXFIMPKCQVAHALKQLQKFCPGRKVAXXHILGMSHAWRXVLDIRMDPCSCSLVWRYHASFVAXWAWTKHRLEPVQSLHSDPLPEPPEPVHDGPETLLQLLGLAEAEQPSLALLPHL

SEQ ID NO: 193537 - protein, 97 aa, Triticum aestivum
  Clone ID: PAT_TA_87955.pep
NAPNSLSSGTSGNIYLMQKKVPRFLPSLLWLHHSSNLSIETPGVIGINDLIRDGGGLGVLRHMRLGLLSVWHRGLGLFRPTQSLVFATRREFTVWFE

SEQ ID NO: 193538 - protein, 154 aa, Triticum aestivum
  unsure (1)..(154): unsure at all Xaa locations
  Clone ID: PAT_TA_87956.pep
AGAQPKKRTFRKFSYRGVDLDALLDMSTDDLVQMFPARARRRFKRGLKRKPMALXKKLRKGEKGRSCWVKNLDQXRTHLXNMIXCPLEMIGHLXRCPXNGXTFNQFXIXPXMIGXYLAXSSXSLKPXXMXKPXFGAKIFSPLLKIASGDSTVPF

SEQ ID NO: 193539 - protein, 92 aa, Triticum aestivum
  unsure (1)..(92): unsure at all Xaa locations
  Clone ID: PAT_TA_87957.pep
PLQTPSLHPIRNLEDSXCGGXCGCGXACKCGKAAAVANVPGVEPPAPTLIVSAIATHKGXPAGMEMAAENGGCGCTQCKCGTXSCGCSCCSC

SEQ ID NO: 193540 - protein, 89 aa, Triticum aestivum
  Clone ID: PAT_TA_87958.pep
PRQTPARGQEKEICDDVSDEGNGEETNEQEFHKATDALCIDGGASLHTSHRQLKRWARQVNVVEPAPEARKPLKWSRTPIIFNEEDHPG

SEQ ID NO: 193541 - protein, 116 aa, Triticum aestivum
  unsure (1)..(116): unsure at all Xaa locations
  Clone ID: PAT_TA_87959.pep
MRSLGQNPTEAELQDMINEVDADGNGTIDFPEFLNLMARKMKDTDSXEEELKEAFRVFXDKDQNGFISAAXXRHVMTNSGEXXTDEXVDQMIRXEPDSXGDGRFNYEDLSKAMMGK

SEQ ID NO: 193542 - protein, 82 aa, Triticum aestivum
  unsure (1)..(82): unsure at all Xaa locations
  Clone ID: PAT_TA_87960.pep
RGRGVRFPRLEEESGRPLPKFGEWDVNDPASADGFTVIFNKARDEKKAGNGQDTESPGKDARTERVXESYATKANSKKWFAA

SEQ ID NO: 193543 - protein, 135 aa, Triticum aestivum
  unsure (1)..(135): unsure at all Xaa locations
  Clone ID: PAT_TA_87961.pep
MARTKQTARKSTGGKAPRKQLATKAARKSAPATGGVKKPHRFRPGTVALREIRKYQKSTELLIRKLPFQAXLSGKXAQDFKDRLRFKSXAVSALQXAAEAXLRRVFXGHNLCAIXAKRVTSCPKDINQDHPGQKG

SEQ ID NO: 193544 - protein, 81 aa, Triticum aestivum
  Clone ID: PAT_TA_87962.pep
GSKNDFWRRCWGDLRSSQDIPSTHHKLFSPALHYLPFASRFPLPTSKMIFENLCLFFALLPFDLVLPCAFFLSASSLAKSL

SEQ ID NO: 193545 - protein, 42 aa, Triticum aestivum
  Clone ID: PAT_TA_87963.pep
PLKELTADEDEAYKTVDHENFMRLFFATKLEGKSFLDRMKLK

SEQ ID NO: 193546 - protein, 104 aa, Triticum aestivum
  unsure (1)..(104): unsure at all Xaa locations
  Clone ID: PAT_TA_87964.pep
FLNKVCLSXFKFSVVPPQFFFIPCKLNYTEQVIFFCITCMLLVLHLLVPIRHGGGADLLGHARRQPPDARRRRAPGDRKFQFYRSLTHHHRRSHQGIKYQLLLA

SEQ ID NO: 193547 - protein, 95 aa, Triticum aestivum
  unsure (1)..(95): unsure at all Xaa locations
  Clone ID: PAT_TA_87965.pep
LNILKVHIKHQLKETYGHKSVPWDRTPNCYKIIHRIPGFDKMFASYMLDLMCKDEMLFNIEGDSWELFWAEILRSNCTERKAGDCSSSCHNKXRE

SEQ ID NO: 193548 - protein, 122 aa, Triticum aestivum
  unsure (1)..(122): unsure at all Xaa locations
  Clone ID: PAT_TA_87966.pep
KFILGFSLFMGISIPQVFQMXYTSVRKAFGPRVHXARKDGSXXMIXVXFSSKSVXSEGAXGPSPGTSNPCQKGTNKXPXXGKXDXGGQPIXWGXKVXGSFPXXRTPPKAXXXSXAPGXFKSX

SEQ ID NO: 193549 - protein, 74 aa, Triticum aestivum
  Clone ID: PAT_TA_87967.pep
VTYDSLEVEGLVDSNLRRTLSLANTSYFTTRVYLISGAEGPGRRGWTSSTRSKASPLSQLLTAVRYSPRSSQSP

SEQ ID NO: 193550 - protein, 89 aa, Triticum aestivum
  unsure (1)..(89): unsure at all Xaa locations
  Clone ID: PAT_TA_87968.pep
MLIYSSGNPTNIANPIIDXSVKIDIKALGGRLTFFQTTACEKIPWKYLKAYNDVDPLDYLGAYNVEDIQLICCQPDASTMWLGTSSSPK

SEQ ID NO: 193551 - protein, 44 aa, Triticum aestivum
  unsure (1)..(44): unsure at all Xaa locations
  Clone ID: PAT_TA_87969.pep
RXNSLEPSPSLFQSSGDCSLFSTRLITIAACTPLKSLDILSVPA

SEQ ID NO: 193552 - protein, 112 aa, Triticum aestivum
  Clone ID: PAT_TA_87970.pep
FHKGRSIYVSKCVTQPKWPYSGLCAKTTTKMSRTCQCLQVHQTRRITLSLHQLNSRSCKHSAACRSSKSPSSSVSLGNLSNSRGWSKEVEKAALSRERQSCSRGGSTLRCLG

SEQ ID NO: 193553 - protein, 45 aa, Triticum aestivum
  Clone ID: PAT_TA_87971.pep
SVACDAAKFIKIYYSVRMDRSFLLIKGPKNSQPLTELLDRGDSVV

SEQ ID NO: 193554 - protein, 90 aa, Triticum aestivum
  unsure (1)..(90): unsure at all Xaa locations
  Clone ID: PAT_TA_87972.pep
MKGLESSLPRVCVEKQEMQETSIFSYLISGEPHCGVCLPNTASNVLSPASPIYNIKPLENREGFPQLXFPHPGCTYCLVSPPGPLLLPSK

SEQ ID NO: 193555 - protein, 69 aa, Triticum aestivum
  Clone ID: PAT_TA_87973.pep
FLLACIMVNPISLVILLASLVIMILILWIQHECECTQSSVDPFKLSFWLRRHFKHEMDLDRSNCHRLYP

SEQ ID NO: 193556 - protein, 140 aa, Triticum aestivum
  Clone ID: PAT_TA_87974.pep
PRPVSAQTRAHPDAIIALPSSIPRPLATSSYATASRRSAVVVSFLYAPRLVSRPPPALAIGLLPTHSRTTLPLIHRSDPPRPRRARLRPLLPRDGCRCHYVRLHHRRPSLSEQLDVGAQGAKMPPPMPTTTWRPTTTRSS

SEQ ID NO: 193557 - protein, 52 aa, Triticum aestivum
  Clone ID: PAT_TA_87975.pep
TRSKAHKTYKSVKRLSQHNTKRKAQRHRCHRISPSALTAQQLRLHPRGQFVV

SEQ ID NO: 193558 - protein, 105 aa, Triticum aestivum
  Clone ID: PAT_TA_87976.pep
LEKVEQELATSEKDGPVSETFYKKLKEFLADAQAEGRSLASLYSTAGKSADSLAHYFGEDPVRCPFEQVVSTLLSFVKTFERAHAENLRQAEAEKKKAHWPRQLP

SEQ ID NO: 193559 - protein, 113 aa, Triticum aestivum
  Clone ID: PAT_TA_87977.pep
MNAARFLRPFSRAAAARAPMAVRPSALARPAFIASQNKKVEVGPQQMTILKSAMPQLIPFFFVNETTVAFILLPSLIYIFSKYILPQRLRMFAARLFIKQVVSEGNGRTRKSG

SEQ ID NO: 193560 - protein, 95 aa, Triticum aestivum
  Clone ID: PAT_TA_87978.pep
FAHWDLKNCGNKLDAVAILQQQELPVGVGAEEFLLCLLWKCFGVTWAALPNNKLPPLFLFLAPVNSHFTATLYTNAPSQAKILFGLNFGLFLLCE

SEQ ID NO: 193561 - protein, 72 aa, Triticum aestivum
  Clone ID: PAT_TA_87979.pep
HYAHLLGQCLRYKMQMNGGICINISRLGFHCHENNLQICYTISGTGRCCCALLIRPVWKPDKSQFCKIIVLA

SEQ ID NO: 193562 - protein, 62 aa, Triticum aestivum
  Clone ID: PAT_TA_87980.pep
RGVVYHWLAGCRYILAPVKRGLRFLPCTHTLDYTEYRQQRCADLTGRRYKMPTCACCRTSGT

SEQ ID NO: 193563 - protein, 60 aa, Triticum aestivum
  Clone ID: PAT_TA_87981.pep
HYVASQCTRQHTGRKIHGDYYRKTSLTYHFTQVNARKGKQLSFASGIWYYYTHPKYKKDH

SEQ ID NO: 193564 - protein, 162 aa, Triticum aestivum
  unsure (1)..(162): unsure at all Xaa locations
  Clone ID: PAT_TA_87982.pep
EGLHYLHKGQVQKIFHLDLKPDNVLLDENFVPKIGDFGLSKLFGTSYTHQISAMKGTVGFMPQEYIHNRKVSPKNDVFSLGVIIFHMMAGEKGYGDYWDARRRPNFSKLIQQDFIDSVQEYWENKDAGNQSYRWDEADLLRVTKCIDMAMXCVEDDRDKRLT

SEQ ID NO: 193565 - protein, 64 aa, Triticum aestivum
  Clone ID: PAT_TA_87983.pep
PRDGGLPAGRCSPALLRSSLVTSGERCASISRAPTLGSVHLANTSSVPRIGCYSGINALLVVVL

SEQ ID NO: 193566 - protein, 87 aa, Triticum aestivum
  unsure (1)..(87): unsure at all Xaa locations
  Clone ID: PAT_TA_87984.pep
QDKLEGKGWEEESLIGGDXEEFFYLVVIYVGVLLLXCHLVXSFLLLXQEFLLXLSXDVFIPIDGLCXAVTRSGSCVQVDKLGCNPLV

SEQ ID NO: 193567 - protein, 90 aa, Triticum aestivum
  unsure (1)..(90): unsure at all Xaa locations
  Clone ID: PAT_TA_87985.pep
TAYAKLSRGARTVKFKDIWSARIPPKXKFFLWQAFRRKLPAADQIRKRNGPGSDRCALCGALENNEHIFFHCSLAKFLWSCIRLWLHVFF

SEQ ID NO: 193568 - protein, 81 aa, Triticum aestivum
  unsure (1)..(81): unsure at all Xaa locations
  Clone ID: PAT_TA_87986.pep
QVEWANVPQCRNNPXGEGAKFVMRMDSYIXENQLRLIEXRPISXKVAKTXGWQXQGXPFRLKSXPXPFXVPQRXLPXXGTV

SEQ ID NO: 193569 - protein, 75 aa, Triticum aestivum
  unsure (1)..(75): unsure at all Xaa locations
  Clone ID: PAT_TA_87987.pep
FFFLKASTKXFFXCFFLRRERLSTRLLSECPYPVVFDDTVQYYSTCTRALSSARQSWSPKLQSPSWLSSIFSASA

SEQ ID NO: 193570 - protein, 88 aa, Triticum aestivum
  unsure (1)..(88): unsure at all Xaa locations
  Clone ID: PAT_TA_87988.pep
DPRYLGPLPXSXGCIVSLXSWXXETIDXGAFASNLFRXLKGXAXXLHXHCSPIXLQXXPSSRNXHLVVSPREGTWGSEAWSRSVCHLP

SEQ ID NO: 193571 - protein, 77 aa, Triticum aestivum
  unsure (1)..(77): unsure at all Xaa locations
  Clone ID: PAT_TA_87989.pep
XQSLXRFRFLGKXXSRRCWRXIAGIIYCNGENCSGRYGDIFRVFQGHVSFVTFTIQXPWLFHEASDMSACACPAATA

SEQ ID NO: 193572 - protein, 119 aa, Triticum aestivum
  unsure (1)..(119): unsure at all Xaa locations
  Clone ID: PAT_TA_87990.pep
SYFANXINQXRTXXAGNPPWGPLVPRGSARRSNCKNNXGYERSQRENHXXRQVFGXXSKXPECWXXPEXFRXXXVCGKXPXXSXXTXSDXIXFGXXSSXXPREXCLXLXXIXQTLKXXG

SEQ ID NO: 193573 - protein, 154 aa, Triticum aestivum
  unsure (1)..(154): unsure at all Xaa locations
  Clone ID: PAT_TA_87991.pep
MPXRKIXGVXVDXXIXVIPYXXELKRCLXHSXGRPAESRSYSWXXXPPSWGXFKVPXGRWSFAQIRNXGGWIGSNCXXSWRNFXCWLTPXNPVAPAEAXADXLWRFXILXPXSSXPPGCFPLXLPXIRXPGFPXNGFLSGSKSSGGLLRRTQPS

SEQ ID NO: 193574 - protein, 75 aa, Triticum aestivum
  Clone ID: PAT_TA_87992.pep
QLWKVRNARVFELSTASAVQLWNVRNARVFDGLSVPLLASCLAIAELIQLWCCRSQDCSLKAFLHHHSELLRNTM

SEQ ID NO: 193575 - protein, 163 aa, Triticum aestivum
  Clone ID: PAT_TA_87993.pep
AMSLTKFVCTDNYLRVDHSKAIVDAGGAKHLVQLVYFSEQAVQLAALTLVCYIAHNVPDSEELAQAEILTVLEWASKQAYMMQDPTIRELVAKRRRLRLELYQSQRRKGYYVTMCRWRCMGEEYNVPPLQCPSAVYTSSGSNTPAFFCSQTTLFKTTTGRPFC

SEQ ID NO: 193576 - protein, 102 aa, Triticum aestivum
  Clone ID: PAT_TA_87994.pep
IRCDANKKGRLDSLKLRGELSKFPQFVAQLRAVEELCLWSTGLSWTDILDGLSTVRGLKYLKLVEDNIGRIEILPDHLISVERICVQCEQRLGTNGRSSPAA

SEQ ID NO: 193577 - protein, 70 aa, Triticum aestivum
  Clone ID: PAT_TA_87995.pep
LANLFACYHQVCIYHNLCLQYALATWGIGRTHGEDTRNTYYAHQSIGLTKQKAQIGLPDISCAGKLTYGP

SEQ ID NO: 193578 - protein, 109 aa, Triticum aestivum
  unsure (1)..(109): unsure at all Xaa locations
  Clone ID: PAT_TA_87996.pep
MXGVIFQCGXXCXXLGILAGCPLGRQPHPDGRXSPNLPHCCHTWRLLESGRATQEIASWSMSLMLLSPSSRFFVGSPQAQGLKRVLLHLTLGRKSSSTYFFCYVVPTTM

SEQ ID NO: 193579 - protein, 83 aa, Triticum aestivum
  Clone ID: PAT_TA_87997.pep
WCAAEVPAAGSNRTGSDDPCAVVGNAAYVRPGPGAARLRQLVTSLLSEENFRPKQCKVAVVEEHIPAKKIEEHIPSEKVEEHH

SEQ ID NO: 193580 - protein, 62 aa, Triticum aestivum
  Clone ID: PAT_TA_87998.pep
GALNLGLKTIALMWYGLAVYWNDRHQSQIFCMVNYWSPFASIIGYLLHGQTGSLEIREVIWF

SEQ ID NO: 193581 - protein, 63 aa, Triticum aestivum
  unsure (1)..(63): unsure at all Xaa locations
  Clone ID: PAT_TA_87999.pep
PPSXPLRGARARGDSAGAHLGFEAVRPTGQRLLQPPVAGEGRRLRRRDGSGSHDAVGAAVGRG

SEQ ID NO: 193582 - protein, 55 aa, Triticum aestivum
  Clone ID: PAT_TA_88000.pep
VFHFFMMYCWLVCPAHCCPHGCFETLLLLSQNQWNEGEVSFFTWLHHLLCLSATK

SEQ ID NO: 193583 - protein, 64 aa, Triticum aestivum
  Clone ID: PAT_TA_88001.pep
LATIKSKFYKTDNLALICHMTIANLSQSIEGKKVYMFFSFYLYKCISIMYLSTCFLNAPLYYPL

SEQ ID NO: 193584 - protein, 93 aa, Triticum aestivum
  Clone ID: PAT_TA_88002.pep
THHGWMVQLEHERDGGGATSTSSIALEQRRPVKMHTVVLTSSSGEEHELTGGRARTPRIGTSAACSLAVRRHEIPVQSSGLLLTTTLSNPTAS

SEQ ID NO: 193585 - protein, 154 aa, Triticum aestivum
  unsure (1)..(154): unsure at all Xaa locations
  Clone ID: PAT_TA_88003.pep
VARKVFLVLSPHIQPDAYTFNIFVHGWCSARRIEEAKWTIEEMKARGFAPSVITYTAVLEAYCKQHNFRMVYEILDWMCSEGCHPNVITYTMIMTSLSKCHMFEEALSVSHRMKSSGCKPDTLFYNSLINVLXNAGYLSEASQVFQVEMPMNGV

SEQ ID NO: 193586 - protein, 53 aa, Triticum aestivum
  Clone ID: PAT_TA_88004.pep
PGWLQRGKLLNFTLYHKNVNSCTTSDNDTSYKVVHSVNSRRMPGDCRGTVRRL

SEQ ID NO: 193587 - protein, 59 aa, Triticum aestivum
  unsure (1)..(59): unsure at all Xaa locations
  Clone ID: PAT_TA_88005.pep
QRGPDXDSSRLPQYXASLKCLXTNQDKSKCQQQFDDYKXCNKRKREAXLXRXXGQTLFG

SEQ ID NO: 193588 - protein, 82 aa, Triticum aestivum
  Clone ID: PAT_TA_88006.pep
AGRREWPPHCAGSGVTPPASRQTATRARQSLCRAPGSSPRHDAPLFSQPSASLLSVTSSSAPTRSWAHARLHGHHTKRSEPS

SEQ ID NO: 193589 - protein, 62 aa, Triticum aestivum
  Clone ID: PAT_TA_88007.pep
GCTEGIPCHAVGAKLACASSCLHKAPRVWRMAPWCRPQITQVMCGQAVPESKMARLLTWEIE

SEQ ID NO: 193590 - protein, 60 aa, Triticum aestivum
  Clone ID: PAT_TA_88008.pep
RKQTRAFYLAGTEMNWAVFLRDAYDDDGVLRDKDPLVLFNEKLQGYACMTEMDPRNTIAE

SEQ ID NO: 193591 - protein, 98 aa, Triticum aestivum
  unsure (1)..(98): unsure at all Xaa locations
  Clone ID: PAT_TA_88009.pep
GVADCSKGLDAKGRWTRARTARVSMLVCPFWFLAQLTFNLSLRYTTVTSNTILSSTSTLFTFLGCIGISWEKHSHGLKLIXRALLHTRTIIVALLIQG

SEQ ID NO: 193592 - protein, 148 aa, Triticum aestivum
  unsure (1)..(148): unsure at all Xaa locations
  Clone ID: PAT_TA_88010.pep
MSLIAGEEFQHILRVLNTNVDGKQKIMFALTSIKGVGRRFSNIVCKKADIDMNKRAGELSAEEMDRLMAVVHNPXQFKVPDWVLNXRKKDYKGREVXQVLXNPLTXTXGLPLEVKKFQEHRGPAHYWGVLXRQXTKTTGRKECWCQER

SEQ ID NO: 193593 - protein, 44 aa, Triticum aestivum
  Clone ID: PAT_TA_88011.pep
SLHTLHKLTGGSFADKYHNHYITRGFPKYTTPRPAILFQGHILA

SEQ ID NO: 193594 - protein, 64 aa, Triticum aestivum
  Clone ID: PAT_TA_88012.pep
MIIKCVLVLCLKITHRTWWTRGSFILIKLACWCRRCLYFLLIAKNDMKINGQIEDSDVQGSLLP

SEQ ID NO: 193595 - protein, 100 aa, Triticum aestivum
  unsure (1)..(100): unsure at all Xaa locations
  Clone ID: PAT_TA_88013.pep
VRGTCAWPXTRLIPWFSKTGGNTYATLLHHPFLFKEKPTQCSRGSRVRRLSGAGIAMTPPTTISSGPVGKRRRERNAHHFLLCCRFAPSVSSIAHTSAAS

SEQ ID NO: 193596 - protein, 50 aa, Triticum aestivum
  unsure (1)..(50): unsure at all Xaa locations
  Clone ID: PAT_TA_88014.pep
XMFFHAFSYXXITINFRCYVKSIHQNHIDTWSCTKLHLTYKTTGTQKHGR

SEQ ID NO: 193597 - protein, 78 aa, Triticum aestivum
  Clone ID: PAT_TA_88015.pep
ASGVLVSAVDWATMRTGESWFSDNLNRAHLDYFYWALAGVAALEVLVFLYFSTRYVYTNKRELVMKCISRENHFEPKT

SEQ ID NO: 193598 - protein, 68 aa, Triticum aestivum
  Clone ID: PAT_TA_88016.pep
AAWEKRYYRAYVSDVSTLAGALQLLAMDTRPGVAAAVAALVLAGVPVSAVFALHLLGQAAGSVLHLVS

SEQ ID NO: 193599 - protein, 154 aa, Triticum aestivum
  unsure (1)..(154): unsure at all Xaa locations
  Clone ID: PAT_TA_88017.pep
MAPKAAEKKPVEKTPAGKKPKAEKKVPASKEGGDKKGKKKAKKSVETYKIYIFKVLKQVHPDIGISSKAMSIMNSFINDIFEKLAGESAKLARYNKKPTITSREXQTSVRLVLPGXKLAKHAVSXGTKAVTNSLVLPRALCVPSCSCLIIRTTV

SEQ ID NO: 193600 - protein, 119 aa, Triticum aestivum
  unsure (1)..(119): unsure at all Xaa locations
  Clone ID: PAT_TA_88018.pep
HCPECTPGSSVVNAIKPAYMLSDRTLERAGRSKKINRKEENNYVARKCMDKTDPPQMIVCSKHNSEYPSGNHVFQDKNITLRACLGSIIFLDVPFLVLKYMHPICPVCTLLIPAEXHTC

SEQ ID NO: 193601 - protein, 51 aa, Triticum aestivum
  Clone ID: PAT_TA_88019.pep
SVWAPLPLSVPSSPAEGVCQPMGMAPASGGFGRTEYDYVDSFLVEPAYALI

SEQ ID NO: 193602 - protein, 98 aa, Triticum aestivum
  Clone ID: PAT_TA_88020.pep
TNGGTNLRIVCLNPAFFSRPVPFVSSHRKIGAVRLASTWCPWTYIFQGLHWRCRITPMNRGSGGKAPNLCILIVYFSFQFFCWPIGELLALSILSNSS

SEQ ID NO: 193603 - protein, 123 aa, Triticum aestivum
  unsure (1)..(123): unsure at all Xaa locations
  Clone ID: PAT_TA_88021.pep
CPQPELPIGTSRQXDSDFLTILLQGEIGGLQILREDRWVDVTPTPXAFVVNIGDLLLMCSXLHDWVQSVEHRVXWLKNIAPRAWIILLPSSTHFHPASXTRMHGPXXGAVCLMGNPLLYREPL

SEQ ID NO: 193604 - protein, 85 aa, Triticum aestivum
  Clone ID: PAT_TA_88022.pep
MMPGPDATVGAMTHSFIRAVECEPRTTYGHLLTSMRTIMRDGGGNCNLQGPAGGCVRKVANFSGVGGASAVFCLQFDIHRERSAC

SEQ ID NO: 193605 - protein, 75 aa, Triticum aestivum
  Clone ID: PAT_TA_88023.pep
PPRDMNMRYIQYNITAEESTLSELYPRGHPVFLDPGPIHKQSWSLVKDIYLGKQDVRLDMARFRPVLQKALDLLR

SEQ ID NO: 193606 - protein, 101 aa, Triticum aestivum
  unsure (1)..(101): unsure at all Xaa locations
  Clone ID: PAT_TA_88024.pep
LVDKYEEMMEKHHPGLGDERWPFITHFVGXKPCGSYGDYPVEQCLTGMERAFNFADNQVLRLYGFRHRSLTNPKVKPVANRTASPLLNKEASLKMDAKIET

SEQ ID NO: 193607 - protein, 58 aa, Triticum aestivum
  Clone ID: PAT_TA_88025.pep
ALLDGAYVGPLIELPIDFDPSILVTGFVGTAIALGCFSGAAIITKRNRTQNKKRKRRS

SEQ ID NO: 193608 - protein, 115 aa, Triticum aestivum
  unsure (1)..(115): unsure at all Xaa locations
  Clone ID: PAT_TA_88026.pep
METCTTYHQVMLWSPLQVPWQRHQRRWATSWERKSGVFSWGGMNKILLPILSRARRHGRWISGEAPTVGKSNGRWVKRSVLRPDYKMYLIXPLRSTLIQSNQLRSGGKLVSSNLH

SEQ ID NO: 193609 - protein, 118 aa, Triticum aestivum
  unsure (1)..(118): unsure at all Xaa locations
  Clone ID: PAT_TA_88027.pep
MAESLLLPLVRGVTSKAADALVQTVTRMCGLDDDRETLKHHLLAVECKLVNAEEMSQTNGYIKSWMEKLKAVAYXDVPVRSAAAQSPDRLHLPQGTRLRHAQKPLLFRFAMSNSRSSQ

SEQ ID NO: 193610 - protein, 150 aa, Triticum aestivum
  unsure (1)..(150): unsure at all Xaa locations
  Clone ID: PAT_TA_88028.pep
VAQETRILSAAEYNXRKLLKIRLLGLAAIERARRRQASRVIXLRAGDASTKFFHGKCSSRRCKXIHTIQSDEQFATTYGDMAXIIHDHFSKVMAADTGRHVTLNWSALQLPRIQAAGXDNSFTEGEVXAAIMQSPAEKAPGXDGFSGTFF

SEQ ID NO: 193611 - protein, 82 aa, Triticum aestivum
  Clone ID: PAT_TA_88029.pep
PSPRARHCHQLISLDFVSCCKKMYCASAGAEQASILLLFRMGKHGIFICCWSIRFVVDLHAWKIRCQCHDHQSNLLLAQKKK

SEQ ID NO: 193612 - protein, 108 aa, Triticum aestivum
  Clone ID: PAT_TA_88030.pep
FFFFPRNKVKLCLKLFSFKKLRWSCRRRSPVPSGQAARGSGAKRSSRSASSTKSAEGSHLLLHAAGRQNCIRLFREVSSSTNPRPNAAVTSSSAFTKDQLVVADWEAA

SEQ ID NO: 193613 - protein, 85 aa, Triticum aestivum
  Clone ID: PAT_TA_88031.pep
YVQYVPCQEGAQGHLQSTADRAGLYVIDRLSITSGNTTPYFQASSTFPIYISWLWCTPIMYTMICLVVVCSCYHGLAINSLYSIL

SEQ ID NO: 193614 - protein, 112 aa, Triticum aestivum
  unsure (1)..(112): unsure at all Xaa locations
  Clone ID: PAT_TA_88032.pep
LSVQHPYQPVGEERMSRTPDDPLFGKKNLKVEVDKRKYSTLQILSGSMPVLLLGRQERRTTRWLLALNSEVLXSSHTHTSSLNPHAGQHDVDVPGLRSCARTWETERRRGVR

SEQ ID NO: 193615 - protein, 116 aa, Triticum aestivum
  unsure (1)..(116): unsure at all Xaa locations
  Clone ID: PAT_TA_88033.pep
LALPLCKRCIVFSEVRCGFLVRAYEFSTEXFSGLLTAVWKLRSRSTQSIFLEELENIVPGPDPALQAKTEKYGPMSNVHGFQPHLREEELGPTLERFLRLLQDKRSLTESNAHLGI

SEQ ID NO: 193616 - protein, 157 aa, Triticum aestivum
  unsure (1)..(157): unsure at all Xaa locations
  Clone ID: PAT_TA_88034.pep
GTVITAKVDVYSYGMVLLEIVSGKRNSGRQYTTGDDYVYFPVQVANKLLEGGVGXLVDINLHGDAHLEQVERALKIACWCIQDDEFDRPTMGDVVQSLEGLLEVNIPPMPRLLQAIAXNQHSTFDGHLDQLHKKQANCNILGAHEDSCCNDGANFPQ

SEQ ID NO: 193617 - protein, 96 aa, Triticum aestivum
  unsure (1)..(96): unsure at all Xaa locations
  Clone ID: PAT_TA_88035.pep
NPFXXXRLSQSSSXXRXPXLXXTXRHXHXXSXQXFXVXATPXPXGMAXHXPLDALRLNFWVRLTRXGHGXASLLCHMPILFFSVGLEXNAADRFGI

SEQ ID NO: 193618 - protein, 137 aa, Triticum aestivum
  unsure (1)..(137): unsure at all Xaa locations
  Clone ID: PAT_TA_88036.pep
XSLSPXFCSLFRFLANYVAFNRCRQEXSTELVGXAAVVQRPCKVRAFXKCXSFGLGGKILYQDVSXGSLDGILXSIFLGSRNLYLNPLLLPNIFRNPLDSSFALDCNPPMDLSCIAHRDQVANLLMFPHGAVCPLPC

SEQ ID NO: 193619 - protein, 108 aa, Triticum aestivum
  unsure (1)..(108): unsure at all Xaa locations
  Clone ID: PAT_TA_88037.pep
LVLQDDVEGLQVMHGGEWLTVDPVPGSFVVNIGDHFEIYSNGRYKSVLHRVGVNSTRPRISVASFHSVGAERVVXPAAELLDXGRGGEPRRYMDTDFATXWTRSCRGQ

SEQ ID NO: 193620 - protein, 81 aa, Triticum aestivum
  unsure (1)..(81): unsure at all Xaa locations
  Clone ID: PAT_TA_88038.pep
CHQLPRTXXDFWXXFRSHFXXXGXTFQXXXLNVCETGXEFAIEGAXTPNFHRPKFWIRYAGEHMSPRKIEITIHVLLTFRC

SEQ ID NO: 193621 - protein, 76 aa, Triticum aestivum
  unsure (1)..(76): unsure at all Xaa locations
  Clone ID: PAT_TA_88039.pep
ARTAALNNSNSASEHIKDQIVQTLTEAGGRVDYVEIVEQESLVPVETIDRPVVICVAAWFGKVRLIXDNIEIHIQS

SEQ ID NO: 193622 - protein, 87 aa, Triticum aestivum
  unsure (1)..(87): unsure at all Xaa locations
  Clone ID: PAT_TA_88040.pep
GEWXGPPXVFXFFFGXNNALEFXGKKXQXGXIXYVKXXQNKIHCPKLXXFANKXXXYLKLVWNELFVKKLXRNXLIGNGQYTLQKMT

SEQ ID NO: 193623 - protein, 123 aa, Triticum aestivum
  unsure (1)..(123): unsure at all Xaa locations
  Clone ID: PAT_TA_88041.pep
ETYSPVAMLKSVRIVLAIATYFNYEIWQMDVKTAFLHGNLTEDAYMIQPEGFVDPTSASKVCKLKRSIYGLRQASXSWNIHFDEVVTXLGFXIKSERGPCLYKKLXGXPXVFDPGSGLKQRSE

SEQ ID NO: 193624 - protein, 76 aa, Triticum aestivum
  unsure (1)..(76): unsure at all Xaa locations
  Clone ID: PAT_TA_88042.pep
FCHSLSHYVYPSKKSYYVCHTCFMLGAQIVSHTLACLGSLATFFVCMTCGAYLSKKXFCFRCGLKPDKHLNWTKLA

SEQ ID NO: 193625 - protein, 106 aa, Triticum aestivum
  unsure (1)..(106): unsure at all Xaa locations
  Clone ID: PAT_TA_88043.pep
LXGTVXHVDTMNXXSSRLATAFXRVRAALIWTTPELAERGAVLLASVPWRCRLXGVSGXHMPELVKRXAVWGDGCPFRLLMAQVRVGTSLFRSRPEVRQLQGSLXL

SEQ ID NO: 193626 - protein, 96 aa, Triticum aestivum
  Clone ID: PAT_TA_88044.pep
TLMFSIQIFTTSRACGIAIHHNSAGNEGNGTSHGKNCRHKCHVMSVSTQRTNKLTNFPYVRARAVRASATPTRARNTCVYTLAMHTSILTSRARQA

SEQ ID NO: 193627 - protein, 109 aa, Triticum aestivum
  unsure (1)..(109): unsure at all Xaa locations
  Clone ID: PAT_TA_88045.pep
KFRGPCPNNKGQQGWVXHXPPXKGMLYPWGGFPPKAKFKGPKGGGYSQGKFXKKXGXPGLNPXKKTIPXFTXPLGXFXPKKTLSKIXFPXGXFXFXPVNXGKGNXFXAX

SEQ ID NO: 193628 - protein, 99 aa, Triticum aestivum
  unsure (1)..(99): unsure at all Xaa locations
  Clone ID: PAT_TA_88046.pep
KXPXPPLGIXPVPXNGGPSNFKVXXXEHGPXXTXLLLESLVLDGLAAELILWVLPPTPYASPPVGPXLVHGVTRDTHGXVGXLXPLLLRVLCARRRSCG

SEQ ID NO: 193629 - protein, 104 aa, Triticum aestivum
  unsure (1)..(104): unsure at all Xaa locations
  Clone ID: PAT_TA_88047.pep
MMIMEPHGGVVGSVVPDSFTPYPHRSGVLYNIQYVAFWWADGGAAEAANGWINGLYGFMEPLVSSNPREAXVNYRDLGHPGRTRWATNGVTPFPTRLAFPSCNE

SEQ ID NO: 193630 - protein, 108 aa, Triticum aestivum
  Clone ID: PAT_TA_88048.pep
RRRRPPRRELHQNPQGEGGQSRGRGPLRDPAGDALPQQPTQEADEKAVDRVSRLRLRLGITNHPAWCACVLEKRGAESMGPCMMLSRHVKHPLSLSLSLCCIRTLCFQ

SEQ ID NO: 193631 - protein, 107 aa, Triticum aestivum
  Clone ID: PAT_TA_88049.pep
TPNRYALIAPSPNFNYAKIVFRNIQQRQLSSLLWTLGRKNRLTTAQQLFANNAGNKFSSSPIEIEPSNLLCSYRRVCCGSTFRIAFEGMPISLPWSQTLRNAARYTN

SEQ ID NO: 193632 - protein, 91 aa, Triticum aestivum
  unsure (1)..(91): unsure at all Xaa locations
  Clone ID: PAT_TA_88050.pep
FGDSSKSGISTLLLSPLLISAAHLVCTQSPSXLVYVLWXSWMICNRNFMKXEVXXPKINLGXIXSGMMPKPKSQPXIKFGXXLRGQXXRGX

SEQ ID NO: 193633 - protein, 88 aa, Triticum aestivum
  unsure (1)..(88): unsure at all Xaa locations
  Clone ID: PAT_TA_88051.pep
FQVFFIFFFSGVQFPQPFHRNLHLNNRKAHLILFIIQFYLIILLSPEFFMVALHDLIHSSSVHQDPGRRSXSNPXSXXAKXELIPRXF

SEQ ID NO: 193634 - protein, 72 aa, Triticum aestivum
  Clone ID: PAT_TA_88052.pep
FFFFPCMIKDLFCFSFQKAKQFSSFDKSVSLIMHCRSSSVHIMHPLYTGVVPNYLARFYMHAMSTHAYVRVV

SEQ ID NO: 193635 - protein, 43 aa, Triticum aestivum
  Clone ID: PAT_TA_88053.pep
WFLVYFGKSYSWKLLGHRNCDMQIGFDNRIIEELNFFLIILYI

SEQ ID NO: 193636 - protein, 96 aa, Triticum aestivum
  unsure (1)..(96): unsure at all Xaa locations
  Clone ID: PAT_TA_88054.pep
PRRRRFSVRFLPPPVKIQESEHSLLSDHFHHRQSQDKVAVLFLPPGSRRREESMSCPTMATTGIQDVIALRNYMVRSTNLGVRYVXNVNLSKEQVP

SEQ ID NO: 193637 - protein, 70 aa, Triticum aestivum
  Clone ID: PAT_TA_88055.pep
PNQPTNHRFINQLFLSLIHSHIPTIITSHTLILILIFPAACSSSSFTSPTGYLSSLTGRIARSALTVIVT

SEQ ID NO: 193638 - protein, 87 aa, Triticum aestivum
  Clone ID: PAT_TA_88056.pep
FFFFEQHNNKLKHLYCPCTNKLFYISANNNPIEISKQLFENEKEFYVHRLGSGIQTSVYSLSLVMHHALLDCTWHAAAVISGAFGAG

SEQ ID NO: 193639 - protein, 169 aa, Triticum aestivum
  Clone ID: PAT_TA_88057.pep
MAERGLVLRLCCGGSQGPGYGGGGSNYASRVIKGIQGNQGGYHQQSWPRQINSSNLGIRVTPKQLNSGQYHVFTTSLCKRDQKLHKRVVNAVEPAVPRYLRWSEQPIVWSREDHPPRVDNPGHLALVVAPQVGGYKFTKVLMDGGSSINILYYETFRRMGLTDKNLKPS

SEQ ID NO: 193640 - protein, 177 aa, Triticum aestivum
  Clone ID: PAT_TA_88058.pep
ENLVFELGHKCVMTTQHTGRHLIILKSWDRDRIVFDSIDFSRLRSLTVFGEWESFLISKRMRLLRVLDLEDATGVKDDDLRKMLKLLRRLKFLSLRGRTKICCLPNSLGDLRQLQSLDVRYTSIVTLPGTITKLKKLQYIRASTTIPASTPDASTSLLPEFAVSPSGVVCQQDGELT

SEQ ID NO: 193641 - protein, 80 aa, Triticum aestivum
  Clone ID: PAT_TA_88059.pep
FFFFEEAENFMTSHCEAKNRYLHNPKPRYNAGDPKKGASNLSLFKGNLAPSGASNSLTLDVEEWRTILLYIFNNLSEVRR

SEQ ID NO: 193642 - protein, 71 aa, Triticum aestivum
  Clone ID: PAT_TA_88060.pep
TTSRKQGFGWGLANPLVPVQSRTGTHGGHTSRFVRPGGRPGLVGAFVPVRLDPFVPVHATNRDQWPRSWAQ

SEQ ID NO: 193643 - protein, 170 aa, Triticum aestivum
  unsure (1)..(170): unsure at all Xaa locations
  Clone ID: PAT_TA_88061.pep
EKIADIAFLHGPAHDRPRSTTLCAHPSPPAAVSAAALAAGCRRCLLSFSPDPRMQQAVTPLVAAPSPGDGRDSGNVDXRSQHPSDELARRNLLRVVKXQQKCPPVVAKKIVGSKQKIXRRCRQPXANXXKSSLPVXFVNCRVAXKSCAPPXTREXIXGGNKNDGWVQKKK

SEQ ID NO: 193644 - protein, 47 aa, Triticum aestivum
  unsure (1)..(47): unsure at all Xaa locations
  Clone ID: PAT_TA_88062.pep
TCNXXLPSXCCXNLGRTWQTXLFWQVGTITXILLEIAVRXVPXTCXR

SEQ ID NO: 193645 - protein, 139 aa, Triticum aestivum
  unsure (1)..(139): unsure at all Xaa locations
  Clone ID: PAT_TA_88063.pep
KTAPPGWPPSKHEPHDLNQAGWQPNVPFSAPPKSDRDNMETNVRGFNLNEESCPMDCEKPDVSMKPPFGDRWPTEPKVLPSPPSRQPLPWQLKQAGPATGSSSYPRSRETQLGLGMDFLSGRGKRSAADGGDXRDKXGK

SEQ ID NO: 193646 - protein, 105 aa, Triticum aestivum
  unsure (1)..(105): unsure at all Xaa locations
  Clone ID: PAT_TA_88064.pep
TXRXPKIFXPGGRKICXHFGAQXXPXPPKIPFXXXFSNIXVXPPFGSXXLXXSVFXKGLFMXKXPCKXSFCLXXFHNPXELDTCDFPTFXEVFLKGLRIASSLXG

SEQ ID NO: 193647 - protein, 64 aa, Triticum aestivum
  unsure (1)..(64): unsure at all Xaa locations
  Clone ID: PAT_TA_88065.pep
MAXRKGGDRXXAVTRXSVKAGLQFPVGRIXRYLXKGRYXXRVSSXAPVYLADVLXXLAAXVLXL

SEQ ID NO: 193648 - protein, 58 aa, Triticum aestivum
  unsure (1)..(58): unsure at all Xaa locations
  Clone ID: PAT_TA_88066.pep
NVTICIRSLEVQCFXAPFVYQNNLKYAVIKNINKKLQXXEXDVFLEKKTXEQDAAVWI

SEQ ID NO: 193649 - protein, 65 aa, Triticum aestivum
  Clone ID: PAT_TA_88067.pep
RGRSPSTSSKSAANDHRSVRRSGSISSLTRAFCLTVMDHFKGAHKAAEAPTPRNQYGAVFSVFQK

SEQ ID NO: 193650 - protein, 96 aa, Triticum aestivum
  Clone ID: PAT_TA_88068.pep
LQGKIIQRLNTTLLHGPAPSTPVDEDADLTKGSVKHWAIETLSSSDGVLHDILPLVEDDTWSSDLNKLKKNSASLVHVLLQIYCVSASSYCMSSES

SEQ ID NO: 193651 - protein, 185 aa, Triticum aestivum
  unsure (1)..(185): unsure at all Xaa locations
  Clone ID: PAT_TA_88069.pep
KVGPSQKLRTSMFFGRSSINLLGSLCTLCKKAKCLRFLRIYVTDADMSPIHSFSNPYHLRYLEYIPVVITPRSSRVYNNTVFPQALTRFYHLQVWNVGISGNFSVPTDMHNLVNLRHLISHEKVHQTIACVGNMTSPQELSFXXSISSFEIREXQSLNELXLLEILNXKSEDKEEAVGQAIDKDI

SEQ ID NO: 193652 - protein, 64 aa, Triticum aestivum
  Clone ID: PAT_TA_88070.pep
HLPDRCTLTNIIDQQTNVHQEFFSRMGALDAMQPMHARQVCIPVLLDRPPWPAPGSFDDHLHDR

SEQ ID NO: 193653 - protein, 57 aa, Triticum aestivum
  Clone ID: PAT_TA_88071.pep
ERETSREFFFFFFFLTLNGNADADNTHHVSLPIANYHYFKTVIFFLLCDQVSVDYNT

SEQ ID NO: 193654 - protein, 55 aa, Triticum aestivum
  Clone ID: PAT_TA_88072.pep
NVETLSAQQMFLPVCSSIEFFHYMCVVKLLYEPVNIICKSYDYCAPVGEQTEKKK

SEQ ID NO: 193655 - protein, 176 aa, Triticum aestivum
  unsure (1)..(176): unsure at all Xaa locations
  Clone ID: PAT_TA_88073.pep
PHDRRIHKMRPRLYAIGHKVNSLPSEPSLSTCETWLLPQTCVRHGYYLRRVCYAIMNQEEDHRTARSIGQDGENTKREEQEEEPPKNSSKRTFGRHRTTGSHSERHPASGGRPAPEDQPTPAITPSEPXSDCTGXPAYXRXRTSGLPCPRHKXFQRXXXLXDTXPRNNGXXPWCXN

SEQ ID NO: 193656 - protein, 80 aa, Triticum aestivum
  unsure (1)..(80): unsure at all Xaa locations
  Clone ID: PAT_TA_88074.pep
EGPYFQSYKGVRQGDPYSPFLFNMAMEALSKMILNAQKXGMLTGLAPNLINGGVAILQYADDTIICFEHDNEAAVNLKTR

SEQ ID NO: 193657 - protein, 70 aa, Triticum aestivum
  unsure (1)..(70): unsure at all Xaa locations
  Clone ID: PAT_TA_88075.pep
DMIRLIKMDSHTTWXYAATHYKXKGCXLXYLXQXPXTGLAPLTTDTGLMPLTVDIXWTELSIPSFSTDYD

SEQ ID NO: 193658 - protein, 127 aa, Triticum aestivum
  unsure (1)..(127): unsure at all Xaa locations
  Clone ID: PAT_TA_88076.pep
GXDRGENLYGTTISIXNXTXTNLSCAPFIISSTLQSLQPVRCSYTNLLRQIRPSQMIYTILPGXGPGVPPGPLSVKGMISASAGYARQFSESEVLPSLKERRASHRAARSRCPGVPGGTNGCSPRSS

SEQ ID NO: 193659 - protein, 65 aa, Triticum aestivum
  Clone ID: PAT_TA_88077.pep
SRKRAPSTPRASSAACMLWLNLKMFVYYQWLFLVSKFSVATIKHFVLVSLIYYVHVLNFVRVFFI

SEQ ID NO: 193660 - protein, 127 aa, Triticum aestivum
  unsure (1)..(127): unsure at all Xaa locations
  Clone ID: PAT_TA_88078.pep
AGVPRQSSSAGSWRRNDSRMSTDENVNRKFARTAPAWKQQKVQDHSNRVCQMLNTMHLNEKAQGTKQTPWRSSAAQRSLFHXHAPFGDNGHSQGXNHTEATNRWAERTWRAQRPGTRTACGSSKEHK

SEQ ID NO: 193661 - protein, 117 aa, Triticum aestivum
  Clone ID: PAT_TA_88079.pep
AHRRSPRLSRAAAKEESKVAAAPRRLHHCRHPPAPRLKGVASLLLQAPPEYSRINHLADKRPPSLSYLLPYVRVGNVYIVRAYFARFELYFSCHLISLSFSFSWLIPPGGRFESLRS

SEQ ID NO: 193662 - protein, 120 aa, Triticum aestivum
  unsure (1)..(120): unsure at all Xaa locations
  Clone ID: PAT_TA_88080.pep
PAVTYSIVTYLIQTTCTIPGLLYYCSKKLRDPGSRLDEQLEQDRQPAGGGLGAPPPGSDSATTGRSAISSRCRRMWPPSAWARLEAQPADVAVRALRAEFXTSILTHQQVKFIHHSSGXS

SEQ ID NO: 193663 - protein, 60 aa, Triticum aestivum
  Clone ID: PAT_TA_88081.pep
FFFFVENMAFQRASVANNIQVIHSFTGAELPQKINHHATANSQKMRLHVCVCPYWQKREI

SEQ ID NO: 193664 - protein, 142 aa, Triticum aestivum
  unsure (1)..(142): unsure at all Xaa locations
  Clone ID: PAT_TA_88082.pep
GAGVSGAGVGYLQASCGTSSPLASGLMPDVDSGGSDDLFAISRQMGFVGSPAGSSSAAPNTAVQQQYYSCQLPAATITVFINGVPMEVPRGPIDLRAMFGQDVVLLHSTGPSSQSTTMDSDSXPANGRNYFWSXSKLKIPFI

SEQ ID NO: 193665 - protein, 112 aa, Triticum aestivum
  Clone ID: PAT_TA_88083.pep
HLPPVAYRPIQPPAFLGQAPASTHASPPTANPRRPTPFSLVSFPLAPPEPFARPLAQPLSILLLLVPPPAASHPPAPHRQGEELPSTRAPLSSIAPASVSRCRLSSSVPRRL

SEQ ID NO: 193666 - protein, 95 aa, Triticum aestivum
  Clone ID: PAT_TA_88084.pep
FGTELNLCSVLEQKMAAFFLWCKDEVSLRTIHATGRQRRRLFVKVLLTLMIHIQRRTNEDKSVCVRQFLAFFFSPSGQCGHTQRTDLCPYPWSCP

SEQ ID NO: 193667 - protein, 107 aa, Triticum aestivum
  Clone ID: PAT_TA_88085.pep
FNKAQVNNRDLSIAVLRWFISKRQEEHDTQLKGRRAEIPAEQHADGLDTATTGSEDTALREESSLKAPKVLEALAASGLRAIRYALEVDGIGEVIALDNNEVAIRIL

SEQ ID NO: 193668 - protein, 159 aa, Triticum aestivum
  unsure (1)..(159): unsure at all Xaa locations
  Clone ID: PAT_TA_88086.pep
MAPKAEKKPVAEKAEKTTTAKKTKAEKRPPASKEGGEKKGKKKSKKSVETYKIYIFKVLKQVHPDIGISSKAMSIMNSFINDIFEKLXGEXSAXLARYNXKPNITSREIKTSVRLVLPGELAXXAVSXGNXXITXXTPPKRMVLCVVQTMSPCNFPLVL

SEQ ID NO: 193669 - protein, 48 aa, Triticum aestivum
  Clone ID: PAT_TA_88087.pep
CASRCFISYSDNAFSFLALHPAENSGCALVGFLFFSIFSDLTQLEKKK

SEQ ID NO: 193670 - protein, 119 aa, Triticum aestivum
  unsure (1)..(119): unsure at all Xaa locations
  Clone ID: PAT_TA_88088.pep
PWVILNPVYLRTAGXPEKVXLPVFGVVILELISGKKATHSXGSSLVINFLEAXKKERKATHLFDKEIIVXEDLEILDSLTGIAVECLSLDVDQRPSMTDVFNRLFILNQSHKSQLVCEL

SEQ ID NO: 193671 - protein, 57 aa, Triticum aestivum
  Clone ID: PAT_TA_88089.pep
FFSSSSPRTGETTRRGPPAVTSALPRGADRSWRWAAVGSRQVVASRTHRRQSTSSSG

SEQ ID NO: 193672 - protein, 66 aa, Triticum aestivum
  Clone ID: PAT_TA_88090.pep
VAPLASRRQADLSARPPPPRPDRSSSASQSLGRHQYIITSPSPCSFFDALLYFVHSVVHLLLYVVI

SEQ ID NO: 193673 - protein, 114 aa, Triticum aestivum
  Clone ID: PAT_TA_88091.pep
FFLKKTESVPIIRIGETTKKCPDATCASVQHIKIILTAADINHHAVALEKKLDGDGGCARRPMTEAARPRARTQASGREAPVSEAARCSVGVRILRRRSSRGAWEGSRRAARAP

SEQ ID NO: 193674 - protein, 55 aa, Triticum aestivum
  Clone ID: PAT_TA_88092.pep
ALRGEFPEEEALPVLKLGVVCTSQIPSNRPSMAEVVQILQVIRAPSLPGCTAQLF

SEQ ID NO: 193675 - protein, 70 aa, Triticum aestivum
  unsure (1)..(70): unsure at all Xaa locations
  Clone ID: PAT_TA_88093.pep
AFIKNFIHFRFHHPKNPPRFCKYLGGELQIQAPKVLNRGNSKELWNQSSRXDQSKXXKVPFNPGSIDVGI

SEQ ID NO: 193676 - protein, 46 aa, Triticum aestivum
  Clone ID: PAT_TA_88094.pep
AIVFSSQWGLPALSHSASGGASRTARLRAFYLDRSLSAGSGAGSPC

SEQ ID NO: 193677 - protein, 76 aa, Triticum aestivum
  unsure (1)..(76): unsure at all Xaa locations
  Clone ID: PAT_TA_88095.pep
ATSSHWLLVIRIIRSSLGSSTRPMVGACELFHGLVESSLSSLVYNLFNGYKRTLYIWLGCYFWAIQXGNWLVXDNR

SEQ ID NO: 193678 - protein, 79 aa, Triticum aestivum
  Clone ID: PAT_TA_88096.pep
WGLHLSLEKEGGSNSKENAACFTVLVGKEGTPELEARTIEYMSTTSVSSFYLISRFLRNRPSTPHQETEKRKQRGINTW

SEQ ID NO: 193679 - protein, 166 aa, Triticum aestivum
  unsure (1)..(166): unsure at all Xaa locations
  Clone ID: PAT_TA_88097.pep
IGRMASGPLIGWMIMNEWYLPAFGTLALSGASDWXRKMGINSVIGSYLDPLADKVLICCVAVAMVERELLHPGLVGLVVARDFLLVGGAFYKRASNLGWXKWNNXWXXFVILDAIQRXKGQXPFXTXVNTSYFXLMLGCLAPQAKKFGTKGKPRNFYTFGFGCQTG

SEQ ID NO: 193680 - protein, 66 aa, Triticum aestivum
  Clone ID: PAT_TA_88098.pep
GAEEAQPSQGKLLSVTWHRLAYDRQPVVTHVFGLDDAELMSFEFLLSSHSHIIMYTVESNLSSRVW

SEQ ID NO: 193681 - protein, 134 aa, Triticum aestivum
  Clone ID: PAT_TA_88099.pep
QAANLQYVQSLLHSAASVAASPTTSSSLNSLTMDLEQINFLSPPQMLSPSVLEGIDGIDLAGQVSQNQMPSVTFDHTIGNINPGSHNNVETSEKHRSEGENSSQKRSFLSENSLPPLTDMAASNICNTIKHLKL

SEQ ID NO: 193682 - protein, 160 aa, Triticum aestivum
  Clone ID: PAT_TA_88100.pep
YPCAKFRTRYFKGKSSAISRDNTYDCVRSFDDSWRNQVDSFVQKGSVKINVNDNICHYFQMQRGLRKGGLMSPILFNIVADMLAILIGRVKKGGQVVGLMPHLVDGGVSILQYAADITIFMEHDLPKARNMKLALYNIIHHKDSYVAAVLQYVPLNIQFM

SEQ ID NO: 193683 - protein, 107 aa, Triticum aestivum
  unsure (1)..(107): unsure at all Xaa locations
  Clone ID: PAT_TA_88101.pep
MITKELALVLLTELNSTPXTTAASVHRRFAGETEKSRRNRAVVLRGEGLLSTDGWSAPRMLVHRFLQPATASPPQLAIHGXLKDXFRGRNCXKTPLQNNXXQQXPWP

SEQ ID NO: 193684 - protein, 58 aa, Triticum aestivum
  Clone ID: PAT_TA_88102.pep
TNPVMDLINLLWNLYVVALVLFLSTLSLQTTNFLTYKRSRIYLSLPESIDPYISAFLY

SEQ ID NO: 193685 - protein, 64 aa, Triticum aestivum
  Clone ID: PAT_TA_88103.pep
PTSASRSASSPSATASPSAAAPSEPQNPSPPLRHRRQEQELINYSPFCLSCSPSVLYIYLLQFV

SEQ ID NO: 193686 - protein, 50 aa, Triticum aestivum
  unsure (1)..(50): unsure at all Xaa locations
  Clone ID: PAT_TA_88104.pep
RESWMSQGSCXSTLPSWMTIAISGSSTKIRRSTSALAMIDSLVYRLCMSC

SEQ ID NO: 193687 - protein, 86 aa, Triticum aestivum
  unsure (1)..(86): unsure at all Xaa locations
  Clone ID: PAT_TA_88105.pep
SLAASHRWRCWGYITGRPTKGPNIMKCGVHTTCGSKSIHTDTLSTXDKXHTIHSNKQHTSTRMTVNXPTXHSLXYTKTXGTNIGSF

SEQ ID NO: 193688 - protein, 150 aa, Triticum aestivum
  unsure (1)..(150): unsure at all Xaa locations
  Clone ID: PAT_TA_88106.pep
PHPAMPELLKPELPHPAVPETPKEVPHPKVPEVPKHDLPPHPAMPEIPKPELPHPIVPAVPKETQAPHSIVPEVPKEHDLPHPVVPEVPKKPEAPHPVVQXVQKGAQLPNPAMQXLQKPKLQNNALPGVXXPYTLFKRSQNCRSPAKFNF

SEQ ID NO: 193689 - protein, 98 aa, Triticum aestivum
  unsure (1)..(98): unsure at all Xaa locations
  Clone ID: PAT_TA_88107.pep
KGXRQLPXPKXPFXRKGVVRGLAQPYDAGLGGQAWMASSTRXCEARAYRSSTXVTGKKALPXRHFAGMHDATRFTXVVLVPAPQXKKKNICCTCGLTD

SEQ ID NO: 193690 - protein, 163 aa, Triticum aestivum
  unsure (1)..(163): unsure at all Xaa locations
  Clone ID: PAT_TA_88108.pep
LDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQXKGIPYLNTYDGRTIRYPDPLIXGNDTIKLXLENNKELLXSTXFXFXNV

SEQ ID NO: 193691 - protein, 132 aa, Triticum aestivum
  unsure (1)..(132): unsure at all Xaa locations
  Clone ID: PAT_TA_88109.pep
MLPLQMMMVLVSMSLVVSPSMGIPTDDKCKCLMCVCDLDPHPLPPAMPSRHPAPYPPPSEPEPEPEPKPEPQPEPXPEPKPEPEPQPEPEPEPKPKATAMPPPPELCDAMYTLPTASEPNNAVYNFTVNTVP

SEQ ID NO: 193692 - protein, 77 aa, Triticum aestivum
  Clone ID: PAT_TA_88110.pep
PPFFLQKISKTAFLSPVYRQIAAKISNNLSFLFSFLHGTSFLLSIYSIVDHTIRIGRELPSHVNQHLRFSSAWKELP

SEQ ID NO: 193693 - protein, 150 aa, Triticum aestivum
  unsure (1)..(150): unsure at all Xaa locations
  Clone ID: PAT_TA_88111.pep
PTSTSPQAQRSEAGIHMEGSFPGYAGGRARTECAASVSLWLHCWSPLSDPRQALFPSSVFYKKTANKASILDEAIEYLKSLQMQTSAELTARGSAGSGGQPSPLPFLFDVRAHGEXARGSAGSDGQPSLLLVLLDIKITLLXSIKXTLRC

SEQ ID NO: 193694 - protein, 169 aa, Triticum aestivum
  unsure (1)..(169): unsure at all Xaa locations
  Clone ID: PAT_TA_88112.pep
MARGPVKHQKRLSAPSHWLLDKLSGAYAPKASPGPHKLRDSLPLVIFLRNRLKYALNAREVNAILMQRLVKVDGKVRTDSTFPSGLMDVISIEKTGENFRLIYDTKGRFTVHRITDEEAQYKLGKVKRVQLGKGGIPYLVTHNREQSATRPAIKVKDNVKXTLQWQDCR

SEQ ID NO: 193695 - protein, 67 aa, Triticum aestivum
  Clone ID: PAT_TA_88113.pep
RLLLLANDGYVFCRLLSPGSCSVDVMCLDSFFFFTLILCIKGDPSASFICTTTRSYGPVQPCLAKKK

SEQ ID NO: 193696 - protein, 115 aa, Triticum aestivum
  unsure (1)..(115): unsure at all Xaa locations
  Clone ID: PAT_TA_88114.pep
FGCXPSSSCYSLSXFSQLWSGFISWYLFHQPKRSPTPSRSLLPMVLLRKGTWREYVDGGWSEASVIWMSLVFRFLHDPLHMKPSPYKWSVHHSTGDITFCNCSPSTFIEIITRNF

SEQ ID NO: 193697 - protein, 138 aa, Triticum aestivum
  Clone ID: PAT_TA_88115.pep
DLVILLILFYLQGYDYSSGVWQFEGYGYVPSGTTGVSIMQVFGAGETATTFMLHVYDGALRYYNRQLVEDAIYDRWFRLNVVHDVDASTLTVYIDGELKLHVQGRGGHSHYFKFGVYGQRRESSRMDRTGRTQDLKKD

SEQ ID NO: 193698 - protein, 133 aa, Triticum aestivum
  unsure (1)..(133): unsure at all Xaa locations
  Clone ID: PAT_TA_88116.pep
LEAHAAPNCKVLVVANPANTNALILKEFAPSIPEKNISCLTRLXDHNRALXQIXEKXGXKFPDVXNAIXRGXXXSXQXPEVXQANVKDPNGEKXVRELVQRLLMXKWGNSXGTVQQRGAAIIKSEGXSPXXXP

SEQ ID NO: 193699 - protein, 51 aa, Triticum aestivum
  Clone ID: PAT_TA_88117.pep
SELHGALLEPEDVARAAVYLASDEAKYVTGHNLVVDGGFTVGKPINVHAAS

SEQ ID NO: 193700 - protein, 61 aa, Triticum aestivum
  Clone ID: PAT_TA_88118.pep
FFFRVNNPRMNELCHNSYTETTMQYSHPSPCAGAWWIPILLLPISLASTFTSFSTFRPTES

SEQ ID NO: 193701 - protein, 82 aa, Triticum aestivum
  Clone ID: PAT_TA_88119.pep
ENCVLKKLIIPKNVRVLKKLFVIFKIFCIFKFCSQLQKIFRYFKSRKIITYSNLYAVVHVQKITCKRNIPQYKVLKYNRDAV

SEQ ID NO: 193702 - protein, 163 aa, Triticum aestivum
  unsure (1)..(163): unsure at all Xaa locations
  Clone ID: PAT_TA_88120.pep
WTEGKRSIVGVSQSLTCRNNNSLTVHEGLCLSDISQGKESIPICVINTIDGVLPTPFKYITKVIYPPSYAKAPSIGCDCTNGCSDSSECACAVKNGGEIPFNLNSAIVYTKPLIYECGPSCRCPPTCHNXVSQHGXKFHWXIFKTGKTSWGVRFLKFYPKVVS

SEQ ID NO: 193703 - protein, 113 aa, Triticum aestivum
  unsure (1)..(113): unsure at all Xaa locations
  Clone ID: PAT_TA_88121.pep
MAGSESWEQETEALCHGYPTEFASYFHYCHSLRFXDYPYLKSLSRDHFIXRGFQFDCIFYWTILKYKQXMTSAPPRAMGVRARQEDKALGWLPRETRQFSEQGKSCKAEFPNS

SEQ ID NO: 193704 - protein, 135 aa, Triticum aestivum
  Clone ID: PAT_TA_88122.pep
LRSLLRNMPGLGAIRRPVKPLSSVVGSVLIPNDLHDSFYSEEVLTRQREKVNRLLVDYNNMHQKLNQDMDAFLESVRRDSNELSRSQHIVDIFENTIHVIFFGVPVVLLTIGIKYEIDIFEYLPLSPWRLKDLWF

SEQ ID NO: 193705 - protein, 113 aa, Triticum aestivum
  unsure (1)..(113): unsure at all Xaa locations
  Clone ID: PAT_TA_88123.pep
LIXMWEKLGQSRWPTSGWSFGXLTXKXXRFSWNWTQRITPEQSKXKXKNSINNQTTIWSLVVKGVLNEVQMAPXKPXKKLETYFEREVSKKTNLLFWXXLVNRKPVRAARXIN

SEQ ID NO: 193706 - protein, 87 aa, Triticum aestivum
  Clone ID: PAT_TA_88124.pep
FFFFVRVASIHNVDLMLQSDGLGACNALDEGHNNGHLLRRLLRHDGVGSRGFGEIIHVTLALRLVQHGLLAAPRAAAERLDVHARPV

SEQ ID NO: 193707 - protein, 110 aa, Triticum aestivum
  unsure (1)..(110): unsure at all Xaa locations
  Clone ID: PAT_TA_88125.pep
LSLKLTGCKLGEXXMNLNLPRKILDRREQHLHGXTLXYIRLNNRSCIADRAKPHPKLHPPFGTKPSPQQKPCPKSHQRFGCRTKLCSKRSTDNSAGFLPAQPSVEVKGTE

SEQ ID NO: 193708 - protein, 88 aa, Triticum aestivum
  Clone ID: PAT_TA_88126.pep
PYPRNHFYLCLLVVRSIAMQRYLPLAISFLPYCHEPLTFVTLRSKPLFGYVTAFAQAPLIALLAAGEDEDCSMLDYVFVGISQCLLYY

SEQ ID NO: 193709 - protein, 80 aa, Triticum aestivum
  Clone ID: PAT_TA_88127.pep
RTLTHTDHFFNTHYLEIGRTTMFPKDHRQLNSGIHERKTHTRTHFTYPHWQRNQSSFHPLLKHWLQGFALLKASSAAQHA

SEQ ID NO: 193710 - protein, 108 aa, Triticum aestivum
  unsure (1)..(108): unsure at all Xaa locations
  Clone ID: PAT_TA_88128.pep
ICKSLLFGWIPCKLFRSTISGILQLSILQNISPLACLSMPYSSMLNKLKYMKAEYCYRFYSTPTCSNLFIRNYYAKLRXNQSNNQFVHYNVHTWIIDTICYLFKKKGG

SEQ ID NO: 193711 - protein, 68 aa, Triticum aestivum
  Clone ID: PAT_TA_88129.pep
SNQPKALILNLSAAFTNQCRMTTRACIYISRLRPPFDSVYSRQTTLHCNIDHLPNRDLQFYTQFANVK

SEQ ID NO: 193712 - protein, 82 aa, Triticum aestivum
  Clone ID: PAT_TA_88130.pep
MSFFETKISELVRTVMLKEQEIDGLQLCRGEMENTVADIQKEKSQLEERLAASLEETSMTSKWLDEAREELLVLTSSVESHV

SEQ ID NO: 193713 - protein, 124 aa, Triticum aestivum
  Clone ID: PAT_TA_88131.pep
PTSVRRDSEPRCRAPSIQVRSEKAMDDFYVSDDELHVPFLPLLTPRCVTICRQYILDLALKRLGLVVESIKSTTKQQTTPSPSTYEQQMTPPPKLDMSSKQVGKRAMCNVRKDLFGKRKRDCEE

SEQ ID NO: 193714 - protein, 87 aa, Triticum aestivum
  unsure (1)..(87): unsure at all Xaa locations
  Clone ID: PAT_TA_88132.pep
GLARXALRPKAXIVWPKLAXEKTEPATSRSHDERRLAHERGRAKVAAAEAQLHQEKVAHREAAMEHRLHKHAGVGGHNHKHGAGGVH

SEQ ID NO: 193715 - protein, 65 aa, Triticum aestivum
  Clone ID: PAT_TA_88133.pep
EDRAVAARGAAWRELRANAMALTELAKAEPLAGESLCMASVRAASDLHLANASGKCTCRLWALSD

SEQ ID NO: 193716 - protein, 89 aa, Triticum aestivum
  Clone ID: PAT_TA_88134.pep
DGESNLLVDPEEIGCLERVSGLNDEANCVDELYPDGQPSPSAWQDLVASPSRASVQRELRAAVQASEARFRAASLADGALRGDAPVQTF

SEQ ID NO: 193717 - protein, 42 aa, Triticum aestivum
  Clone ID: PAT_TA_88135.pep
RAAGGGARSSNSSSGGSPGTLSGGTWAACVGSTLLAAAPMLL

SEQ ID NO: 193718 - protein, 166 aa, Triticum aestivum
  Clone ID: PAT_TA_88136.pep
PKRKEFGLDFHLVQLFFVCMPSLAVYLVAQYARSEIKRMEAEAEAKRKKIEEVEKQKQLEVDSVKVDADSKLATVLVRLDTLEGVVKEIADDKMRSSALTKEESLKKGQTSSPDKASAPKSDASDQLASVKIKDIKGCYQILPPDCDTSKDTKRDREQISNYLGFG

SEQ ID NO: 193719 - protein, 179 aa, Triticum aestivum
  unsure (1)..(179): unsure at all Xaa locations
  Clone ID: PAT_TA_88137.pep
EKVAAGELSSAIALVRPPGHHAEHSHPMGYCLFNNVAIAANYLLNERPDLGINKILIVDWDVHHGNGTQNMFYNDPRVLFFSVHRYGYGSFYPYEADASHVFIGDETGRGYNINVPWEHAKCGDADYVAAWDHVLLPVAEAFDPDIILLXSAGFDXTMGDEMGGLLITQMGFXAXKKLG

SEQ ID NO: 193720 - protein, 63 aa, Triticum aestivum
  unsure (1)..(63): unsure at all Xaa locations
  Clone ID: PAT_TA_88138.pep
PSPGXVKICYLKDGFITRXMSWXSVFKPLMCIFMGXCLGFXYXXXIKCLISGSLFVVYIKNXR

SEQ ID NO: 193721 - protein, 56 aa, Triticum aestivum
  Clone ID: PAT_TA_88139.pep
TGRVIAGIRAGEQSAEDLWFFLGYAGWGYSQLFDELSEGAWHVSAGPIRHLEWPDS

SEQ ID NO: 193722 - protein, 79 aa, Triticum aestivum
  Clone ID: PAT_TA_88140.pep
VRRERISERLKVLQDLVPNGTKVDMVTMLEKAITYVKFLQLQVKVLATDEFWPVQGGKAPELSQVKTALDAILSSQQQP

SEQ ID NO: 193723 - protein, 145 aa, Triticum aestivum
  unsure (1)..(145): unsure at all Xaa locations
  Clone ID: PAT_TA_88141.pep
AYEDLPPRNERYQNRYHDEELRYGKIKFTMPKFSESNDPEEYLSWTLKVDNIFRLHNYDEEKXIAMASLEFQDYVLIWWEQVIEQRHKRGEPPITTWKEMKEVMRARFVPTHYTRYLXKKLQLLKARHERWWEEYYQEMENCHDT

SEQ ID NO: 193724 - protein, 76 aa, Triticum aestivum
  unsure (1)..(76): unsure at all Xaa locations
  Clone ID: PAT_TA_88142.pep
NSLDMRGSVEIYRPPLSISSDFWMSWLEHEFNMVGWLEPQLGRRCSVGRSGLAARAPALLWQPGAGADKARXHDVH

SEQ ID NO: 193725 - protein, 79 aa, Triticum aestivum
  Clone ID: PAT_TA_88143.pep
NSIFFYRRCNRYLQLTKLCYFPKKIRSCSVGDVDMQQKSQVRCLLVLDGGHRLHQETCQGQQFSISAWGTANPTPAELA

SEQ ID NO: 193726 - protein, 110 aa, Triticum aestivum
  Clone ID: PAT_TA_88144.pep
RLRTCYRCAVAVQKSKPHEPCVALPIGTVPCSDYVATRGKNSGLEFHRLKLSQLRDIRWNHRRHRPHRRCRKFAGKLHPLHPVYYRHLKTNHPQPFGVTLRPVFSQQPSS

SEQ ID NO: 193727 - protein, 88 aa, Triticum aestivum
  unsure (1)..(88): unsure at all Xaa locations
  Clone ID: PAT_TA_88145.pep
RSINNYIFFGVXKHCSRLFRARHSIENLSSTENCILVSPTFNAKIHHPNQAPLLCKLAIHFQNIPANNEMTNIYFWIGLLSTSMLKFD

SEQ ID NO: 193728 - protein, 84 aa, Triticum aestivum
  unsure (1)..(84): unsure at all Xaa locations
  Clone ID: PAT_TA_88146.pep
LRXXPNXXPMILPALDEEGETXHTVXPHCQKNKLAHFVMKMLVPASXKAPKKKPEKESKXTRGXLRRKGXSDVVSEDSEAXSSS

SEQ ID NO: 193729 - protein, 69 aa, Triticum aestivum
  Clone ID: PAT_TA_88147.pep
PAAKGVTFKDAFDVALERVIDRVAKRRRAAAEGREYVDSVDGKYSWKYDLAQDREKMLAPHEFDPYINT

SEQ ID NO: 193730 - protein, 133 aa, Triticum aestivum
  unsure (1)..(133): unsure at all Xaa locations
  Clone ID: PAT_TA_88148.pep
LDLYRKFLEGPNFMPWXRQRRSAAEQDQIRLWRQARMNVDIEKLMSKMSELERIDSFNVIERYLLKEMENSRTGTAESIAACQKLKADLQAAFSVLPKDMQQLLVSNPKRAVLLQASQEKVSGLGDVVSQTSL

SEQ ID NO: 193731 - protein, 112 aa, Triticum aestivum
  Clone ID: PAT_TA_88149.pep
VTPFYVVYYQSRCLVSYVHYSAHQVKQHFIVVALASCNDVLRFYFVSLSYASFTHHICGYLASSCLLHLFHLSSYHVFSFKCRSCLSDIQTDEVDCRLRRSANKVFLKDSAT

SEQ ID NO: 193732 - protein, 36 aa, Triticum aestivum
  Clone ID: PAT_TA_88150.pep
KAEYHKKYKRSLADAIHSETSGNYRTFLLSLVGRDR

SEQ ID NO: 193733 - protein, 51 aa, Triticum aestivum
  Clone ID: PAT_TA_88151.pep
RDIDGHIVSPRLMRWHQADIQKYSARAEKRSRTAGEPKREVNLKQANRVQA

SEQ ID NO: 193734 - protein, 136 aa, Triticum aestivum
  Clone ID: PAT_TA_88152.pep
PATLAEYTLGQGGSQDFFDLSVIDGFNTPMSFQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 193735 - protein, 69 aa, Triticum aestivum
  Clone ID: PAT_TA_88153.pep
SYQVNYTRILKAWYYFKKLLVKLGIPANQIFPMRSYVVILSVNIKCSLWYINFGVCNMLYAIVQIYNCF

SEQ ID NO: 193736 - protein, 114 aa, Triticum aestivum
  unsure (1)..(114): unsure at all Xaa locations
  Clone ID: PAT_TA_88154.pep
RRPIDHVWMVGEGRAQRLQGGEPAAPPLRAHPGPRVRRHDGHXRRLXXXRRDAHGRHLPGLXGLRVPGXGQLAAVVLEXAXSTAXSXPVXMXXTGEAAPGISWPRQXLAQGSYX

SEQ ID NO: 193737 - protein, 84 aa, Triticum aestivum
  unsure (1)..(84): unsure at all Xaa locations
  Clone ID: PAT_TA_88155.pep
QGGAPGGLRPASYSAGTVGGRQVSFLCSIYFGPFSFXNSFCNCLNSKQIXNSDNIPLNIKLHNGIIQRXIIFSXXSELXPXXRM

SEQ ID NO: 193738 - protein, 133 aa, Triticum aestivum
  unsure (1)..(133): unsure at all Xaa locations
  Clone ID: PAT_TA_88156.pep
PLXPXQIXPLWXIFXXNPFCXXXPXDFPPILXPXIKXHXSXKEXXAPXRSLXEAIAXAHXXSXSSAREGLTVARREAMAXGRGRVARRRRIRWCGXPRLLYLEARMDGAERQGGRRRKKRGERAGYYWRPPII

SEQ ID NO: 193739 - protein, 92 aa, Triticum aestivum
  unsure (1)..(92): unsure at all Xaa locations
  Clone ID: PAT_TA_88157.pep
DKLFGDGGNTQYITNICLLIIFTLSKRIFMSIXKMVLILHXSRHLLLYKSKTSTQCNSXQHHHTSLDTNAAGXTYTSLEYEXDWXISIGRNX

SEQ ID NO: 193740 - protein, 72 aa, Triticum aestivum
  unsure (1)..(72): unsure at all Xaa locations
  Clone ID: PAT_TA_88158.pep
PXGGTFLLGPNSFLKXPLEENPGLTQXCSHSVSINSXLCQLIPVGQXTLLXKTVHSPXKKXIXLTYIGIXFX

SEQ ID NO: 193741 - protein, 115 aa, Triticum aestivum
  unsure (1)..(115): unsure at all Xaa locations
  Clone ID: PAT_TA_88159.pep
RPRARVESNRSGGGGGGDRRRRHRRRAAAASSRQAVSAVGSAACGVRRRRRTRRGVGRARXKXPPTGTXREXVKTSDAVRISPXXQGLDPCKGXAKTXXTXKGQTLXVFRTFNRI

SEQ ID NO: 193742 - protein, 157 aa, Triticum aestivum
  unsure (1)..(157): unsure at all Xaa locations
  Clone ID: PAT_TA_88160.pep
SNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQXINXVEEARRXPDAYVXIIGFTTSQVQCXTYRKQRAARSKAKSQGQIKMGVTAWVSFN

SEQ ID NO: 193743 - protein, 61 aa, Triticum aestivum
  unsure (1)..(61): unsure at all Xaa locations
  Clone ID: PAT_TA_88161.pep
CFVVKYVHFXFRGRGRXCLXLYFFGSYSPFXGTXKYSPAXPSLXQYIVYSSYSXVKYLEXX

SEQ ID NO: 193744 - protein, 125 aa, Triticum aestivum
  unsure (1)..(125): unsure at all Xaa locations
  Clone ID: PAT_TA_88162.pep
MAPTVMASSATSVAPFQGLKSTAGLPVSRRSNGASLGSVSNGGRIRCMQVWPIEGIKXFETLSYLPPLSTEALLKQXDYLIRSXWVPCLKFSKLGXFREHXASPGYYXGXYWXCGSAYFGCTTHQ

SEQ ID NO: 193745 - protein, 151 aa, Triticum aestivum
  unsure (1)..(151): unsure at all Xaa locations
  Clone ID: PAT_TA_88163.pep
MAASLQAAATLMPAKIGGRASSARPSSHVARAFGVDAGARITCSLQSDIREVASKCADAAKMAGFALATXALLVSGASAEGAXPKRLTFDXFKSKTYMEVKGTGPRTMPDIDXGVXPPLQXRXYEMKILPGPLLNVKAXXSKKRAPASKNK

SEQ ID NO: 193746 - protein, 148 aa, Triticum aestivum
  unsure (1)..(148): unsure at all Xaa locations
  Clone ID: PAT_TA_88164.pep
MAASLQAAATLMPAKIGGRASSARPSSHVARAFXVDAGARITCSLQSDIREVASKCADAAKMAGFALXTSALLVSGAXADGAPKXLTFDXIXSKTYMXVKGXGTXNQCPTIGXRCXXFPFKXXKYXMXXFCXEPLLVKARDQEDSAAS

SEQ ID NO: 193747 - protein, 81 aa, Triticum aestivum
  unsure (1)..(81): unsure at all Xaa locations
  Clone ID: PAT_TA_88165.pep
EPXRXPXFSDGAILXQLVXTYIQTCDVFMXLVLLSYLFILVPCEHNISXQEILQFEQAKTRLRVSFSLDAKYFLLGVTLIR

SEQ ID NO: 193748 - protein, 146 aa, Triticum aestivum
  unsure (1)..(146): unsure at all Xaa locations
  Clone ID: PAT_TA_88166.pep
KKFETLSYLPPLSTEALLKQVDYLIRSKWVPCLEFSKVGFIFREHNASPXYYDGRYWTMWKLPMFGCTDATQVINEVEEVKKEYPDAYVRIIGFDNMRKLXASVHRXXQRGCKDPXRKLITAKFKIAVCKPEIAWVPSQLPSGCPK

SEQ ID NO: 193749 - protein, 117 aa, Triticum aestivum
  unsure (1)..(117): unsure at all Xaa locations
  Clone ID: PAT_TA_88167.pep
AGLLQSQAILERRHCSGSSSSSGTTSSGDRTASXSSXDAHASSXNSPDPSSSSSSSSDSCTRDSSADATAGIRTLGGDMARRRGRSGGTAKRRAGGGEAKVGKKAAEHRRDGDGVAQ

SEQ ID NO: 193750 - protein, 141 aa, Triticum aestivum
  unsure (1)..(141): unsure at all Xaa locations
  Clone ID: PAT_TA_88168.pep
PFXKXFVWXPSGXNGSPWVAXPLXXARXSVXTQSXAPRXQIILDTLLNTLCWFLYSPLKSIVQVEASVELVLRAVCADRSDLERGVIVDARVLAAALLGAGALHGAGAVWLGIGVGRGGEQDGQHHAQCNHLRCLSARSHC

SEQ ID NO: 193751 - protein, 123 aa, Triticum aestivum
  unsure (1)..(123): unsure at all Xaa locations
  Clone ID: PAT_TA_88169.pep
SRVFFFFFLSSAAYTPCPFFFFCLVQKKGNPRAISHVRVINSQQVHDAYSCHILCPMHAYTLPGALAVFAFRISXXRAGPDIERQRDVLDNGXXXEGXRWRQXTRFXPPTCGXNTPDVXXXFK

SEQ ID NO: 193752 - protein, 137 aa, Triticum aestivum
  unsure (1)..(137): unsure at all Xaa locations
  Clone ID: PAT_TA_88170.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKSXIFREHNASPGYYDGRYWTMWKCYFGCTDATRYQEVEEVKKDT

SEQ ID NO: 193753 - protein, 127 aa, Triticum aestivum
  Clone ID: PAT_TA_88171.pep
LENMGATVFDPARPPVSFPPTPLWELGCGPTADPLPATISSRKSWPNRPVCGVALTCPPLHLSSNVSLECGSAPGCRLVAEPRNHRSSVKAEPLRIYPPLLCTAARASPRASFVGCPVESCLCFRRI

SEQ ID NO: 193754 - protein, 115 aa, Triticum aestivum
  unsure (1)..(115): unsure at all Xaa locations
  Clone ID: PAT_TA_88172.pep
SPPRTPSCTASCHVCLVGFQSDTLAGELERGQEVGVSRGKLLAAVVVLSLLLSCRARKLVAHRASSTWSVSRQAPLAGACPXRSAWRSGSFLDPWWLRKLSAGSVLPXDLXRALX

SEQ ID NO: 193755 - protein, 110 aa, Triticum aestivum
  Clone ID: PAT_TA_88173.pep
RIMLLLLMRMLLSSTSHRVANPPCTLPSSMLKLWVRLPLRPCHGPTDGVHAVPAAHVVDALDDYGADAGARLCSGSCRPPRNLDVNIEFTFTDEIQNKMPLQGQYYFCFN

SEQ ID NO: 193756 - protein, 153 aa, Triticum aestivum
  unsure (1)..(153): unsure at all Xaa locations
  Clone ID: PAT_TA_88174.pep
HLRRRVSHLHVHTACSTQFPTRPPTHQPPRWQPPPPPPRRPLPPPXAPPPPTPPSKFHGRALPRATTVPRAPPHRAPGRRQQRVPIPVPRLADEAAAAPKLRVAPVGVYSQGLASGRLVQYVVLEGKASGQSSGGVLWDRPVGSPHSGGHSIR

SEQ ID NO: 193757 - protein, 53 aa, Triticum aestivum
  Clone ID: PAT_TA_88175.pep
QNKNHIIQELVYKVSDHTILQRIFQNKNWPEKVLQGTPCTRFLGTDSIYSWGG

SEQ ID NO: 193758 - protein, 172 aa, Triticum aestivum
  unsure (1)..(172): unsure at all Xaa locations
  Clone ID: PAT_TA_88176.pep
EGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXLRGGMQIFVKTSLARHHLELSLGHIDNLRQVKTRGPRTKRLLLATLRMAHPAKIRRI

SEQ ID NO: 193759 - protein, 104 aa, Triticum aestivum
  unsure (1)..(104): unsure at all Xaa locations
  Clone ID: PAT_TA_88177.pep
PPKLPGHVRMIGEDWGRWGGVKEDKHLSMVGRIRRGGLDMPGHPHIIPIYRLDLRRVGQSRHIRMILGLVGXDSHSLISNIVRVVRTXYRRKCVVXAGRKWGGG

SEQ ID NO: 193760 - protein, 46 aa, Triticum aestivum
  Clone ID: PAT_TA_88178.pep
VLCPILKKFSKCVRPIVIQQLDLCFIFHKNLFFAYMKGCMFFILQV

SEQ ID NO: 193761 - protein, 81 aa, Triticum aestivum
  unsure (1)..(81): unsure at all Xaa locations
  Clone ID: PAT_TA_88179.pep
VQSEVPQPPSSSVKPASTSCRKKNSGTSFVTQLRDHFHEFIHASMDEHRTCLTNTVKKLFXMSKGVQEGTAGAKLLKTFAQ

SEQ ID NO: 193762 - protein, 96 aa, Triticum aestivum
  unsure (1)..(96): unsure at all Xaa locations
  Clone ID: PAT_TA_88180.pep
GTXGGPQALGARQRRKGHDRVXEDGRHGVAGSGEARGIVAKRREEEARMGRRRSPTSGPMVELVVVGGGSGRGWTQGRGGREWGKGIAPLYVRVWR

SEQ ID NO: 193763 - protein, 112 aa, Triticum aestivum
  unsure (1)..(112): unsure at all Xaa locations
  Clone ID: PAT_TA_88181.pep
KKKNSMPGVIPVASGGIHVWHXPALTEIFGDDSVLQFGGGTLGHPWGNAPGAAANRVALEACVQARNEGRDLAREGNEIIRAACKWSPELAAACEVWKAIKFEFEPVDTIDK

SEQ ID NO: 193764 - protein, 87 aa, Triticum aestivum
  unsure (1)..(87): unsure at all Xaa locations
  Clone ID: PAT_TA_88182.pep
GGEKRKRSSRARATTTTTTPAAATMSPLRALLVLAAVLAACLGPAAADQPGSVEGYTIAGPHQDXAAKGXWXSTXEFXHXGDXKGGX

SEQ ID NO: 193765 - protein, 78 aa, Triticum aestivum
  Clone ID: PAT_TA_88183.pep
YMWLQSPFLRKMYDMYGFNFTKYSLMGLNVPANKRKRKTGTRPNLSVAYYGNVFITVLFKCVANSRIIVTCVCVTSQC

SEQ ID NO: 193766 - protein, 96 aa, Triticum aestivum
  unsure (1)..(96): unsure at all Xaa locations
  Clone ID: PAT_TA_88184.pep
MSDTDEHHFESKADSGASKTYPQQAGAIRKGGHIVIKARPCKVVEVSTSKTGKHGHAKCHFVAIDIFNGKNLRXYRPSSXNCDXPHVDRXDYQLIE

SEQ ID NO: 193767 - protein, 103 aa, Triticum aestivum
  unsure (1)..(103): unsure at all Xaa locations
  Clone ID: PAT_TA_88185.pep
MASAVLSYIQSLWPLSALLKEDDLGASARLVRTLSVPEETKQFVFAIGSPRPXLALHPRGAELSEHPLWTPESDRRSPGPDTKSPQESGLYDMLLSERRCSIY

SEQ ID NO: 193768 - protein, 88 aa, Triticum aestivum
  unsure (1)..(88): unsure at all Xaa locations
  Clone ID: PAT_TA_88186.pep
VMXSSATSVXPFXGLKSTXGLXVSRRSTSAXLXSVSXXGRIRCMHVWPIEGIXKFXTLSXLPPLSTEALLXXVDYLIRSKXVPCLXFS

SEQ ID NO: 193769 - protein, 149 aa, Triticum aestivum
  unsure (1)..(149): unsure at all Xaa locations
  Clone ID: PAT_TA_88187.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVDSSDTIDNVKAKIRTRRDSPDQQRLIFAXSSWRMVAPXADYNIRRITLTGAPPRVV

SEQ ID NO: 193770 - protein, 145 aa, Triticum aestivum
  unsure (1)..(145): unsure at all Xaa locations
  Clone ID: PAT_TA_88188.pep
LTCLQQLDEFVVRTDKGYKISELKEMKEIRGHICIKNIECVASIEEAIGAFLSEKAFISILDLIWSDNRHIASEEANQDKRILXGLRPHHELXRLTVKAFAGPPSQGWLPTANLHCLMYKMFDPTTRGDCLNQYNGSRHISKQDK

SEQ ID NO: 193771 - protein, 115 aa, Triticum aestivum
  unsure (1)..(115): unsure at all Xaa locations
  Clone ID: PAT_TA_88189.pep
KCAXXGICQXEWFQXYVCRXAAPAXVLWSLXPXXXPGVQGXPXPLXSXSEXSRLDLLASRATXAARALALSXXSGPEGVVVXPKRXRVXXGXRMVGRLXWRVRRRRARDXRCLXA

SEQ ID NO: 193772 - protein, 117 aa, Triticum aestivum
  unsure (1)..(117): unsure at all Xaa locations
  Clone ID: PAT_TA_88190.pep
LDSRSPRLQXSXSIRCRPXSIHAPTRCIGXLRXSAXCXRSVHPSPSXDSMIHXSAQLPRHRLPXSGSPAPXXXASGLSGVGSARWAPQYAXSGXPXHPXXTXQAAXPILTNXRTPRX

SEQ ID NO: 193773 - protein, 77 aa, Triticum aestivum
  unsure (1)..(77): unsure at all Xaa locations
  Clone ID: PAT_TA_88191.pep
MADVEYRCFVGGLAWATDDQSLQNAFSKYGDVIDSKIITDREXGRSRXFGFVTFXSDXXMRXAIXXXNGHXLDGRNX

SEQ ID NO: 193774 - protein, 72 aa, Triticum aestivum
  Clone ID: PAT_TA_88192.pep
SKKQKKNARDHRNALRRAAYWRNKDKRIKDQNKRPSDTSGIRLCPISLSLSGPTILDGAPPVPKNQTVLTTS

SEQ ID NO: 193775 - protein, 66 aa, Triticum aestivum
  unsure (1)..(66): unsure at all Xaa locations
  Clone ID: PAT_TA_88193.pep
LHTLLLILSVYGXNNFGAKQWXXPXQSVXRKIYSSLGKXWMVLSTVMXEYXVTXXHSXQEKYSXNY

SEQ ID NO: 193776 - protein, 180 aa, Triticum aestivum
  unsure (1)..(180): unsure at all Xaa locations
  Clone ID: PAT_TA_88194.pep
MAPTVMASSATSVAPFQGLKSTAGLPVSRRSNGASLGSVSNGGRIRCMQVWPIEGIKKFETLSYLPPLSTXGLLKQVDYLIRSKWXPCLDSASWXIFREHNXTPGYYDGVLACGTAYFGALTHTVSTSGGVKKIPDPIPHHPIDTCSGECSLSHGCRIGSQTPSKAKFILHPNAWFLHYF

SEQ ID NO: 193777 - protein, 146 aa, Triticum aestivum
  unsure (1)..(146): unsure at all Xaa locations
  Clone ID: PAT_TA_88195.pep
MSPQTEXXAXVGFKAXVKDYKLTYYTPEYETKDTDILVAFRVSPHPGVPPEEAXAAVXAESSTGTWTTVWTDGLTSLDRYKGRCYHIEPVAGEXSQWIXYVXXXXTXLXRFXXNMFXSXVGNVFGSXPTLRWRQSPTIKLQGRSWT

SEQ ID NO: 193778 - protein, 148 aa, Triticum aestivum
  unsure (1)..(148): unsure at all Xaa locations
  Clone ID: PAT_TA_88196.pep
HGTPVALRRKRGGLQALTXIPPPSRGERRERQPRVWRGDARRQPLGAPQHAVRWRPLDALLGLDFRCAACRRPPAQSARGPQPARAGGNLGEVADHDNGEAMPSTTISRRVVSRPVPTADSARCSRPPMRRQQHMACTASWRSWAASR

SEQ ID NO: 193779 - protein, 96 aa, Triticum aestivum
  unsure (1)..(96): unsure at all Xaa locations
  Clone ID: PAT_TA_88197.pep
PRGQQRERIGRSKDPTAPSPLVPIHSFHLLVISWRVWIQPSXISHGCRRRSGAQPARPVGVSGAGAAVWDGVVVVGEMLGRARGGAGEAYGRGAGG

SEQ ID NO: 193780 - protein, 59 aa, Triticum aestivum
  unsure (1)..(59): unsure at all Xaa locations
  Clone ID: PAT_TA_88198.pep
NVXDSXIRQLXFFARHFRRXXFKRMNLRXKXCQXLXXLAENXXASXNPGPXXGGRNSSF

SEQ ID NO: 193781 - protein, 174 aa, Triticum aestivum
  unsure (1)..(174): unsure at all Xaa locations
  Clone ID: PAT_TA_88199.pep
MGKEKTHINIVVIGHVDSGKSTTTGHLIYKLGGIDKRVIERFEKEAAEMNKRSFKYAWVLDKLKAERERGITIDIALWXFETTKYYCTVIDAPGHRDXIKNMITGTPRLTVLCSSLTPHWXLXWYLQGWQTVRPLLLHLGVTDICCCNKMXAHPXYQRPYRKCKDPLPKSRTGP

SEQ ID NO: 193782 - protein, 92 aa, Triticum aestivum
  Clone ID: PAT_TA_88200.pep
SVKVLALKVRFRVPKEVRTLLCFLRCFPGVDTLHIMASDNDTDHYDDPGEVKPSDMLKSTFWQGVSPIKCVKSRVQKLVFDQFTGGTNQVDS

SEQ ID NO: 193783 - protein, 142 aa, Triticum aestivum
  unsure (1)..(142): unsure at all Xaa locations
  Clone ID: PAT_TA_88201.pep
MGNPXXLMXQIFDLKFXSKSLXRXARKCDXDEKEQKLKVXKAIXKGNXDXXRIYAXNAIXKRTXHMXXXRLASRLDAVVTRLDTXAKMXAIGXSMGSIXXXNSSLAXGXLHQHSETXXXPAQFVNMEVXXIMXGXWPNPLQP

SEQ ID NO: 193784 - protein, 127 aa, Triticum aestivum
  unsure (1)..(127): unsure at all Xaa locations
  Clone ID: PAT_TA_88202.pep
FDGTILHTAAGAXSSHATPRQAGIYARNTWXXSIDDGRAVPXTYVTFHGXGCGATXARXHGXGGVVVVVVLVRGRXGREPGXGXSGXRXAAGVVGAGFHPXHXXHWMXPXXMVLXGTLVLGXLXLIA

SEQ ID NO: 193785 - protein, 133 aa, Triticum aestivum
  unsure (1)..(133): unsure at all Xaa locations
  Clone ID: PAT_TA_88203.pep
MKGAKSKGAAKADAKLAVKSKGAEKPAAKGKKGKAGKDPNKPKRAPSAFFVFMGEFREEFKQKNPKNKSVAAVGKAAGERWKXLSESEKAPMWPRQQLKGEYNKXIAAYNKGETLLLLPKEAAARSRGEXKRI

SEQ ID NO: 193786 - protein, 164 aa, Triticum aestivum
  unsure (1)..(164): unsure at all Xaa locations
  Clone ID: PAT_TA_88204.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTXQADCAVLIIDPHGGLRWYLQGWQTSTSLASPWCEQISLLNKMMHTYRSRRINPHTRS

SEQ ID NO: 193787 - protein, 61 aa, Triticum aestivum
  unsure (1)..(61): unsure at all Xaa locations
  Clone ID: PAT_TA_88205.pep
XPXXXRCXATTXSAXAGPSPPQXPSASXRPGPSGGAGTPSSRXPWPPXXXSARGAAGDLDG

SEQ ID NO: 193788 - protein, 105 aa, Triticum aestivum
  Clone ID: PAT_TA_88206.pep
MTLISTGGPPHAPSSEISHRAHPGHKLMLVPTGQAVFKCDGCHEHGTGGDRYTCLQPSCDFDLHKDCALAQPTFKHQLLPDSTFDSPSSPPVPSTGSYAVPAATT

SEQ ID NO: 193789 - protein, 178 aa, Triticum aestivum
  unsure (1)..(178): unsure at all Xaa locations
  Clone ID: PAT_TA_88207.pep
MATSAVLFLLLAVFAAGASAATFNIKNNCGSTIWPAGIPVGGGFELGAGQTSSINVPAGTKAGRIWARTGCSFNGGSGSCRTGDCGGQLSCSLSGRXPATLAEYTIGGGGTRXYDISVIDGSTCHGLSCTPATAPVXGSSCPPPQATTPNDKQHLHGYNYRYFAIFSPHNIKGLITAK

SEQ ID NO: 193790 - protein, 189 aa, Triticum aestivum
  unsure (1)..(189): unsure at all Xaa locations
  Clone ID: PAT_TA_88208.pep
GVFLSKDVPGSNHIGPIIHDEEVFASDVVTCVGQIIGIVVADTHDNAKAAANKVNIEYSELPAILSISEAVKAGSFHPNTTRCLSNGDVEQCFASNTCDKIIEGEIRVGGQXHFYMEPQCTFVWXVDSGNEIMISSTQLPEHQNMLLMPWLHIKVARQAWWRLVERTDRIFGARAQCQEAVRCLGFYTQ

SEQ ID NO: 193791 - protein, 78 aa, Triticum aestivum; identical to SEQ ID NO: 106980
  Clone ID: PAT_TA_88209.pep

SEQ ID NO: 193792 - protein, 109 aa, Triticum aestivum
  unsure (1)..(109): unsure at all Xaa locations
  Clone ID: PAT_TA_88210.pep
LXYLFXRMXXVSWHPXLXVXXXLCXAXXLHTXGXIXXXNXLVXNGFSTDLXLDGKALWIDXLLSVXNGXXXKSXHXFCIYPXXFXNNPGXXISSFSTXFXFVMGFNSIK

SEQ ID NO: 193793 - protein, 169 aa, Triticum aestivum
  Clone ID: PAT_TA_88211.pep
TEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEDPALNSSLTTGIYKVPLHFVNSDIAWFPPQLPSNCPKNIVCHSSSTWPRNMLKMHRGIYDHNTYSNVY

SEQ ID NO: 193794 - protein, 133 aa, Triticum aestivum
  Clone ID: PAT_TA_88212.pep
ATSTGYSNYPSALFFANINSRGYPHLESNMSSPCLIWPAFLRDDGSLYIPRNDLASGSTNVQQSSSSLAQNVLSSDAENQQSDQSVTPMDVCPGEPSASSDVQMPSTSNSCHSGNSRLRSAVDRMPVNHHTSG

SEQ ID NO: 193795 - protein, 135 aa, Triticum aestivum
  unsure (1)..(135): unsure at all Xaa locations
  Clone ID: PAT_TA_88213.pep
VTCRRRLTCQPICSRCCRLFHHQRCLPNPPSSMWCFPMFQPQGDALTEGMTGEEEARSTASEEGRAATMARPDRPAPSTSSPLLPVPVRLGSISTTTTYSAMEGALRACSSLPGTPLLRPWTLXEKXRXEXFPQK

SEQ ID NO: 193796 - protein, 122 aa, Triticum aestivum
  unsure (1)..(122): unsure at all Xaa locations
  Clone ID: PAT_TA_88214.pep
MGKEKTHINIVVIGHVDSGKSTTTGHLIYKLGGIDKRVIERFEKEAAEMNKRSFKYAWVLDKLKAERERGITIDIALWEFETTKYYCTVIDXPGHRDXIKNMITGYSQADCAVLIIDSTLVV

SEQ ID NO: 193797 - protein, 134 aa, Triticum aestivum
  unsure (1)..(134): unsure at all Xaa locations
  Clone ID: PAT_TA_88215.pep
MVXYSXDPANXTKXXKAMXRDLRVHFKXTRETXFALRXMSLNKAKRYLEDVLAHKQAIPFXRRYCRXVGXTAXVNKRQPXGHGXWSAKSAXFVLDLQKMXKQCXVKXLKLXSLNSTSNQATACQAKFQHCSKRN

SEQ ID NO: 193798 - protein, 87 aa, Triticum aestivum
  unsure (1)..(87): unsure at all Xaa locations
  Clone ID: PAT_TA_88216.pep
HTDHHHHXHITDDDIVLCNPFAQGXCVYTSYHGFMNHHIPEXVDTXVAQISLVCERHQASMRWMAFANPTCGDVVHANSKYAQLDSY

SEQ ID NO: 193799 - protein, 82 aa, Triticum aestivum
  Clone ID: PAT_TA_88217.pep
CLQRQHAIKYNVEQVMSRIPVPALKFRGVILQSHLPRPGNLPGQLSKLAIIIIYNLGAIVLALPEPRASNRPNRKQQIKTNP

SEQ ID NO: 193800 - protein, 173 aa, Triticum aestivum
  unsure (1)..(173): unsure at all Xaa locations
  Clone ID: PAT_TA_88218.pep
VTTRSPEVAKVISPTYHYELPCLKGDVFWKFFKLCAFGSTSSVDNRESLECIGKNILPKLKGNPLAAKTIGRLLRMDLSTTHWENIMESELWQVEQTENDILPALRLSYMYLPQNLKRCXSICAMYPKDHKFEXAFLADIWTAHGYRESQKTHLMPQIVIFKNIPYSSRSNQI

SEQ ID NO: 193801 - protein, 75 aa, Triticum aestivum
  unsure (1)..(75): unsure at all Xaa locations
  Clone ID: PAT_TA_88219.pep
APPXWCADRMDCWELLXNAWXXXQWMATHXEAKDKRAQMEGVPHXQGSSNLFQXRXNWVCGLLHDSCNSFIMLAL

SEQ ID NO: 193802 - protein, 190 aa, Triticum aestivum
  Clone ID: PAT_TA_88220.pep
LPRVDPILLSPASPLASPQQAPQPATSPLTATPSHPLPSWKIERQPRRGRAAPTRCSRPRSCSRRATRTRPSPARLPRRLLRAHSRRRTEAGGGTRLCWRGPGSTRPCSTPLAPSPSHAPTPASPPTPTTDMTGRRTGDHDDEHLLRNPARRSLFSDSSAWSEGFPDMCMASVGSKEEKSVISVDMISVS

SEQ ID NO: 193803 - protein, 121 aa, Triticum aestivum
  unsure (1)..(121): unsure at all Xaa locations
  Clone ID: PAT_TA_88221.pep
LPFPFLPFPSLPFPRKRDLLLTPATAKHTATTQTNRQTRCSPTPASASPPTRRRGQATHTPRSSPPPPPPSPPXSASTHAAPPPPPLPLPLPLLHTNNNNIKPPPPPPPCTTTSETWGSHP

SEQ ID NO: 193804 - protein, 149 aa, Triticum aestivum
  unsure (1)..(149): unsure at all Xaa locations
  Clone ID: PAT_TA_88222.pep
AAGRVGDGCRILKEMVDAGYRADLKTYNILIGGLCGIGREDKAHQMFQIVLXEELVPSSETVSQLLVCYADKGEMVNFFGLVDKLVELSLPAVEFLADFLRLFACXGGRELXAVELFKTLRQKGIXSVNIYNILLRICQDQGEEKHYYC

SEQ ID NO: 193805 - protein, 185 aa, Triticum aestivum
  unsure (1)..(185): unsure at all Xaa locations
  Clone ID: PAT_TA_88223.pep
MASSLLIIILPGATIALGATAFCFYSWCLSIGKKLEKGKVEASIDLEDPVSHQLISHVDLVRATDNFSEDNMLGSGGFGKVFKGQLSSGLVVAIKVXDMRSKHSVKSFDAECRVFRMARHRNLIRVINTCYNMDSXALALQYMPTAASMHHQKMGKTIGSRSSLAEYMQYCTWYIMVDVLSHMLL

SEQ ID NO: 193806 - protein, 150 aa, Triticum aestivum
  unsure (1)..(150): unsure at all Xaa locations
  Clone ID: PAT_TA_88224.pep
MSILVITVDLQCCRCKKXIKNVLECLKEDYCIKKIEYEDKDNRVIVRGKFDADKLCKKIWCKACKAVKEIEIVKQWPPPPPPPPPCQTSQRNTCACTCPPPPDRQNMHMHIRLRPAKHVIHRSMPRSDTTSNPNIRRANIKLRQTSGDKT

SEQ ID NO: 193807 - protein, 128 aa, Triticum aestivum
  unsure (1)..(128): unsure at all Xaa locations
  Clone ID: PAT_TA_88225.pep
NSYXEGLMSPQTETKAGVXFKXXVKXYKLXYYTPXXEXKDXXILAXFRXSPXPXVXLXXAXAAVAAEXSSXGTWXTVWTDGLTXVLIXYKXXCYHIXPVAGEDXQXIXXVAXPXDLXXXGSVXXSYSL

SEQ ID NO: 193808 - protein, 127 aa, Triticum aestivum
  unsure (1)..(127): unsure at all Xaa locations
  Clone ID: PAT_TA_88226.pep
MAPTVMASSATSVAPFQGLKSTAGLPVSRRSNGASLGSVSNGGWIRCMQVWPIEGIKKFETLSYLPPLSTEALLKQVDYLIRSKWVPCLEFSXVGFIFREHNASPXYYDGRYWTMWNCYFGCTDATQ

SEQ ID NO: 193809 - protein, 152 aa, Triticum aestivum
  unsure (1)..(152): unsure at all Xaa locations
  Clone ID: PAT_TA_88227.pep
LGSVINGGRIRCMQVWPIEGIKKFETLSYLPPLSTEALLKQVDYLIRSKWVPCLEFXXVGFIFREHNASPGYYDGRYWTMWKLPMFGCTDATQVINEVEEVKKXYPDAYXRIIGFDNMRQVQCVSSSPSSNGLRRSGRLNTHHTGIYKCMHL

SEQ ID NO: 193810 - protein, 181 aa, Triticum aestivum
  unsure (1)..(181): unsure at all Xaa locations
  Clone ID: PAT_TA_88228.pep
XCGXHXRVTRPXSAFVCAPMNXXDPRIALCFLLEQGELHLAACAHCLVVMXMSSGLMRXCIDLSKSFGVLASSCCVVVEAGRTRPSMEPRGGLQVGRTGYPQVQDSDNYQENKDEGLPIRHHMCLILSNCLNDIKHLILIPYLQISFWIKKKKQCINQGLQYFNLYLEHYNIYSLYELCNT

SEQ ID NO: 193811 - protein, 110 aa, Triticum aestivum
  unsure (1)..(110): unsure at all Xaa locations
  Clone ID: PAT_TA_88229.pep
ILCRTSPTSPWSAATAHRVVLRQVLRCRRSRGGRRSRAPALTSHRDAPAGPSLQPASEXSKPSHPLLVLFFLQASLFIWSGQTQSEQLPPAQFPQISAHLFFSFVQRICI

SEQ ID NO: 193812 - protein, 73 aa, Triticum aestivum
  unsure (1)..(73): unsure at all Xaa locations
  Clone ID: PAT_TA_88230.pep
MVPGYXDGRTDNVXLRMFGXCTDATQVINEVEEVKKEYPDAYVRIIGFDNMRQVQCVSFIAFKPPGCEESGKX

SEQ ID NO: 193813 - protein, 140 aa, Triticum aestivum
  unsure (1)..(140): unsure at all Xaa locations
  Clone ID: PAT_TA_88231.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGXYWTMWKLPMFGCTDATQVINXVEEVKKDT

SEQ ID NO: 193814 - protein, 158 aa, Triticum aestivum
  unsure (1)..(158): unsure at all Xaa locations
  Clone ID: PAT_TA_88232.pep
LDATGAEATEQGNCTRFVGAHSCEKRPVMMDLGPGTPYNLQVANCCRGGVLSSLVQNSKAATSTFRMIVGNFAPSSDGGPQMPFNFSIGVPGYTCSNATVVPPSRTQFDKQRHIQALMTWQVLCFYSQTXRPTESCCVSLSCLQYVVVECPRSSAGCQ

SEQ ID NO: 193815 - protein, 137 aa, Triticum aestivum
  unsure (1)..(137): unsure at all Xaa locations
  Clone ID: PAT_TA_88233.pep
MAPTVMASSATSVAPFQGLKSTAGLPVSRRSNGASLGSVSNGGRIRCMQVWPIEGIKKFETLSYLPPLSTEALLKQVDYLIRSKWXPCLDSASRXIFREHNXXPGYYDGXYWDMWXLPISGAPTHTVINKWRRQEDT

SEQ ID NO: 193816 - protein, 148 aa, Triticum aestivum
  unsure (1)..(148): unsure at all Xaa locations
  Clone ID: PAT_TA_88234.pep
XKXTVXXVXIXYHXXDIXSXPIXXTXSXLLIVRXHQDXCGXXXLSSLXIPPXFXSLTIIFXLSLRTGPWPRHPQLNCGMVEQKAPRDAREEGVKGTDLVDRVVGTTRLTRGPYKAXDLGGDKSPGAATGDDGGGVANPLLRWLVMREE

SEQ ID NO: 193817 - protein, 86 aa, Triticum aestivum
  Clone ID: PAT_TA_88235.pep
CYKRVTLVLAPIRSNFCTGCWTSCGTTWWPGLARRRASTSSAGPPPPNPSPSTQVQFIYVSPEVPTWPETVEKNVRTSTSSFQKKI

SEQ ID NO: 193818 - protein, 164 aa, Triticum aestivum
  unsure (1)..(164): unsure at all Xaa locations
  Clone ID: PAT_TA_88236.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGASLLPLQGGKYEMKXFCLEPLLTSRRGHQKNSAAQKTTIPLTNLTKPSRRT

SEQ ID NO: 193819 - protein, 54 aa, Triticum aestivum
  Clone ID: PAT_TA_88237.pep
RKGRMIFIANKNRTYLFPRKHGTPKYKCGITAYCSRLKQKLVKTSTAEDLQVIF

SEQ ID NO: 193820 - protein, 145 aa, Triticum aestivum
  unsure (1)..(145): unsure at all Xaa locations
  Clone ID: PAT_TA_88238.pep
RGEQRGVPNGTEXVIATRIPRAGRSALVVGRVVAGMDVVGRMAAVATVKDNTGSAYFKVAKLIGDKRAVVAERGFNRPYTKILVTNCGVLEQQQQKWNKLEIHAWPPFSFHSFLSSALQPVLDHAKASINKNGFVAKKKEKKKKK

SEQ ID NO: 193821 - protein, 135 aa, Triticum aestivum
  unsure (1)..(135): unsure at all Xaa locations
  Clone ID: PAT_TA_88239.pep
VKLPGGEELARSVVRKVAPNLPSVAPPSSLVEDRKRFTRRTFTLDXGDIQRLKQRIVHLGESHGAPLPHSPSTFTAVVALAWTCFARCKPFSPEDDAQLFFFADTRARLDPPVDVGYIGACLTGLISNSPCRTSW

SEQ ID NO: 193822 - protein, 151 aa, Triticum aestivum
  unsure (1)..(151): unsure at all Xaa locations
  Clone ID: PAT_TA_88240.pep
MSPQTETXAGVGFKAGVKDYKLTYYTPEYETKDXDXLXXFRVSPQPGVPPEEAGAAVXAESSTGTWTTVWTDGLTSLDRYKGRCYHIEPVAGEDSQWICYVAYPXDLFEXGSVXXMXTSXYVTYWFQSPXCSMLXDHKSPXXKTSGASRTR

SEQ ID NO: 193823 - protein, 87 aa, Triticum aestivum
  Clone ID: PAT_TA_88241.pep
LAVQRNLSTTTIKKKRGADPNNPPIHHQDLMALNHFVFNSTNHALSHYNQSIANLVRTNKTGRPHDLHLLLPHDLLLLPRRSPPTAS

SEQ ID NO: 193824 - protein, 156 aa, Triticum aestivum
  unsure (1)..(156): unsure at all Xaa locations
  Clone ID: PAT_TA_88242.pep
MQIFVKTLTGKTITLEVESSDTIDNVKAKIQDKEGIPPDQQRLIFAGKQLEDGRTLADYNIQKESTLHLVLRLRGGMQIFVKTXTGKTITXEVDPPDTIDNSRLXVQDKEGSLRTTALIFAGTLEEAHLADXNIQKDQPPLVLGVDQICKTHGRHT

SEQ ID NO: 193825 - protein, 147 aa, Triticum aestivum
  unsure (1)..(147): unsure at all Xaa locations
  Clone ID: PAT_TA_88243.pep
MAAALSLRAPFSLRAVAPPAPRVALAPAALSLAAAKQVRGARLRAQATYKVKLVTPDGEVELEVPDDVYILDQAEEEGIDLPYSCRAXSCSSCAGKLVSGEIDQSXQSFLDDXXXEHGGCYLPYPSRHRIRPQRGGVTALLTLIYTT

SEQ ID NO: 193826 - protein, 126 aa, Triticum aestivum
  unsure (1)..(126): unsure at all Xaa locations
  Clone ID: PAT_TA_88244.pep
MRKGPSRSGSARHQQFRARAKTRVDDLQDMFSGLQYARKEARSTDAVLLEAQLHQMLREWRAELSVPSPASSLQQGNNNRDPPSETPRPPQLAAAEEEDDATSKLVEXKXRPSANQAHKHRRETRT

SEQ ID NO: 193827 - protein, 76 aa, Triticum aestivum
  unsure (1)..(76): unsure at all Xaa locations
  Clone ID: PAT_TA_88245.pep
APRVTSQNRELCSAKRAAHPXPHXSGXRXACLPXMMLAYMDRAAXGAAAERDXLELTXXAADAXQCXAAXDFXGXV

SEQ ID NO: 193828 - protein, 119 aa, Triticum aestivum
  unsure (1)..(119): unsure at all Xaa locations
  Clone ID: PAT_TA_88246.pep
AXFRPLXXLGAHGYXXNGACNVSSRXHNXRLXXQXEQXPXLRSXPXPXQQVLSXPRXXXTMLSQEEAARLXCSSFMTIILVALGEHXHGRGXAKEATVINHLGLGPAXCWQPXLIVFXX

SEQ ID NO: 193829 - protein, 125 aa, Triticum aestivum
  unsure (1)..(125): unsure at all Xaa locations
  Clone ID: PAT_TA_88247.pep
DSLRQTSVAAKEAGGITQHIGAFVVEMQSGASITFLDTPGHAAFSAMRARGAAVTDIVVLVVAADDGVMPQTLEAMSHAKVANVPIVVAINKCDKSGADPERVRIQLGSEXLLLEDMGGNXKNSH

SEQ ID NO: 193830 - protein, 128 aa, Triticum aestivum
  unsure (1)..(128): unsure at all Xaa locations
  Clone ID: PAT_TA_88248.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYXLLTESGNTKDDLNSTDDFCLGSDGC

SEQ ID NO: 193831 - protein, 113 aa, Triticum aestivum
  unsure (1)..(113): unsure at all Xaa locations
  Clone ID: PAT_TA_88249.pep
GRWMPSSVTEEDVLKLRDARYLTYEISHRLPARGQLSQLPRLARSSCSCITPSXLSSRRSFMRXSFLLWARIMTGSXSPHISHHVVVNLLAHLTRYGQNLMWSXDMRASXSRR

SEQ ID NO: 193832 - protein, 163 aa, Triticum aestivum
  unsure (1)..(163): unsure at all Xaa locations
  Clone ID: PAT_TA_88250.pep
DYPLSXTIXSNYXNXXXRGXFIAAXFAXQXFGILXGGXFTHIVSXAFRAAXHTPXXXDAPLXXTPPXAXFXWXXILMXGXVAALMTYXWRMKXPXTARXTALVTKNAKQAAGXXVQGAQVDIRAXXXDXKAKAAPRRHAIVRLSILAGRTRNGTAVRPQLSEF

SEQ ID NO: 193833 - protein, 102 aa, Triticum aestivum
  unsure (1)..(102): unsure at all Xaa locations
  Clone ID: PAT_TA_88251.pep
MSPQTETKAGVGFKSGVKDYKLTYYTPEYETKDTDXLAAFRVSPHAWGSARRXRGCSSCRIXYWYMDNCFTDGLXSLDRXKGRCYHIEACWGQPDLVSLIHT

SEQ ID NO: 193834 - protein, 157 aa, Triticum aestivum
  unsure (1)..(157): unsure at all Xaa locations
  Clone ID: PAT_TA_88252.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKXFCLEPLLNVKPRASRRTAPASEDNYDRY

SEQ ID NO: 193835 - protein, 121 aa, Triticum aestivum
  Clone ID: PAT_TA_88253.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSGVPGKCGVSVPFPSAFNNCNNVN

SEQ ID NO: 193836 - protein, 180 aa, Triticum aestivum
  unsure (1)..(180): unsure at all Xaa locations
  Clone ID: PAT_TA_88254.pep
SKGAAKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKXAVAKEVEEEDEEDPTIQSEINDDDDDKVAMRTRHDDEETIFQALAPADKANGLPRTTELVGG

SEQ ID NO: 193837 - protein, 185 aa, Triticum aestivum
  Clone ID: PAT_TA_88255.pep
TRNCFDRAEIARVMNAAGRRPEALPQDLQKGIDLGVVSPEILQNFFDLDKNPVMTELIHRFQGFRERLLADPKFLQRLAIEEAISISTTLLAQYERRKGRFFEEIDYVLTDTIRGSVVDFFTVWLPAPTISVLSLLIMIWQTWACQSFWDADKRPKETLGKTEITRGCKGLFRGLFWADSKSCSA

SEQ ID NO: 193838 - protein, 89 aa, Triticum aestivum; identical to SEQ ID NO: 130083
  Clone ID: PAT_TA_88256.pep

SEQ ID NO: 193839 - protein, 158 aa, Triticum aestivum
  unsure (1)..(158): unsure at all Xaa locations
  Clone ID: PAT_TA_88257.pep
KCRPVLSLVLLAVFSCLPHVVTSLSFDYNFSAPGVLAGADLKYMNDSAPVLDRIDLTNLSRSWSTGRVAHGQAVRLWDDATGKAASFTTNFTFAVKSLNVTTSQGDGMAFFVGPYRRACRRTPAAASWRCSITAATGNTTPADIGVEFDTLXNSSGTR

SEQ ID NO: 193840 - protein, 186 aa, Triticum aestivum
  unsure (1)..(186): unsure at all Xaa locations
  Clone ID: PAT_TA_88258.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATSDQRVEEXKKIPDPIRIIGFDNIVGESAYRLKHGLKIGRQTLSQGIYKSLYSKCFGFSI

SEQ ID NO: 193841 - protein, 68 aa, Triticum aestivum
  Clone ID: PAT_TA_88259.pep
MNGAKRSAEAVGCQNASVGERSALEGSNRESGGRRSGSENVGLSNENIGENPMPRKPKVSSARFVHGG

SEQ ID NO: 193842 - protein, 180 aa, Triticum aestivum
  unsure (1)..(180): unsure at all Xaa locations
  Clone ID: PAT_TA_88260.pep
MAEEKHHHHLFHHKKEGEDFQPAADGGVDMYGYSTETVVTATGNEGEYERITKEEKHHKHKEHLGEMGAAAAGAFALYEKHEAXKXPEHAHKHKIDXEVAAAAAVGAGXFXFHEQHEKKQDHKEAKEAXXRRSTHFGSSVAGLASGVPVTYFHKKWDRPSPWFPLPLMVRIVQLRFLFVF

SEQ ID NO: 193843 - protein, 70 aa, Triticum aestivum
  unsure (1)..(70): unsure at all Xaa locations
  Clone ID: PAT_TA_88261.pep
LFLRXWILAXYGCXXLTLLCVSSKAIMFXSXLIVXMRCTIVQSXXDLHPKNRNHKKTXRVLSXRNKKRXT

SEQ ID NO: 193844 - protein, 119 aa, Triticum aestivum
  unsure (1)..(119): unsure at all Xaa locations
  Clone ID: PAT_TA_88262.pep
SDFPGVSPPNKFFASAYGLLVAGRERPGAGWACGCSGAVWICAGVAAGFGTRSRRWARGKLGLRLWWLRAXRLPMEREMGPARIVGGPCSAGXPCEFSRPXLYNFLNPYIGLSSPSLXT

SEQ ID NO: 193845 - protein, 157 aa, Triticum aestivum
  unsure (1)..(157): unsure at all Xaa locations
  Clone ID: PAT_TA_88263.pep
TQCMYFNSSDFDFXNFSTDVQINGQCTTTAFVRGSSPATRRTPCPTRXAFSXLRPRRDPVPWRRSHTVKTSXRRRQRDRTRSSCEFGGGGCEIARNPTVSSAAAVAAVRSHEIRLCQLELGSQDGGGVGHAGASVRSRRGARKEERRQCAATSGAGA

SEQ ID NO: 193846 - protein, 113 aa, Triticum aestivum
  unsure (1)..(113): unsure at all Xaa locations
  Clone ID: PAT_TA_88264.pep
DSFYLCRQFLLGCQPSXTALLMTAKTASFKTIAPIFDTASSIASAICFTRSASRPSRPLPLXSALVAAAAALSVQLQSPPGNLKKLRPQPGRLGGREWGLRKKAGLHEAEAWQ

SEQ ID NO: 193847 - protein, 155 aa, Triticum aestivum
  unsure (1)..(155): unsure at all Xaa locations
  Clone ID: PAT_TA_88265.pep
MQIFVKTLTGKTITLEVESSDTIDNVKAKIQDKEGIPPDQQRLIFAGKQLEDGRTLADYNIQKESTLHLVLRLRGGMQFSVKTLTGKTITFGGLRXWTPSDNVKAKXQXDKXGIPPGPATPLSLLGKQLEDGRTLXDYNIQKDQPPTGAALGINL

SEQ ID NO: 193848 - protein, 139 aa, Triticum aestivum
  unsure (1)..(139): unsure at all Xaa locations
  Clone ID: PAT_TA_88266.pep
MAAALLPGTGMTLSGAWQQVRGPVIVPLLRASVLFCVAMSAMLFAEKVYMAVVVLALRLLGRRPERQYRXEPMRXGDDPTPERRLPMXLVQDPKXNERXVYRCHXGRLSGXSWASDWVIVKVLQQSXNLRIGVECNGQR

SEQ ID NO: 193849 - protein, 155 aa, Triticum aestivum
  unsure (1)..(155): unsure at all Xaa locations
  Clone ID: PAT_TA_88267.pep
MAETEYRCFVGGLAWATDDHNLQQAFSQYGEILDAKIINDRETGRSRGFGFVTFGSEESMRQAIEEMNGKELDGRNITVNEAHPARPAVGAGXRGYGGQRXAVXEYGRPXAVGYGAKXVAGYXXKGXGGNXKGGGXYXXPRAAKAVAGTAQLLLA

SEQ ID NO: 193850 - protein, 155 aa, Triticum aestivum
  Clone ID: PAT_TA_88268.pep
CELNMRIHSWSLCKMRYILYLHDPGRFQKQRWGSLPAPPPGLAAVCMRLLRIRSREGPSYNPSSLLVTSLGRQSYDEGKTFHSAVKNGILLHELFANRVAWFLKSLLGCSHISITCSSSLNMFRSSSSSVVSSEYFQCEARHVIDVMIKHKIHLA

SEQ ID NO: 193851 - protein, 172 aa, Triticum aestivum
  unsure (1)..(172): unsure at all Xaa locations
  Clone ID: PAT_TA_88269.pep
AHQEHPHQCGCDGGGLDAAVERLKTGFEKFKTEVYDKKPDFFEPLKAGQAPKYMVFACADSRVCPSVTLGLEPGEAFTIRNIANMVPSYCKNKYAGVGSAIEYXVCALKLXIVVIGHSRXGGIKXLLSIKDXAKQSFXFVXDWVKDXVPGKEKXQTDCPSLMTERLQKTKNP

SEQ ID NO: 193852 - protein, 186 aa, Triticum aestivum
  Clone ID: PAT_TA_88270.pep
QPYRRRGTSTDGAAGKQRRLPPCPPSPPSPPPTHTLPSPLPKRPPPNHASPWPTPAPPRLPMPSPTAAPPPPTTACEAWSAAATSRRPSGSSIPWRPPPSPRGPAPRSSRTVRVRAHRGGPARAGRPATRLGLQRDGPGYCVTGQLDNRASRRCHGAGYTTTPHPRLCRRGRTITPRVLDISRRGW

SEQ ID NO: 193853 - protein, 185 aa, Triticum aestivum
  unsure (1)..(185): unsure at all Xaa locations
  Clone ID: PAT_TA_88271.pep
MLDKLRSYQGAPFIESFLGPQEDKFSSSSSQDTAKPSVPTAPSSHTGQLPAFPDVNADDKVVDEGTLCWNLLSSRLFFDAQMSDEINKAIKARIQRTLSSMRTPAYVGEITLTEFNLGKXPPYVHAMRXXPLDLKXLWAFEIDFGISRGILLDIEXRLEVEEXSTEGLMKTISEXTQXGKVTQNX

SEQ ID NO: 193854 - protein, 194 aa, Triticum aestivum
  unsure (1)..(194): unsure at all Xaa locations
  Clone ID: PAT_TA_88272.pep
QTQHEIPRFPESDRSFSSSPIQISRALRWRPPPSPTSAGERSATRSYTSRAATSPLRPPSPPPPRSPPLLAAFSLRWWNPARPRRREAISPRPSTPSALPSLQRLRRWSRLPSRTPRYPAAPGGSFCGRGARAGFGGFAERAIGGPEGXAGGREEXGGVAGGEGSVVVAQRAVVNYAAXRWTVERRPSRQHMLX

SEQ ID NO: 193855 - protein, 128 aa, Triticum aestivum
  unsure (1)..(128): unsure at all Xaa locations
  Clone ID: PAT_TA_88273.pep
PLPVPGSIARQRFPVAPPGLFALPPRAPPLTPHLDRRRVSSSTARRQRRRWPRQHPDPQSPRVPPRPRRPHSALPSPTRKRPPPQNRSQAAQQFRTSDPXLPPPPPPPPRGRERRTRRFRMRYSGNLA

SEQ ID NO: 193856 - protein, 111 aa, Triticum aestivum
  Clone ID: PAT_TA_88274.pep
AASSGWLTRRQRDQGRVSHEVPVTQAMTTGGARRVPAHASSFLPLWCKGGKRSRGVPRHQAKVAISVQRDQDQEDYEMEVIVEPKTASSPELCAGEDYFCQVASTSCPPSN

SEQ ID NO: 193857 - protein, 184 aa, Triticum aestivum
  unsure (1)..(184): unsure at all Xaa locations
  Clone ID: PAT_TA_88275.pep
RATTARPTGLSPGSPRXRHPRPAAPPVWSTISSRSRPPLVVLPRPPNPALLGNTTAPXACSPWRFASPSPTPATWRRASLRRSASAAGPRPPPGAASSRRGRGAPSASSPPLATSPSASRPAAVTAMTPPTXTITQAQALAATAASXGSNLVPFEAYPRPTAAALSRGCCRARGGSRDASGSFG

SEQ ID NO: 193858 - protein, 183 aa, Triticum aestivum
  unsure (1)..(183): unsure at all Xaa locations
  Clone ID: PAT_TA_88276.pep
NSRVIGRDLCHHKQKLKAGVGFKAGVKDYKLTYYTPEYETKDTDILAAFRVSPQPGVPPEEAGAAVAAESSTGXTWTTVWTDGLTSLDRYKGRCYHIEPVAGEDKPMXIVMVAYPLDLFEXGSVTNMFTSIXGKXFGFKSPTLLYVLEDLRIPPNLFKNFQGPPQGIQVXRKNLNNALYGMYN

SEQ ID NO: 193859 - protein, 205 aa, Triticum aestivum
  unsure (1)..(205): unsure at all Xaa locations
  Clone ID: PAT_TA_88277.pep
PPPSKLYTYIVQPWPPPVMASSATSVAPFQGLKSTAGLPVSRRSNGASLGSVSNGGRIRCMQVWPIEGIKKFETLSYLPPLSTEALLKQVDYLIRSKWVPCLEFNKLGSSSXEHNASPGYXMAGYWDNWKLPKFGCXTDATQVXINEVEGXQERITLDPYVRIIXGFDNMRQVQCVNLIAXKPTGCXDPXRLNTHHKGIYKVHCL

SEQ ID NO: 193860 - protein, 169 aa, Triticum aestivum
  unsure (1)..(169): unsure at all Xaa locations
  Clone ID: PAT_TA_88278.pep
QWRPRPWALSSPAMAGTPVKASRAAPFGEGRITMRKTAGKPKVAASSSPWYGSDRVLYLGPLSGDPPSYLTGEFPGDYGWXDTAGLSADPETFXAKNRELEVIHCRWGMLGALXGCVFPGLLARNGSXPRXFLFKXGXQISXKGGSILGNPTWCTANTSIWASSGLMAP

SEQ ID NO: 193861 - protein, 178 aa, Triticum aestivum
  unsure (1)..(178): unsure at all Xaa locations
  Clone ID: PAT_TA_88279.pep
MAPAVMASSATTVPPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFXCTDATQVLNEVXXVKXXYLTLCRVIGFDNLRXVXCVSSTPLGNGLVRQGNYELNKGV

SEQ ID NO: 193862 - protein, 199 aa, Triticum aestivum
  unsure (1)..(199): unsure at all Xaa locations
  Clone ID: PAT_TA_88280.pep
QLRVVADAVALNSMGHGAAGARTNGSSSASHGANCSPREDQRTHSGARAGTSRACMATGAQHTRPPASPQRTTLSKRSTTLRSPSPCKDSAEFTLKPSPSSSNSKSEYRRSSSITLPLLLPRPHRPRRRVHRPLRPGPSFDAACLVPKNRSPNCSVRSXLDNGGGPGGLSXXAKYWXKSKGXXVIWXXXHXMEMXMPXR

SEQ ID NO: 193863 - protein, 107 aa, Triticum aestivum
  unsure (1)..(107): unsure at all Xaa locations
  Clone ID: PAT_TA_88281.pep
THTQAFXEMIFSXSLAGPCSXGSSDNTXKGSWRAPXCGQXXXXTXXXXDPQCITGICISXXSVXVTHVWKRSXRLXIPMYPHHXDLMXWXVKVIXEXIXXRVSFTLL

SEQ ID NO: 193864 - protein, 146 aa, Triticum aestivum
  unsure (1)..(146): unsure at all Xaa locations
  Clone ID: PAT_TA_88282.pep
LPYYGPYVWGCVQRDQLAERNINICSSSXPPAAPCLLLLPRLVESVSQYSLPCHIVLVCDHHGKGDAAKQQLRPSPWWCGCIRCCRRTDGPAPAAGARPQWPIGASPTPRLYCSGRPKIPVVESAERSPERASSTSPGVSGRASQS

SEQ ID NO: 193865 - protein, 120 aa, Triticum aestivum
  Clone ID: PAT_TA_88283.pep
IKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 193866 - protein, 126 aa, Triticum aestivum
  unsure (1)..(126): unsure at all Xaa locations
  Clone ID: PAT_TA_88284.pep
MALATPLRHLLAAQPEPATGAAPSLQAQPARASPHHRRLLLRSIRHVAAPSVCPASARVAARAAGGGRPTVLVXEKLGXAGLXLLXAFXNXVDCAYDLTXXELXXKVXLVDALVXRNATXVNRXVF

SEQ ID NO: 193867 - protein, 197 aa, Triticum aestivum
  unsure (1)..(197): unsure at all Xaa locations
  Clone ID: PAT_TA_88285.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFRXEHNASPGYYDGRYWXTMWKLPMFXCTDATQVINEGGXXQEGVPDAYXRIIGIHNMPXVXCVSXIASKQRGCKXSGXAKQSSRQAYSAMQCNSLLGVS

SEQ ID NO: 193868 - protein, 110 aa, Triticum aestivum
  unsure (1)..(110): unsure at all Xaa locations
  Clone ID: PAT_TA_88286.pep
GVDDQPVKVVDIVDTFRLQEQXAFDKKQFISHMKXYIKNLSAKLEGDDLDAFKKNVESATKYLLSKLKDLQFFVGESMHDDGGVVFAYYKEGAADPTFLYFAHGLKEVKC

SEQ ID NO: 193869 - protein, 177 aa, Triticum aestivum
  unsure (1)..(177): unsure at all Xaa locations
  Clone ID: PAT_TA_88287.pep
DTSTLAAVASFVAFSTKPRLLPPLNPSRTLPRTRGSLAVCCSHSHASPPPSPLPCTASDEEEVAPPRLRLRLLAEEFGALPDADRARRLLAYAAALPRLPQADRVAANRVMGCVAQVWLLXSCDRSGRMRFAXDSDSELSRGYCSCLVSALEGAGPEXVLEVGPXRXAPLGVGGASR

SEQ ID NO: 193870 - protein, 200 aa, Triticum aestivum
  unsure (1)..(200): unsure at all Xaa locations
  Clone ID: PAT_TA_88288.pep
VIVPRPRXTIXGIVRGVMLRNVDPYRSTPXSTTFXSPASAALGSVEASAVVRHAVARQTATTQVAAIEPDESLYGLFDLSTGSVETASKCDSSDLAAEILMVDGPRSPPGFARDGGAGDRGDPARDHEEYQPEPLDSLQREELRRRNMDTLHTPIAGETPKARALEEARLANLAERARLANLQRALDERARQRVPNANRR

SEQ ID NO: 193871 - protein, 121 aa, Triticum aestivum
  Clone ID: PAT_TA_88289.pep
LASSVREPRSHGRARRPGRPAVRLSDGRRVSAVAGADGRGGRASFMALAGAKIPQPSMLTGPVCKALINLPSKLYIYEGFVFVFTGPLKNFKGRTILRGLFRAFFLLKLLKTVIYGLTNYI

SEQ ID NO: 193872 - protein, 187 aa, Triticum aestivum
  unsure (1)..(187): unsure at all Xaa locations
  Clone ID: PAT_TA_88290.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRXPGCQESGKAKTTVKQWPCRPL

SEQ ID NO: 193873 - protein, 112 aa, Triticum aestivum
  unsure (1)..(112): unsure at all Xaa locations
  Clone ID: PAT_TA_88291.pep
PWRGIEQEEPGAGPHAGHDGRQERARAARPPPGAPPPPGAPPXPRPPPPTPTPRPSSGRSSRTSSRSTTSAWIPAPRCSGSASTPPSRTAPSPPSTSPWRACPTSSSTTRSR

SEQ ID NO: 193874 - protein, 152 aa, Triticum aestivum
  unsure (1)..(152): unsure at all Xaa locations
  Clone ID: PAT_TA_88292.pep
MARLNSKAVVAAVVLAAVVLMMAGREASAALSCGQVDSKLAPCVAYVTGRASSISKECCSGVQGLNGMARNSSDRKIACKCLKSLAXTSINSINMGKXPGXPGKCXVNVPFPSTIPTNXXHQLIQYITLPNVHADLVWSLPSMDGPNPKSYQ

SEQ ID NO: 193875 - protein, 92 aa, Triticum aestivum
  unsure (1)..(92): unsure at all Xaa locations
  Clone ID: PAT_TA_88293.pep
LIXSNLVXXSXHCVXHARTCXSTVHTTHISRVVYXGXQLLXXXLTHXAQRXEXTGTXXTVEDGAQXGTRGXLQDLYXLDXXCGXGSXXRLPV

SEQ ID NO: 193876 - protein, 147 aa, Triticum aestivum
  unsure (1)..(147): unsure at all Xaa locations
  Clone ID: PAT_TA_88294.pep
MAAAFSSTVGAPASTPTNFLGKKLKKQVTSAVNYHGKSSKANRFTVMAAENIDEKRNTDKWXGLAYDISDDQQDITRGKGIVDXLFQAPTGDGTTRRPQSYXYSPGLKNTXLDNTMGGSTSSCFMDNLLSLSKNXDRPNXXIIWYLG

SEQ ID NO: 193877 - protein, 79 aa, Triticum aestivum
  unsure (1)..(79): unsure at all Xaa locations
  Clone ID: PAT_TA_88295.pep
TXSTCGLNPTVFXNGDLXCQQXQIVQSSRVLNHPPFLXLXLKTSCNHCXVGSHCXIQSKKLYAKLCLTEYCPQQANNKV

SEQ ID NO: 193878 - protein, 150 aa, Triticum aestivum
  unsure (1)..(150): unsure at all Xaa locations
  Clone ID: PAT_TA_88296.pep
MSRGGSAGGGQSSLGYLFGDGEPAKPAAAPAAKPAPAEKPALAAADVTKQIPAGIPGSRANNYYRADGQXNTGNFLTDRPSTKFMLLPGGGPSLGYLFGREVISVNGCCEWACTPLMVKTGMFFNIYTCVDVPVRKVHGSKLTPAWEPLA

SEQ ID NO: 193879 - protein, 79 aa, Triticum aestivum
  unsure (1)..(79): unsure at all Xaa locations
  Clone ID: PAT_TA_88297.pep
MSCCGGNCGCGTACKCGNGCGGCNMYPEAEAAGATLLVSATATHKASSGGMEMAAENGGCGCTQCKCGTXSCXCSCCXC

SEQ ID NO: 193880 - protein, 186 aa, Triticum aestivum
  unsure (1)..(186): unsure at all Xaa locations
  Clone ID: PAT_TA_88298.pep
MSPQTETKAGVGFKAGVKDYKLTYYTPEYETKDTDILAAFRVSPQPGVPPEEAGAAVAAESSTGTWTTVWTDGLTSLDRYKGRCYHIEXVAGEDSQWICYVAYPLDLFXXGSVXNMFTSIVGNVIGFQKPYXALXXEDLRNPXTXSKTFQXPPHGIQXXRDNXNKXGXPFIGCTIKPKMGLSXKNN

SEQ ID NO: 193881 - protein, 174 aa, Triticum aestivum
  unsure (1)..(174): unsure at all Xaa locations
  Clone ID: PAT_TA_88299.pep
IERRGLRRRRGASTKSDRGGELWYRVVDGSPPPRPGQSQALKRGCTMELSKQGQEPMSASMGSQALPSSNIQPTQTGYPTAFYPPLSAGWGCTANVLYGSFGTCQVHIILSLXSQQAAQAGCFQGXXTSTSLYLXAEYHVGPAXXAECSKHPCPAXDXIKVSHLCGKXXVALQR

SEQ ID NO: 193882 - protein, 97 aa, Triticum aestivum
  unsure (1)..(97): unsure at all Xaa locations
  Clone ID: PAT_TA_88300.pep
MADQLTDDQIAEFKEAFSLFDKDGDGCITTKELGTXMRSLGQNPTEAXLQDMINESDADGNGTIDSQXPQPDGRKMKTPTKRRLKELQVFTRQTFTC

SEQ ID NO: 193883 - protein, 105 aa, Triticum aestivum
  unsure (1)..(105): unsure at all Xaa locations
  Clone ID: PAT_TA_88301.pep
PAPLDSLVXTAXLPGLXTTXAPXLSXVLNPHSSPSTTSPHTPSLSXMAPSXTCXLHSMASVSRALRPRPRLAAPRXGCXLXXXCSVXSYXMCXHXQCXVGIXXCA

SEQ ID NO: 193884 - protein, 177 aa, Triticum aestivum
  unsure (1)..(177): unsure at all Xaa locations
  Clone ID: PAT_TA_88302.pep
GWISSTLQKTMGFVSKSRQAKLGQQNKFYYDEKLKRWVEEGAEIPAEEPPLAPPPTKSSSYQNGMPDYNLNGPTSGMHTPNGXGRTKSPKHAVMVWGMPPIRPAXEPFSARGRTGVRXQYVDTSTSWVQLGRPSYTDRRYICDTTYRCSLCPGASRRQSLPTCTGETSNGRRLTQRK

SEQ ID NO: 193885 - protein, 111 aa, Triticum aestivum
  Clone ID: PAT_TA_88303.pep
LFCFSSDPFCFACMACFLAQHHLPSKQTSLLFAPYSFHFYLFVSCIFRCSFTDLILNFSCTSLLVSMSTGSHLCIKDKAFVFVDSAYGENSLYHRDIHDELVIFLYYMNSF

SEQ ID NO: 193886 - protein, 171 aa, Triticum aestivum
  unsure (1)..(171): unsure at all Xaa locations
  Clone ID: PAT_TA_88304.pep
MANTVILYPGLTVSHFVPMVHLAGALLDHGYAVSVALIDPAVNGDPAFRAVVARAVASMPSLRFHTLPPSEDAPTLIAPFIPRYLDIVGRHNDRLRDFLCSFTRGVHAVVVDSLSVEALGVVKRLGIPXYVMFTSGAXXLAAFVQXXSSRXGXKTFMKLSDAPLSYRPSPC

SEQ ID NO: 193887 - protein, 157 aa, Triticum aestivum
  unsure (1)..(157): unsure at all Xaa locations
  Clone ID: PAT_TA_88305.pep
XFXRXPRMSFGXXVMYCXDXXIEKIXXGGXFFLQXWVXHARFXCPVAFRXYFHVWXXPAXLTEXFGXGXVLQXGGGTXGHPWGNAXGAAXNXVALEACVQXRNEGRDXXXEGNEIIRAAXXKWSPEVAAACEVWKAIKXEXEPXDXXGKKKLKKRYK

SEQ ID NO: 193888 - protein, 135 aa, Triticum aestivum
  unsure (1)..(135): unsure at all Xaa locations
  Clone ID: PAT_TA_88306.pep
NCAIXXKXCARGIFXXQGLXPXPGFIPXAXGGTHXWXLPALXEMXGADXXLQFGGGTFGHPWGNAPGAAANXVAXEXCVQXRNEGRXLXREGNEXLRAAXKWSPEXAXACXVWKXIKFEXEPXXXIDWKVKIKKR

SEQ ID NO: 193889 - protein, 129 aa, Triticum aestivum
  unsure (1)..(129): unsure at all Xaa locations
  Clone ID: PAT_TA_88307.pep
MGNAGSAGAPEQAKKPEEADGGGVGGAPPSTVRFFPAAAHHTARXPPPIKLEGEDLPPPPAAAXXGXXEDMAAPRNLWQVYXLGAFLXARXGWAKXXESXDRXXSDDGQLPPAASSLGPSPNVTDLLTV

SEQ ID NO: 193890 - protein, 168 aa, Triticum aestivum
  unsure (1)..(168): unsure at all Xaa locations
  Clone ID: PAT_TA_88308.pep
LAVAAALSSAPPSSSHSRGRATPSSCRPLPASASKSKALRAAAAPAADAVDEEAPASPPPSDPGRGVENLVIIGSGPAGYTAAIYAARANLKPVVFEGYQVGGVPGGQLMTTTXVENFPGFPDGITGPDLMDKMRKQAERWGAELHXEDVEXIDVKNXPFVIRSSDER

SEQ ID NO: 193891 - protein, 188 aa, Triticum aestivum
  unsure (1)..(188): unsure at all Xaa locations
  Clone ID: PAT_TA_88309.pep
METSFLPTARPLPAFQTLAAAPRCPRPLRRSTIRAAISRGRKEDTVAVVREQLEGCYLLAGIRYEGLTVKQFQGIRDALPESCHLLGGERTRWWGKAIXGTPWEALKPCMKGMNAWLFVHTEEVPVALKPYAPSKKEERLXGDNDSXGPFPXQVYRRRVKSLXTCQXRRVQTARLKWPQLLSQAGPQG

SEQ ID NO: 193892 - protein, 147 aa, Triticum aestivum
  unsure (1)..(147): unsure at all Xaa locations
  Clone ID: PAT_TA_88310.pep
AAPGIDAAGVPPHLQDHRRPTTSSPRPTRLLPPLLLPVPNDKPQPSSQGPGRRRVPKLLRPPADSSPAVPVTXGRSPEXPNQAAAPCRRPSLPRPPSPPFPGCSPSPENPWPPIPGRCGPXTPMGAAASVVNRDGSLDAGPRRRPRF

SEQ ID NO: 193893 - protein, 68 aa, Triticum aestivum
  unsure (1)..(68): unsure at all Xaa locations
  Clone ID: PAT_TA_88311.pep
FTIAISCLLGISCSMHLHRMSTWLEMYAISNICLYHYILVLLNSCVSSVTDGTPPLPSTPKARYXEVV

SEQ ID NO: 193894 - protein, 78 aa, Triticum aestivum
  unsure (1)..(78): unsure at all Xaa locations
  Clone ID: PAT_TA_88312.pep
VXDNXAECYTAALXIXVPIMCVPXEPSSAFAHVIGXVWIXKGNLNWLSRQSIVWNCRFRNIXDHVKLNTRIYMQIYSF

SEQ ID NO: 193895 - protein, 82 aa, Triticum aestivum
  unsure (1)..(82): unsure at all Xaa locations
  Clone ID: PAT_TA_88313.pep
GXVIKKXXLVXLAXEIKKRKXYIVHXHNYRIIXTVNSSSTXSXTVNFXFLALHKFXCIXXFIXSKKKKKKKKKKKKKKKKKK

SEQ ID NO: 193896 - protein, 152 aa, Triticum aestivum
  unsure (1)..(152): unsure at all Xaa locations
  Clone ID: PAT_TA_88314.pep
PNNXFLICGICPRXGTQTXNRFFGHDVLRRLGRCYPKXPRFQHPFPEDRGIQLXASRQRGKLFSTFYRMFSFFHSLTLCXNLKSXTFDRLGGRYLGPINCPAPLPEDPAPALLSEAAGSGALCGAGKEGQEEEDHGDSKEYPQHGVVGLVIR

SEQ ID NO: 193897 - protein, 70 aa, Triticum aestivum
  Clone ID: PAT_TA_88315.pep
TTSTCPSAPKFVEKSHVCPLGDFLGHMQEMGMKFKHLGVLTRTGKIEKLDFLIHVNPKHVLKLMKLRMVS

SEQ ID NO: 193898 - protein, 179 aa, Triticum aestivum
  unsure (1)..(179): unsure at all Xaa locations
  Clone ID: PAT_TA_88316.pep
MAPTVMASSATSVAPFQGLKSTAGLPVSRRSNGASLGSVSNGGRIRCMQVWPIEGIKKFETLSYLPPLSTEALLKQVDYLIRSKWVPCLXEFSKVGFIFXXEHNASPGYYDGRLLGQCWKLPMFXGCTDATQVINEVEEVKEGXPDXYSASSGFXNMRQVQCVSSXAXXPRGCXXSXKG

SEQ ID NO: 193899 - protein, 103 aa, Triticum aestivum
  unsure (1)..(103): unsure at all Xaa locations
  Clone ID: PAT_TA_88317.pep
GXSRKXXYLXRGXKXXRGFSHFSAXNDSXRSXRHVXLPDSXXTCXVGGVXXHGXHRRGHGGAPVYXXCSRXVAAPXDPDSTXXVRXXLDPXAACRXLXCRTWX

SEQ ID NO: 193900 - protein, 114 aa, Triticum aestivum
  unsure (1)..(114): unsure at all Xaa locations
  Clone ID: PAT_TA_88318.pep
FLSVLNLSYNGLVGXLXDPPHFQTFXNLSFLGDIGXCGLPLSKDAERTNPKYGLHTSFEEEXVDIILFLFVGLGLVSGFAVSVVVSVTWGSTIAKHLEMALPRGVVKYLLCRLV

SEQ ID NO: 193901 - protein, 177 aa, Triticum aestivum
  unsure (1)..(177): unsure at all Xaa locations
  Clone ID: PAT_TA_88319.pep
MAPTVMASSATSVAPFQGLKSTAGLPVSRRSNGASLGSVSNGGRIRCMQVWPIEGIKKFETLSYLPPLSTEALLKQVDYLIRSKWVPCLXEFSKVGFIFREHNASPGYYDGRYWXTMWKLPMFXXAPTHXVINEVEESRXIPDAYVPHHRIRQHRQVQCVKLHRPXSHXGXKESGKG

SEQ ID NO: 193902 - protein, 168 aa, Triticum aestivum
  unsure (1)..(168): unsure at all Xaa locations
  Clone ID: PAT_TA_88320.pep
MLVYQDKLSGDELLSDSFPYRELENGVLWEVDGHWVVQGAVDVDIGANPSAEGGGDDEGVDDQXAVKVVDIVDTFRLQEQPAFDXKQFISHMKRYIKNXSAKLEXDDXMLSKKNVESATKYPPNKLXDLQFLVGQNXHDDGXVCSPTTRELPIKLPVLCWKANNPTVC

SEQ ID NO: 193903 - protein, 52 aa, Triticum aestivum
  unsure (1)..(52): unsure at all Xaa locations
  Clone ID: PAT_TA_88321.pep
MAETEYRCFVGGLAWATDDHNLQQAFSHYGXILDAXIXNXRXTGRSRGFXFV

SEQ ID NO: 193904 - protein, 165 aa, Triticum aestivum
  unsure (1)..(165): unsure at all Xaa locations
  Clone ID: PAT_TA_88322.pep
MQIFVKTLTGKTITLEVESSDTIDNVKAKIQDKEGIPPDQQRLIFAGKQLEDGRTLADYNIQXKESTLHLVLRLRGGMQIFVKTLTGKTITLEXGSHLDTIDNVKGKIQGQGGHSPRDQQAPSLXGKQLEDGRXLXDYNIQKDPTSNLVLRLPGGMQVKNLNGQD

SEQ ID NO: 193905 - protein, 148 aa, Triticum aestivum
  unsure (1)..(148): unsure at all Xaa locations
  Clone ID: PAT_TA_88323.pep
YRSHQSKLLRRCAYAIRQKDGGFVSRYGVSGCQWLRASASLSTPCVRHRQFSPAPVACRPTTLIVQTARRYRCMTGSSSSRQHDTVRVLSVHAATVESRGRGTPSLRVQDHRIYQRAHACTGALVACPFQSNARVENXXAALDIRCXT

SEQ ID NO: 193906 - protein, 196 aa, Triticum aestivum
  unsure (1)..(196): unsure at all Xaa locations
  Clone ID: PAT_TA_88324.pep
VSIVQLXMGPIAQINLQXHPYLVLPVDXGFFYLLRXPFLVGIQYPIIKDPIRRSFFHXPSTNQTVPGSKWMSSSWSGGIGRNNIHGYVIMAAGFGQVDMWIALHPDXQADPEYFDAILNGLEVFKLQNYGSPNNLSGLNPPLPQKPADASPSAASGKMKSVAAIIGGAVGGFIVLLAACFGVCIICKRKKKKKKKN

SEQ ID NO: 193907 - protein, 194 aa, Triticum aestivum
  unsure (1)..(194): unsure at all Xaa locations
  Clone ID: PAT_TA_88325.pep
LGSGLLISFWKDQWLEVGRLCQLFPTLYSFAAQPACSVQSQHSNGSWAIQLHPNLSQTASTELAALQGLLMGIAPNLLHEDKRSASVSSGQLCTGIXYRLLTFRGVLTTFHTXFGDVVIPLKHRIFLWLAFRGRLNTKXNMVKKGWVRRLPRXAHCDSCPAVESIDYLLLPQDGAGLLACSANVLPLWSKHNTR

SEQ ID NO: 193908 - protein, 160 aa, Triticum aestivum
  unsure (1)..(160): unsure at all Xaa locations
  Clone ID: PAT_TA_88326.pep
MKIDDPLDFEGDNDPLLTVRRPAKRKKVIGLDDLVEDYFNSGKDELKASAAKSKGRPKGDNSDDEDRQVRKKEIDFCKFVEECEEKAKAMDPGEDVPQWGQQVFXGCQKSPSXVLNSTGVENCQLLQSFCGDEALXFDXEIERRKGFSXXMLINGWXLXL

SEQ ID NO: 193909 - protein, 194 aa, Triticum aestivum
  unsure (1)..(194): unsure at all Xaa locations
  Clone ID: PAT_TA_88327.pep
VLSGQVDSQLQVTGSILRPXDVSGMIRLSHGEAYLPHDKGNGAVATRLASNKSSYLLAGFGQTTTSQDVSRFLGALSTSPDKTERTLENGSFKPNIDARLNDLKLTLGPXELRIVYPLILNFAVSGDLELNGMVHLKYIRPKGILTFENGXVNLVATXVRLXNDXLNXXKFEPDLXXNPVPGSVXVGSEWQXKS

SEQ ID NO: 193910 - protein, 162 aa, Triticum aestivum
  unsure (1)..(162): unsure at all Xaa locations
  Clone ID: PAT_TA_88328.pep
RLPLRDVVDDXGVGGKASRNLRLKRPSGRPXGKLDXXVAVKEPAXYYDSNVPGGYPAPAGYGSSRXAYGGGYGAGXGAYCAAAGAGGYGAYAAAAPGYPGYGSTAPPPQGRTVRLRSTSLRRRAPGSWSKRLRLLCSTGILRHTASREARAPLLLLTAATSR

SEQ ID NO: 193911 - protein, 197 aa, Triticum aestivum
  unsure (1)..(197): unsure at all Xaa locations
  Clone ID: PAT_TA_88329.pep
NNSLSGAVPDGMFECRNITRVNIAHNRLGGSLLPLCGSASLLSFDATNNSFEGGIPAQLGRSSSLQRVRLGSNALSGPIPPSLGGIAALTLLDVSNNALTGVIPDALSRCTQLSHIVLNHNRLSGPXPAXWLGTLPQLGELXLSANEFTXALPVQLNKVLQAPSSCRSXGNQINGTXPPGNXKLASXXVLNLAQNKL

SEQ ID NO: 193912 - protein, 118 aa, Triticum aestivum
  unsure (1)..(118): unsure at all Xaa locations
  Clone ID: PAT_TA_88330.pep
NIVEPIXXRPXXKFLIISPLYKXXXKYVXERRNRSMLTRSKAQTHXXNMPLQFCRKXLVEXGTRLDIRSSKFGSIIIWLEVSSAVLRSSGTWLSAARSTTARSGRSISSAAEEERGTG

SEQ ID NO: 193913 - protein, 65 aa, Triticum aestivum
  unsure (1)..(65): unsure at all Xaa locations
  Clone ID: PAT_TA_88331.pep
XCRLGTVSYNHPPQLFVFFILVWXVNYXMFXWNXXXRCYIRDSVFXFXLXXVIPCFFLCFIVGDF

SEQ ID NO: 193914 - protein, 121 aa, Triticum aestivum
  unsure (1)..(121): unsure at all Xaa locations
  Clone ID: PAT_TA_88332.pep
CSLQSDIREVASKCADAAKMAGFALATSALLVSGASAEGAPKRLTFDEIQSKTYMEVKGTGTANQCPTIDGGVDSFPFXAGKYXMKKFCLEPTSFTVXAXGIXXNQXPAFQKXKLMNRXTP

SEQ ID NO: 193915 - protein, 144 aa, Triticum aestivum
  unsure (1)..(144): unsure at all Xaa locations
  Clone ID: PAT_TA_88333.pep
MAPTVMASSATSVAPFQGLKSTAGLPVSRRSNGASLGSVSNGGRIRCMQVWPIEGIKKFETLSYLPPLSTEALLKQVDYLIRSXKWVPCLEFNKVGFXFXRXAQRTPGYYXGRYWTMLELLCPDERHPGKWRSHKDYLLSRTKC

SEQ ID NO: 193916 - protein, 119 aa, Triticum aestivum
  unsure (1)..(119): unsure at all Xaa locations
  Clone ID: PAT_TA_88334.pep
MAAMKIALLAVAAMAVLLGTASAVTYNVGDQGGWXTLSTDYSSWVSGKXFNVGDEIXVFKYSDXTHDVGPRSSKGRYDPXSIDGAIKPWAPGNDFITXNATGTRYXICGLTWQPHAAAT

SEQ ID NO: 193917 - protein, 116 aa, Triticum aestivum
  unsure (1)..(116): unsure at all Xaa locations
  Clone ID: PAT_TA_88335.pep
RSMQREVAFLKDELGSIHAVLKKLENMEEELDPQTREWKQXVMDITFHIEDCIDEFMHEXGEDSNRGDVRFVXGKIAQLHQPFETRHQFAKQIQQLKHGSKDVSEPPERYNLIMCP

SEQ ID NO: 193918 - protein, 81 aa, Triticum aestivum
  Clone ID: PAT_TA_88336.pep
HPTHLLSSAAAPVVRWPRGPSSSGQPPAAAPLSTPHPPPRACTRGSAATPPLPSSASPRSPSPPPPRPPARTAPAAVTEGE

SEQ ID NO: 193919 - protein, 103 aa, Triticum aestivum
  unsure (1)..(103): unsure at all Xaa locations
  Clone ID: PAT_TA_88337.pep
RLATLLTLARRSEASSRSSMAMSEQDGQHATNSLPGDAANGAVXIDSFSXLPFVRPKPPPATEAGGXSPTSSIRLFGFDSRPTGRRPPXXRRRICRCQLHCPR

SEQ ID NO: 193920 - protein, 110 aa, Triticum aestivum
  unsure (1)..(110): unsure at all Xaa locations
  Clone ID: PAT_TA_88338.pep
PEGEGXXXPXXWNXSKXLVWXXFEGPXXSXLVDDESFTRWSSQKVRPGRRVCTKCTDPEPANPTQDCAARTGLDTQARPVTRYLRREPQRSFGSAVLVTVPVSRSMPKAA

SEQ ID NO: 193921 - protein, 145 aa, Triticum aestivum
  unsure (1)..(145): unsure at all Xaa locations
  Clone ID: PAT_TA_88339.pep
MASTSCFLHQSTARLAASARPAPAVGRTQLFVCKAQKXDEAASDAAVVTSRRAALSLLAGAAAVAVKVSPRRCRLRRTANVFRQGERKNTDSLAYSGKGXKLMIPGKVGTQQGRDSPGKXSXYXXNFXATRTLPLYQPTNQETSR

SEQ ID NO: 193922 - protein, 179 aa, Triticum aestivum
  unsure (1)..(179): unsure at all Xaa locations
  Clone ID: PAT_TA_88340.pep
GEAPLPFHIHGQLVIHVIPSDFTTRHHRSSSEVAPHFTSAGARAWPPQRVSRFRTLRSHLTRWMKCNKGMKVPLELRAPLLCASWVKSTVSTWEAIGNLPKGRLXANATIAAPQXWLRFWPIDDLSPXPXQNIWYDTLPNSXDFRKKCSXIKXCNXWEXAQWRLXNCSCLFPEXXKFPS

SEQ ID NO: 193923 - protein, 173 aa, Triticum aestivum
  unsure (1)..(173): unsure at all Xaa locations
  Clone ID: PAT_TA_88341.pep
PCRFPSSPAAPSSRQPTIPGASPPYSALPLPLLAGGSSLAAATNTARRRGPTSAGEVSGEYGEAPQPHEPPRRQRRIGQGAXAARAAARSAVNTARRRVRTGGXGQGGPGAQPPRCQGAEAAIRRSXFVXAAVTPXCLGQLPLCVXTGSQLPTASXRSKIPDXRXQQWMSFWT

SEQ ID NO: 193924 - protein, 97 aa, Triticum aestivum
  unsure (1)..(97): unsure at all Xaa locations
  Clone ID: PAT_TA_88342.pep
MLILIGAECPXPGVXXKSCXFLNRGQLTRXYQGFQGKETACGXLGEXIKLRVVPYCQTLGAGRQMPKXSRPIALYEMGKKEGVLPLLPPSSGSSSNL

SEQ ID NO: 193925 - protein, 149 aa, Triticum aestivum
  unsure (1)..(149): unsure at all Xaa locations
  Clone ID: PAT_TA_88343.pep
KTLTGKTITLEVESSDTIDNVKAKIQDKEGIPPXDQQRLIFAXGKQLEDGRTLADYNIQXKESTLHLXVLXLRWWHAVLRXRPLTGKXTITLGGPILWTPSDNVQAKFQGQGGIPTGQQRLXLWGTLLGWPTFGYKSRRIHIHLGLLPQ

SEQ ID NO: 193926 - protein, 131 aa, Triticum aestivum
  unsure (1)..(131): unsure at all Xaa locations
  Clone ID: PAT_TA_88344.pep
SVLSGIXVVMSQSTRWXGXGIMXICWYIWSQFGYTDSRFERMHQRLSSKSLCCPGQGEVRRRRRGHLEDRVHGMRGRCMMPTRWAADYYPLWTPDVAAGGSVAAHDHRGEDDQQRHHQDTGSSGEGRHYCI

SEQ ID NO: 193927 - protein, 105 aa, Triticum aestivum
  unsure (1)..(105): unsure at all Xaa locations
  Clone ID: PAT_TA_88345.pep
SQRQKESLTTIWDRKXFAFPCCCFNSLXPKXSXTNMVQGRRAXEXMHYLPPKLXXGLLLHCSXVFXGGPXLAQEXXXTXXPXXRHRSXXVTRSRPQPXVSRARCX

SEQ ID NO: 193928 - protein, 140 aa, Triticum aestivum
  unsure (1)..(140): unsure at all Xaa locations
  Clone ID: PAT_TA_88346.pep
AAEQRKFRGSYKLQXRSRXCXTXXXXEVGAAQLLYKQKAQGGXATAATSPFNVLPTSPTGKATPNASXPGXPXLPPXLXAPTXPAXPVDFRPTPRXIXTSPEYSSTKGAFCRARPARCLPXRPFGRXLQFXQRXDXKDXH

SEQ ID NO: 193929 - protein, 142 aa, Triticum aestivum
  unsure (1)..(142): unsure at all Xaa locations
  Clone ID: PAT_TA_88347.pep
MAPTVMASSATSVAPFQGLKSTAGLPVXSRRSNGASLGSVSNGGRXKXCCRCXPSKGIKEXXTCLNLPPLNTEASXKQVDYLXIRSKWXPCLGFNKVRSXSRXXNASPREXDGRYWTXWELPKFXXTTHTGXNXVEEVXKDT

SEQ ID NO: 193930 - protein, 145 aa, Triticum aestivum
  unsure (1)..(145): unsure at all Xaa locations
  Clone ID: PAT_TA_88348.pep
TLSTPSNPPLSPPRRIPSPPELGNXKTHHPGAGDSMMTAKLRFXGAQSPKRMHRFNNLQGWENQKEVIVGPNWGSAXPTNEDXNKDLPXNDWPIXVFDSDSTTRXICKRAGPPYLRXPDTQSXEKMTXLXNENLRDLDGSNXXXD

SEQ ID NO: 193931 - protein, 110 aa, Triticum aestivum
  unsure (1)..(110): unsure at all Xaa locations
  Clone ID: PAT_TA_88349.pep
TSQXSWXPTFMLLQVILNVSTSIPTSSPVFRRNFFHPCLNKMQPFMCLFRHSSPXWDLCLPNHNLRQSMXGDIXMXSYFLWVFLHXHXLXAKKCEXXGPVRXTDKNIXKH

SEQ ID NO: 193932 - protein, 157 aa, Triticum aestivum
  unsure (1)..(157): unsure at all Xaa locations
  Clone ID: PAT_TA_88350.pep
KEXFXGFIXXXRXXGPGPPFFVFXIGVKXWXGPXNTQGGITTRLGLTRGTTXTPXLLACRGIRXKGNKLPALXAXVEXEDNHISSGQQRTLAGLDTKRXANMAASHKLLSTLLQFSGRRLLFSGGCSLSXSCXXKAXCXRXGSXAXGXXXGXXXXXX

SEQ ID NO: 193933 - protein, 143 aa, Triticum aestivum
  unsure (1)..(143): unsure at all Xaa locations
  Clone ID: PAT_TA_88351.pep
MATTAMALSPSSFAGKAVKXLPSSALFGEXARHHAQRPRPRPSRLXSGTPXYXPDRVLYLRPLXSGRPPEYSTGXFPGDYGXDTAGLXADPRTSAXEPGXEVIQCPVGHAGAAPCSSPNCRPQRSISASVSKAQLKALTEPTV

SEQ ID NO: 193934 - protein, 103 aa, Triticum aestivum
  unsure (1)..(103): unsure at all Xaa locations
  Clone ID: PAT_TA_88352.pep
AFLPTATGKMPDSLELAAHLLLSRRFLLDEDDALPIACLEQEQLSLLVLCRCFPEICTXVTCMLLVXRXCLCPGTXGMCLDEQAMLLTIRKCKVXAIILQKKK

SEQ ID NO: 193935 - protein, 166 aa, Triticum aestivum
  unsure (1)..(166): unsure at all Xaa locations
  Clone ID: PAT_TA_88353.pep
RLTPPWKHRERGEWRRXGGKXXTLEEVPKKSSKDXCXLVIGGXKVYKCDQSFLRXPPWEGERLLAVLQTSQRMPTDDFXGRWGTTTTAXANDGRLXLGEIXPTTIPTKSNSRPPKQPHYNQGQTPXXVIXILQFFXPLXXTGLAPYGLKDLTRRLYNQSIIRNVQN

SEQ ID NO: 193936 - protein, 123 aa, Triticum aestivum
  unsure (1)..(123): unsure at all Xaa locations
  Clone ID: PAT_TA_88354.pep
MACGGGGESEAERRAELLREITEEGGFAFVASAEKAAAGDLRAAEAAREMAWEQLHSGPWSEVGSAWRDAYALACLHVARLRRAAAXRRAALRALHMGLIMXGNSPRRFRPPGLIAADPTTRM

SEQ ID NO: 193937 - protein, 148 aa, Triticum aestivum
  unsure (1)..(148): unsure at all Xaa locations
  Clone ID: PAT_TA_88355.pep
ILWGMLLYERSVVEFKLGLPAWEDCLMAAIEKFKLGGASATNIAVXVKNHCANETAQDGLGLQMSMKCASLGMRCTTLNGGLRGCSILPSPSHYLRRENPQLHMALGAYIVPMNCSNAIILGHVTNTISFGRPIADWGYNTWICPLHF

SEQ ID NO: 193938 - protein, 192 aa, Triticum aestivum
  unsure (1)..(192): unsure at all Xaa locations
  Clone ID: PAT_TA_88356.pep
VVEVVVSPPYVFLPTVKGKLRPEIQVAAQNCWVKKGGAFTGEVSAEMLVNLGVPWXSSLGHSERRSLDGKNKRXVWERRLHMHSLKGLKGIACVGWNXLSKRRTGFQPWAVFPEQTKQLLTRXKDWANVVLPXEQCWAIXTGKFHNGQXQXPCNLRTXQDKXPXVAXPAVMEVVTANSRLPQPSHGLVSLTI

SEQ ID NO: 193939 - protein, 79 aa, Triticum aestivum
  Clone ID: PAT_TA_88357.pep
QNQGRAGAQPRPTGSSACVLDDVMGACVGDFGLTKFVHSYTSSRIDGSTSLVGPKRINWDTLHQEYGFGEQNLYPKGDI

SEQ ID NO: 193940 - protein, 61 aa, Triticum aestivum
  unsure (1)..(61): unsure at all Xaa locations
  Clone ID: PAT_TA_88358.pep
TWMFKXGRILYLSCCVSHYVLNLXGRVLLRFVPCFHRIAVRKQWCFSLLKFSFSLDFELLH

SEQ ID NO: 193941 - protein, 145 aa, Triticum aestivum
  unsure (1)..(145): unsure at all Xaa locations
  Clone ID: PAT_TA_88359.pep
XFTSRFSSRSPLSPQSSTPALVFXPQFIXXLTXNTXNARKHQFSTFXNXVRSNXCPQXTLXSSIXINXRSPQLEHFLQLIXYHRXXSIQRXNXLGGTXDAQVQXRFPGRXVAXXPHXXAXRVCGDHSRKLXLRPTSHPPSXLSXX

SEQ ID NO: 193942 - protein, 51 aa, Triticum aestivum
  unsure (1)..(51): unsure at all Xaa locations
  Clone ID: PAT_TA_88360.pep
VSLGVYIKVMLLQXQTVELGRSTSIXFNKMLPHNXYHNYNLNKXHTNSXLA

SEQ ID NO: 193943 - protein, 81 aa, Triticum aestivum
  Clone ID: PAT_TA_88361.pep
MSCCGGSCGCGSACKCGNGCGGCNMYPEVEAAGATLLVAATATHKASSGGMEMAAEDGGCGCTQCNCGTSCGCSLLQLANY

SEQ ID NO: 193944 - protein, 143 aa, Triticum aestivum
  unsure (1)..(143): unsure at all Xaa locations
  Clone ID: PAT_TA_88362.pep
MATVSDSLVWELVRKNNCFLIKQFGQQQCQXVKFSKEPNNLYNVHPTITLAWANKKTVDCAAKLADKEMTVGLSNNEIQRSXTSCCXTHKMSCQGFXKMARYQDKSLKLLRLNNLKRFTLKLQSGFKKQHYRATVWVVVKFNF

SEQ ID NO: 193945 - protein, 149 aa, Triticum aestivum
  unsure (1)..(149): unsure at all Xaa locations
  Clone ID: PAT_TA_88363.pep
KVVLASHLGRPKGVTPKYSLKPLVPRLSELLGVDVVMANDCIGEEVXEKLXAALPDGGVLLPRKCGDSYKGRKEKNDPXSAQETTSVADLXMLNDPFXTAHXRHMLQTEGXTNYFXPAVPGSLMQEGLDXLLTVSNPTTICGFKCQLIG

SEQ ID NO: 193946 - protein, 78 aa, Triticum aestivum
  unsure (1)..(78): unsure at all Xaa locations
  Clone ID: PAT_TA_88364.pep
NSCXFEXNGLXSXTLPSVPQVXCHAXXRYEDPRTLNRSXSSKRASTPYLSRAGQYIKAPTSNLIGYFRLQLQQGSFLX

SEQ ID NO: 193947 - protein, 165 aa, Triticum aestivum
  unsure (1)..(165): unsure at all Xaa locations
  Clone ID: PAT_TA_88365.pep
LVXXGKQASKLGLPPDYSPSFSPVCYIDGGCPLSPAAASSKSQTAADALAKXERTPGSLLPGGKKPRXGNXQMADLXXPPVLSCCNCRNTXAPTTIYLXSFXXKNAXSLFPSHNXQXGXEXGXIXVKLSESXXYPXGPVELNAXKIQNXGGFNXKXNFRXXXIMK

SEQ ID NO: 193948 - protein, 106 aa, Triticum aestivum
  unsure (1)..(106): unsure at all Xaa locations
  Clone ID: PAT_TA_88366.pep
MEHKETGCQSREGPILCVNNCGFFXGSAATMNMCSKXXHKEMXMKQEQAKLALLFRXIVNGGDAAKRILLLAHAWNFSRSEDLITENLLISLAKGAMATQRPTHCR

SEQ ID NO: 193949 - protein, 146 aa, Triticum aestivum
  unsure (1)..(146): unsure at all Xaa locations
  Clone ID: PAT_TA_88367.pep
MARLNSKAVAAAVVLAAVXVLMMAGREGLRRRCXCGQVDSKARAVPWXXTGERPPPXSKECCSXGXQGAEPAGPATXPDRKIAAXAXKTSPTSIKSXNMXKSPGXPGNXXSSCPPHQHFNKLEHVNSITFQLHDGPLGLNSTLMPN

SEQ ID NO: 193950 - protein, 175 aa, Triticum aestivum
  unsure (1)..(175): unsure at all Xaa locations
  Clone ID: PAT_TA_88368.pep
GLXSPQTETKXGVGFKAXVKDYKLTYXTXXYETKDTDILAAFRVXPQPGXPPEEAXAAIAAEPXTGTWDNCFGLDGLTXSLDSFTKDDAIHIRPVXWGKDTQWXXXMLLXPFNLXXEGPLYNMFTPIGRNXFXFXTLTAPNFGGXTFPXTYXKTFQXRLXGTKFXRIIQLLMGFQ

SEQ ID NO: 193951 - protein, 183 aa, Triticum aestivum
  unsure (1)..(183): unsure at all Xaa locations
  Clone ID: PAT_TA_88369.pep
MFDTFQISILVSYSEGSSEDSRIPAHMVMPGIAMGVSIPSSQMFQFGVLVLGNRHGRRNVXHITWSRMNFVNLYGEHXNRGNVXEXIGPSLGXHPPVGPDLKCIHVXXLCVQRKPASRPTVSSVNIMFSSHTVRLPSLSRPPFFIQEVGVSESSTAHSDAYLPGENSTVMSSNQVSITELSPX

SEQ ID NO: 193952 - protein, 116 aa, Triticum aestivum
  unsure (1)..(116): unsure at all Xaa locations
  Clone ID: PAT_TA_88370.pep
RDXKQRRPLIGDVLQIAALPLGESNRLGGIGLHVCFVSGSLESXPLWLSLDSDALCCLEAIAPASVTALAAAAHLKLGVGSWEELDFEAMVDWTKLCISFLLWEAFPAAGCLSVLC

SEQ ID NO: 193953 - protein, 165 aa, Triticum aestivum
  unsure (1)..(165): unsure at all Xaa locations
  Clone ID: PAT_TA_88371.pep
MQIFVKTLTGKTITLEVESSDTIDNVKAKIQDKEGIPPDQQRLIFAGEAAGRMAVPSLDYNIQEGSTLHLVLRLRCGMQXFREDLNWERLSPXVXXSDTIRHVQGKIPRQGGIPPDNTLILAGXQLEDVHLADYNIQKDQPLVLARGGNNASNQLVPFCVPLSVF

SEQ ID NO: 193954 - protein, 86 aa, Triticum aestivum
  Clone ID: PAT_TA_88372.pep
DGNGDLDLPLGDRCSWLLVTHLHSLSHSPAASAPRSTSRRLSAGYLAPRTNHGPNFPPPADFCSSDSGRQCQVRFKNVRGPNTNGG

SEQ ID NO: 193955 - protein, 176 aa, Triticum aestivum
  unsure (1)..(176): unsure at all Xaa locations
  Clone ID: PAT_TA_88373.pep
XVFXTXXXNXPXVXXXLYKGXRXXTRXXNLLGKFELSGIPPAPRGIPKLTVCFDIXAMGILNFPAEDKXTPGKKNKLTIXTNDKGQADQXRNLRRXPKEAENSXPEDXGHKKKVDPKNXLGNTPFNMRTPREIPPTAGGDKRNLGIDLHQWVGTNPAIGKIKTAEPIIPKFQGLAK

SEQ ID NO: 193956 - protein, 104 aa, Triticum aestivum
  unsure (1)..(104): unsure at all Xaa locations
  Clone ID: PAT_TA_88374.pep
PNDAKSKGRASRNAXRNMHTKLGGAATHYGSLRLRRPKLGCSCXPGHRFKSETTTPERGYXXPFFFQCPXXKXXPGNKDSXQFFXPSXTRXTLAPVXXXPSQKP

SEQ ID NO: 193957 - protein, 124 aa, Triticum aestivum
  unsure (1)..(124): unsure at all Xaa locations
  Clone ID: PAT_TA_88375.pep
LSTGDRHHSGARGARRQTEPPSSSSRFRAARARTNPLIQQQQQQQRRVSGVHWGPSNGLRREASGGSRFSSALSLCSALSSTVRGEPPRKFWIXGRPFWKDGRVPDXPAXTSYFRSPRVLENPF

SEQ ID NO: 193958 - protein, 188 aa, Triticum aestivum
  unsure (1)..(188): unsure at all Xaa locations
  Clone ID: PAT_TA_88376.pep
MAPTVMASSATSVAPFQGLKSTAGLPVSRRSNGASLGSVSNGGRIRCMQVWPIEGIKKFETLSYLPPLSTEALLKQVDYXIRSKWXVPCLQFNKVGFILRXEHNASPGXYYDGRYWTMWKLLCSGCNDPHKXXXKVEXVXKDYXYPYVRIXRFNNMXQVHXSTXRLKXTGCXDPXKAKHKGILNAFNL

SEQ ID NO: 193959 - protein, 163 aa, Triticum aestivum
  unsure (1)..(163): unsure at all Xaa locations
  Clone ID: PAT_TA_88377.pep
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFXREHNSSPGYYDVXTGTMWKLPMFGCTDATQVLNWRSQEGVPDPIPCIGFTAQVCYRKHKLQDPAG

SEQ ID NO: 193960 - protein, 109 aa, Triticum aestivum
  unsure (1)..(109): unsure at all Xaa locations
  Clone ID: PAT_TA_88378.pep
MGGSAAAGKSVDGGGRAARVPVPEARPFLDTFRANLKETFFXDDPFRAVVLXRGFCRRAAAALRYFFPFLXWAPXYRLGTFXSXXXAGXTTAXLXIPQGIXQRNCHASA

SEQ ID NO: 193961 - protein, 97 aa, Triticum aestivum
  unsure (1)..(97): unsure at all Xaa locations
  Clone ID: PAT_TA_88379.pep
MATTAMALSPSSFAGKAVKDLPSSALFGEARVTMRKTAAKAKPVSSGSPWYGSDRVLYLGPXSGDPPSYSPVXFPGDYGWDTXGLSADPETSQXNRN

SEQ ID NO: 193962 - protein, 159 aa, Triticum aestivum
  unsure (1)..(159): unsure at all Xaa locations
  Clone ID: PAT_TA_88380.pep
MSPQTETKAGVGFKAGVKDYKLTYYTPEYETKDTDILAAFRVSPQPGVPPEEAGAAVAAESSTGTWTTVWTDGLTXLDRYKGRCYHIEPVAGERQPMDLXMXXPLRLXEEGSVTNXXTSIVGNVFGSKPXNVLHFGDLQFPXLIKNFQGXLMEPIRIIQ

SEQ ID NO: 193963 - protein, 106 aa, Triticum aestivum
  unsure (1)..(106): unsure at all Xaa locations
  Clone ID: PAT_TA_88381.pep
NSTMXPXXGAXRXXTAXXRSFXXIVXDADACSXFXGSQTTRSRDGAGRPACXXSSGXAAGAGTGGALQPQAPGRTWWPPPSANQLSWAVAMXASGRRWPVGNREAG

SEQ ID NO: 193964 - protein, 122 aa, Triticum aestivum
  unsure (1)..(122): unsure at all Xaa locations
  Clone ID: PAT_TA_88382.pep
FTDKDKAAAHLKGGAXXVXISAPSKDXPMFVVGVNEDKYTSDVNIVSNASCTTNCLAPLAKIINDNXGINXGLXNXVHAXIAXKKTLNXPKKGLKVXGPXLKXIPXXLXPAKXWKXXPELME

SEQ ID NO: 193965 - protein, 169 aa, Triticum aestivum
  unsure (1)..(169): unsure at all Xaa locations
  Clone ID: PAT_TA_88383.pep
MSPQTETKAGVGFKAGVKDYKLTYYTPEYETKDTDILAAFRVSPQPGVPPEEAGAAVAAESSTGTWTTVWXTDGLTILIRYKGRCYHIEPVAGEDSQWIVXYXXLDLFXEGSVTKQFTPMVXNVFGXKALLPLYNSPTITSKAQVPIEYYGLLESITKWINETHAYCES

SEQ ID NO: 193966 - protein, 66 aa, Triticum aestivum
  unsure (1)..(66): unsure at all Xaa locations
  Clone ID: PAT_TA_88384.pep
PKNRXQLTNSSTNREYMAGGRLDVAAXAXEXAGQRXADHXXLHHXXXAEXHLVHAPPXAEPGXXAE

SEQ ID NO: 193967 - protein, 118 aa, Triticum aestivum
  unsure (1)..(118): unsure at all Xaa locations
  Clone ID: PAT_TA_88385.pep
XXRGRPXEERPMLDPRKSGAEAXVERSPSAXHPNGAAAQNTAACMQEAKSNSSVTAAAAMITRSTQELEGWGFLGADRSIHRLPGLCSNDELSGKDLDLYIYHVMCLNSKLVGLQIGT

SEQ ID NO: 193968 - protein, 107 aa, Triticum aestivum
  unsure (1)..(107): unsure at all Xaa locations
  Clone ID: PAT_TA_88386.pep
LTSWRSFCPVCKRDAGAGMSGPPASETTPLFASAGHLPSPSSSFRSSMGASPPRPISRRPSSQSISRVYSASGTPAXLSKTQRLLRNSSAMSISXRSNANLANMFSP

SEQ ID NO: 193969 - protein, 155 aa, Triticum aestivum
  unsure (1)..(155): unsure at all Xaa locations
  Clone ID: PAT_TA_88387.pep
VLLKMWLXDXXGWLXVCLXQSGKXRXMEMANLXSYXXFIELXHPASLSRAVITCRDTSWAVYGADEGGFXSRSSSLQGRKGAMELQHSKANLDPILSPSHGWDGSFHQRLTCLPPHPRSQNFGNQEWWRVGLRCHYFVWLQCLQHVPLFFWPDKL

SEQ ID NO: 193970 - protein, 158 aa, Triticum aestivum
  unsure (1)..(158): unsure at all Xaa locations
  Clone ID: PAT_TA_88388.pep
MQIFVKTLTGKTITLEVESSDTIDNVKAKIQDKEGIPPDQQRLIFAGKQLXEDGRTLADYNIQXKESTLHLGAQTPXVDAIFVKNLTAKHHPGRLIPXKTSXNXKAKIQGPRRXFPRATXSIFAXXXLXGWXXAXXXNPQGTKNLGPRPLGDHFKTRK

SEQ ID NO: 193971 - protein, 90 aa, Triticum aestivum
  unsure (1)..(90): unsure at all Xaa locations
  Clone ID: PAT_TA_88389.pep
XPIXTSXXARXTHPRWXXVCSASXLHRXSXTWWRGWLSXCATXTSXDXXVSASKGXSTXXHSXYSHRQSXLXXXITTLGSYRXIAXCGSS

SEQ ID NO: 193972 - protein, 80 aa, Triticum aestivum
  unsure (1)..(80): unsure at all Xaa locations
  Clone ID: PAT_TA_88390.pep
THXXQXXRXQXTNXGRXEEAEXGXGAARGXXEXXVHGKCXPECGGAXXPPRXRGXGCARGRAPXFXPPXAEERRXRRERF

SEQ ID NO: 193973 - protein, 133 aa, Triticum aestivum
  unsure (1)..(133): unsure at all Xaa locations
  Clone ID: PAT_TA_88391.pep
XLVWLLFPGFPXDLXFLLPQXLREPWRVPXFFXPRRLXVXECXXXCDXPTGAXXXPGIGKXXXPLXWTLGFRTXANAIXAGPPSLPHPMQMQVQPAAAAPTXVVVVAGSSRCGRCGEVTAPAGARATDAAFLA

SEQ ID NO: 193974 - protein, 159 aa, Triticum aestivum
  unsure (1)..(159): unsure at all Xaa locations
  Clone ID: PAT_TA_88392.pep
ILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRAXLRLGGSTNPPYLIKNFQRPPHGIQVERDKXNKYGXLMGCXNKPKWDYRKNYXKTCYDVVVD

SEQ ID NO: 193975 - protein, 66 aa, Triticum aestivum
  unsure (1)..(66): unsure at all Xaa locations
  Clone ID: PAT_TA_88393.pep
XHXMTFLGFRSPXVHRNHXLPVMXYPXHDHHHAFLLLSRKRLQLISISLRRLCSTGRRLKELDDTG

SEQ ID NO: 193976 - protein, 80 aa, Triticum aestivum
  unsure (1)..(80): unsure at all Xaa locations
  Clone ID: PAT_TA_88394.pep
LIXXLVHYWWXIPXXLSGLPCCXCQHAVVXPVVSQRGLTDPLPIXGVXQFQRFDANPSASSSSSVKGASQTHQPEHGGQK

SEQ ID NO: 193977 - protein, 123 aa, Triticum aestivum
  unsure (1)..(123): unsure at all Xaa locations
  Clone ID: PAT_TA_88395.pep
WSIGVSVGVFLSVSMCFWLYLGLQKRKLIKAKQSFFEHNGGVILQQQMRSYSGTAGGGGGGFKIFSEEELEKATNNFAADXVLGRGGHGIVYKGVSRTRRGGIKNQDGGDRDKELPKRAHLSS

SEQ ID NO: 193978 - protein, 76 aa, Triticum aestivum
  unsure (1)..(76): unsure at all Xaa locations
  Clone ID: PAT_TA_88396.pep
MAAALSLRAPFSLRAVAPPAPRVALAPAALSLAAAKQVRGARLRAQATYKVKLVTPXGEVELEVPDDVYILDQPKV

SEQ ID NO: 193979 - protein, 132 aa, Triticum aestivum
  unsure (1)..(132): unsure at all Xaa locations
  Clone ID: PAT_TA_88397.pep
AXDLGGHXFIRPGVYCXNDVHLYILRAIPSXXYWQRTFDVLISQEPNAVSFVSGTKDRXTCTTSSRNAIDTLTPGRLVSLKLKLSRRLLLGRXSRILGILLSTLTLEDSSSPFDFLAAARSVDLTFDLILLT

SEQ ID NO: 193980 - protein, 174 aa, Triticum aestivum
  unsure (1)..(174): unsure at all Xaa locations
  Clone ID: PAT_TA_88398.pep
KAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVXNVFGFKALRALRLEDLRIPPTYSXTXKAASWYQVERDXXNKYGRLNGMYNKHGIPQKIW

SEQ ID NO: 193981 - protein, 73 aa, Triticum aestivum
  Clone ID: PAT_TA_88399.pep
PRTMKSLPMVNNLHFSLLILLLRASQPCEYRAQADNCTAHVSDEPELCFPFGELCDGTEELCLNFERAVELSH

SEQ ID NO: 193982 - protein, 115 aa, Triticum aestivum
  Clone ID: PAT_TA_88400.pep
DSLGKLKNLRALDVCHCDFTELPPAISCLFHLRYLSLSRTIRSLPESISKLLHLQTLCFEDKCSLDKLPAGISRLVKGFPGGPKPPFLGGKKFSKKKPWKRVFKPKFWGQNPKRA

SEQ ID NO: 193983 - protein, 170 aa, Triticum aestivum
  unsure (1)..(170): unsure at all Xaa locations
  Clone ID: PAT_TA_88401.pep
GXKKXGGGPPXGXKXGGGGGRGGGGGPGXIFXAPPGXPGGFFPLFXPGXKKXFPLLKXFFLGEKKGEIXPKXGVFSPLXPPPKXPGGGNFKFPPGXXKNPPGFLXGGFFXPQKKGPPXFXPQKILDLMARGVAVNLLQMAKRVGPRYEAAEHKNQSREKGSSLDSVVSDD

SEQ ID NO: 193984 - protein, 141 aa, Triticum aestivum
  Clone ID: PAT_TA_88402.pep
MPGSIAFGRFDDSFSLASFKAYIAEFISTLIFVFAGVGSAIAYTKVSGGAPLDPSGLNLAPRFGGPGKLKFWPPPKKPGGGFSGGGPLWGFPRGVFRGGFPGPPKNFRGGAPGPPPKKNPKFPLFPPRGGPGGPPKNRGFF

SEQ ID NO: 193985 - protein, 155 aa, Triticum aestivum
  Clone ID: PAT_TA_88403.pep
ENPCKFYQLKYLHLNLSIGHKEAANILSFASFLRAAPSVEKLEMHFSVLAIPHRVSEPIKSLPRCPHSYLKNLHITRNFFFPRGGGEKKPKKTPKKGGGNPQKKPFGKNFFFSPKLGPQKPGFGGFGEKKKKLGAPPPPPLGAPFSPFGGKKKKI

SEQ ID NO: 193986 - protein, 181 aa, Triticum aestivum
  unsure (1)..(181): unsure at all Xaa locations
  Clone ID: PAT_TA_88404.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVXYPLDLFEEGSVTNMFTSIVGNYLXFQSLRALLWXXYKSPTYQKLQSPPKVPIXRIINXYGPLMGFHQGYPKFGICTDFK

SEQ ID NO: 193987 - protein, 139 aa, Triticum aestivum
  unsure (1)..(139): unsure at all Xaa locations
  Clone ID: PAT_TA_88405.pep
AAALLPIDLRLSSRPRPRSPRRVFCSPPRRLSPASPLAAARSTTPPTKARRPRQPLLGRPPWLGPRDLDGVSCWLMDMAGPRWKKGKDGKDFAALAAAQPMSSIVAELQSSLKARNLWQLYLVXARMQPRCESATSFTX

SEQ ID NO: 193988 - protein, 201 aa, Triticum aestivum
  unsure (1)..(201): unsure at all Xaa locations
  Clone ID: PAT_TA_88406.pep
HESSYSSCDEYDVDCMEEPPKSTISKDDVGVHQPAVHIREENGSSSGNKKRHDKRSTQTLPSTKETKKPPKRRRHTGQCSVDGSEVEGTQRNDNMPEVLSNAIPDMNSNQMEVVCVANPLTSFNHAGTNGGSYNIKEISRELCTPGVVGNXYSQAANIAPQHYMVNNHYSERMLTNPGWNTSQIWLXNXXSLNIQLAEXQX

SEQ ID NO: 193989 - protein, 111 aa, Triticum aestivum
  unsure (1)..(111): unsure at all Xaa locations
  Clone ID: PAT_TA_88407.pep
LADSLCLSDLLGFSPCLTTASKATLPCGXTLSARILDPPLSSRRPMPSGXCARRISGKAPPSPKSSGRRGTKPVRFPXGGTGLAGPASFPAAASGGSPPYRSLNHGSLLWS

SEQ ID NO: 193990 - protein, 134 aa, Triticum aestivum
  unsure (1)..(134): unsure at all Xaa locations
  Clone ID: PAT_TA_88408.pep
MAGTGGLSESVMRKVLLSYCYVAVWIFLSFAVIVYNKYILDPKMYNWPFPISLTMVHMSFCSSLAVGLVRVLRVVEPPSSPPMTPQXYTSSVVPIGALYAMSLWFSNSAYIXLSVSFIKMLXXLMPSPSLHRVS

SEQ ID NO: 193991 - protein, 199 aa, Triticum aestivum
  unsure (1)..(199): unsure at all Xaa locations
  Clone ID: PAT_TA_88409.pep
MAPAVMASSATTVAPXKGLKSXTXXLPLSGAXXGTXGSVNNGGXRXXCMQVXXIXGHQRNFKTLSYLPXLSTEGLLKQVDYLIRSKWVPCLXFNXGGFVLREXNNSPGXNNGRYWDKXGXCLMFGWNXRQXRVLKEXEEVKXGXPDXXVRXIXFXKLRXVQCVTQSNQATGFKDLERLNIYFNCLWNSIKTSHKKSEIG

SEQ ID NO: 193992 - protein, 106 aa, Triticum aestivum
  unsure (1)..(106): unsure at all Xaa locations
  Clone ID: PAT_TA_88410.pep
RKSSSEIAPCLERLXPIWLSLNPGXISVISAPKLETLGCLSSYSSNTFTLYSTVIQGLRVDSLTKTVCTVKVLSVCMGALSLDVVIDLMRCFPCLERLYIEVTILP

SEQ ID NO: 193993 - protein, 77 aa, Triticum aestivum
  Clone ID: PAT_TA_88411.pep
RCSSSSSPAVPRDWWVEDLCELDVELYKRVMVAIKSRGDRMPSDVVGEALRAYAARWLPESCRRGEPADDNDDCALE

SEQ ID NO: 193994 - protein, 169 aa, Triticum aestivum
  unsure (1)..(169): unsure at all Xaa locations
  Clone ID: PAT_TA_88412.pep
LLLALELLLLLLALPRLTCASNSTHPSLYRQAKALLQWKSSLKGWSSELDSWTKGTNPCDWTGVGCSNAVLPRGDAVLVVDNISLPSCHIQGSIGVLPELAYLNLSSNGLNGSIPTSLDLPHLVYLDLRKNSLLGXIPSSIGALVKLVFLNXSYNFLNGVVHIHRRDRD

SEQ ID NO: 193995 - protein, 91 aa, Triticum aestivum
  unsure (1)..(91): unsure at all Xaa locations
  Clone ID: PAT_TA_88413.pep
SXFFFFFFFFFFFXXKGKXHHYQQQFXRPTKLPGRYNYSDLTXQXEHSTVXXPILPXXDTKLPXMDSICTTLXNFLXXPLXXXRVXXRFAF

SEQ ID NO: 193996 - protein, 136 aa, Triticum aestivum
  unsure (1)..(136): unsure at all Xaa locations
  Clone ID: PAT_TA_88414.pep
MQIFVKTLTGKTITLEVESSDTIDNVKAKIQDKEGIPPDQQRLIFAGKQLEDGRTLADYNIQXESTLHLVLRLRGGMQIFVKTSLARXITLXVESSDTXDNLXKVKTRXGIPRTTXLIFWQQLEDXXPADTSEGSP

SEQ ID NO: 193997 - protein, 47 aa, Triticum aestivum
  unsure (1)..(47): unsure at all Xaa locations
  Clone ID: PAT_TA_88415.pep
VVXRLNCPNTEHLLLTRRTIHNLMQGSYSEXEAKKIPMEQSVLLKLQ

SEQ ID NO: 193998 - protein, 150 aa, Triticum aestivum
  unsure (1)..(150): unsure at all Xaa locations
  Clone ID: PAT_TA_88416.pep
SLFPLDPHSLSCLLHLSPRVTMGAPPTPAGRPPSSLFEAEDQLTPQLFFTHDLGLGRPGLLGGVEAQGMAGRPTVGEHPGRRMEQRVPSSKRRTHCGMEKGLMGCXGQRGKERWVLHLLXSNRDPTTPPRCSLXGVXAAXGLGLGRIQAI

SEQ ID NO: 193999 - protein, 108 aa, Triticum aestivum
  unsure (1)..(108): unsure at all Xaa locations
  Clone ID: PAT_TA_88417.pep
GPRGRDPGAVLGIARRATTHRCKAXCARTAASPSPAAAPAXPRXPPPPPPQPPRPXXGPXSSSSPAPPGAPATGARTXSSPEGTGAEPEGPGRGAXSAPPWTSLGSPS

SEQ ID NO: 194000 - protein, 82 aa, Triticum aestivum
  unsure (1)..(82): unsure at all Xaa locations
  Clone ID: PAT_TA_88418.pep
CHPVEPAGXFPKLQNQGPLLRLQVPCITYSSTPRLLGRISILAIIPPAVEREAGEGRCRCRARPDLTPPTAPLSPYRMRAER

SEQ ID NO: 194001 - protein, 78 aa, Triticum aestivum
  unsure (1)..(78): unsure at all Xaa locations
  Clone ID: PAT_TA_88419.pep
LLVEGTXGXPWGNALXASXNRVXLEACVQAXRNXGRDXAXEGNEIXRAAXKWSXXLAXACEVWXAXKXEFXPVDTIDK

SEQ ID NO: 194002 - protein, 129 aa, Triticum aestivum
  unsure (1)..(129): unsure at all Xaa locations
  Clone ID: PAT_TA_88420.pep
MLVYQDKLSGDELLSDSFPYRELENGVLWEVDGHWVVQGAVDVDIGANPSAEGGGDDXGVDDQXAVKVVDIVDTFRLQEQPAFXKKHLSPHMKALHQELTAKLEGMTRCASCERKLLLWGGRYQFAYRI

SEQ ID NO: 194003 - protein, 128 aa, Triticum aestivum
  unsure (1)..(128): unsure at all Xaa locations
  Clone ID: PAT_TA_88421.pep
MTFKRRNGGRNKHGRGHVKYIRCSNCAKCCPKDKAIKRFXVRNIVEQAAVRDXQEXCLHDGYVLPKLYAKVTMCVLFHPCXIXRFRPVRTGGTLTPARFKXKDNGPRLERLAPLLVPAPLLWAFPGPP

SEQ ID NO: 194004 - protein, 76 aa, Triticum aestivum
  Clone ID: PAT_TA_88422.pep
GKHGSWVIRGSMVHGEQSNCASRMGCPEAKLALPLLDDLTWTAPSARPGRHPALNLDGGVATLERFLACRLVHQYI

SEQ ID NO: 194005 - protein, 79 aa, Triticum aestivum
  unsure (1)..(79): unsure at all Xaa locations
  Clone ID: PAT_TA_88423.pep
RARKPNLKSGGXSCSXXVITYAIPIIHVLFLVWALSSRGFLAMSSSRLITSVPRGSFEHFAYCPVAMLRLKVLCSKLYS

SEQ ID NO: 194006 - protein, 62 aa, Triticum aestivum
  Clone ID: PAT_TA_88424.pep
KLLTNMHITYGTATPTLQSIFLRNYLGSYYVVACIALVNFRSSFLTAKKLVGYFHALTRRQG

SEQ ID NO: 194007 - protein, 63 aa, Triticum aestivum
  unsure (1)..(63): unsure at all Xaa locations
  Clone ID: PAT_TA_88425.pep
MSKQGGKAKPLKQAKVAEKDYDENDLAYLQKKKDEQKALKELKAXAGQKGALGGSGLKKSGKK

SEQ ID NO: 194008 - protein, 57 aa, Triticum aestivum
  unsure (1)..(57): unsure at all Xaa locations
  Clone ID: PAT_TA_88426.pep
DTELYFFSYVFANLTVFNKASPFGTIKKIXWXVYIFXVQYILMPSIFNAPGSNFRST

SEQ ID NO: 194009 - protein, 113 aa, Triticum aestivum
  unsure (1)..(113): unsure at all Xaa locations
  Clone ID: PAT_TA_88427.pep
ANGKFPGETKLGFSFKSTQGTWFTPTYQWPDNSLSFGVAHAVAWKKSGLMMRPSTQVSVCPILGGSXIPGIRAEIVHSLKEESVXQCGXQCSXKPSXFXSLXIGXXXLTGNNS

SEQ ID NO: 194010 - protein, 114 aa, Triticum aestivum
  unsure (1)..(114): unsure at all Xaa locations
  Clone ID: PAT_TA_88428.pep
AERALPFFKILKKTGPMEWTPEAEAALQDLKKYLSSTLVLVAPKPXEPLLLYLAATNQVVSAALSGAERGQQRGSGSGRVNGWRTRNIPQVRAPVPARLIPGKSTQLQQGHTTG

SEQ ID NO: 194011 - protein, 70 aa, Triticum aestivum
  Clone ID: PAT_TA_88429.pep
LSLLRNFIYSIDDYYIANLVEYARYFYKYDLAMHLFFSNCSCSYFTYTSLDKIANSLGSQTTGNTPAMLS

SEQ ID NO: 194012 - protein, 109 aa, Triticum aestivum
  Clone ID: PAT_TA_88430.pep
VGKTKLPIPSAAFELRQIVTGFWSGGVIIDTGSPFTSLADAAYGPLRKELARQLNRSLMQPPADSGLDLCVARNDFDKLVPVMLFHFSGGADMAVPPGSYWGRWTIHAG

SEQ ID NO: 194013 - protein, 99 aa, Triticum aestivum
  Clone ID: PAT_TA_88431.pep
MENPYTTFLKNYHQRRYYFSPTLVPAPVASTTAPPPLSAYSSSPFFSPPPPPAPPPSPPLREALPLLSLAPASRRSRERRFGPGKDDSDDGDEDEGKQP

SEQ ID NO: 194014 - protein, 80 aa, Triticum aestivum
  Clone ID: PAT_TA_88432.pep
NNNCTIHYNESKLESNKKGNTFEFKSSNIRKISQLANSRGIIQILASGHSIIRVASDLTHGTATQKNYIRSALLTASLLV

SEQ ID NO: 194015 - protein, 126 aa, Triticum aestivum
  unsure (1)..(126): unsure at all Xaa locations
  Clone ID: PAT_TA_88433.pep
MADQLTDDQIAEFKEAFSLFDKDGDGCITTKELGTVMRSLGQEPXREAESKDMINEVHAEWXXTIDFPXEFLNLNGRKXKXNDQKXXSKELXVFDKGQKGSTLLLTPQSHDNSGKTHDKSGQISFH

SEQ ID NO: 194016 - protein, 82 aa, Triticum aestivum
  unsure (1)..(82): unsure at all Xaa locations
  Clone ID: PAT_TA_88434.pep
LQXQKDNHQSTIHSCILQRISNXRHPEKKALSVPLVHKNYTWFSVVTNPSYEIPXHKIXAIIPKISLSSPKXPVXVVXTRWG

SEQ ID NO: 194017 - protein, 97 aa, Triticum aestivum
  unsure (1)..(97): unsure at all Xaa locations
  Clone ID: PAT_TA_88435.pep
SITIFADYIVPAVLRELGILKYESNLCCSIDSNSEIVPGSEEEVEIRACSVHAVEKMRELINKNLGSXVLSIDIDSXVWSVSVQNMXLSHHEPLNYN

SEQ ID NO: 194018 - protein, 54 aa, Triticum aestivum
  Clone ID: PAT_TA_88436.pep
KVRPGNVAQASLQSVLPQLYLVYHHFILCPSLCGHTSISICASPPHLTVKHVAF

SEQ ID NO: 194019 - protein, 112 aa, Triticum aestivum
  unsure (1)..(112): unsure at all Xaa locations
  Clone ID: PAT_TA_88437.pep
FFKGKCVTSFELQYKILPCXLXMGKXCNLQRHPLLIINCGCVGTESRKYQMPLAPVSMTHKSRPISPRXSLQHGNPFVLPSYCPCCPLQRALLLAKPSRRLDLARVSLSFAD

SEQ ID NO: 194020 - protein, 118 aa, Triticum aestivum
  unsure (1)..(118): unsure at all Xaa locations
  Clone ID: PAT_TA_88438.pep
SSQLTSSGKSAHDALDSNNLNQFSLHGWASRPSLASPSXPXPCQPLPVGHXFSGXKSTRTTREEASSINSPAXGVQHRTQAAPTDREPHKAGKTQQNPXNKGAQGKQRNKDRAVXXFN

SEQ ID NO: 194021 - protein, 136 aa, Triticum aestivum
  unsure (1)..(136): unsure at all Xaa locations
  Clone ID: PAT_TA_88439.pep
TKQXXXTSXXCINTLHXCSMFKGXKAXAKXGKAXXXRXFGCRASXFMXXSXLRLGLYDNPDAIISGDVAXELLPPQATXTSXPTSSXXSXXSSXHLPTLXIXNXGRSCXKHVDTRXXVTAXQAXXXFXHLXPVXLP

SEQ ID NO: 194022 - protein, 95 aa, Triticum aestivum
  unsure (1)..(95): unsure at all Xaa locations
  Clone ID: PAT_TA_88440.pep
PXVPXGKRGVNAGLAWRRGPGAVTTGXLHDPRPGGHPAEQLALGEATAAVNVPEIGAQGRRVAGRRHGQQDREEENMQRTHVLQRAHTLTQFSTG

SEQ ID NO: 194023 - protein, 130 aa, Triticum aestivum
  unsure (1)..(130): unsure at all Xaa locations
  Clone ID: PAT_TA_88441.pep
LNPEIGDIDDNHVGIDVNSLASVESQTAGFYNFYGEFQTVVLRSGERIQAWVDYDSKLYQLNVTLAPCPSFKPQLPLLSTTVNLSSLLSLGPVYAGFSASSRXLLQHYVLGWSLKVDGVAXPLHNSCIVF

SEQ ID NO: 194024 - protein, 150 aa, Triticum aestivum
  unsure (1)..(150): unsure at all Xaa locations
  Clone ID: PAT_TA_88442.pep
MQIFVKTLTGKTITLEVESSDTIDNVKAKIQDKEGIPPDQQRLIFAGKQLEDGRTLADYNIQKESTLHLVLRLRGGMQXFVKNPNRQDITXEVEXSDTXDKSREXSRQGGIPPGQXRSXXXXNNFRTAHLXDXNSKGPTLVSAAWMKQNS

SEQ ID NO: 194025 - protein, 158 aa, Triticum aestivum
  unsure (1)..(158): unsure at all Xaa locations
  Clone ID: PAT_TA_88443.pep
NVKAKIQDKEGIPPDQQRLIFAGKQLEDGRTLADYNIQKESTLHLVLRLRGGMQIFVKTLTGKTINLEVESSDTIDNVKAKIXDKEGSSGPXTPIFAXKQLEDGRTSQTTTSXRXHLQLVVRLXXXXXXFXKTSLGKTYXEVEXPGHPKASKQGGIPR

SEQ ID NO: 194026 - protein, 143 aa, Triticum aestivum
  unsure (1)..(143): unsure at all Xaa locations
  Clone ID: PAT_TA_88444.pep
MQIFVKTLTGKTITLEVESSDTIDNVKAKIQXDKEGIPPDQQRLIFXAGKQLEDGRTLADYNIQKXPPSNWCSRLRGGAKEAQEEDLHQAKKQNITQEVNSPSSNSNKSTTLPAHQVKEGCPNDRDFMGNIHCHNAEIRLTSN

SEQ ID NO: 194027 - protein, 50 aa, Triticum aestivum
  unsure (1)..(50): unsure at all Xaa locations
  Clone ID: PAT_TA_88445.pep
GXSSLXHDXALKVNXCGAPTVSXPGRRTPCDRPXXDXMVCXISSCASLFS

SEQ ID NO: 194028 - protein, 117 aa, Triticum aestivum
  unsure (1)..(117): unsure at all Xaa locations
  Clone ID: PAT_TA_88446.pep
TTQRRPTSPAATTAPATHPSPPPLTRAVAPCAAXAAAKEGQPPPPQNVLYEQARHRRRLPRSRPVAVRLLPAQPSREPSEEDALNXGTAVXNRGXYIYSXVREQGEXHDIKLCNGHS

SEQ ID NO: 194029 - protein, 91 aa, Triticum aestivum
  unsure (1)..(91): unsure at all Xaa locations
  Clone ID: PAT_TA_88447.pep
MLVLICNLLLDYKLPSLHCAVRAAESKLQNPSFLALCREGSGKKVAKPPSKNGXIKRAFAQMDKLFTVTMXKLHPNAWRPELRETKKXKAL

SEQ ID NO: 194030 - protein, 97 aa, Triticum aestivum
  unsure (1)..(97): unsure at all Xaa locations
  Clone ID: PAT_TA_88448.pep
FTPHSPAKKPAVASRRGGAXGGXRAXXXLVTLCGXPRRRXSGXDXCVXPTXYGRXEHXREVEDXXITHHWVXHTVXMYLXIXSNXXLCRAXSYAXLS

SEQ ID NO: 194031 - protein, 38 aa, Triticum aestivum
  unsure (1)..(38): unsure at all Xaa locations
  Clone ID: PAT_TA_88449.pep
EXNEIXRAXCKXXPEXXAACEVWKAXKFEXEPXDSIXX

SEQ ID NO: 194032 - protein, 163 aa, Triticum aestivum
  unsure (1)..(163): unsure at all Xaa locations
  Clone ID: PAT_TA_88450.pep
DVRLSGDLELLSILANGLPVSEDVDMASVELLKAPPVPKKRIFLLVGVFSTGNNFKRRMALRRTWMQYESVRSGEVAVRFFTGXLHKSEQVNMELWREXNCMGDIQFKPFVXHYTLITLKTLQFCTLGTKIMPAKVHMKTDDXALLRIDESFQPEEGNPMAFF

SEQ ID NO: 194033 - protein, 155 aa, Triticum aestivum
  unsure (1)..(155): unsure at all Xaa locations
  Clone ID: PAT_TA_88451.pep
IMLNCDGRHVVGTAXRSERCDIGSEPRSYGNEYGIXAGSAXTGLSARRRLKRXCXRPHRFCRVRASRTCQVSRGMVYAMCSSSSRGSWRTSYRLRHDRLLNSAVSRPSRSWSAVRSDGGASCTKDQGESAEKTTTASTVAARTQTAGTKLLGRPG

SEQ ID NO: 194034 - protein, 133 aa, Triticum aestivum
  unsure (1)..(133): unsure at all Xaa locations
  Clone ID: PAT_TA_88452.pep
MAAKCYPTVSDEYLAAVAKAKRKLRGFIAEKNCAPLMLRLAWHSAGTFDVATKDRRAFGTMNAPXELAQXANAGLXIXVKLLQPSKXXPILSXADFNSRWILAFKATAGXSXFNPGKQDKPTLQKALLIYQGL

SEQ ID NO: 194035 - protein, 93 aa, Triticum aestivum
  unsure (1)..(93): unsure at all Xaa locations
  Clone ID: PAT_TA_88453.pep
PSPPPXPRPAGAPPGSRPEMPMPPPPPPPPPPEPPQXTAWSSSPSRPPTSPPRARPSPPSPTPTXPGAGAPAPPPHRGPPMVRRGEGQGDKRA

SEQ ID NO: 194036 - protein, 114 aa, Triticum aestivum
  unsure (1)..(114): unsure at all Xaa locations
  Clone ID: PAT_TA_88454.pep
GRHSRASSVSRFSGILRGGSGRKGGGGGDLKAVNAKGWPECSVIEEEGSYEGLSGGXSGLSGRCKLALAFVSFLLLFTVICLIXWGXARPXXPXXLVXVVXXYYIQSFIPLYLR

SEQ ID NO: 194037 - protein, 103 aa, Triticum aestivum
  unsure (1)..(103): unsure at all Xaa locations
  Clone ID: PAT_TA_88455.pep
ITQDLNLESGDMLDSLDNIQESKFLSSEIPRPLRLRWGEASDLIPPTHPNISDLSKINKSPMKQYIITRPDSSSVKNRLRDYREEDAISTSAIIARTXEYSTP

SEQ ID NO: 194038 - protein, 141 aa, Triticum aestivum
  unsure (1)..(141): unsure at all Xaa locations
  Clone ID: PAT_TA_88456.pep
MQIFVKTLTGKTITXEVESSDTIDNVKAKIXDKEGIPPDQQRLIFAGXQLEDGRTLAXDYNIQXXPTSTCVRLRGXAEKRKKKXYTKPKEAXXKHKKXXWLPPXLXVDEPXRQVTKXRXXAPNXNGGGDFMXTFDLRGHGH

SEQ ID NO: 194039 - protein, 122 aa, Triticum aestivum
  unsure (1)..(122): unsure at all Xaa locations
  Clone ID: PAT_TA_88457.pep
MLVTRIIILHRCSIGPRLVSWHNILSWLDSINVIQGRDVLRWNLMTLGSFTLDSTYRALTHFEVPVSNNKXIXKSKISVKVKISCDIFVGXVLTKDNLTXHNWQGSTKRCFCTHDEKTNTPF

SEQ ID NO: 194040 - protein, 78 aa, Triticum aestivum
  unsure (1)..(78): unsure at all Xaa locations
  Clone ID: PAT_TA_88458.pep
LNLPCYHMFPPPXLILPRNFPLPCSLFDSXILLSYSPAWVPVPRQTNLSGVMEIKRFFXVDIILXXIXFFXESNXXIH

SEQ ID NO: 194041 - protein, 115 aa, Triticum aestivum
  unsure (1)..(115): unsure at all Xaa locations
  Clone ID: PAT_TA_88459.pep
VGIPXPKXKXFHRFHIXTQAATGGAEPNLRPECNAGRGRGGERPAHPGGEELGRLRDREGEEPRDDWVVHHGGDHLQLQIGVDKAAAVAGMGAPPRTARPRTRVRGGRGGVRRVT

SEQ ID NO: 194042 - protein, 89 aa, Triticum aestivum
  unsure (1)..(89): unsure at all Xaa locations
  Clone ID: PAT_TA_88460.pep
MKFIAAYLLAYLSGNASPSAEDLTSILESVGCEIDNEKMELMLSQVKGKDITELLAAGXGEFAAVPSGGGGLAVSTAAPAAGRCCCPCS

SEQ ID NO: 194043 - protein, 44 aa, Triticum aestivum
  Clone ID: PAT_TA_88461.pep
IGCPRWMSNLVLKLLMRIYRVPNVNLSSMPQMHYQCWSATKNIA

SEQ ID NO: 194044 - protein, 147 aa, Triticum aestivum
  Clone ID: PAT_TA_88462.pep
CIVIPSQQVGVHPTPSLRSLADIISSCSRIWSILNSSDTMAWTIFLSVSWCRWAWPALLRRRGVTPARRRPDPEWLDLPQQDPGARQRGAAAATQGRGRGTEELGVQGRRGRAALDCRAGVVESRRSSPELATVAARRRERERRAGE

SEQ ID NO: 194045 - protein, 123 aa, Triticum aestivum
  Clone ID: PAT_TA_88463.pep
FLDLSNNQLFGDLPGCLWNLKELHSLDLSTNAFAGEVPTSTHYSSSLRSLHLSNNNFTGCFPAMLKNFKNIVILDLGNNKMFGALPPWDRGKQSFAENLGTVIKHVLWYPRQLLNCPNFKRLI

SEQ ID NO: 194046 - protein, 114 aa, Triticum aestivum
  unsure (1)..(114): unsure at all Xaa locations
  Clone ID: PAT_TA_88464.pep
VFFFFFFFFFFFLKKXQPLXQGLVYSDEEYTSYYXHNQYLRSPMYWAPVTILNIGLSRYSXTXSTFXPXSSLIDQSGXPWSLDRKRTHXXLKAMSPQCQXVXXLXLDAVGTSRT

SEQ ID NO: 194047 - protein, 118 aa, Triticum aestivum
  unsure (1)..(118): unsure at all Xaa locations
  Clone ID: PAT_TA_88465.pep
DIAGGEELSAPTAGVVRRHGRARGDRGNGQGLTRGRERSSVGSGKPLQRRIDDGDLRAPEMKTTTLRSTAASSGRVRRVCSSTGSGQSSGMHSGSEGVAGRGVSQRSGMAAXAXXGKR

SEQ ID NO: 194048 - protein, 134 aa, Triticum aestivum
  unsure (1)..(134): unsure at all Xaa locations
  Clone ID: PAT_TA_88466.pep
KDGAFERRFQQVFVAEPSVNDTVSILRGLKERYEGHHGVSIQDRALVVAAQLSSRYITERHLPDKAIDLIDEACASVRVQLXDSQPEEIDSLXRKKIQLKTFSFSQTKDKDKGNQDILRKSFTICPFGKTLAPS

SEQ ID NO: 194049 - protein, 91 aa, Triticum aestivum
  unsure (1)..(91): unsure at all Xaa locations
  Clone ID: PAT_TA_88467.pep
LRRRLSHPISSAPTSGARVPSPALRRQEGRFRQLKKFKQGERKTVCEHLCGHLSLRCCSFLSSWVPSGPSAXRHPKAALCSRSLLLSVXXP

SEQ ID NO: 194050 - protein, 97 aa, Triticum aestivum
  unsure (1)..(97): unsure at all Xaa locations
  Clone ID: PAT_TA_88468.pep
MXRTSSQSQSSVAGAAGASRPAXVGPRGTAAAXAGMRRRPXXXSSSXGAXXXGXXSGGGNNXLRFYTDXAPGLXLXPTMVLXMSVXFIXFXXSLQRL

SEQ ID NO: 194051 - protein, 124 aa, Triticum aestivum
  unsure (1)..(124): unsure at all Xaa locations
  Clone ID: PAT_TA_88469.pep
YLHGMDLNFTLAKALYASLFELLVXQINKAFLVGKRXVGWVNQFPPASAKWQKKATMDVLXALPSPSPHHLCHMQHLTYLLXARVGSSKENEIXDGGTEPACMXTMHKITXAAPRVDXXPPXMT

SEQ ID NO: 194052 - protein, 160 aa, Triticum aestivum
  unsure (1)..(160): unsure at all Xaa locations
  Clone ID: PAT_TA_88470.pep
MSPQTETKAGVGFKAGVKDYKLTYYTPEYETKDTDILAAFRVSPQPGVPPEEAGAAVAAESSTGXTWTTVWXTDGLTXLDRYKGRFXHIRAVSGKDXQWFCYVTYPLXLFXRGSVTNSLLPLXVRIWFKTLXRALXLEDLXPPTLSKTFQRPPQWYQFER

SEQ ID NO: 194053 - protein, 103 aa, Triticum aestivum
  unsure (1)..(103): unsure at all Xaa locations
  Clone ID: PAT_TA_88471.pep
RLLTRSKALALAAARADAXAPSPLAAAWGAXALSALXRDPXDASPASSXRXPEEVSPLGLSNILXYEXASXLGGTHXFPXWFSXGASNESSDXQTSXTVDGTI

SEQ ID NO: 194054 - protein, 138 aa, Triticum aestivum
  unsure (1)..(138): unsure at all Xaa locations
  Clone ID: PAT_TA_88472.pep
MAPTVMASSATSVAPFQGLKSTAGLPVSRRSNGASLGSVSNGGRIRCMQVWPIEGIKXFETLSYLPPLSTEALLKQVDYLIRFKWVLASSQQVGSXSVEHNATXGYYXWXFWTMWKLPILGALTHXVLTKXEEXKKTL

SEQ ID NO: 194055 - protein, 142 aa, Triticum aestivum
  unsure (1)..(142): unsure at all Xaa locations
  Clone ID: PAT_TA_88473.pep
MAALSSAAVSVPSFAAKAATPMRSSRMVVRASLGKKAASAAVAVAASAMXLGGSAMAQDVLLGANGXGVLGVPSPTNQRQXGETITSKNNPGXXANVVFDEXTXPSGVDSPRFPRGSTPKRTSQSPNPLRSTATAARAGWSE

SEQ ID NO: 194056 - protein, 80 aa, Triticum aestivum
  unsure (1)..(80): unsure at all Xaa locations
  Clone ID: PAT_TA_88474.pep
LACFPLARRSWRKPLGGRVQPWRARCCLQVWPRSYRLLAGAPPPRRDSGVKLRARTSFTGSSFKLAPQTQDLVXCCTCSF

SEQ ID NO: 194057 - protein, 150 aa, Triticum aestivum
  unsure (1)..(150): unsure at all Xaa locations
  Clone ID: PAT_TA_88475.pep
RGRAKAFGAPKLDAVYLVSVHKDLSVRNLISYVKDLAGPRSNVWXIGAXNACKSTLINAFAKKQGVXITRLTEPXXGTTFXHIKDDRFLPAKAKIYDXPGLLHHILFXLRLNXKERKMLEIKERLPARTSGLKAGHLPHWRVYPVYNFIQ

SEQ ID NO: 194058 - protein, 99 aa, Triticum aestivum
  unsure (1)..(99): unsure at all Xaa locations
  Clone ID: PAT_TA_88476.pep
SYSIDPHWYMDSGATEHLTSEMGKLHTREPYHGSDKIHTAXGAGMHISHIGQASLLTRHANRIFNFRNVLPSPSVTRXLLSVPKPLRDNMCFVNFNLIF

SEQ ID NO: 194059 - protein, 150 aa, Triticum aestivum
  unsure (1)..(150): unsure at all Xaa locations
  Clone ID: PAT_TA_88477.pep
MSPQTETKAGVGFKAGVKDYKLTYYTPEYETXDTDILAAFRVSPQPGVPPEEAGAAVAAEXSTGTWTTVWXTDGLTXLDRYKGRFFHIEPVPGXDSXVCYVTXPLDLFXXGSXPNKFTSXGXYVFCSKPTCXTFGGLTIPPTXNFPAAQG

SEQ ID NO: 194060 - protein, 115 aa, Triticum aestivum
  unsure (1)..(115): unsure at all Xaa locations
  Clone ID: PAT_TA_88478.pep
MAXSLQAAXXLMPAXIGGRXSSARXSXHVARAFGVDXGAXIICXLXSDIMEXSXNCAXAAXMAGFALAXSAXLVSXWVXGAXXEGVPNTXTFDXXHSXTYIGGXRYRXANHCXTN

SEQ ID NO: 194061 - protein, 152 aa, Triticum aestivum
  unsure (1)..(152): unsure at all Xaa locations
  Clone ID: PAT_TA_88479.pep
HRHAPDAAPPAEPLLAGAFAVGPPLLRRDRPRRGAHRPPRLAPRQDTLQPPDVAPQEHRRRPPXATPQATSVPLAPRRVGRRWATTSPSLGSGTPATPTPWSSDTGHRQVXXXPLRWCPXTGRPAVXNPARPQLKRXACXXXHXGTSRPHLT

SEQ ID NO: 194062 - protein, 96 aa, Triticum aestivum
  unsure (1)..(96): unsure at all Xaa locations
  Clone ID: PAT_TA_88480.pep
MAASLQAAATLMPAKIGGRASSARPSSHVARAFGVDAGARITCSLQSDIREVASKCADAAKMAGFALATSALLXVSGASAEGAPRXDFDEXQSKTT

SEQ ID NO: 194063 - protein, 93 aa, Triticum aestivum
  unsure (1)..(93): unsure at all Xaa locations
  Clone ID: PAT_TA_88481.pep
AWPPGKETDLCHQRGKGGSSPCLVMRKEVGLLQSWSINIHMLHYIRIIIPSLWYLCVRCQNTITCXYXQHEDLSPTEXXXSTTKKLLPNIIIL

SEQ ID NO: 194064 - protein, 129 aa, Triticum aestivum
  unsure (1)..(129): unsure at all Xaa locations
  Clone ID: PAT_TA_88482.pep
MAASMITSPIVAXTSLPSLSRRGSSFAVVCSGXKKIKVDKPLGLGGGLTVDIDXHGRKVGKKGVYQFVYKYGAHVHRDSPIYTPGRMAESGDRYAXXNDXVLILAVTLPGSSARLLLVYXTAXLPKKYL

SEQ ID NO: 194065 - protein, 148 aa, Triticum aestivum
  unsure (1)..(148): unsure at all Xaa locations
  Clone ID: PAT_TA_88483.pep
MGKIKIGINGFGRIGRLVAXRVALQSDDVELVAVNDPFITTEYMTYMFKYDTVHGHWKHSDIKLKDDKTLLFGEXKPVTVFGVRNPEEIPWGEAGADYVVESTGVFTDKDKAAAHLKGGAKXVVISXPSKDAPKFVVGVNEDKXTQTL

SEQ ID NO: 194066 - protein, 144 aa, Triticum aestivum
  unsure (1)..(144): unsure at all Xaa locations
  Clone ID: PAT_TA_88484.pep
QHQQAGGKQRKHNNQMATISAAAATTVVARAAIARPQALGLPQLRTRSERVRCSYSKDAKEATPAAGXCXGXAFPYSPRAGRGXRFRGAGAXAGRQADVDGGTGXSLGLNNNCWVGFSLASSAHLSSTRLXSRSTRXRFRXXPS

SEQ ID NO: 194067 - protein, 130 aa, Triticum aestivum
  unsure (1)..(130): unsure at all Xaa locations
  Clone ID: PAT_TA_88485.pep
MAASMITSPIVAPTSVPSLSRRGSSFAVVCSGGKKIKVDKPLGLGGGLTVDIDANGRKVGKKGVYQFVXKYGAHVDGYXPIYTPEEWPXLVTLXRXKNGXLXWGLTXPXPPGGGLSKFPPQKNTTKKVSA

SEQ ID NO: 194068 - protein, 149 aa, Triticum aestivum
  unsure (1)..(149): unsure at all Xaa locations
  Clone ID: PAT_TA_88486.pep
SIPPPPPQIRHRHHRPFPPPPWASAPPLPATTTTASPLLRRRPPPRRQRRLVSAAPQAXEDAAAEADYTSDLPEELLAVVFGLLGSGDRKRCSLVCRRWLATXASSRLRLALDARAPLLAAAPXILARFSAVSKLALNANAAPENVGDP

SEQ ID NO: 194069 - protein, 118 aa, Triticum aestivum
  unsure (1)..(118): unsure at all Xaa locations
  Clone ID: PAT_TA_88487.pep
RKFKXXWXIXXXIVVNQINRXTXXPNGXAXPVFNTRTVGRXVSXFXDPAMGKERLMEIPAARRXXCXKXRXXXVXFXKLSERERCYGERGRRQGFGCAALPPPSLYRGPGGGAPAPRD

SEQ ID NO: 194070 - protein, 83 aa, Triticum aestivum
  unsure (1)..(83): unsure at all Xaa locations
  Clone ID: PAT_TA_88488.pep
PPAPPWSPPSSAPXSASSXTTXAASPRPSPRRPPRSSSXCXSCPPTTTPPPSTRPRRRPARRPPTXSGSSTMFSASMPPSPSC

SEQ ID NO: 194071 - protein, 147 aa, Triticum aestivum
  unsure (1)..(147): unsure at all Xaa locations
  Clone ID: PAT_TA_88489.pep
NTGSIRRLLPSHGDRTGCRPAAPASRMLRRGAPAAHLPQGRGRIPCEEGREAAEPSPRRQARCIPASNPRAHDHDPALKPPAPAPAGRYRREGLXRRPPIXRRNKGGXRRTXWRKKGFGAPPGINGXLLRKPVXTSPLVTQXLXPLX

SEQ ID NO: 194072 - protein, 141 aa, Triticum aestivum
  unsure (1)..(141): unsure at all Xaa locations
  Clone ID: PAT_TA_88490.pep
ATSVASAPRPLRATPRRHPCAPCRHHYAAPPHALRRPRLAVSASSAEETSSASSSSSSRFYFNFTGFPFPLGPFLNRRTTRTEAVKGSVWLFEXEXALGSSSVSTNTRMTVVKXRSGXCGLHAPSAPTRNDPXLXXDXGPP

SEQ ID NO: 194073 - protein, 102 aa, Triticum aestivum
  unsure (1)..(102): unsure at all Xaa locations
  Clone ID: PAT_TA_88491.pep
QKLCQLLEEYTKVLIAVADNVGSKQLQEIRKGLRGDSIVLMGKNTLIRRCIKVHXEKTGNKDSXELKQPXSSGNVWLIFNKGDSRXXQEVPSKRFVSCSLFG

SEQ ID NO: 194074 - protein, 145 aa, Triticum aestivum
  unsure (1)..(145): unsure at all Xaa locations
  Clone ID: PAT_TA_88492.pep
MADVDVDTEVAAGAQPKKRTFRKFSYRGVDLDALLDMSTDDLVQMFPARARRRSKRGSKRKPXALVKKLRKGEKGPXAGEEPEQLRXHLRNMINCPLXIIGTLPXPKNXXTFNKFEIKPENXALLXXFQLLKAXXHGXPVPGXXX

SEQ ID NO: 194075 - protein, 136 aa, Triticum aestivum
  unsure (1)..(136): unsure at all Xaa locations
  Clone ID: PAT_TA_88493.pep
MQIFVKTLTGKTITLEVESSDTIDNVKAKIQXDKEGIPPGPSSVSSFAGKQLXDWRTFXDYNIQEGSISTLGSKSLGGMQXLVKNLNREDITLEVESSXHIXXVKXKFKDKXGSPRQHLIFXGTTQDWRTLRLKKK

SEQ ID NO: 194076 - protein, 131 aa, Triticum aestivum
  unsure (1)..(131): unsure at all Xaa locations
  Clone ID: PAT_TA_88494.pep
ATHTHTHASSQGEELPSARTLLASCAPPWRCLAASSSAKPPLRQVPCASPCRCPVPDLLRCPPPLPSSKRRRPLLRRRASSXRRXEHESVXARSSSLRPARRNAWLLXXAFRLCSSLKPLPSSXXSXAWLL

SEQ ID NO: 194077 - protein, 159 aa, Triticum aestivum
  unsure (1)..(159): unsure at all Xaa locations
  Clone ID: PAT_TA_88495.pep
THSMRARPCPPPPLSPSSSSSSSSCSLHAAAAAPGTSFSMPAPTIPPRSPTCSRXRPXXSXTASXATWRASATQSVPDDAXXQSWVRSTSPTXGXPSPGXSTTAPXLXDTRRLRXHGXALXTKQXPLRSSRASSXGAPXGHFWSLQARXFXRXNIRYXX

SEQ ID NO: 194078 - protein, 136 aa, Triticum aestivum
  unsure (1)..(136): unsure at all Xaa locations
  Clone ID: PAT_TA_88496.pep
MAPTVMASSATSVAPFQGLKSTAGLPVSRRSNGASLGSVSNGGRIRCMQVWPIEGIKXFETLSYLPPLNTEASSSKFDYLIXRFKWVPFLXXTKVGTSVKTNPWVLQCRTGNLELSEPTGLKVKRPNFEFNSQGMV

SEQ ID NO: 194079 - protein, 74 aa, Triticum aestivum
  unsure (1)..(74): unsure at all Xaa locations
  Clone ID: PAT_TA_88497.pep
STIYNNMFREGDKTKLEAILVHLGVQKPIAIPTXDWRFLXPVLFFQLSRXGFXFPLGFPGXPWTQXQIKGPLCL

SEQ ID NO: 194080 - protein, 106 aa, Triticum aestivum
  unsure (1)..(106): unsure at all Xaa locations
  Clone ID: PAT_TA_88498.pep
ARSIGVVIKPEVDQGARTIKGHEHARGPRATIGCCWSSQLSFRFRHGQFQDGDGESMHAACRSAXSRPRXXFXGGXXCSGXXTEXLSQIPXQSXYXXXGXEXEKRV

SEQ ID NO: 194081 - protein, 101 aa, Triticum aestivum
  unsure (1)..(101): unsure at all Xaa locations
  Clone ID: PAT_TA_88499.pep
EAEHYLXVLSFNHPVPKKXLELVNXXLKILXQYPCTQKTVRXLVYTYLLLAISLDQVKFSSHTNNMVPFKAHXTYKFELRYFYLVQAHKIPIRGSLLNVAV

SEQ ID NO: 194082 - protein, 66 aa, Triticum aestivum
  unsure (1)..(66): unsure at all Xaa locations
  Clone ID: PAT_TA_88500.pep
SMVCFXRLGXFYWTSXPRXXNFFEXXCPXSCXKKGKTLSSKVPIIKRQLPWRPLXFXNPEHLXXLN

SEQ ID NO: 194083 - protein, 152 aa, Triticum aestivum
  unsure (1)..(152): unsure at all Xaa locations
  Clone ID: PAT_TA_88501.pep
SDTIDNVKAKIQDKEGIPPDQQRLIFAGKQLEDGRTLADYNIQKESTLHLVLRLRGGMQIFCERPSPARPSTLEVGSSXDTIDNVEXXRFKDKXGFPPDQQRSSXAGKQLXGWRTXGGLQHLRRXNLHFXAXLRWWATPGHFGSSPLPLKDP

SEQ ID NO: 194084 - protein, 148 aa, Triticum aestivum
  unsure (1)..(148): unsure at all Xaa locations
  Clone ID: PAT_TA_88502.pep
KEYFLQKWKNEASRLQWRDKLIKSFTGAGKAKDLQQCNEVCLSHLLYICASLILLFFSLIFLPLLYDMKLFFPNATQSHXSFPGWDCCAHKSSCLDSKVRWEXAHTTRQXXHDDSKTSNDLGXILXKXYGIKHYETAYPTYGTIRXVR

SEQ ID NO: 194085 - protein, 45 aa, Triticum aestivum
  unsure (1)..(45): unsure at all Xaa locations
  Clone ID: PAT_TA_88503.pep
QTXLVWIVFQPLXTXSAVNXSRNYXXSHDXLIFKAKGXLRSFNEI

SEQ ID NO: 194086 - protein, 71 aa, Triticum aestivum
  unsure (1)..(71): unsure at all Xaa locations
  Clone ID: PAT_TA_88504.pep
KFQKPHPQLHFGLTKKDPGLVFHLDILDLFKCWSKLSLTRIQMSKTXKKIHIFKSAKHVLIQTCAHSNIIQ

SEQ ID NO: 194087 - protein, 148 aa, Triticum aestivum
  unsure (1)..(148): unsure at all Xaa locations
  Clone ID: PAT_TA_88505.pep
XRXNFAPTXLAXGPLXVTGEPEMATRMTPFQGXLLXLCFGKKTGKALXXXCRGQXFQXXGQARPVFXTXRVVAQYIGENSFAMDFCAHPEARAISPRDKSERPSAPLQTQAAQRDRVAAWRRCTMFHRRQSFGSIGNVEDTPVEFSVS

SEQ ID NO: 194088 - protein, 114 aa, Triticum aestivum
  unsure (1)..(114): unsure at all Xaa locations
  Clone ID: PAT_TA_88506.pep
HRNHHLWPLLHRAHAPLRARLCPATIAVDEARQPLVGNPPSRPLAPTRIRTTPQPSPPVSSSSPSHRGVPNPSPTSPTSWXAWTRLPLPLGATSACTLPTTKHCAHLNSASPIS

SEQ ID NO: 194089 - protein, 75 aa, Triticum aestivum
  Clone ID: PAT_TA_88507.pep
LVSSFFFFFFFFFLMSTIYVTLHVPVCRLSLSAALTNLFHTYYHRSITFFLSMTTIRKNIMVFPHCFTHTSLTLQ

SEQ ID NO: 194090 - protein, 103 aa, Triticum aestivum
  unsure (1)..(103): unsure at all Xaa locations
  Clone ID: PAT_TA_88508.pep
YHLQQHITCFCIICKPSATQVAXGGHXLRKNLXXDLXXVTNXRNKSGIPSSTGDXXQXXQIKTXEXNXIXQKTXXLKKXNRXXXFLGPNXWVXPLKXXLPWFF

SEQ ID NO: 194091 - protein, 105 aa, Triticum aestivum
  unsure (1)..(105): unsure at all Xaa locations
  Clone ID: PAT_TA_88509.pep
ETKAGVGFKAGVKDYKLTYYTPEYETKDTDILAAFRVSPQPGVPPEEAGAAVAAESSTGXTWTTVWTDGLTSLDRYKXRCYHIEXPVAGERQQWSVMLAYPLXLF

SEQ ID NO: 194092 - protein, 56 aa, Triticum aestivum
  Clone ID: PAT_TA_88510.pep
SEVLQTTSLMNMAQNIELVQNIVDQVSTVTVHKITQRERCSLTVVEVQQGEKVQQQ

SEQ ID NO: 194093 - protein, 159 aa, Triticum aestivum
  unsure (1)..(159): unsure at all Xaa locations
  Clone ID: PAT_TA_88511.pep
DSTPPAQPPSPSSAAPIAGDFQIRLPGRRTSRSTSVAVWRWLPPRPVLQNQEVVALQRPSLRSDIATPQPSRSRSPIQACLKNHNXASSRRXSKXIGKERHSXFXXMFLVLLNKFSXHXEPRKDFQLFXTIQXXRAGVNLGXKLVTYXVWLHIVNXIXX

SEQ ID NO: 194094 - protein, 122 aa, Triticum aestivum
  unsure (1)..(122): unsure at all Xaa locations
  Clone ID: PAT_TA_88512.pep
MADQLTDEQIAEFKEAFSLFDKDGDGCITTKELGTVMRSLGQEPXREAELQDMINEFDAXDGNXTSIPRFLNLMARKXKGHAPRXESRSFRVFDKTRSLGGGAGTTTPGLRQEVNIGKALTS

SEQ ID NO: 194095 - protein, 121 aa, Triticum aestivum
  unsure (1)..(121): unsure at all Xaa locations
  Clone ID: PAT_TA_88513.pep
ETLSYLPPLSTEALLKQVDYLIRSKWVPCLEFSKVGFVFREHNSSSGYYDGRYWTMWKLPMFGCTDATQVLNEVEEVKKXEYPDXYSASXGFDNLRQXVQCVSFIAFXATGCKXPARLNTI

SEQ ID NO: 194096 - protein, 67 aa, Triticum aestivum
  unsure (1)..(67): unsure at all Xaa locations
  Clone ID: PAT_TA_88514.pep
PSNQXLSYQDXLKHMXXQHHQEWVXLNAMMLYSLRRXXXPKTYWSXIXXAMDPLIPGSSRGSHNSKA

SEQ ID NO: 194097 - protein, 91 aa, Triticum aestivum
  unsure (1)..(91): unsure at all Xaa locations
  Clone ID: PAT_TA_88515.pep
QANIXPLRCKRTRPRQSQSFFTQGIGPVDLMPGRQILEKEPRRCRKCEMEHCLPVLIAYQRPAADLQPCVVAIGSGSSSISTEMCWQCHEA

SEQ ID NO: 194098 - protein, 116 aa, Triticum aestivum
  unsure (1)..(116): unsure at all Xaa locations
  Clone ID: PAT_TA_88516.pep
MSDTDEHHFESKADSGASKTYPQQAGAIRKGGHIVIKARPCKVVEVSTSKTGKHGHAKCHFXVAIDIFNGKKLXEDIVPSSHNCDVPHVDRQDYXLIDITDDGIXSFLTESGNTKG

SEQ ID NO: 194099 - protein, 57 aa, Triticum aestivum
  Clone ID: PAT_TA_88517.pep
NYHLSGPLCQNVNHSISALVLTLNFISSLILNYVLMYSMNVHQIPIFLHCSSDYVRL

SEQ ID NO: 194100 - protein, 141 aa, Triticum aestivum
  unsure (1)..(141): unsure at all Xaa locations
  Clone ID: PAT_TA_88518.pep
MQIFVKTLTGKTITLEVESSDTIDNVKAKIQDKEGIPPDQQRLIFAGKQLEDGRTLADYNIQKESTLQLXVLRLRWWMQXFXVXDLNRARXNLEVDXPXHLQVKVSSRQGGIPPTNXAYLPQATXXDGRNLXDXNPPVSLL

SEQ ID NO: 194101 - protein, 138 aa, Triticum aestivum
  unsure (1)..(138): unsure at all Xaa locations
  Clone ID: PAT_TA_88519.pep
FFSAHKIXLAMRSAXFRSEFXRAQLRDKKRRSITVEDMQPAAFRGLLHFIYXDSLPPMDELNDEEYEEMLRHLLVAADRYAMERMKLMCESKLCEVLCAETVATTLALADQHHCSQLKDACIEFMNSSNIICDVVASK

SEQ ID NO: 194102 - protein, 161 aa, Triticum aestivum
  unsure (1)..(161): unsure at all Xaa locations
  Clone ID: PAT_TA_88520.pep
XELNGPFXXXQYXWXNLXXIXPQRRATREGXVRXTXRXXHLALXPSPASLPASQTIVXASGPLSRMENSXLGHGHLNQNPDHLPKQSAAVIMSCAYCLAVVYGRETPRQQRRRGDGVLVCPPHPIIQRATKRGRHEEGQSDPGRREEPEPHAVEPSWQLAA

SEQ ID NO: 194103 - protein, 165 aa, Triticum aestivum
  unsure (1)..(165): unsure at all Xaa locations
  Clone ID: PAT_TA_88521.pep
SAHPCRRRMMLVYELMPNGSLQDALLGKRCPELVSEWPRRLAVARDVAAALHYLHFVVHPPVIHGDVKPSNVLLDSELRARLSDFGLARIKSEEEDELDSGVLGDNAVXNGNPSGGCHDDVXSXAGESMTAVXSEWGKTGANKXPEDDXGXTTASHAXADQLPDP

SEQ ID NO: 194104 - protein, 49 aa, Triticum aestivum
  unsure (1)..(49): unsure at all Xaa locations
  Clone ID: PAT_TA_88522.pep
XAXSXVELLGCPPLHAVGEARGLIIDLXLPXVASPLAPSASPENSSPTA

SEQ ID NO: 194105 - protein, 92 aa, Triticum aestivum
  unsure (1)..(92): unsure at all Xaa locations
  Clone ID: PAT_TA_88523.pep
XTCXPVNXXFLLKLSVHKLTXYTCTNYPFFLLFDDTSACLDSQRHQSPHPPTXTSMAASFRXTFSLXXSSQAXXHGIPKXHXXAASSNXSTX

SEQ ID NO: 194106 - protein, 108 aa, Triticum aestivum
  unsure (1)..(108): unsure at all Xaa locations
  Clone ID: PAT_TA_88524.pep
PEDHRSQRHPRRRQXKSFVAYDDELRXLRSQVGRLEEMLQRNRKDKAVHDAASRKLEQTRKALADAEATHASATNAVXRKEKEKKWLKFLIRDVCVCTAGGRLIGALL

SEQ ID NO: 194107 - protein, 157 aa, Triticum aestivum
  unsure (1)..(157): unsure at all Xaa locations
  Clone ID: PAT_TA_88525.pep
MSPQTETKAGVGFKAGVKDXKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMXTSIVXNVIXFKAYVLXFGGLRIPLXSKXXKGPXXGPSSPL

SEQ ID NO: 194108 - protein, 146 aa, Triticum aestivum
  unsure (1)..(146): unsure at all Xaa locations
  Clone ID: PAT_TA_88526.pep
MQIFVKTLTGKTITLEVESSDTIDNVKAKIQDKEGIPPDQQRLIFAGKQLEDGRTLADYNIQKESTLHLVLRLRGGMQIFVKTLTGKTINLEVESSDTIDNVKAKIXDKEGSSGQXRLIFAGKQLEDGATLXDYNIQKDQPQLSRS

SEQ ID NO: 194109 - protein, 53 aa, Triticum aestivum
  unsure (1)..(53): unsure at all Xaa locations
  Clone ID: PAT_TA_88527.pep
XPPPFLXIYTKIRTKXLXKSXTSRFXSXXHPNPLXXTLAXLASXPWAAPPRRR

SEQ ID NO: 194110 - protein, 59 aa, Triticum aestivum
  unsure (1)..(59): unsure at all Xaa locations
  Clone ID: PAT_TA_88528.pep
MAVTEXRCFVGGLAWATXDHNLHXAFSHYXDILXAXIIXDCXTXXXRGFCFVTLLLLAL

SEQ ID NO: 194111 - protein, 68 aa, Triticum aestivum
  unsure (1)..(68): unsure at all Xaa locations
  Clone ID: PAT_TA_88529.pep
SLEFFFFFFFFFFFFFFFFFFLFKQXYAHFGFXKHFFFKLATPECIKMSMNSIFTKFSQALDSSLPLG

SEQ ID NO: 194112 - protein, 98 aa, Triticum aestivum
  unsure (1)..(98): unsure at all Xaa locations
  Clone ID: PAT_TA_88530.pep
ESPPPLLSPSATPPSTRRPXPPSPPFPAPASLXSPPPSXPLDPVAPAPLPPXPRRHLPPTPVGSANFPDCAASLDPMPSWAAXTSPSSPSSSPMGHTN

SEQ ID NO: 194113 - protein, 105 aa, Triticum aestivum
  unsure (1)..(105): unsure at all Xaa locations
  Clone ID: PAT_TA_88531.pep
YLRLLRFXLHRDIYSVRFXPXIKLNRCIIPINIECRSAXSQXRCHTYKYPWKHTDFFHEFYLFSCLDIIYVLVLSIFLELFLLKSNGSSVVVNRGLLPNLSKTLS

SEQ ID NO: 194114 - protein, 123 aa, Triticum aestivum
  unsure (1)..(123): unsure at all Xaa locations
  Clone ID: PAT_TA_88532.pep
MVSAGGHGGYSDADDAVDFRGNPVDKSKTGGWLGAGLILGTELAERVCVMGISMNLVTYLVGELHLSNAKSATIVTNFMGTLNLLGIVGGFLADAKLGGTHIAVSGTXAAASXSLLAVDTWRR

SEQ ID NO: 194115 - protein, 139 aa, Triticum aestivum
  unsure (1)..(139): unsure at all Xaa locations
  Clone ID: PAT_TA_88533.pep
MPALYTLLLLLLVSSFHAPPCSSTTSHDTLTAGQTLAVGDKLVSSNGKFALGFFQPAARTTISKSDTTTSPNWYLGIWFDKIPVFTTVWVGNREKXIPGPELHLTHLKISSDGNLAIVXHAGTESVLWSTHIINRTQTT

SEQ ID NO: 194116 - protein, 94 aa, Triticum aestivum
  Clone ID: PAT_TA_88534.pep
DVPPWSSCRGAEERGRGQGGRAAGTGRRCFRDRASRKSCSGGGGYDDGRAWAAAPSQEQKGDSHCFKIRSSRCQALERVSRLRAYDQVRIRFLP

SEQ ID NO: 194117 - protein, 136 aa, Triticum aestivum
  unsure (1)..(136): unsure at all Xaa locations
  Clone ID: PAT_TA_88535.pep
SCRNDPARNPDFYNWNRVKLRYCDGGSFAGDSEFTNGSSVIYMRGQRIWDAIIADLLTKGLAKAKKVLLSGCSAGGXATFFHCDDSGEFSGGVXTVKCMNDPGFXLMWDXISXNNXIRXFFNNLILLKERKFYKDV

SEQ ID NO: 194118 - protein, 90 aa, Triticum aestivum
  Clone ID: PAT_TA_88536.pep
GSFMLLPPRAPPKRRKEWRELKFRPFFSWMVSEVLQSFICRIAPPFLFFTALCAWLGSSYLKYFPVSYVLYTPVLLPQVPFALSCWFSSL

SEQ ID NO: 194119 - protein, 166 aa, Triticum aestivum
  unsure (1)..(166): unsure at all Xaa locations
  Clone ID: PAT_TA_88537.pep
APGSLDIIVGFIINNKTLHANFPSCPEATPSGWRSRAPTQPADSVSAPGRALRPSAGGLRVHAQRPRHHRRLLQQRQDPPRNFSKLPGGXEATPSGCARMPPPETRRACCTPVAGCXRHLLLHRRPLKTSAQLFKLPGGQKLCXGDXNGXAXMXXLQXIGTTXPHX

SEQ ID NO: 194120 - protein, 81 aa, Triticum aestivum
  unsure (1)..(81): unsure at all Xaa locations
  Clone ID: PAT_TA_88538.pep
QXCPFPXIIAXXXKPPFAAGXLXAKXARETRCLXWRGGARGRDQAERPAPWIRPAGSSGAQIRGAARRLRRGRGLGSGSEA

SEQ ID NO: 194121 - protein, 112 aa, Triticum aestivum
  unsure (1)..(112): unsure at all Xaa locations
  Clone ID: PAT_TA_88539.pep
DKSLTHFSIRKSSRCSCFENIRMMFAYDDVKGFITNIHANTLNTEHIYSNFINKFLIFLQHYMFVLYAVHFHVMSCLSLHYIYMMVMLECLCRLWATELGDGYVITVGRCQX

SEQ ID NO: 194122 - protein, 142 aa, Triticum aestivum
  unsure (1)..(142): unsure at all Xaa locations
  Clone ID: PAT_TA_88540.pep
MAAATMALSSPAMAGTPVKASRAAPFGEGRITMRKTAGKPKVAASSSPWYGSDRVLYLGPLSGDPPSYLTGXFPGDYGWDTRALRRPRDFAKNRXWGXSLPLAIWAPSXXFPRTAARNXSXRXGFXLKAVQYSRLNTSEPTW

SEQ ID NO: 194123 - protein, 126 aa, Triticum aestivum
  unsure (1)..(126): unsure at all Xaa locations
  Clone ID: PAT_TA_88541.pep
PARRPSRPSPSSPTSSPPLIPTPSAPSSLASASPAPMSPPSSQRTRSYSAPAWRRSWPVTSTSXPASASRVTTSSGSSRSRPAAAISAAEPSSPSCSTTCPSSAPPRTPPGLTAFLPHRRRHREDD

SEQ ID NO: 194124 - protein, 99 aa, Triticum aestivum
  unsure (1)..(99): unsure at all Xaa locations
  Clone ID: PAT_TA_88542.pep
MILGXXXFRXXXGDLFKKFXFXNFXHDKCVDXXIXSLTCVFLYAMXSLKGCLPCIFVIFVVTSTSLQSSVIVDADFRDFEFHYVLVLFFVVMPYVHVVS

SEQ ID NO: 194125 - protein, 163 aa, Triticum aestivum
  unsure (1)..(163): unsure at all Xaa locations
  Clone ID: PAT_TA_88543.pep
QDHLTSKTFLLLPLPLFHRLAIHEHRQLQFRRAEVRGQACWLRRRLWPEERTLQLQGEGGGGRERGCPLAEQRRLLQGAVPGSTRRTXGAEEVKRAYRRLGAAYHRTCARRRAGPIHGVFXRLXRAYESSPDLPQXAIHLNSRRAGSARRRENGSPKDFWKPX

SEQ ID NO: 194126 - protein, 151 aa, Triticum aestivum
  unsure (1)..(151): unsure at all Xaa locations
  Clone ID: PAT_TA_88544.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLXPANGVNSGEAFLFKGRSQISSEGGSILXNPTS

SEQ ID NO: 194127 - protein, 80 aa, Triticum aestivum
  unsure (1)..(80): unsure at all Xaa locations
  Clone ID: PAT_TA_88545.pep
RPTVFGKSYYXKLLDFXNDCEGLGTLHQGEXGSLXEVXSGTLEXLEYLAQFYDVPTGERNYGISSPPSKEDRVPSYTVRR

SEQ ID NO: 194128 - protein, 51 aa, Triticum aestivum
  Clone ID: PAT_TA_88546.pep
DEPSCPHNLVLLTCTLTQIPGIGVDELNLQSLIELCLSCVPTVQMGRTLIS

SEQ ID NO: 194129 - protein, 67 aa, Triticum aestivum
  unsure (1)..(67): unsure at all Xaa locations
  Clone ID: PAT_TA_88547.pep
MAMXSXALXSGLSLLHAKPAXTSLPRPHPFFPIHGRRXSVAVACTSTAAASPXVLXLGDAIXGLNLX

SEQ ID NO: 194130 - protein, 109 aa, Triticum aestivum
  unsure (1)..(109): unsure at all Xaa locations
  Clone ID: PAT_TA_88548.pep
MQIFVKTLTGKTITLEVESSDTIDNVKAKIQDKEGIPPDQQRLIFAGKQXEDGXTLADYNIQKXXTLHLGVRLRGGAKXRKKKLHQSPKKQKHXHKKTRFNFYKVDPPK

SEQ ID NO: 194131 - protein, 128 aa, Triticum aestivum
  unsure (1)..(128): unsure at all Xaa locations
  Clone ID: PAT_TA_88549.pep
DYFRQHGGLILFDEMRSKQGISFKIFTEEELQEATNRFSEQQVLGQGGYGTVYKGILEGNVEVAVKRCKTADEQQKKEXGKEMLILSEVNHRNIVKXLGCCLQSGIPMLVYEFLPKWXLXQLIHGNHG

SEQ ID NO: 194132 - protein, 149 aa, Triticum aestivum
  unsure (1)..(149): unsure at all Xaa locations
  Clone ID: PAT_TA_88550.pep
MSPQTETKAGVGFKAGVKDYKLTYYTPEYETKDTDILAAFRVSPQPGVPPEEAGAAVAAEXSTGTWTTVWDXWTYHLDRYKGRCYHIRPVAGKDNQWFGXTYPLNLFEEGXLTNMFTPLXVTIGSKPKCXTLEXXRIPLLIKNFQGPPR

SEQ ID NO: 194133 - protein, 159 aa, Triticum aestivum
  unsure (1)..(159): unsure at all Xaa locations
  Clone ID: PAT_TA_88551.pep
RGKVSMASRCRGGSTVARRICSQQRPASLASARLRSSRFGLHPISSSPGRYSHQWAGPPPAAVHCLSRAPVLQDRARPVPDAAGPSSSRAWCSRTDLVPLSGAARPXSSRARGCKMGXWMHFGRFIXFDAXVPQGRRKWNFPLVSSLGCDXLGEWFQAW

SEQ ID NO: 194134 - protein, 69 aa, Triticum aestivum
  Clone ID: PAT_TA_88552.pep
ICFPFPLSEISARACTPQLPPKSSPPSRSVAGLIQEGILGGRRSSLWVLCSRSSSNMSLLSNYGWALWM

SEQ ID NO: 194135 - protein, 104 aa, Triticum aestivum
  unsure (1)..(104): unsure at all Xaa locations
  Clone ID: PAT_TA_88553.pep
RKGGHIVIKARPCKVVEVSTSKTGKHGHAKCHFVAIDIFNGKKLEDIVPSSHNCDVPHVDRQDYQXLIDITDDGYVSLLTESGNTKDDLXLPTDDVLLGQXKRC

SEQ ID NO: 194136 - protein, 75 aa, Triticum aestivum; identical to SEQ ID NO: 106874
  Clone ID: PAT_TA_88554.pep

SEQ ID NO: 194137 - protein, 155 aa, Triticum aestivum
  unsure (1)..(155): unsure at all Xaa locations
  Clone ID: PAT_TA_88555.pep
XHQRXXATKDXIHPKSPRKDTQEVRTPEAVSLXPGKXWVSPGLTSWLEGGGEGGTWTXLTRRYGALGRRRRRASIAGLGFSRSQPPTSSSPKRYNSGDKGRPKQDHSRQPLVEVDGGLQIWIGRRRDARTTAATCRRLAAPAAEEERPAPTSTGH

SEQ ID NO: 194138 - protein, 143 aa, Triticum aestivum
  unsure (1)..(143): unsure at all Xaa locations
  Clone ID: PAT_TA_88556.pep
HSASRRRRRATSAPPRLRTQAAAPSPVPVAPPLEPPAGPLPLVLLPAPIPPSREPXPPPSPTRPPPRSPSWRRTRPPRDSAPPRRRTQAAAPSPVPVATPLEMPAGALPSTEDWVKPLRAEAWVQAVVLFFLAVFSAPSSGPK

SEQ ID NO: 194139 - protein, 58 aa, Triticum aestivum
  Clone ID: PAT_TA_88557.pep
DQQLHGSIRSYVAIAISIGSVSLSGRRFGVRLRTYVRVVNHQRNGGRAMVLVLVIVIV

SEQ ID NO: 194140 - protein, 131 aa, Triticum aestivum
  unsure (1)..(131): unsure at all Xaa locations
  Clone ID: PAT_TA_88558.pep
MARGLKKHLKRLNAPSHWMLDKLXGGAFAPKPSSXGPHKAREXCLPLILILRNRLKYALTYREVQSILMQRHIXXDGKXRTDKTYPAGFKDTFPFPRRVKNYRFLYDTKXXFRLNPSRMRMLIQTLKSLQF

SEQ ID NO: 194141 - protein, 135 aa, Triticum aestivum
  unsure (1)..(135): unsure at all Xaa locations
  Clone ID: PAT_TA_88559.pep
MAMAASWWALLMAVVXAAAAGCGEAAXTAAAXAAHDXLQSHGLPRGXLPAGIXAFTHDPAXGRFXAVLESPCTGRTXVXLRYNXXVAGQXTXGRIXELSGVDVQDLXXWFAVXSIRVDXPSSGXIYFNSXASTTP

SEQ ID NO: 194142 - protein, 122 aa, Triticum aestivum
  unsure (1)..(122): unsure at all Xaa locations
  Clone ID: PAT_TA_88560.pep
MARLNSKAVAAAVVLAAVVLMMAGREASAALSCGQVDSKLAPCVXXERGXASSXLSKECCSGVQGLNGLXRSNPDAKIRASPQELANNNKSNNMGKXPGLPXSXLSVPFPSXXSTNCNNSTN

SEQ ID NO: 194143 - protein, 60 aa, Triticum aestivum
  unsure (1)..(60): unsure at all Xaa locations
  Clone ID: PAT_TA_88561.pep
AXASXVXVVSNAXPPKXKRXRXPXXGXAXIEPXDRPGRSPXHSLSPNQPRSDRSRRREEN

SEQ ID NO: 194144 - protein, 94 aa, Triticum aestivum
  unsure (1)..(94): unsure at all Xaa locations
  Clone ID: PAT_TA_88562.pep
SMMYSSTYDEVKFICKLECTVLCHRPPQHIASSSSLPIHLLLLVKLQQTGSCCFHADEGCKTNLKECXCLRKXILLGASLLSGDQXCLPXRFYX

SEQ ID NO: 194145 - protein, 100 aa, Triticum aestivum
  unsure (1)..(100): unsure at all Xaa locations
  Clone ID: PAT_TA_88563.pep
XXXLGLGXIQYXSVNYSLLXEXXXFFARVVCQFEPXTQDLXRDRFVFTIVXHQSLRQPIEGSRQSLVFILWLAIHAYLTVLKLKPLRALLLKGLGSALVF

SEQ ID NO: 194146 - protein, 110 aa, Triticum aestivum
  unsure (1)..(110): unsure at all Xaa locations
  Clone ID: PAT_TA_88564.pep
RFRAPAXPPHXRISTASPPKPPPPTMXPPPSKPYCCSSXTPPLPTPSPGALPSPPSPXXSPXASPMASPXXPXTLXXPXPPSSXPSAXAWCGGRSTSRESTQLRSHLRQH

SEQ ID NO: 194147 - protein, 81 aa, Triticum aestivum
  unsure (1)..(81): unsure at all Xaa locations
  Clone ID: PAT_TA_88565.pep
LIETIQHLSLVRIPXLGSYLPTSSDFYLVPFPGIRPDYFLFLPWVLSREWTTKRSKRYPDRKRKTQSKREXLHXTQTXPAN

SEQ ID NO: 194148 - protein, 71 aa, Triticum aestivum
  unsure (1)..(71): unsure at all Xaa locations
  Clone ID: PAT_TA_88566.pep
ILDLGEEXPPIFILLQYYHSFFHYSQEILQCPXLCSLRVILRNIWLETPWRCLVINLHFLCALVINHGRGR

SEQ ID NO: 194149 - protein, 113 aa, Triticum aestivum
  unsure (1)..(113): unsure at all Xaa locations
  Clone ID: PAT_TA_88567.pep
MAALSSAAVSVPSFAAKAATPMRSSRMVVRASLGKKAASAAXVAVAASAMXLGGSAMAQDVLLGANGGVLVSEPXELSVXSGETSLRKPRFRKVVFKLAFVDSPNQEGSPESI

SEQ ID NO: 194150 - protein, 150 aa, Triticum aestivum
  unsure (1)..(150): unsure at all Xaa locations
  Clone ID: PAT_TA_88568.pep
MAPTVMASSATSVAPFQGLKSTAGLPVSRRSNGASLGSVSNGGRIRCMQVWPIEGIKXFETLSYLPPLSTEASSSRSDYLIRSKWVPCLRXSKLGXLPXEHNAPLGYYDCRYWDMLKLPXFGXTDAPSLXXLKXVKEXXLNLIPTIGTRK

SEQ ID NO: 194151 - protein, 73 aa, Triticum aestivum
  unsure (1)..(73): unsure at all Xaa locations
  Clone ID: PAT_TA_88569.pep
PPVDSSFRXSSRRGSTPGCGGEEGPEEGVVALVGTSGKEEGGGRGRRDAAAGGYPDEQQGGMGAALSSEGGRR

SEQ ID NO: 194152 - protein, 77 aa, Triticum aestivum
  unsure (1)..(77): unsure at all Xaa locations
  Clone ID: PAT_TA_88570.pep
REILAPLFTQDESXVDGSLLPWTWTRIPSQSLLRAISIVVFQEVQKAGQRPSLLIFPYLNSSWRERGSAKHLRKENN

SEQ ID NO: 194153 - protein, 99 aa, Triticum aestivum
  unsure (1)..(99): unsure at all Xaa locations
  Clone ID: PAT_TA_88571.pep
AFNNWPLNQAVXKXGGGNSVGRHLLSTHCPTPNANVQPAPPPPGPGGRLHRHRRIGERVVGVEPREVDGVRPKRGHVAEVAVKQQPRPFLAALHRLLIA

SEQ ID NO: 194154 - protein, 73 aa, Triticum aestivum
  unsure (1)..(73): unsure at all Xaa locations
  Clone ID: PAT_TA_88572.pep
NKSGGNXXIXNPFSLGKXIXYCVALLFILCRNFGGTICLTPKQNIVAQFLEHSSYYSRFLDETNFRLKVDKKR

SEQ ID NO: 194155 - protein, 134 aa, Triticum aestivum
  unsure (1)..(134): unsure at all Xaa locations
  Clone ID: PAT_TA_88573.pep
MAPTVMASSATSVAPFQGLKSTAGLPVSRRSNGASLGSVSNGGRIRCMXVWPIXGIKNSETLSYXLPPLSTEASIQAVHYXXRSKWVPCLRXNKLVHFPLTQPPLGTNMADWNVELPISVHRPNKYTVGVKKDT

SEQ ID NO: 194156 - protein, 152 aa, Triticum aestivum
  unsure (1)..(152): unsure at all Xaa locations
  Clone ID: PAT_TA_88574.pep
MASTSCFLHQSTARLAASARPAPAVGRTQLFVCKAQKNDEXAASDAAVXVTSRRAALSLLAGAAAIAVKXSPAAAAYGEAATCFXKAKXKNTDFXALHAKGFKLMIPXQSXNPNKDXFPWASVRYXDTXKQQTLSVFINPLQEDITISLILS

SEQ ID NO: 194157 - protein, 116 aa, Triticum aestivum
  unsure (1)..(116): unsure at all Xaa locations
  Clone ID: PAT_TA_88575.pep
LRLNLXLTQVVQVSSNNITIXGINHHSSSLTMPYRTYSSRXGXRDKHXSTQDNDFPGFLXSMHEELTXMIQSTSASFLITXQPKVYSCTXLTXXTXXAYPXKWXCFLSXXHXXYYX

SEQ ID NO: 194158 - protein, 86 aa, Triticum aestivum
  unsure (1)..(86): unsure at all Xaa locations
  Clone ID: PAT_TA_88576.pep
KTLLSVCKIHRDVEVAELAAGNVLLLDPEDSSVYILLSNVYAESGKWADVSXRTRRLMKHGXRLKKEPGCSWXEVQNEMHGFLGRR

SEQ ID NO: 194159 - protein, 56 aa, Triticum aestivum
  unsure (1)..(56): unsure at all Xaa locations
  Clone ID: PAT_TA_88577.pep
PFAPPCPRXXXFSQPXRXRPCPPVXXVCVRPXVXSFALSNCVCCVGKWISPLALAL

SEQ ID NO: 194160 - protein, 125 aa, Triticum aestivum
  unsure (1)..(125): unsure at all Xaa locations
  Clone ID: PAT_TA_88578.pep
MASTSCFLHQSTARLAASARPAPAVGRTQLFVCKAQXSDKAASDAAVVTSRRAALSLLAGAAAFXXKVSPAXAXYGKTXKXSXRXKKTRFWGVKRXGXKLISGXWXPXRTFLGKFLQEFNPQLPL

SEQ ID NO: 194161 - protein, 111 aa, Triticum aestivum
  unsure (1)..(111): unsure at all Xaa locations
  Clone ID: PAT_TA_88579.pep
VXFXXVLYNPXWXXLXEGLPRLKNPXXRFXXLSPPXLXTVRVXRRYIRDKPSCPXSMTLDMACDTDRPRSPATAGTGTGAGASASDPAGTVAAGFPDIESVLWRETMEGLX

SEQ ID NO: 194162 - protein, 108 aa, Triticum aestivum
  unsure (1)..(108): unsure at all Xaa locations
  Clone ID: PAT_TA_88580.pep
MGKEKTHINIVVIGHVDSGKSTTTGHLIYKLGGIDKRVIXRFXKEAAEMNKRSFKYAWVLDKLXAERERGITIDIALWKFETTKYYCTVIDAPGXRDFIKNMITGTPS

SEQ ID NO: 194163 - protein, 97 aa, Triticum aestivum
  unsure (1)..(97): unsure at all Xaa locations
  Clone ID: PAT_TA_88581.pep
RVLKVLGGXIPSSLXAFXRRXGVFKALAXGAAXVXIGRPLLFSLALPGEAGVSNVLKMLRDEFELTMALSGCNSLADITRNHVVTEADKFGVMPSRL

SEQ ID NO: 194164 - protein, 103 aa, Triticum aestivum
  unsure (1)..(103): unsure at all Xaa locations
  Clone ID: PAT_TA_88582.pep
SSSWSLLEVKXCKVLXQGXFRWSFPNRTKIQQSXXXQGAWXMQXFGGXCSRXNFPRFXPXXXKXPXKXFXGGXIKXSQXKVXXXPPQXKXGGXSFFXXXXWGS

SEQ ID NO: 194165 - protein, 63 aa, Triticum aestivum
  unsure (1)..(63): unsure at all Xaa locations
  Clone ID: PAT_TA_88583.pep
FRSRPRPSRSCSRPRARARPARGPSRPPAVRPPASIAWXSFPRXSHRRPPMRRRGRSASARLV

SEQ ID NO: 194166 - protein, 82 aa, Triticum aestivum
  unsure (1)..(82): unsure at all Xaa locations
  Clone ID: PAT_TA_88584.pep
GLXHHPCRCXRGDRRVQGRGGVARAALLEDGXNGATSGLRRRTTGDQFXCTTKRNTTVTRAXAPLNIAXTELPVMTXXKXTA

SEQ ID NO: 194167 - protein, 78 aa, Triticum aestivum
  unsure (1)..(78): unsure at all Xaa locations
  Clone ID: PAT_TA_88585.pep
DLSTGEDLRVTPEAFDAVTPAAIDESRVAVATIRQKSVXTDVRTEXQYRXIEILXXIFXXXHLKXPGXXAPKGXKKNP

SEQ ID NO: 194168 - protein, 62 aa, Triticum aestivum
  unsure (1)..(62): unsure at all Xaa locations
  Clone ID: PAT_TA_88586.pep
PKLAVFATFXXKLXIFLKKXNLXGGACQCKHSPQRVASAVDIFSLLCCKLVQCLSCRASLFS

SEQ ID NO: 194169 - protein, 85 aa, Triticum aestivum
  unsure (1)..(85): unsure at all Xaa locations
  Clone ID: PAT_TA_88587.pep
FRKNRFLNATWTDPRRNLRCLKGAMLQQQNGGXPXFPVPRXFSNFQFQFPXKKXVIPKKDIWNCFXGHIXXXGLXXFHXKXXRXP

SEQ ID NO: 194170 - protein, 72 aa, Triticum aestivum
  unsure (1)..(72): unsure at all Xaa locations
  Clone ID: PAT_TA_88588.pep
CIHHNMXITLSXXDLMACXXFMCGXGCDGGYPITXWQYFVXXGVVTDXCXPYFDXVXCKHPEFQXAKPTPVC

SEQ ID NO: 194171 - protein, 105 aa, Triticum aestivum
  unsure (1)..(105): unsure at all Xaa locations
  Clone ID: PAT_TA_88589.pep
GVXPVAPGGXXVXHIPAFSRXFXXXSVXXXGXGTFXIPWGNXPGAXXXXVALEXCVQARXEGXDLAREGNXIIRAVCKWXPXXSXXXEVWKAIXFEFEPVDTXXK

SEQ ID NO: 194172 - protein, 110 aa, Triticum aestivum
  unsure (1)..(110): unsure at all Xaa locations
  Clone ID: PAT_TA_88590.pep
MAAKEPMRVLVTGAAGQIGYALVPMIARGVMLGXANQPVILHMLDIEXAAEALKGVKWXLFNAAFPLSXGIXLQQLMXFXACTGVKXSGXGWGGSPRKEGWKEGXFXKNV

SEQ ID NO: 194173 - protein, 164 aa, Triticum aestivum
  unsure (1)..(164): unsure at all Xaa locations
  Clone ID: PAT_TA_88591.pep
ASPGARWLSQTSTTASTLQRVLRPSRRPRPGWPPPASAPPPPATTRCSARSWTSTAASTPSSDSPRLSQGPRQSRPPRPRRLPXTTSCSVPCPWSXKISXPPLPAGKKIASGQATGXQGQYQSIYPSXIXYVNICFQXNVXRXLISRLXANKLXXLXKFTERKM

SEQ ID NO: 194174 - protein, 79 aa, Triticum aestivum
  unsure (1)..(79): unsure at all Xaa locations
  Clone ID: PAT_TA_88592.pep
PRXXQMLGFENGPLKSGNXRXXREXKESPGKARLXSSXCFRXEPGNFGSHFSXGNLXXNXLLAXPRVRGAAGSGGECTG

SEQ ID NO: 194175 - protein, 94 aa, Triticum aestivum
  unsure (1)..(94): unsure at all Xaa locations
  Clone ID: PAT_TA_88593.pep
HLYWVXAGLGRGLLLXLXLMRPTTXQRMQAMRRARASXWTXNGGRDEEGGDENSXRNKPEHAFSHDASVITTRTGASGALWHGRPCPVDVPWCP

SEQ ID NO: 194176 - protein, 165 aa, Triticum aestivum
  unsure (1)..(165): unsure at all Xaa locations
  Clone ID: PAT_TA_88594.pep
LEVESSDTIDNVKAKIXDKEDISLDQQRLIFAGKQLEDGCTFADYNIQKESTLHLVLRLRGGMQIFVKTLTGKTITLEVESSDTIDNVKAKIQDKEGIPPDQQRLIFAGKQLEDGRTLADYNIQKESTFXLVLRLRGGMQISQDLTARHHVGVESWTHRQREARS

SEQ ID NO: 194177 - protein, 163 aa, Triticum aestivum
  unsure (1)..(163): unsure at all Xaa locations
  Clone ID: PAT_TA_88595.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNXVXEXXKEYXPYVRVIGSQPAXVQCVTHRRHG

SEQ ID NO: 194178 - protein, 140 aa, Triticum aestivum
  unsure (1)..(140): unsure at all Xaa locations
  Clone ID: PAT_TA_88596.pep
KESVLKTVNLANGEAYIGPFSFTECSQRKRLRLTARVKRQDLSIRVQEAISDPFVVKVGRSKQNRKSYPPSKEEAVYRLEKISLKGKHCTLLAEKILLRXEXIQRHYYRDESWSQKXXDMXEDXSTLINMQHILAEINWC

SEQ ID NO: 194179 - protein, 57 aa, Triticum aestivum
  unsure (1)..(57): unsure at all Xaa locations
  Clone ID: PAT_TA_88597.pep
XLCPXXGCSRXXKXFACVRVLAWLLEGGERRVADGRNPQMRRCPRATAKENSGRRIS

SEQ ID NO: 194180 - protein, 98 aa, Triticum aestivum
  unsure (1)..(98): unsure at all Xaa locations
  Clone ID: PAT_TA_88598.pep
LEIDXTSKIKTILFSAIYHWIAPVLTLSLFTSDIWFDLKNAGKVDERGICGSPSKRLQNLGGPLGWRNLKQMKFSRVNKLNELKALHIRSMPCVFKQS

SEQ ID NO: 194181 - protein, 63 aa, Triticum aestivum
  unsure (1)..(63): unsure at all Xaa locations
  Clone ID: PAT_TA_88599.pep
GSRGGAERRRPHQHFGDHGRGGATTPKISAXTEGAGVSTALILTIXAGRXLKQSXGPWSXKTX

SEQ ID NO: 194182 - protein, 121 aa, Triticum aestivum
  unsure (1)..(121): unsure at all Xaa locations
  Clone ID: PAT_TA_88600.pep
MAPTVMASSATSVAPFQGLKSTAGLPVSRRSNGASLGSVSNGXRIRCMQVWPIXGIKNFETXSYLPXLNKXASSSKXTLYPLKWXPCLKXNKVRFXSRLXNALPGYXQRRYWTIWXLPIXG

SEQ ID NO: 194183 - protein, 58 aa, Triticum aestivum
  unsure (1)..(58): unsure at all Xaa locations
  Clone ID: PAT_TA_88601.pep
XIFLFLLGSFWPFFFSFRSDSHPYLRGNHSLHHPFLTWDNALIMMIIALLFTYNSKLQ

SEQ ID NO: 194184 - protein, 89 aa, Triticum aestivum
  unsure (1)..(89): unsure at all Xaa locations
  Clone ID: PAT_TA_88602.pep
QDPSCLHLSTPRACFCINQHLSCLHLSTLRACFCINILLIHQLKMEIIFCFDFLNQNLSCLHHELXFLSXGGMVLAKADFARPYQMDAK

SEQ ID NO: 194185 - protein, 51 aa, Triticum aestivum
  unsure (1)..(51): unsure at all Xaa locations
  Clone ID: PAT_TA_88603.pep
MAETEYRCFVGGLXWATDDHXLQQAFSHYGEILDAKIIXDRXTGRSRGFRF

SEQ ID NO: 194186 - protein, 92 aa, Triticum aestivum
  unsure (1)..(92): unsure at all Xaa locations
  Clone ID: PAT_TA_88604.pep
LLLQILNGXVVLSGTXIVSXYISRIGSPCXKPWDLINPSPPSXLAATVXXKLXFPPFXFAFTIGLQIFLWKSSPLGLFGPGIRMYGESRSRQ

SEQ ID NO: 194187 - protein, 96 aa, Triticum aestivum
  unsure (1)..(96): unsure at all Xaa locations
  Clone ID: PAT_TA_88605.pep
LGPCLGRREVAWRGLRVPLSSRLCSPFCSTSSGPGPRAGLKPSLVCRGAMPWAQPEGEGWTAGRSLSRDAQVPPPLKRKLGLDXGALLLGSTXKGG

SEQ ID NO: 194188 - protein, 101 aa, Triticum aestivum
  unsure (1)..(101): unsure at all Xaa locations
  Clone ID: PAT_TA_88606.pep
LXRFXXELXXEHESAEXGSKVPXGEASVSRMXAXDASARRXEVRXPWLSGWRREAXSFRLAVAXVVVXGVWIGTDGGYEEGRGSRRSARXRCGAIPQDATR

SEQ ID NO: 194189 - protein, 146 aa, Triticum aestivum
  unsure (1)..(146): unsure at all Xaa locations
  Clone ID: PAT_TA_88607.pep
MLGVFSGEVVEVPAELVAAGSRTPSPKTRASELVKRFLAGAEPAVSLXLGSLGNLAYSHAKXSSSSQRLSLQKDEXFCXFQGXLDNLGRXNKQYGSPKGGTKCPXIQGXKXLRXRPPTPPXQALQLTGXTLRALRSTLPLVQPTGK

SEQ ID NO: 194190 - protein, 78 aa, Triticum aestivum
  unsure (1)..(78): unsure at all Xaa locations
  Clone ID: PAT_TA_88608.pep
GHPKKRSNVPNEIENIISLQTEYVSTWNPIFFHRANMRNLTIHIRPSPRPHSSLSSKILGYNFYMISSQSSPRXPNSR

SEQ ID NO: 194191 - protein, 71 aa, Triticum aestivum
  unsure (1)..(71): unsure at all Xaa locations
  Clone ID: PAT_TA_88609.pep
RRGVKXXAXXIYVXLEXPNIPDPQPSRAPVWLXRIPXQSNPPTLTIQSYLDAPKWAKAHAYRFDPKLVVMT

SEQ ID NO: 194192 - protein, 162 aa, Triticum aestivum
  unsure (1)..(162): unsure at all Xaa locations
  Clone ID: PAT_TA_88610.pep
DKLSGDELLSDSFPYRELENGVLWEVDGHWVVQGAVDVDIGANPSAEGGGDDXXVLNDQXAVKVVDIVDTFRLQEQPAFDKKXXISHMKRYIKNSLPTXXDDLXXFKENLIRHKYFLTTQGLXFFVGESXHDDGXVVFPYYKEGTADXTFLYFHMAEKNANP

SEQ ID NO: 194193 - protein, 107 aa, Triticum aestivum
  Clone ID: PAT_TA_88611.pep
LPIAQELREIPNRIPNGSMASIPEFYSLPDTFSGSDQEYISILRKYRGSEVEALVRRALINYELASLWLLARHGYEVMDVWKTDHGTWSRKNWSPSLTPPKVIPQLT

SEQ ID NO: 194194 - protein, 53 aa, Triticum aestivum
  unsure (1)..(53): unsure at all Xaa locations
  Clone ID: PAT_TA_88612.pep
NPEDAEXFAXWGAGFSXQERQDEXEAICYESDAVEGMXDRXVPDAVEGASISS

SEQ ID NO: 194195 - protein, 149 aa, Triticum aestivum
  unsure (1)..(149): unsure at all Xaa locations
  Clone ID: PAT_TA_88613.pep
VGRTISTPRASLATKAVRSTNNVHTAQNIHSRGNFKRVDTASPGHTIRNANRFGSSAPISTLSLMNNALPHVSQPVQAIPGTNTAHVSQQVQPQGTNPFSGTVKKSAPQRSLSAPIASQGQQGQLAXSSXAASXVXHGVGXQLSRCTRL

SEQ ID NO: 194196 - protein, 79 aa, Triticum aestivum
  Clone ID: PAT_TA_88614.pep
PVKFPDQCRSQLYTVNLNHLFITQKLGASRKDGDQISSAAVAHKSRNLRARIMNVNKQYSLQFFPPYHVRSKAHNTILL

SEQ ID NO: 194197 - protein, 88 aa, Triticum aestivum
  unsure (1)..(88): unsure at all Xaa locations
  Clone ID: PAT_TA_88615.pep
FLARXRGXRAXXEXGVNGDHSHXDHAXARQDHXQVGAFVVTVVQQQGGXPXCIXLLSXXKXADKKGVLXVXXADXVMLNXFFXSLDSS

SEQ ID NO: 194198 - protein, 164 aa, Triticum aestivum
  unsure (1)..(164): unsure at all Xaa locations
  Clone ID: PAT_TA_88616.pep
GLASYALQYGILLPSSALAATLPYPAVFLICLAAGCSICWFNTVCFVVCIRSFSAANRPLALSLSISFNGLSAAFYTLFANALSPYSPSVYLLLNAILPLAASIIALPAILLCHPHDHSSLRTVPKHDRRVFXLLLHIAIVXGIYLVTFGLSHNQVCCKGILMG

SEQ ID NO: 194199 - protein, 144 aa, Triticum aestivum
  unsure (1)..(144): unsure at all Xaa locations
  Clone ID: PAT_TA_88617.pep
APTTPSDSHDDAGIIRWLDAHPPRSVLYISFGSQNSINADQMTELALGLEASGRPFLWVLRPPLGLDAKDGFRPEWLPAGFEERTAGAKRGLLVRGWARQIXILAHRXTGAFMNHCGWESIPGKAVPRRXGYRWALGAQHSSTR

SEQ ID NO: 194200 - protein, 140 aa, Triticum aestivum
  Clone ID: PAT_TA_88618.pep
MPSPSVVRVLSTRTVAPPPRPRERIPLTCWDAAMLSANYIQKGLLFHKPASSAVHVVDHLATALGDALVHYYPVAGRFATEQHRDELTGAVVGCSVHVDCEGQGVRSCTRRPTGDMADVAPPDADCHATCWILPANGRLN

SEQ ID NO: 194201 - protein, 107 aa, Triticum aestivum
  Clone ID: PAT_TA_88619.pep
EPISALLALASSPPSCSSFNGFSAPSVSCPRSLPWVWVLVLVAVGWGWLGCGFTTHKERRRDHSASELFLPLPASAQSPGEKQSSKPAARLPGRGFFPFCQAPCLLA

SEQ ID NO: 194202 - protein, 72 aa, Triticum aestivum
  unsure (1)..(72): unsure at all Xaa locations
  Clone ID: PAT_TA_88620.pep
MFRRRGVDDGQGHDEWLTTVAASPDVISMASCPSTPWLNGVPGRGFSTRRQSLLRYKXPIEELEXXLEFKVP

SEQ ID NO: 194203 - protein, 56 aa, Triticum aestivum
  Clone ID: PAT_TA_88621.pep
LYQASANTKYHKVNQTIALSNKSLLIPYATTCEPELSLSRSSNPNNKKIMNICNTL

SEQ ID NO: 194204 - protein, 160 aa, Triticum aestivum
  unsure (1)..(160): unsure at all Xaa locations
  Clone ID: PAT_TA_88622.pep
GLSRGCIITSFSQHGMSGSHSVFDLMPGGSXLSQDDYTFVGLLSSCSRNGXLLLEGCEYFKLMNTKYSVKPKMEHYTCMVDLFARAGRFSDALEFIDAMPCHPDQLVWEALLASCRTHGNVELGRLAAKKILEIRPDDPSPYITLSSIHASIDMWEEKAW

SEQ ID NO: 194205 - protein, 65 aa, Triticum aestivum
  unsure (1)..(65): unsure at all Xaa locations
  Clone ID: PAT_TA_88623.pep
KGCALDFKFTGELDASNEQTSSGGSCVSPGFKFHXTEEELVGYYLAXXVAAQKIDLDIIQEVSTG

SEQ ID NO: 194206 - protein, 41 aa, Triticum aestivum
  Clone ID: PAT_TA_88624.pep
FPLLNALPFLDRNRVMSWIVFHFTSKSMFVVYVSCGSTYIK

SEQ ID NO: 194207 - protein, 153 aa, Triticum aestivum
  unsure (1)..(153): unsure at all Xaa locations
  Clone ID: PAT_TA_88625.pep
MAPTVMASSATSVAPFQGLKSTAGLPXKXRSNGASLGSVSNGGRIRCMQVWPIEGIKKFETLSYLPXPLNTEALLKXVDYLXRSKWXVPCLEFNKSGSSSXEHNASPGYYDGXYWDNLELPISGCNDXTQVYXGXXEVXKDYXDALLRIIGXT

SEQ ID NO: 194208 - protein, 108 aa, Triticum aestivum
  Clone ID: PAT_TA_88626.pep
APFPSPHHPAPVPRKRASCRRNQQAAKMVAAFAVTPSSSICGVCVPTACRPEARGIVPAPRFFHNRNQANTRSATAWVLEGRSMGLSQIWVLKTSNSTETVRATIHST

SEQ ID NO: 194209 - protein, 133 aa, Triticum aestivum
  unsure (1)..(133): unsure at all Xaa locations
  Clone ID: PAT_TA_88627.pep
MGKIKIGINGFGRIGRLVARVXALQSDDVELVAVNDPFITTEYMTYMFKYDTVHGHWEAQWTSSSKDDKTXLLFGEEPVTVFGVRXPEEFRXVSWCRYLWXHGVFTDKDKALPFKXGAKKVALCPSKDPYFVX

SEQ ID NO: 194210 - protein, 121 aa, Triticum aestivum
  unsure (1)..(121): unsure at all Xaa locations
  Clone ID: PAT_TA_88628.pep
MARLNSKAVAAAVVLAAVVLMMAGREASAALSCGQVDSKLAPXCVAYVTGRASSISKECCSGVXGLNGLARSSPDRKIACRCLKSLATSIKXINMGKVSGVPGKCGVSVPSHQHVTTATCH

SEQ ID NO: 194211 - protein, 167 aa, Triticum aestivum
  unsure (1)..(167): unsure at all Xaa locations
  Clone ID: PAT_TA_88629.pep
EEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLLVGLDFTKDDENVNHNXIYRWRDV

SEQ ID NO: 194212 - protein, 109 aa, Triticum aestivum
  Clone ID: PAT_TA_88630.pep
PPSLYKLLHYDGQIFPFHNASQAISMLDQPVALVDNHHGRTMLAQLAPLTYGLWTKRQLMCSSPVQKYTLLLFPALLLPTDVTDLNAIWVDRSHLAVTSFRSGLELIRK

SEQ ID NO: 194213 - protein, 135 aa, Triticum aestivum
  unsure (1)..(135): unsure at all Xaa locations
  Clone ID: PAT_TA_88631.pep
QTETKAGVGFKAGVKDYKLTYYTPEYETKDTDILAAFRVSPQPGVPPXEEAGAAVAAESSTGXTWTTVWTDXLTXLDRYKGQCYHIEPVAGEDSHGSVSXLSIRXFEEGSVTNMFTSIVGNXFGFKALSAXXLED

SEQ ID NO: 194214 - protein, 115 aa, Triticum aestivum
  unsure (1)..(115): unsure at all Xaa locations
  Clone ID: PAT_TA_88632.pep
MARGLKKHLKRLNAPSHWMLDKLGGAFAPKPSSGPHKARECLPLILILRNRLKYALTYREVQSILMQRHIMVDGXVRTDKTNLLXFMDIISIPKTGENYXLLYDNXGRFRXNLQG

SEQ ID NO: 194215 - protein, 57 aa, Triticum aestivum
  Clone ID: PAT_TA_88633.pep
LLPYLEQTFHVCIFRSKRHKVSLLMLRFPSGFLHQMAVSYSIALDSSIAAVKLWELP

SEQ ID NO: 194216 - protein, 70 aa, Triticum aestivum
  unsure (1)..(70): unsure at all Xaa locations
  Clone ID: PAT_TA_88634.pep
IXLCRLGNLYPNIRHHITVAVSVFLEPRICFVSVSVISFGACGVGPATVWPRRASCEQKIQLDRFEQKKK

SEQ ID NO: 194217 - protein, 67 aa, Triticum aestivum
  Clone ID: PAT_TA_88635.pep
ALALTLSRPNPTTGAALPPLSATAPPAPRRPRRPSPPPLLPPHAAPTATTPPASRPTLPRSLPRSPT

SEQ ID NO: 194218 - protein, 78 aa, Triticum aestivum
  unsure (1)..(78): unsure at all Xaa locations
  Clone ID: PAT_TA_88636.pep
REHRLXXFAILEMHLIXDDQVVNGCLRSAXCCKCLHVLPVIPITXLXDILYTLAPXQLGKFLXXXKXNVHXFXFQGPT

SEQ ID NO: 194219 - protein, 103 aa, Triticum aestivum
  unsure (1)..(103): unsure at all Xaa locations
  Clone ID: PAT_TA_88637.pep
RRDKHPPYQRHHVXARDSLDQDFHPRLLGPNQRKTITAREIPPSSRVYIIYIGKVKAXDTPTRXWLPHNDCXQPSSEARXNLWPVVXNXXKVLKLPXHLNQRK

SEQ ID NO: 194220 - protein, 127 aa, Triticum aestivum
  unsure (1)..(127): unsure at all Xaa locations
  Clone ID: PAT_TA_88638.pep
AXEFGCLPXPSRSIRPXTAEFLAKLCRISAILPLPHRPAAKIDLIHLSPLLYVXSXKCVQFEGIVCAVLHRXDPIKVRPXHPRLLXCLTCVFYKAIAXXWQHTHRESXLVTLDDIFKSRPSRLIQAX

SEQ ID NO: 194221 - protein, 100 aa, Triticum aestivum
  Clone ID: PAT_TA_88639.pep
AINHRRGTWWQNPQGAPTPSRRAQWVVPTWWPPQTLKPTLQNPIFPEKNQEGRITAFHETELPPPSPVLHREARSGVRLGFQRGGFSIFVISNPSPSPIP

SEQ ID NO: 194222 - protein, 123 aa, Triticum aestivum
  unsure (1)..(123): unsure at all Xaa locations
  Clone ID: PAT_TA_88640.pep
FKSYREGLMSPQTETKAGVGFKAGVKDYKLTYYTPEYETKDTDILAAFRVSPQPGVPPEEAGAAVAAESSTGXTWTTVWXTDGLTSLDRYKGRCYXIEPVAGEDSQWVLYVTXPLDYXKRVRY

SEQ ID NO: 194223 - protein, 94 aa, Triticum aestivum
  unsure (1)..(94): unsure at all Xaa locations
  Clone ID: PAT_TA_88641.pep
PVFHFXIPXNXXFFLLNWTVSKSPMIYCPFXPPHVXKSRHXSSQLIMTSVALKXAGTQECPXEEXFAIRYLADFLEPQHRFVXENLPVQXFSSS

SEQ ID NO: 194224 - protein, 70 aa, Triticum aestivum
  unsure (1)..(70): unsure at all Xaa locations
  Clone ID: PAT_TA_88642.pep
LXPIPXEEXFRASAPAPKXYXXYGIXAGSVIAAXXXLXDXTLXXGLSSLMGKNKHHTXRXRAQXLXINGG

SEQ ID NO: 194225 - protein, 161 aa, Triticum aestivum
  unsure (1)..(161): unsure at all Xaa locations
  Clone ID: PAT_TA_88643.pep
XHSPRPPPPVPPASPHSPSKPRLPVHAAIISFVRPAXHAAPVCSARARDAPSPVPPASSLSLSLLTLTHXHFPVXPPAMAALGRAPPRCSGXTTLPRXSSLXSRXHSPAQIXRSFLXXEPXRAHQRSGPTAGWXSTTKKLPRXMLLSLXXXMGXKPLEKRX

SEQ ID NO: 194226 - protein, 70 aa, Triticum aestivum
  unsure (1)..(70): unsure at all Xaa locations
  Clone ID: PAT_TA_88644.pep
PCNWLDXXHVVFGEVVEGMDVXXNIEKVGSRXXTCSKXVVIDDCGXLIRPRAGRLSPSSPPRVSRVVSSI

SEQ ID NO: 194227 - protein, 152 aa, Triticum aestivum
  unsure (1)..(152): unsure at all Xaa locations
  Clone ID: PAT_TA_88645.pep
MSPQTXTXAGVXFKAGVKDYXLTYXTPEYETKDTXIXAAFRSKVLKPGVPPEEAGAAXSAESXTGXTWTTVWXDGLTNLDRYKGXCYHIXPVAGEDSQWXCYVALSXLDLFEEGSVXTXMFTSIVGNVFGFXXPYXASTFWEDLRIPPYIKT

SEQ ID NO: 194228 - protein, 159 aa, Triticum aestivum
  unsure (1)..(159): unsure at all Xaa locations
  Clone ID: PAT_TA_88646.pep
SHSPRPXPPVPPASPXSPSKPRLPVHAAIISFVRXXTHAAPVCSARARAAPSPVPPASSLSLSLLXLXHAHFPVPPPXMLLWVARRRVAPLQEAPPSLLPVLQAXSPAXDRPLLPPSEHXRGIKRXGPTRGCFSNNMQLARVCXFSXQXVGXASNGXAX

SEQ ID NO: 194229 - protein, 93 aa, Triticum aestivum
  unsure (1)..(93): unsure at all Xaa locations
  Clone ID: PAT_TA_88647.pep
ARPXAPPASASASRPNPARPPRRRGXYGVPPQAPLPLGRXPSRPVPAPRPSSXAPLRAARASPWLPPPPPLKXDSPPGDASPRLLGIVGPLSS

SEQ ID NO: 194230 - protein, 111 aa, Triticum aestivum
  unsure (1)..(111): unsure at all Xaa locations
  Clone ID: PAT_TA_88648.pep
XGXPGPPPFFFFFXXQGGXNLYXFAIXGFFKEFNXXGHRFXXVFSKTXXHPNXPXVHKPVSXGITSTRQAGXLVRTKKRANFGCSLWEISLLNTSXGYFPXXFFPFFPFFQ

SEQ ID NO: 194231 - protein, 111 aa, Triticum aestivum
  unsure (1)..(111): unsure at all Xaa locations
  Clone ID: PAT_TA_88649.pep
AXNAXPXASMXGGGXDSXPAGQPRXEPXLPFGSFXLSLXLXKDNXPAXLXSXXSGVRLXNQIXNLAXXLKTSGGSSXPRRGKRIKXGAGVPPLPAQWFLXRGSLXSFXSGG

SEQ ID NO: 194232 - protein, 113 aa, Triticum aestivum
  unsure (1)..(113): unsure at all Xaa locations
  Clone ID: PAT_TA_88650.pep
HALAXLPGRRLTCCLLEXKTHXLAFXRHLXEPERXGRXPQQSTAGLFVFPPRXPLGXPRPDSRXTRXXGTAGXTSRPXFGLGRSGRPTASAPAVRACXXNVXRXDXSAXPHQX

SEQ ID NO: 194233 - protein, 102 aa, Triticum aestivum
  unsure (1)..(102): unsure at all Xaa locations
  Clone ID: PAT_TA_88651.pep
SISTXWGSRTXMCCLGNRAXTGDAXTYLXLYRNSGDYFCECLNIYPLLSKWEXVGXFISPPSSXAEXXQFPFPXXEGNXGSVRXPXVRMQRSNVXSXPKXFK

SEQ ID NO: 194234 - protein, 140 aa, Triticum aestivum
  unsure (1)..(140): unsure at all Xaa locations
  Clone ID: PAT_TA_88652.pep
MGGXFSSTVGGPGSTPTXFLXKXLKXXVTSAVNYHGKSSKXNXXXVMAXGKHXXKRXTAKWEGXXFDISGDQXXITKGKGIVXSLFXAPTGDGNHEGVLXSXXVSQXRXLKXVRLXXTMGEGFXIXPAFMXKXFXFISPK

SEQ ID NO: 194235 - protein, 137 aa, Triticum aestivum
  unsure (1)..(137): unsure at all Xaa locations
  Clone ID: PAT_TA_88653.pep
SPSPSPPPPPPPPGGAPASLPXPPPGLHPPPPPLISRHLPPPPPLRGRFSEPSXLRRGGVXRPPPAGSPQRRPARPPPSSPTSSPRXTPTPXSPSSPGSGSPPATSPPPSARTPGCSARAWRQPGPQCRGARPGLAF

SEQ ID NO: 194236 - protein, 91 aa, Triticum aestivum
  unsure (1)..(91): unsure at all Xaa locations
  Clone ID: PAT_TA_88654.pep
XWDVELYXELLXKXGGKERMAAXFNKDXWAAKAXKTXXERKXFIXSLHKRKTKLXMGLIEKXXLXLPPXVQRVIXEXALRKXXKVXVCNTS

SEQ ID NO: 194237 - protein, 58 aa, Triticum aestivum
  unsure (1)..(58): unsure at all Xaa locations
  Clone ID: PAT_TA_88655.pep
QXPXPKASPLLPNPKGGVXRXSGXRGGHGFRRTXNFXFQAGXXQXGLAHQXKLXFQQG

SEQ ID NO: 194238 - protein, 125 aa, Triticum aestivum
  unsure (1)..(125): unsure at all Xaa locations
  Clone ID: PAT_TA_88656.pep
MGTXAMGXSPXSXPXKXVXXLPSSVLFREGRVXXXKNAGKXKXVXXGXPWXGSDRVLXLGPLSGEPPSXLTGEFPPRLXWDXHGXCLADPQTFFXXRGXXGDHCRWXMXXALXWVFPXLVAPQRG

SEQ ID NO: 194239 - protein, 131 aa, Triticum aestivum
  unsure (1)..(131): unsure at all Xaa locations
  Clone ID: PAT_TA_88657.pep
WWRGGXGXGRXWRTSSSXGPLCXNKXLPPSXSXSTTGXARSAPASXPTCRLXTXDVRGASASIXXTSSXPVRGXPQXXXAXARARKLNWXARPXRXKXNSXXXRSTEPXKGGXGXRXSXLPXXQXWVGXGL

SEQ ID NO: 194240 - protein, 158 aa, Triticum aestivum
  unsure (1)..(158): unsure at all Xaa locations
  Clone ID: PAT_TA_88658.pep
PSKPHSPXPXXRXEAAQAQQPNGHHXRRRGXXRRRPCRHXQAAXPXSAPTEDXEREGEVQXLQXRKEXTPAAAVRGXGXSLLXAXGAVTXSAGPALVLVDQRMSXEXNGLXLGLXQQXAGXGXPWGASGSXGXSTTSXTSGSXKXEEXRXALLXNLHK

SEQ ID NO: 194241 - protein, 119 aa, Triticum aestivum
  unsure (1)..(119): unsure at all Xaa locations
  Clone ID: PAT_TA_88659.pep
GRXXCSPXPRAPXSPRASPFXCGEGLNLCXXIPXXPLXGAPPXQAAPXCXXVXRGNRGCSVGLGETXEDXXRGLXTXLGSEMXDSIXXNKRVXHSXNXQVXREXXGNRXYSGESSYQCL

SEQ ID NO: 194242 - protein, 138 aa, Triticum aestivum
  unsure (1)..(138): unsure at all Xaa locations
  Clone ID: PAT_TA_88660.pep
XFSFHXXLXIYXNNIXLXERXLHSSQLSRWGSXSPXTXXFIKYFHKKAHRXTGHIXIXDXXLLRDFGQLGXKRXENPKQAGVVXRPKXKGLXRXFCRAIQGQPSKQSPNEFRSKXLGLXXGXFNPGVXPXNPNKRQKG

SEQ ID NO: 194243 - protein, 75 aa, Triticum aestivum
  unsure (1)..(75): unsure at all Xaa locations
  Clone ID: PAT_TA_88661.pep
GTGFIFRXGRXRCPXXTRGGPELXNHQVSHFPXXXLRGEGRRXXLHRPHRRRGXXRXAGLWXXSXRRGGARQEEG

SEQ ID NO: 194244 - protein, 136 aa, Triticum aestivum
  unsure (1)..(136): unsure at all Xaa locations
  Clone ID: PAT_TA_88662.pep
MGPTVXGSSGNSVAPFXGVKXXDGLPVXRRLQRSXPRQRXNGGRIXCMQVWAIXXIXKXXTLSYLPXLXXEGLLKQGDYLIRSKWXACLQFXKGWXLXSVGXXKPPGXXMGGYWGKCGKLXMFXXTDAXQKVGGQK

SEQ ID NO: 194245 - protein, 151 aa, Triticum aestivum
  unsure (1)..(151): unsure at all Xaa locations
  Clone ID: PAT_TA_88663.pep
TARSGSCAGXLXWPXFXXSGLVPPSGSPSXLDAPGVANGSSPGASKSRCXXQSPVCSPVDQALLTCXKSXYLAPLALHVRQPMQMWASLTXHVGPLRPDSPPRPCLLPLPDPAYSRSASATTTDLDLSPWSTSQQAANLTQCGFFPVSEFA

SEQ ID NO: 194246 - protein, 97 aa, Triticum aestivum
  unsure (1)..(97): unsure at all Xaa locations
  Clone ID: PAT_TA_88664.pep
FDAALPSTPWKVGERTXSSLYRXTTPPPHRLVFLXGLEXDGGAAGVPGGAXLDTAGAAGLAHRPLPPEXLAXSSXSSSSNSSXSPSSXYCKKKTRVV

SEQ ID NO: 194247 - protein, 106 aa, Triticum aestivum
  unsure (1)..(106): unsure at all Xaa locations
  Clone ID: PAT_TA_88665.pep
MGEGSSPAXXKDVTELIGKTPLVXLNKVTDXCVGRVXAKLESMEPCSXXKDRIGYXMITXPGXEXGSIFXGKKCAXCXKPVXKXRXLGXAXXGXAQGQFYSMAPLP

SEQ ID NO: 194248 - protein, 130 aa, Triticum aestivum
  unsure (1)..(130): unsure at all Xaa locations
  Clone ID: PAT_TA_88666.pep
KLRFPXXPTXXQTSPXXDXKEPSVQPKXXPPLGWXXXSPXPAPKKLWSRLLXNXWAXRREEXWVIXSRPPFXXFAGRPXKGIPSLLSPSXFVPRLFEGGGGRQTKXXGGGXFVXLLPXXAQGSXXGPFXD

SEQ ID NO: 194249 - protein, 155 aa, Triticum aestivum
  unsure (1)..(155): unsure at all Xaa locations
  Clone ID: PAT_TA_88667.pep
XXRKKIPPXVFIVHQTXESXEVFIVXRVPPXTQXAAPQTXXXTGXGPFGRHLLPHPRSFGXRXPFXGRTRAKHXXXTXTPPHKPQLRXKFXPQRNAGGKQRXRLGFWSAXLLARAXILSHLNXNLAIASFVAGXSLLLRCXEFXLPAPGESHLVS

SEQ ID NO: 194250 - protein, 180 aa, Triticum aestivum
  unsure (1)..(180): unsure at all Xaa locations
  Clone ID: PAT_TA_88668.pep
WDSPGACXEIRQRRXQRALRSPKGPGXGKAPPSKVSTVEGRXSGGRAEGRRXPPRSFGLNGQPGSPSGERVRLKVVQRRATRRRXIKGLGPPARPALPGGTPPGKRXKLGTEGKGELSXLAPLKETGFLTLQARLPNRAGRRXGLRGQKGSSGPXEQFLKXFKGPPQSXKXKPNGAXSXN

SEQ ID NO: 194251 - protein, 158 aa, Triticum aestivum
  unsure (1)..(158): unsure at all Xaa locations
  Clone ID: PAT_TA_88669.pep
RRQRXPNPAVAPIPPXGVLSSSPNAAXPSPSPSSGDLGAVXTPXAXXXSSPPQFRLFLWXHPTQSSSPTPLSYSPVPRRSGPXRRTXHRAAAXANHTRARARAELQWLVVXXNXIDRVXPQTAAIMEGAXSAXXVQTDGARRVGRSWGQSLPPCRIAH

SEQ ID NO: 194252 - protein, 98 aa, Triticum aestivum
  unsure (1)..(98): unsure at all Xaa locations
  Clone ID: PAT_TA_88670.pep
PLGTSHLAXIXFFXPHPDLVRFKEXKGKFQGVFISXLRLXEPIPPIPRSRKELASXGQLELPLAASSAQSXPTHCPILRPXQRSCQPGPLGFFPCRQX

SEQ ID NO: 194253 - protein, 144 aa, Triticum aestivum
  unsure (1)..(144): unsure at all Xaa locations
  Clone ID: PAT_TA_88671.pep
PPSXLLEFXXXNXRXDCARHXRRRGXRRLRGAGAXQEVRRXRXRLFQGPTQAGXSRTFAIDVVXSVXIVAIRHRFAGAPXRPLTPRXRRRARXPENAXEXPVIXYRXRXXFFSXKGAXXWXGXXGPNSTARXGTXYNGGXXXDQ

SEQ ID NO: 194254 - protein, 101 aa, Triticum aestivum
  unsure (1)..(101): unsure at all Xaa locations
  Clone ID: PAT_TA_88672.pep
SPQTETKAGVGFKAGVKDYKLTYYTPXYETKDTDILAAFRVSPXPGVPPEETXAASSXPESSTGTWTTVWTDGLTXXDRYKGRCYHIXEPVAGERPMGSVM

SEQ ID NO: 194255 - protein, 115 aa, Triticum aestivum
  unsure (1)..(115): unsure at all Xaa locations
  Clone ID: PAT_TA_88673.pep
KLGLNCRQLSTGXSPLXLCLPNXILXPVXEXPPGRREEAEEPRRPRASXYGGGGEANXGNPERRSGXXRRARXSRPAPSHHAGXMRCDAPHSLPCVAXCXVLRXLPWLXAFFXSS

SEQ ID NO: 194256 - protein, 107 aa, Triticum aestivum
  unsure (1)..(107): unsure at all Xaa locations
  Clone ID: PAT_TA_88674.pep
MGGGALVLALVXALAVALAGAXSEGEALSALRRXLRDPGGVLQXWEPNLVNPXTWXXVTXERXKRVNPXKXLGNLNLSGHLGPEAWWGQFAITWLYKKIIFEGDDNE

SEQ ID NO: 194257 - protein, 84 aa, Triticum aestivum
  unsure (1)..(84): unsure at all Xaa locations
  Clone ID: PAT_TA_88675.pep
AESNXVIMMGGNKSDLNHLRSVXREERQALTXKXGXXFLXTSXLGTXNXQKXFQTKLSXIQQIIIXKGLXGQWKWSHKEQQQCW

SEQ ID NO: 194258 - protein, 155 aa, Triticum aestivum
  unsure (1)..(155): unsure at all Xaa locations
  Clone ID: PAT_TA_88676.pep
GKLVDILAQRFDVVARCQGXANAGHTIYNSEGKKFSLHLVPSGIXNENTXCVIGNGAVVHLXPGFFKEIDGLXSNGVSXCKGRILVSXDXAHXLFXFQQXVHGLXEVXLXGNSFIXTNKKRGNXGPCLFPKQRIKETGASKGPPWRAKMGQPFGW

SEQ ID NO: 194259 - protein, 72 aa, Triticum aestivum
  unsure (1)..(72): unsure at all Xaa locations
  Clone ID: PAT_TA_88677.pep
NLSAKLEGDDLXAFKKNVESATKYLLSKLKDLQFFVXESMHDDGGVVFAYYKEGAADPTFLYFAHGLKEVKC

SEQ ID NO: 194260 - protein, 95 aa, Triticum aestivum
  unsure (1)..(95): unsure at all Xaa locations
  Clone ID: PAT_TA_88678.pep
XPPXNLXFPXGXRAQGNXGPRXXFCPXGKAPLSPXRXKERXAGRIXTPVGHPRIWXXXGEFGESHQFGSAPIXXTREXDXFFGPGPRPFRKPFSX

SEQ ID NO: 194261 - protein, 131 aa, Triticum aestivum
  unsure (1)..(131): unsure at all Xaa locations
  Clone ID: PAT_TA_88679.pep
GXSXVXFPQAVCXXXRGXLGAXNIRLTXLAHFFFPGLTDRGEGVSFXXRGPVPXLXXEYGVPPSXWPPRPFXLAXPHPLFFSFAGWRTRCPRTTFNYTPLPVGGVLXLSVGAWLSTPGFVSRGPSPMSXCS

SEQ ID NO: 194262 - protein, 63 aa, Triticum aestivum
  unsure (1)..(63): unsure at all Xaa locations
  Clone ID: PAT_TA_88680.pep
MGPXVMGSSGNXXAPXXGXKXNAGLPVXRRSKGAXLGKVKNGXRXKCMQVWXIQXIKKFENLS

SEQ ID NO: 194263 - protein, 39 aa, Triticum aestivum
  unsure (1)..(39): unsure at all Xaa locations
  Clone ID: PAT_TA_88681.pep
PALAXPSCNLRHXXLFNKQILXSXKKKKKKKKKKKKARD

SEQ ID NO: 194264 - protein, 127 aa, Triticum aestivum
  unsure (1)..(127): unsure at all Xaa locations
  Clone ID: PAT_TA_88682.pep
RXPAPHPVRSRARAWRSXPPATSVAAXPSPGGGAPSPXSRPAPXNDSPTEPSXTPPGQLXQDXCYXRRGPXESXXNXRRNPPPPSXGRPPPXWGXSSTXRXRXXSPGAGLXPSXPDGXTNIXPSPQH

SEQ ID NO: 194265 - protein, 117 aa, Triticum aestivum
  unsure (1)..(117): unsure at all Xaa locations
  Clone ID: PAT_TA_88683.pep
MSLPPTDGGDDWFLHCILEDLPAACGAFPWXASVSSSNPSAXSRQAMXTSXXSPXIPASNKXLRXEPCXRATSKXCXEKVRRDKLNDKXLELGNKXDSGKXPXKADKAANPEVIATG

SEQ ID NO: 194266 - protein, 59 aa, Triticum aestivum
  unsure (1)..(59): unsure at all Xaa locations
  Clone ID: PAT_TA_88684.pep
QKSPSQKPSPHXXFLGARWTTXGWFFLXTVGGAPXGGHHXGACSKTPCRXTVXEIPXGS

SEQ ID NO: 194267 - protein, 76 aa, Triticum aestivum
  unsure (1)..(76): unsure at all Xaa locations
  Clone ID: PAT_TA_88685.pep
QEMQMAQILMIVSFFRNCNGPNCCPRPGFKTCSCNANQSSXLLISRNQFLLFFNFPLFGKNGSIISQLKRVCYKXQ

SEQ ID NO: 194268 - protein, 132 aa, Triticum aestivum
  unsure (1)..(132): unsure at all Xaa locations
  Clone ID: PAT_TA_88686.pep
MXTXAMGLSPSSFAGKXVKDLPXSALFGEXXVTMRKTAXKXKPVSSGSPWYGSDRVLXSGPLSGDPPSXLXGEFPGDXGWDXXGLSXDPETFPKEXXLXVIQXPWAMXGRGFGCVFPXLLARNGGSNSKGVV

SEQ ID NO: 194269 - protein, 54 aa, Triticum aestivum
  unsure (1)..(54): unsure at all Xaa locations
  Clone ID: PAT_TA_88687.pep
NCWRRRRXGXFLLXXGXIREDADVLPWLXGXTXSPQXXHGDXGFFRXFCPLLXS

SEQ ID NO: 194270 - protein, 103 aa, Triticum aestivum
  unsure (1)..(103): unsure at all Xaa locations
  Clone ID: PAT_TA_88688.pep
MDLAXVNEELXXIDGXIADIFXALQNGFQKLXKIKDANRRXXQLXELTDKMRDCKRLIKDFERXVKDEARNVXXEHLXISETKRKQXLXKGNLLMFAQTNNAR

SEQ ID NO: 194271 - protein, 146 aa, Triticum aestivum
  unsure (1)..(146): unsure at all Xaa locations
  Clone ID: PAT_TA_88689.pep
XLXRXXRVAXXKXFNXLXLWXXNXXXPXHSXFMXDQIXGXVAXLLPFGSRPCRTCIAXPSCXGESPSSSSPLVTAISSSRIDGGDFGHRXPPPXRRXPRRRSPXLPPPRRGAPRRAXCXPSEGLGGSALVTSESTRRREGGTKGDX

SEQ ID NO: 194272 - protein, 93 aa, Triticum aestivum
  unsure (1)..(93): unsure at all Xaa locations
  Clone ID: PAT_TA_88690.pep
MGNCQAAXVAAAVVXHPGGRVERLYWSTPAAEVMRANPGHYVALVTLRVAEERQDADGGGARRTVRLTPRQSSSKPKGDAAPRPLLPPSSPTR

SEQ ID NO: 194273 - protein, 83 aa, Triticum aestivum
  unsure (1)..(83): unsure at all Xaa locations
  Clone ID: PAT_TA_88691.pep
SRLFFFFFFFFFSXEIIVLQXSHLRXTTEFRTRSGRINRSXQTXKVXLALLTNHXXGXXINXRPXXWAXXNIXHXSLXRCXXS

SEQ ID NO: 194274 - protein, 68 aa, Triticum aestivum
  unsure (1)..(68): unsure at all Xaa locations
  Clone ID: PAT_TA_88692.pep
ATWSXFSWSPHXXKNQXLLXQRMAPSGXXKWXSIXLHGFDLIDRRXPSXXFXXGXPLGGXXRGGEGRG

SEQ ID NO: 194275 - protein, 146 aa, Triticum aestivum
  unsure (1)..(146): unsure at all Xaa locations
  Clone ID: PAT_TA_88693.pep
MPASIAFGRFDDSFXLXSFKXYIAEFISTLIFVFAXVXSAIAYSKVSGXAPLDPSGLIAVAICHGFGLFVAVAVXANISXGHVKPXVTFGLXLGGQINXLNGNXLTGVWPXXXXAIXRGAFLVQXWXGXWGTPTXXXFPGWXXXQG

SEQ ID NO: 194276 - protein, 85 aa, Triticum aestivum
  unsure (1)..(85): unsure at all Xaa locations
  Clone ID: PAT_TA_88694.pep
QQDPPQLPFXIHQGVGRLKSPRIVGEDLVNRXHIIHIGWRTPASFIWFMTKPWRSYLVHHDTWIQEDVLDRHLTFLPLFVYLTTP

SEQ ID NO: 194277 - protein, 158 aa, Triticum aestivum
  unsure (1)..(158): unsure at all Xaa locations
  Clone ID: PAT_TA_88695.pep
PKLKVSNYXQAWVARXTQXXTSSXKXWXSPREXPXSSXPSSXLWAXSPSSXPRXTWAXTXRSXPRWXTXXXEMXNNXPSKRRXXQRSWGGISQXGKEVVLNXVASXAVTLXXVFAKXNSXLFXGVQEXIRGTXIPSPGXPPXKGXQXGANLXGASXXR

SEQ ID NO: 194278 - protein, 159 aa, Triticum aestivum
  unsure (1)..(159): unsure at all Xaa locations
  Clone ID: PAT_TA_88696.pep
RRRPTCLPHAAAPPASPAPRGHHFCPRYCPTSFPRGXAXXSRQPPTFHPASXPPCDAGDLLLPTSXARDPPPSRAXEAPPLQLSXXTXSSPXXTFSWXXPLLXMXMAGXLTPPXPXSNGXXAGLHQPSGXRAFXXKLXSASPHGXDXAXPKXAXSPSLN

SEQ ID NO: 194279 - protein, 141 aa, Triticum aestivum
  unsure (1)..(141): unsure at all Xaa locations
  Clone ID: PAT_TA_88697.pep
PXFPVPLLCPSGRXLFLXPELTKXLFDXERNSXXFSFSTPSHCPRXGLLXSXSXXAAPDVFFVEEXSXXFCFWRXSXXRGGXIKGFXHLWXRGRRARPAGNQSPLXVSPXPPEEQERAPRLVSACGGRWRXPRRCERPAXK

SEQ ID NO: 194280 - protein, 139 aa, Triticum aestivum
  unsure (1)..(139): unsure at all Xaa locations
  Clone ID: PAT_TA_88698.pep
DFATSSCRGSAWSRLTXSQGCGSSLAARPWGGQAKTRHAAWFPVRARAIDNGWSEARNSGWHRGFLATSHEIYDEVMAAPDKGSKYVQHQARAVDLLISGFAIKLLKQGWEVHARDFVXTIEWETXGRDFFKASELALA

SEQ ID NO: 194281 - protein, 79 aa, Triticum aestivum
  Clone ID: PAT_TA_88699.pep
YTTQSSNSKPLELHPKKQWRPWPELSNSWVVTQLVVSALTLFLTMEACSCFCFARSDPLHQTTSLFPPLMPRTAAVYQH

SEQ ID NO: 194282 - protein, 49 aa, Triticum aestivum
  Clone ID: PAT_TA_88700.pep
EYHHHYKVKSMYLVTWLNVKVCLLCLLDVLWCQQESCNLCRVSYKPTRI

SEQ ID NO: 194283 - protein, 157 aa, Triticum aestivum
  unsure (1)..(157): unsure at all Xaa locations
  Clone ID: PAT_TA_88701.pep
IPGNILCXXPTSFXLFSTKLWRXFARENWKGTQLMSLLGETCRPLXPSXGIAXWXEENPARRRXPREAARGYPRLEQSDEDGDXICTXVFVLCVCXHQPKLARAXAXPLAEWNGNAXDLVGARRGEGGIXGRXRXLTTAPSRYXLADPVXTQRLQRL

SEQ ID NO: 194284 - protein, 154 aa, Triticum aestivum
  unsure (1)..(154): unsure at all Xaa locations
  Clone ID: PAT_TA_88702.pep
MSPQTETKAGVGFKAGVKDYKLTYYTPXEYETKDTDILAAFRVSPQPGVPPEEAGAAVAAESSTGTWTTVWTDGLTXSLDRYKGRCYHIEPVAGEDSQWICYVAYPLNLFEEGSVTNMFTSIVGNVFGFQSPTCLYVWXDLXIPPTYSKTSKGX

SEQ ID NO: 194285 - protein, 119 aa, Triticum aestivum
  unsure (1)..(119): unsure at all Xaa locations
  Clone ID: PAT_TA_88703.pep
KYMTFFDTVTVSNREHTRKLCLSLLYVLIKSSRVLSFSLYLKLNKMLHGSSPQALLPCLPLYQNMSCTEMVKILKCRRASKELPSAAPPXKNVLXDXWPXLXXQRXAXPIXXGKXXAPX

SEQ ID NO: 194286 - protein, 49 aa, Triticum aestivum
  unsure (1)..(49): unsure at all Xaa locations
  Clone ID: PAT_TA_88704.pep
CMEXRSYLRRGSSSSSPXEHGHCCRGSTAITLPSPRQRSPRRQNSSTII

SEQ ID NO: 194287 - protein, 78 aa, Triticum aestivum
  unsure (1)..(78): unsure at all Xaa locations
  Clone ID: PAT_TA_88705.pep
INFDSLXTXTVXPLTRLXLNLLXVHAXXGILXTTILAXIPNLNGKXLXXXLSDIXHSYRXNGVGXIYQQKKRGHPALF

SEQ ID NO: 194288 - protein, 120 aa, Triticum aestivum
  unsure (1)..(120): unsure at all Xaa locations
  Clone ID: PAT_TA_88706.pep
PQTPDHARQSLASLVLPGDERSPPPSPSRRAPPSYGGGGSPGTIAAIVTALGGGPAAVGIVRLSGADAVAVVARVFRPAKKEPAPWRARSHFVEYGVRWTEMGASSNEVLXWVPMLAPRS

SEQ ID NO: 194289 - protein, 140 aa, Triticum aestivum
  unsure (1)..(140): unsure at all Xaa locations
  Clone ID: PAT_TA_88707.pep
AGTMGANWRQSSPNKNLSKVHDXGSIXRXKPKKTLXGGAXXSCLTXXPXGGGXENXPDXXYLGXGEQRKIXKPKRVLGWVXXKNALGAFXPKWGPNQXNFLGQPXSNFWALVLXKGGWXKIPXXGPTFPKGKXXKGGPPS

SEQ ID NO: 194290 - protein, 153 aa, Triticum aestivum
  unsure (1)..(153): unsure at all Xaa locations
  Clone ID: PAT_TA_88708.pep
MAPTVMXSSATSVAPFQGLKSTAGLPVXSRRSNGASLGXASSNGGRIRCMXVWPIEGIKKFETLSYLPPLXTEXLLKQVDYLXRSXKWVPCLXFNKXGFIFREXNASPGXYDGRYWDKCXNWLCFGXNRPPPKVNXTKVGGRVKRSYPERLCS

SEQ ID NO: 194291 - protein, 122 aa, Triticum aestivum
  unsure (1)..(122): unsure at all Xaa locations
  Clone ID: PAT_TA_88709.pep
SIIKVAPDKTGRPPPSAPTRTPRGTHPXTLFLPLPPIFLPRMXASPRSPPVGTLXRRAXAXTXGGXXAAXADGXXRGXWXAXPILRXGSGRRXXFRXXKSTGFSSXRLPGWGRSSAQXXAGG

SEQ ID NO: 194292 - protein, 128 aa, Triticum aestivum
  unsure (1)..(128): unsure at all Xaa locations
  Clone ID: PAT_TA_88710.pep
MLVYQDKLSGDELLSDSFPYREXLENGVLWEVDXHWVVQGAIDVDIGANPSAEGGGDDEGVDDQAVKXVDIVDNFRLQEATCFXDKKQFISHMKXRYNQRXSSAKALKGDDLNVFKEXMLKSGQQKYP

SEQ ID NO: 194293 - protein, 123 aa, Triticum aestivum
  unsure (1)..(123): unsure at all Xaa locations
  Clone ID: PAT_TA_88711.pep
NNTFNASDAPAWFNALPSLTSLYLENLQIXGKLPQELFALSAIXTLKLRGNRFNXTLNIGSDFGSQLQTIDLQGNQIDQLTVGGXQYNKKLILFXNPXCXKGTKSNTAPATQIQPGGATKLTF

SEQ ID NO: 194294 - protein, 142 aa, Triticum aestivum
  unsure (1)..(142): unsure at all Xaa locations
  Clone ID: PAT_TA_88712.pep
MXPTVMXSSGXSVAPFXGLKSXAXLPVSRRSNXASLGSVXSNGGRIRCMQVWXIEGIKKFETLSYLPTLNKEXLLKQVDYLXRSKWVPCLXFNKXGFIFREHNASPGYXDXRYWXMWKXLPMFGCTGATQGDTSGGRKKGVT

SEQ ID NO: 194295 - protein, 133 aa, Triticum aestivum
  unsure (1)..(133): unsure at all Xaa locations
  Clone ID: PAT_TA_88713.pep
GVAFPSWPICXPXTAKEXASXXNXFXHSRXFSYXAKRALCWXYLFGKFDPLWXTPRXKGAXHWRXLLLLLVXFFIIXCPCTLILKXGXRSLPGPPQICFCICIXKTQAPFPPGLXLPFVXIGIHPRNLXSGXQ

SEQ ID NO: 194296 - protein, 85 aa, Triticum aestivum
  unsure (1)..(85): unsure at all Xaa locations
  Clone ID: PAT_TA_88714.pep
KNFPLFXXHPANRGXXPGXPXGLLXTDPXFASPLAFFLXTFFWXPXKSWGVRXTXCFCYCTPSCRISLQPRGNPQLVXRAPRXPA

SEQ ID NO: 194297 - protein, 81 aa, Triticum aestivum
  unsure (1)..(81): unsure at all Xaa locations
  Clone ID: PAT_TA_88715.pep
TAGGRAPIKGALCDFCGEXRATIYCRXXXASLXLSCERNVHSANNLSXRNXRTLLCXRCXSQTASXPVVFXEKNSLCQKMV

SEQ ID NO: 194298 - protein, 119 aa, Triticum aestivum
  unsure (1)..(119): unsure at all Xaa locations
  Clone ID: PAT_TA_88716.pep
LLEVXLVDXKGLSGTXFXXKIXPYVVXXYRSXERKSITARDAGRNPXWNXVLXFQINSXAANGQXKLVFRLMXHXTFSXDXFLXQAXINXXDLXXXRMESXXSRXNPXXYRVXTRRXTR

SEQ ID NO: 194299 - protein, 72 aa, Triticum aestivum
  unsure (1)..(72): unsure at all Xaa locations
  Clone ID: PAT_TA_88717.pep
MGKEKXHISIVVIGHVDSGKSTTTXHLIYKLXGIDKRVIERFEXETAEXNKRSFKYAWVLDXLKAXRXXGYQ

SEQ ID NO: 194300 - protein, 72 aa, Triticum aestivum
  unsure (1)..(72): unsure at all Xaa locations
  Clone ID: PAT_TA_88718.pep
XSQXSCICRXXNNXXKLSLRVPLXVYAHQINLTLXKLSXAGREKXTXWVLXSXPPIGXPASXPTTFLXXESG

SEQ ID NO: 194301 - protein, 101 aa, Triticum aestivum
  unsure (1)..(101): unsure at all Xaa locations
  Clone ID: PAT_TA_88719.pep
XKPVLPLQXEALXGQLLVSKSISPMRRQGXNEGSPSIXHTSSITLLXERXXNLQRVKEMXEGRELXRVDQSAXAXDXAGVPXLXSXXSWXLXXCXPDRRAX

SEQ ID NO: 194302 - protein, 70 aa, Triticum aestivum
  Clone ID: PAT_TA_88720.pep
APSRLSLSLSKTKRRENMYRQVTPMSMVASYFSFCSYLCQELHVVAVPLRCHPQRQGQHWLLVDLGFLTG

SEQ ID NO: 194303 - protein, 122 aa, Triticum aestivum
  unsure (1)..(122): unsure at all Xaa locations
  Clone ID: PAT_TA_88721.pep
QEEKKRQTLGXXKSSKLTSMXNRKQATMEEKNASXLGQREVHAPLLPRPRAPEWAPLRRRPWISWSCRSSRARAHASXPARXXXRRRRDXGPHHGCRXRGGRRPLGEGRXRPRXWVLAXXXX

SEQ ID NO: 194304 - protein, 140 aa, Triticum aestivum
  unsure (1)..(140): unsure at all Xaa locations
  Clone ID: PAT_TA_88722.pep
TSRXLALGXETLWKEPPFGRLTEKKXTQFLACDYXGXXCMDVQGSFAQICTKLIRKQLFWVXRSXITPYTXMGXWNFGWNSXXLXPXTTTMWTXFCNGYAXAIXFGXLFGKTXWAIYFXGVXQLKXVTTSIGXWWCLKRK

SEQ ID NO: 194305 - protein, 74 aa, Triticum aestivum
  unsure (1)..(74): unsure at all Xaa locations
  Clone ID: PAT_TA_88723.pep
MXEGIXIHXGQAGIXXGNACWELYCLQHGIXPDGQXPGDKXVGGXGDAXNXFFXKXGXGXXXPXXVFXDFSXHC

SEQ ID NO: 194306 - protein, 96 aa, Triticum aestivum
  Clone ID: PAT_TA_88724.pep
RIGEGLPLEPRGHVRDWAPPGWYWVVLPSGERSLVRSQPVVDPELLWWRSRGPALVHRLESPVQVVQHRVTKEDAHVQRYMVALADGRFSNTWQIL

SEQ ID NO: 194307 - protein, 50 aa, Triticum aestivum
  unsure (1)..(50): unsure at all Xaa locations
  Clone ID: PAT_TA_88725.pep
HSCYKQSIEXCYLPIKVVRKGVPLMFLALCELPIQRLPAKYSSNCSDFSH

SEQ ID NO: 194308 - protein, 80 aa, Triticum aestivum
  unsure (1)..(80): unsure at all Xaa locations
  Clone ID: PAT_TA_88726.pep
NVAPLDKVLXLLRESDLNEEGKTWXKLIEGLSACPEVSVLXKTPVNGXSDRFVNVVPVSGVVSDLLSMLEVAPERSTVQA

SEQ ID NO: 194309 - protein, 105 aa, Triticum aestivum
  unsure (1)..(105): unsure at all Xaa locations
  Clone ID: PAT_TA_88727.pep
TYHQPAXPAPRGDXXNXTPSXFKXXRLXTSGESSPXGSXRRGQAGPPXGAAARGXGSRXTAXKGGGXILXLXHAXVVVXXIGLVXGXGXSWXLXXFHXRGXCLGC

SEQ ID NO: 194310 - protein, 134 aa, Triticum aestivum
  unsure (1)..(134): unsure at all Xaa locations
  Clone ID: PAT_TA_88728.pep
MMPAMGKDIHFGSSIGGAGGTNTANGGNGGNIGAPASRADSCAKPQQELPSLTHQYAEQYVYAYPAPPAYGXPPKPPPAYRYGYGYGGGGSGGYGYGYGYPEPDGIWDEPAGAYGGGKIPTNTAARIIMAAVVG

SEQ ID NO: 194311 - protein, 42 aa, Triticum aestivum
  unsure (1)..(42): unsure at all Xaa locations
  Clone ID: PAT_TA_88729.pep
MXGSEXQQFQSXAGAGASKTYPMQGXXIRKXGFLXXKKXPCK

SEQ ID NO: 194312 - protein, 60 aa, Triticum aestivum
  unsure (1)..(60): unsure at all Xaa locations
  Clone ID: PAT_TA_88730.pep
PXNXXXLEXCXQAXXEGRXLXXEGXEIXRXACXWSXXLPXAXEXWKAIKXEFEPVDXIDK

SEQ ID NO: 194313 - protein, 100 aa, Triticum aestivum
  unsure (1)..(100): unsure at all Xaa locations
  Clone ID: PAT_TA_88731.pep
DXEIPXSRWXSIRAFLXIFDLVXVXAHXPPPGXXPFVAXPFCATXXDGEPFLGREPSXLNPMPGGLTHLTTSPPXLRXSRLRRTXWMDSLFCNQEXGIPP

SEQ ID NO: 194314 - protein, 171 aa, Triticum aestivum
  unsure (1)..(171): unsure at all Xaa locations
  Clone ID: PAT_TA_88732.pep
FPKXLXCSRFXPPSPTPIXXLXQKEPARGRLPSTAXLPXXDGVNPPRAAPSVVPXTGXWRPRSSPLTVTAPRTHRXRGAPVLLSFSFFTASSFFXLLFLSPTSPFTATELGPEPAAEPGMVSDQAGGRLHAVDGGEGAEGGNGHCWRWMVLLGCRNGGVTEGGQAGAGSVE

SEQ ID NO: 194315 - protein, 94 aa, Triticum aestivum
  unsure (1)..(94): unsure at all Xaa locations
  Clone ID: PAT_TA_88733.pep
SARAXXQGRWILLPKXWKLLPXPXRIYRXKALXARASKXGXNSPXGRAGXHXTWGXLSFXHXSDGGYSPXRWNRPXGLXVRALRRDRACGEGKI

SEQ ID NO: 194316 - protein, 53 aa, Triticum aestivum
  unsure (1)..(53): unsure at all Xaa locations
  Clone ID: PAT_TA_88734.pep
KVLGXFXXXLESCXXFPXLIPFLLTSCRFPPASPGXGWLXPXVGDGXWANPSL

SEQ ID NO: 194317 - protein, 68 aa, Triticum aestivum
  unsure (1)..(68): unsure at all Xaa locations
  Clone ID: PAT_TA_88735.pep
RXLXPVXVISGERLAGXLXXXXRDPXVGXPPSIRRCRSLQSGGIERSARGPGPRXRSLXLGGDPSSNX

SEQ ID NO: 194318 - protein, 75 aa, Triticum aestivum
  unsure (1)..(75): unsure at all Xaa locations
  Clone ID: PAT_TA_88736.pep
VLHPKHLEGDVESXKVQCIKLWMTIXQEEINXEXEEEEGEEXEEEEEEEEEEEEEGASSFIDTLCSFVPLLHTLK

SEQ ID NO: 194319 - protein, 93 aa, Triticum aestivum
  unsure (1)..(93): unsure at all Xaa locations
  Clone ID: PAT_TA_88737.pep
MEGGGLVLALXXGLAVALAGXNSXGXALSXXXGXXRXPGGXLQXWEPTLVKXCXWXXVTCEXEXRVTXLXXXXLHLSWTGRALWRINWFKILK

SEQ ID NO: 194320 - protein, 101 aa, Triticum aestivum
  unsure (1)..(101): unsure at all Xaa locations
  Clone ID: PAT_TA_88738.pep
LPSSRXXXSHGADQGXGGGHRDXPREXLLXRRGVXXRPRPDXRXQRPXETXHALVRRLQRLRAPQRXMAARNKSXXNPTKTVFDXKAXLLXKGLLMPLQWY

SEQ ID NO: 194321 - protein, 90 aa, Triticum aestivum
  unsure (1)..(90): unsure at all Xaa locations
  Clone ID: PAT_TA_88739.pep
SINVPPKAIKIPXAWXPGYXXQIDAAKEFKTGXXAKKKKSLGFHXXXILAKERSGPAXGIISXWXLHXXXSXLGVGRXEXGGXXQXPPGX

SEQ ID NO: 194322 - protein, 63 aa, Triticum aestivum
  unsure (1)..(63): unsure at all Xaa locations
  Clone ID: PAT_TA_88740.pep
WAHLINHRFXPIIFFLRXXPQFFGFNXXHSPIKGGAPXLCSTFFXSNFGXXLXGPFGXFFXLS

SEQ ID NO: 194323 - protein, 157 aa, Triticum aestivum
  unsure (1)..(157): unsure at all Xaa locations
  Clone ID: PAT_TA_88741.pep
LQVLHSAMRGVXXLVGVAVSXSXPGXQQLXXLXPVVNXSTVGIXXSSAXXXVXGGFXXDXQRSXLXWGWXRRPXXSQSXSGNXLALXGGGXMIDXQASSLTNXFXGTPLFGXGXFXQXXGXPKNXSXNNGGXXEFXPNKXGGXLFFSNKKNSXGAGN

SEQ ID NO: 194324 - protein, 80 aa, Triticum aestivum
  unsure (1)..(80): unsure at all Xaa locations
  Clone ID: PAT_TA_88742.pep
PXXLLXWXGSXPXXGPSPVXSSXLVTXXXPVHTXPVXGKEEXXGGGEXRAGSXQXGXVLXXRREREXEEADPRQGGGGRL

SEQ ID NO: 194325 - protein, 156 aa, Triticum aestivum
  unsure (1)..(156): unsure at all Xaa locations
  Clone ID: PAT_TA_88743.pep
AGGXRGGRRCCXSSSSSPXXGAPPXIPGRXRCPPRRRPSRASPHLLPAGSPPRRXGRRHRRRXXYIXXGQVNLLYLNXDEXIAVXFXXSXXPVFTXRCKTNFRESXGQPXPNLIRAIFAIXXGIXXNLXPKXXISXEYXDFMXXIQTNXFLSXXSX

SEQ ID NO: 194326 - protein, 85 aa, Triticum aestivum
  unsure (1)..(85): unsure at all Xaa locations
  Clone ID: PAT_TA_88744.pep
VGIPXXVXQCGSXXPXDXPPPHKXVFVGXLSPGLLLXXFLSXQXRXGXGNSVCXLYXPAXEXXMYLSXDHRLAXKXXPNLVCSSD

SEQ ID NO: 194327 - protein, 86 aa, Triticum aestivum
  unsure (1)..(86): unsure at all Xaa locations
  Clone ID: PAT_TA_88745.pep
GKHLNRSQYSKLKLTDLQHACLCITCLQAVSFLRITSRLRPTXRLHCFPSRADHGVGPGHHTXPQGLHEALTSLAKFMSQPIVWPS

SEQ ID NO: 194328 - protein, 43 aa, Triticum aestivum
  unsure (1)..(43): unsure at all Xaa locations
  Clone ID: PAT_TA_88746.pep
HNXKFNAYXYSXPGSSXSXLSETNIFHVTXCWIFLVXTVXXSI

SEQ ID NO: 194329 - protein, 45 aa, Triticum aestivum
  unsure (1)..(45): unsure at all Xaa locations
  Clone ID: PAT_TA_88747.pep
MVRXXKVEFDERPPDDXYPNNPYGDPVVDXXXXREQLLREKWXQI

SEQ ID NO: 194330 - protein, 87 aa, Triticum aestivum
  unsure (1)..(87): unsure at all Xaa locations
  Clone ID: PAT_TA_88748.pep
EKXCDKFXCXGLLFRAXCKCIXSWSXTINGPLMKXXDIWMAHFDCXYIDDXQVTKRSEIPPGXGXFXGXTSSNIILCXXGGXAMPDX

SEQ ID NO: 194331 - protein, 78 aa, Triticum aestivum
  unsure (1)..(78): unsure at all Xaa locations
  Clone ID: PAT_TA_88749.pep
PTASRFSXGPCTATXXWDAELXILAHSATAAFMXXCXWNSTMESMXHGKPXXAWPMXCDXPWDAEXXCNYLKAGTRMP

SEQ ID NO: 194332 - protein, 80 aa, Triticum aestivum
  unsure (1)..(80): unsure at all Xaa locations
  Clone ID: PAT_TA_88750.pep
FLTTXPXEEYELPGXKRIHRLCAQSVPLLSAPTTIAWVRTNMXCGEQKVEGPRAFRGHVRGVSGSSRAHLIIIISSGTSY

SEQ ID NO: 194333 - protein, 53 aa, Triticum aestivum
  unsure (1)..(53): unsure at all Xaa locations
  Clone ID: PAT_TA_88751.pep
XKVSSFFFFFLVGXXLQXAXLRVFFLTNXNYASSSQNPFWQRXSIXXCLXIGN

SEQ ID NO: 194334 - protein, 68 aa, Triticum aestivum
  unsure (1)..(68): unsure at all Xaa locations
  Clone ID: PAT_TA_88752.pep
XVHTVLIVXILRWXQYXRNYLTWXLKILVTCVLVSNMXSCLGNWKKAATYRTLTKQERFGQGTWKELY

SEQ ID NO: 194335 - protein, 99 aa, Triticum aestivum
  unsure (1)..(99): unsure at all Xaa locations
  Clone ID: PAT_TA_88753.pep
WDLQPGGXYXFTRNMSCLXAFAXXEKYRVGNGFNIXAAHXDSPCLKLKXXSXSFKSGHQXVGVQTYGGGLWHTWFDKXXTLAGRVILNAPNGSFKHKLV

SEQ ID NO: 194336 - protein, 106 aa, Triticum aestivum
  Clone ID: PAT_TA_88754.pep
LRRRPPSARRPNPRPRPHPPTSSSTSPAPASAAAAPFLSRKDPCPDLSSRRPVSLVGSRWPSRCVPRHVLGATHLVAGRPQNSCRLSPSFMYAGQMNCSLLDRPDG

SEQ ID NO: 194337 - protein, 114 aa, Triticum aestivum
  unsure (1)..(114): unsure at all Xaa locations
  Clone ID: PAT_TA_88755.pep
MLDKLWDDVVAGPRPETGLDKLRRAAATQPLAINTAAGEAIKQSPSMPTTPTTPVTPSSSTPPRGGSVWRSVFHPGSNLAPKSXGQLFERPQAKLPTVYDWXFTGRRQPRQPLN

SEQ ID NO: 194338 - protein, 73 aa, Triticum aestivum
  unsure (1)..(73): unsure at all Xaa locations
  Clone ID: PAT_TA_88756.pep
KXXLCXTPDXLRPXLXRXPRAXGLPGNCPSSPPVPXLXSFWXPXVGGARLVXRXQLXGRRTSHLFSEEERLAR

SEQ ID NO: 194339 - protein, 98 aa, Triticum aestivum
  unsure (1)..(98): unsure at all Xaa locations
  Clone ID: PAT_TA_88757.pep
PPPNRXXLTXWXXKXRRXKEXPARKWIAGLXMAFGGXSXPGXXISAQMAAXLVDXGFIPPSALRXGQQMETXGSDPEHPGQXLGAXEYRSQLRRSXSA

SEQ ID NO: 194340 - protein, 73 aa, Triticum aestivum
  unsure (1)..(73): unsure at all Xaa locations
  Clone ID: PAT_TA_88758.pep
XVSKICSPLLPRVAPXGRVGGDPXXVRRQPPSSXSPLAXXGXXRRXPXXNAXEGGGEVXRXXXSLXNRPRVPS

SEQ ID NO: 194341 - protein, 154 aa, Triticum aestivum
  unsure (1)..(154): unsure at all Xaa locations
  Clone ID: PAT_TA_88759.pep
MAPTVMASSATSVAPFQGLKSTAGLPVSRRSNGASLGSVXSNGGRIRCMQVWPIEGIKKFETLSYLPPLSTEALLKQVDYLIRSKWXVPCLEFNKVGFIFREHNASPRVLRRLLGQCGNCLCSGWNRPTQGDRWGRVGTLDAVRPQSIRITIPR

SEQ ID NO: 194342 - protein, 66 aa, Triticum aestivum
  Clone ID: PAT_TA_88760.pep
PDLICSPPFRKSTHIFHSFTRFSLLPTVGRRPCQLSLPTTARALQAATPGAGCLLVLAAGCCRFSS

SEQ ID NO: 194343 - protein, 147 aa, Triticum aestivum
  unsure (1)..(147): unsure at all Xaa locations
  Clone ID: PAT_TA_88761.pep
MAXTTTMGLSSPAIKLAGASYALXGGGRITMRKAAPKXSASNSPWYXPDRVLYLGPLSGEPPSYLSGEFPGDYGWDTAGLSADPETFAKNRELEVIHCRWAKLGALXWVFPXXLAXNGVXFGEAXWVKGGLPXXSXRGGLPIFLXXP

SEQ ID NO: 194344 - protein, 109 aa, Triticum aestivum
  unsure (1)..(109): unsure at all Xaa locations
  Clone ID: PAT_TA_88762.pep
MGSXTLLKSSFLPKKGXWXVARXXXAPRVXMXVRAGAXXDXLVKTXKXXXLXGAGILXMXEXNAXXGKRLHXXXLXNTKXEPKRSATPGSPVPLGLGKTKSGGPPLSRT

SEQ ID NO: 194345 - protein, 156 aa, Triticum aestivum
  unsure (1)..(156): unsure at all Xaa locations
  Clone ID: PAT_TA_88763.pep
GSLXLXXGGQXGRGWVGMEXLDSKSXNGVRXPPREXKWEXXFGXWSXGVXNSPLGXPWGGKXGGXGDPWXGXLRGVPSXGIXWGKLKAXPGFXPXFSPXFLLXNKTQXMGGXKXGPPSSXLVPXKQXXVGKXKNKKQPREIVHCLGKLGXXXAPVG

SEQ ID NO: 194346 - protein, 96 aa, Triticum aestivum
  unsure (1)..(96): unsure at all Xaa locations
  Clone ID: PAT_TA_88764.pep
PGPRGSVDRSSKLHAHGKINAYPSPLDHPSVQPISSLCMHGYLTIGIITXSKLCXWVXLCNFLPMCDNEXEKHNKVDDPWXLAKTWGCNFPGLQGG

SEQ ID NO: 194347 - protein, 83 aa, Triticum aestivum
  unsure (1)..(83): unsure at all Xaa locations
  Clone ID: PAT_TA_88765.pep
VYFIFLLLQIILFNFXLSAFLFLQELSGDEGGFEKALLKFYLNQKVKCLKRKLSSTVRRNVVSPPWLYLKFYLSKMLCNLFSL

SEQ ID NO: 194348 - protein, 145 aa, Triticum aestivum
  unsure (1)..(145): unsure at all Xaa locations
  Clone ID: PAT_TA_88766.pep
XXFERXGAGPXSRXKEXAWRFARARFMXGXGXRQPPTPXLXPLKNKIKEDXKKSXAPGXPAALKHQXPXLKXHSTARMGGXSRLXSRXXGGRRIDTGEATTSTAGXTVDLAPNLSRRKGADXHGGLXGGHXXXIRRRMDRGGEAT

SEQ ID NO: 194349 - protein, 147 aa, Triticum aestivum
  unsure (1)..(147): unsure at all Xaa locations
  Clone ID: PAT_TA_88767.pep
TCTKNIKENVGGEPEAQPRKVEPATEILFLCSYDNCGKTFVDVAALRKHAHVHGERQYVCXEPGCGXKKFVDKLKVEGXTTLLTXGQKDFVCPTSKXWVXAFXLDFNLRAHPPKXHAXGXNYQXMPPSQXCGXKGFYXRPSKFXXHX

SEQ ID NO: 194350 - protein, 160 aa, Triticum aestivum
  unsure (1)..(160): unsure at all Xaa locations
  Clone ID: PAT_TA_88768.pep
RPVPSKSQXAKSKKIDVAKKSSKFQQKTVPRWEXASGSSTDGCRFQQILWLGCSTVDAWFQQKLRHTKNCRLVAAPGSAGSSILHHSSIILPLWLQHPSTWSPCPWWAAPCSTGCSIAGRRLQHQWTPPSPAPAPPRRPKAAAAQWLAAPPPVEAMRMEK

SEQ ID NO: 194351 - protein, 148 aa, Triticum aestivum
  unsure (1)..(148): unsure at all Xaa locations
  Clone ID: PAT_TA_88769.pep
XEKSGDGSRRGGLRRLKIWERQPEPVAWSGRTEETPAGFSAGSAXCVGFTQILRXGPSLPRPRPHVFVDPYQPYLFFFQNLHPRSPTTHAPRSLPLAVHGSTPASLPPPSPATAAALRHSAPATCNAAAANLPPTQAPEVPTSTRLGL

SEQ ID NO: 194352 - protein, 123 aa, Triticum aestivum
  unsure (1)..(123): unsure at all Xaa locations
  Clone ID: PAT_TA_88770.pep
MAASMITSPIVAPTSVPSLSRRGSSFAVVCXSGGKKIKVDKPLXLGGGLTVDIDANXRKVXKXGVYQFVDKVXGPNVDGYKPIYTPEGMVLKSGGTLRGNGFYLGGRPSPGASLRGGGGSLKK

SEQ ID NO: 194353 - protein, 79 aa, Triticum aestivum
  unsure (1)..(79): unsure at all Xaa locations
  Clone ID: PAT_TA_88771.pep
GVXERPVAGRASPRPGRXXRQXVHRXGVFXGGRGRRAPRGPWSHGQTEXSGTRSLXWCXPAPSXXSRLXPRRRSPVXSP

SEQ ID NO: 194354 - protein, 52 aa, Triticum aestivum
  unsure (1)..(52): unsure at all Xaa locations
  Clone ID: PAT_TA_88772.pep
DTDXXSWRXAERXRVPPXXXTGEXXDGTXRLPPPHVDVAGSPVGGANPRSXG

SEQ ID NO: 194355 - protein, 131 aa, Triticum aestivum
  unsure (1)..(131): unsure at all Xaa locations
  Clone ID: PAT_TA_88773.pep
MAPAVMASSATTVAPFQGLKSTAGLPVGRRSSGSLSSVSNGGRIRCMQVWPIEGIKKFETLSYLPPLSTEALLKQVDYLIRSKWVPCLEFNKVGFVFREHNNSXPGYYDXRYWXTMWKLPMFGCTGRHTRC

SEQ ID NO: 194356 - protein, 134 aa, Triticum aestivum
  unsure (1)..(134): unsure at all Xaa locations
  Clone ID: PAT_TA_88774.pep
MAPTVMXSSGTSVAPFQGLKSTAGLPVSRRSNGASLGSVSNGGRIRCMQVWPIEGIKKFETLSYLPPLNTEXLLKQVDYLIRSXKWVPXLEFXRXGFIFRXEHKRIPLGTNXXRYWXKWWKAGLCSDCNRPHAK

SEQ ID NO: 194357 - protein, 60 aa, Triticum aestivum
  unsure (1)..(60): unsure at all Xaa locations
  Clone ID: PAT_TA_88775.pep
SRGDMNSYPFXTACXIYQTCQCXHXXEYLXQHVYQNISTILGHKIKKDSXQNTKCKYCVS

SEQ ID NO: 194358 - protein, 109 aa, Triticum aestivum
  unsure (1)..(109): unsure at all Xaa locations
  Clone ID: PAT_TA_88776.pep
MGKIKIGINGFGRIGRLVARVALQSDDVELVAVNDPFITTEYMTYMFKYDTVHGHWXXHSDIKLKDDKTLLFXXEKXVTVFXVRKPEEIPLGXEAGADYVVGXPTGVFN

SEQ ID NO: 194359 - protein, 77 aa, Triticum aestivum
  unsure (1)..(77): unsure at all Xaa locations
  Clone ID: PAT_TA_88777.pep
EQWXPKVFSLGGXCWGGLCNPPSPXRLPPGKSPFVVRGSIQTPLPSKMTTXSCXSRPXSPSPTSTGXMPGXFXFYPL

SEQ ID NO: 194360 - protein, 115 aa, Triticum aestivum
  unsure (1)..(115): unsure at all Xaa locations
  Clone ID: PAT_TA_88778.pep
GRRRPTPPSVPXRSRSIAPPPARPPAGVSAPSAALNIGFKGQCLRRCGAKSFXSLXSCLGVFITQSKVILSGPVELLKYGGQPGIISRGEXSPGFXXMXKKXRXFNSXGEKXPGX

SEQ ID NO: 194361 - protein, 132 aa, Triticum aestivum
  unsure (1)..(132): unsure at all Xaa locations
  Clone ID: PAT_TA_88779.pep
XGTXVDPNRXXHXXKXWSWMGAPXPWRDAKCLPGISXXPSWHVAESHTHCHRRXPVXHXRAXMXRXCXCXXEACMLXGGAISXXEQYPLYVCGPHXPMCSXLHVSLXKHXNXNXCXHXSXVXXXXCTQXNXA

SEQ ID NO: 194362 - protein, 70 aa, Triticum aestivum
  unsure (1)..(70): unsure at all Xaa locations
  Clone ID: PAT_TA_88780.pep
MSARVCTMLKVKIXHIIXRXQISFFLXXPIFLNYLDCLPHVSXGNGTNIFAGXNPTSRCFXSSPXVSSVF

SEQ ID NO: 194363 - protein, 104 aa, Triticum aestivum
  unsure (1)..(104): unsure at all Xaa locations
  Clone ID: PAT_TA_88781.pep
LPRGGGGGRLPHTDGRRRPWLLHGRGHHSLRQFFSLAIPTQPLYAKNVWICFCLSMNNFFPGIYIPISFFPTNIXSLCSKPRDEPELSGKPKSRXXDFLDDRXV

SEQ ID NO: 194364 - protein, 61 aa, Triticum aestivum
  unsure (1)..(61): unsure at all Xaa locations
  Clone ID: PAT_TA_88782.pep
RFTLMLYSSIQIIFLRSLKQQIISQPYTWXHGEFDQKRXNKTHFLSLFMLGLXKEFKSSSN

SEQ ID NO: 194365 - protein, 115 aa, Triticum aestivum
  Clone ID: PAT_TA_88783.pep
ATRRRIGQWNDMVRARRWQRPSSTYLSTSGGLLSGQRKRKKTRKGDERKEGSLHTEGGDGIDLRSVELLRRKKEQFIENRQESQETELSPLSGSKKPMDNNVSVAREIAEHMKLM

SEQ ID NO: 194366 - protein, 146 aa, Triticum aestivum
  Clone ID: PAT_TA_88784.pep
SLEFLDLSNNQINGSIPPTFWKLTSVTTLSLDSNQLNGLLPPELGSLVLLTKLNLSSNLFLGNIPPEIGHCHLLSSLLLSDNLLTGEIPQELGYLTNLYELDLSRNNLNGAIPTTFSNLTQLYRLKLSYNYLAGQSSIYRCNIDLT

SEQ ID NO: 194367 - protein, 93 aa, Triticum aestivum
  unsure (1)..(93): unsure at all Xaa locations
  Clone ID: PAT_TA_88785.pep
SSINPXAXTFSPQLRRGLPLIHPHLRPAGQPAILLRPHLNRHLWCPIYRQAAARGQRQGELFCSPLQEGRGAGPAAQRHRHRHHAHPHEEPSY

SEQ ID NO: 194368 - protein, 85 aa, Triticum aestivum
  unsure (1)..(85): unsure at all Xaa locations
  Clone ID: PAT_TA_88786.pep
LPXEEXQRRQHHLAIMNISYKPFXVPGLQLQAHWCKECSTYIPCEXSRRLLIKAMSSSAISSFRCSSATSVFRAAARGEAAYIPS

SEQ ID NO: 194369 - protein, 103 aa, Triticum aestivum
  unsure (1)..(103): unsure at all Xaa locations
  Clone ID: PAT_TA_88787.pep
SPDSGQLRXLPRAAAHGNGSPRRPLPIRPAXQPSSPPRXSPLVTEEMSCTACEAXLPIHLFPRQHRAAXGXELTIGHGMRAXKXLPAPCPAVXXTGNGTXPXE

SEQ ID NO: 194370 - protein, 93 aa, Triticum aestivum
  Clone ID: PAT_TA_88788.pep
MHWKLLRKLSNVPNVMFQLGFDLEVIGVHPHANIIFFIAHWNNELIAYDLDHHESTVVYHVEPNYQKFRPFFSYVPLFSRLPLDGGIRLATPN

SEQ ID NO: 194371 - protein, 150 aa, Triticum aestivum
  unsure (1)..(150): unsure at all Xaa locations
  Clone ID: PAT_TA_88789.pep
MFTAWELGEMYITQLLKLSFLEHSKIARSFYDDANVTAFTMHDLVHDLARSVMGDEILLAGNDGNIEGNRCHYALLNDCREPLELRRIRAIRFMGSDEIRLDDAAFSSAKSLRVLDLSECSIHELTKSIGRLKQLRYLNAPRVQHEXIPG

SEQ ID NO: 194372 - protein, 135 aa, Triticum aestivum
  unsure (1)..(135): unsure at all Xaa locations
  Clone ID: PAT_TA_88790.pep
LAHPXXWXPPXSFPGFXXGSYXXFGXNXPPRFPTXLVXGEXXVEXAXGXXXXAAXVRXTRXDXYNGXPEDTGLPLAAXLRMVTRPLPEEPRXRQVLDPLPGEGRGGEPXSXCSPIAXKKTRACPXSLLSESGVLL

SEQ ID NO: 194373 - protein, 128 aa, Triticum aestivum
  unsure (1)..(128): unsure at all Xaa locations
  Clone ID: PAT_TA_88791.pep
GDGRGGRGGRWSALAASALIXASRGASYCFGLYSPAIKASQGYDQSALDAVAFIDVGANAGVLSGFLSAXPSGASDAPXIVLLAXAALCAAGHLHMWLAVAGAAPXPIPLVCLSXXYMLLPAQAQTFL

SEQ ID NO: 194374 - protein, 90 aa, Triticum aestivum
  unsure (1)..(90): unsure at all Xaa locations
  Clone ID: PAT_TA_88792.pep
VMSSSLSLDXSXSXAMTXAVTPXGRXXPPXLEXAPXILHXHRRRRXHDNNPXLXVPWXXXPKLXQQAAMEIRRGTGEGXRDXGGREXXTR

SEQ ID NO: 194375 - protein, 152 aa, Triticum aestivum
  unsure (1)..(152): unsure at all Xaa locations
  Clone ID: PAT_TA_88793.pep
LDIPPSFLKRSCRACRSRPPPPICPPSFIILXHQXWYXLTLGLXTKKSKVGALRVRXGGHXXGRGPTLXGHDPARGREQXXHPRGSPGKRXGALXSSRXGGASTSXVYXRXXGLGRRPGFLSAXERPSREGXTAXPLVGGSKGLSLGQXXAN

SEQ ID NO: 194376 - protein, 132 aa, Triticum aestivum
  unsure (1)..(132): unsure at all Xaa locations
  Clone ID: PAT_TA_88794.pep
KXVLDLXAGVKDYKLTYYTPXSMKLXDTDXLAAFPSXVPQPXVXRPNEAGAAXSXXNLLLGTWTXVWTDGXTXLDSLRLSHRRLFWKTQLLALSTPYFARRVVTNMYFHLVPVGSKPLPCSFWRLNSPLYKL

SEQ ID NO: 194377 - protein, 148 aa, Triticum aestivum
  unsure (1)..(148): unsure at all Xaa locations
  Clone ID: PAT_TA_88795.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASXPGYYDGXRYWTMXXLLCSGCTRTPHKIKRWREGQNGPLNFPA

SEQ ID NO: 194378 - protein, 142 aa, Triticum aestivum
  unsure (1)..(142): unsure at all Xaa locations
  Clone ID: PAT_TA_88796.pep
MAFSGQFLELLDLGSCNLTGAIPTELEQLSQLSQLNLSENELIGPIPASLDNATELAILLLDQNMLTGXVPRTIGNMNSLIILDISTNYLHGDVNFLPVFSDLPNLQYLXIKSNNFNGVALPKQCGGKATAGRTGETPSPSP

SEQ ID NO: 194379 - protein, 78 aa, Triticum aestivum
  unsure (1)..(78): unsure at all Xaa locations
  Clone ID: PAT_TA_88797.pep
RLDXGGDLSFDFDPRGLFEHRGAILLGRPRCSLECHYNRWQRCSLGERSPKXQNTYEECLELFSXSLRESGVLVHQWF

SEQ ID NO: 194380 - protein, 114 aa, Triticum aestivum
  unsure (1)..(114): unsure at all Xaa locations
  Clone ID: PAT_TA_88798.pep
EEEKKXXXRSXXFXXRVXXEXQRTAGXPHAYXPQDCXESGXSLXKXPSXDEDAEAFXGGGRGAKQPWHHRTXVAXXIPPPPAASGLXLTPARAGWLFVAARRRVVGAAVHGLGR

SEQ ID NO: 194381 - protein, 113 aa, Triticum aestivum
  unsure (1)..(113): unsure at all Xaa locations
  Clone ID: PAT_TA_88799.pep
MXRXPXXALXSLXNXDAXRXPWLXRXXRHXRTSPXXRTXXXAXXXSPAGXIAWSXYXCLTSLRNRIXAAALXXETRLQLPLFRLLXENXPLXVIVEXHGXAXFLEVXYXWRGG

SEQ ID NO: 194382 - protein, 141 aa, Triticum aestivum
  unsure (1)..(141): unsure at all Xaa locations
  Clone ID: PAT_TA_88800.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXMVGFNFREHNASPWVXXGRYWXMWXLXXFGCTDPTXGDQRWREGNKGPL

SEQ ID NO: 194383 - protein, 66 aa, Triticum aestivum
  Clone ID: PAT_TA_88801.pep
FQPIPITFDDLAYMPLPVSKAKLPPQSLTDSSVVSPINSQHFESGFIPDHLSTSPQRLELKVAAAP

SEQ ID NO: 194384 - protein, 96 aa, Triticum aestivum
  unsure (1)..(96): unsure at all Xaa locations
  Clone ID: PAT_TA_88802.pep
NSLEFFFFFFKWRNTLHIDFVTVRNSVFTLHTNLTCAEIIICRFPLFQRSSSADFHYPQIMWLSPNQSNCRLXHDSCGRPSSLATFNLHVTGVQQW

SEQ ID NO: 194385 - protein, 134 aa, Triticum aestivum
  unsure (1)..(134): unsure at all Xaa locations
  Clone ID: PAT_TA_88803.pep
RXPXSFHYRLCLLFLLCCXLIXISLCLGPLTPAAAAAVGXRSRPSPPLPAARAQRQEPTGSPARRALCQNPSDPTSSIPPADPARIDRGLPLPLLLPLQVERSCERANTELVEGEMRGRGANGYSCYSTWGIWD

SEQ ID NO: 194386 - protein, 81 aa, Triticum aestivum
  unsure (1)..(81): unsure at all Xaa locations
  Clone ID: PAT_TA_88804.pep
MSGMEEEENPPELXIXEEXLKAKCLMNCEVAIILEHXWEQLXHMXXGRXPTXVSQVFEKXXAYVKRFXSRXXXPXXVPSRS

SEQ ID NO: 194387 - protein, 75 aa, Triticum aestivum
  Clone ID: PAT_TA_88805.pep
LDGEEGWISPPRNGKVESSFDREGVASAVRAVVVEEEGRRVFAANAKKLQQIVADTACHETCIDNFVQQLRFYKG

SEQ ID NO: 194388 - protein, 123 aa, Triticum aestivum
  unsure (1)..(123): unsure at all Xaa locations
  Clone ID: PAT_TA_88806.pep
MSPQTETKAXVXFKAGVKDYKLTYYTPEYETKDTDILAAFRVSPQPGVPPEXAGAAVAAESSSGTWTXVWTDGLTXLDXYKXXCXHIXEPVAGEDXQWXCYCSLSITPIXXEGPXTNMFTSIR

SEQ ID NO: 194389 - protein, 93 aa, Triticum aestivum
  unsure (1)..(93): unsure at all Xaa locations
  Clone ID: PAT_TA_88807.pep
SPTSTDYSSVLDDXAPRLLTEKKKTRHHSINRYSSGAPASTYCFQGRLNDWMSMXKRGSKDDVVVLLPSSSQQIXPQXPRGCPLEREISGEXX

SEQ ID NO: 194390 - protein, 120 aa, Triticum aestivum
  unsure (1)..(120): unsure at all Xaa locations
  Clone ID: PAT_TA_88808.pep
DTLXLLLSMXNVXAYSNVLAVDMVGGLIVGAVAERLRGTXYVCSTNLXSGXSSXXXIRMYNLDXEXXNKXFXAPLNDLWPXKTSGDAPGRGWLQTKVFNHPWENQLVQYQMGMQRTSATN

SEQ ID NO: 194391 - protein, 117 aa, Triticum aestivum
  unsure (1)..(117): unsure at all Xaa locations
  Clone ID: PAT_TA_88809.pep
AVARKAPCXCLLXDFPSASSSSFTPTPEQLDSPSPVSLCSTTFASTDSCWVSATILLLFLFVCKLHSIFIDTQRKQSRIHLLHHSHENIKALDIAVAKHHTXQRLHVHSVMPGFITS

SEQ ID NO: 194392 - protein, 138 aa, Triticum aestivum
  unsure (1)..(138): unsure at all Xaa locations
  Clone ID: PAT_TA_88810.pep
MTRFCAGEDSWLARSNNMTKNPGNSDTRDSNGRSRRNKQKRRINGDNAEDTAVXAGFRGYKYGQRKKPFXRNPRGPSSLXKYSTACARYMAPPEKLGNHTNRDCWVFKHAKQXXCSNTTGAXGWHTXXXXAXRPRAAR

SEQ ID NO: 194393 - protein, 97 aa, Triticum aestivum
  unsure (1)..(97): unsure at all Xaa locations
  Clone ID: PAT_TA_88811.pep
LLPLLYLQKIVXPKKKERDSSLSIHDDDTAQDENVYHFNNTNRRLDKRMQPDGFLKCPTKHITEQPEGAVICGRRHAMLRGSLSAESPITLDQAKTS

SEQ ID NO: 194394 - protein, 86 aa, Triticum aestivum
  unsure (1)..(86): unsure at all Xaa locations
  Clone ID: PAT_TA_88812.pep
KRXRHLPAXECLMCXXXXPPTSPVFPWRXLRHHLAVGPHARNVNQXVRKXALXRQEXIXGEIXKLEVXXLVRGXLHPXRVXXXVLV

SEQ ID NO: 194395 - protein, 156 aa, Triticum aestivum
  unsure (1)..(156): unsure at all Xaa locations
  Clone ID: PAT_TA_88813.pep
VKGXIFFTXEGDXPXTVXGXVTGLNEGXHXFHVHXLXDTTNGCMSTGPHFXPXXHVHGAXEDXIRHAXDLXNVTXGAAGVANINVXDCHIPLTXXKFKLXAVLLSSMXTLHDLGKGAHELXKXTENAXARVACGIXGAPGARCHLRTNVVDLGLFK

SEQ ID NO: 194396 - protein, 125 aa, Triticum aestivum
  unsure (1)..(125): unsure at all Xaa locations
  Clone ID: PAT_TA_88814.pep
XPPKIXRLLXLAPLXAXGPXIRXPPGWLRNSHPTPGRXVDPVGRXXGQVRXEEGKGGHGGAPPXXXGPGADHRXXLXXKXSFLNWGDKXVXWAKAXWPXXFGGFSWMGSXHXNKGFXLTNXFGXF

SEQ ID NO: 194397 - protein, 80 aa, Triticum aestivum
  unsure (1)..(80): unsure at all Xaa locations
  Clone ID: PAT_TA_88815.pep
GLSSLLQPSTSXXLYSPIAMGKIKIGINGFPKDRXARGQGSPSNSRRMXSSVXVKDPFITTNXMTYMFKVRKRPRXLVAK

SEQ ID NO: 194398 - protein, 98 aa, Triticum aestivum
  unsure (1)..(98): unsure at all Xaa locations
  Clone ID: PAT_TA_88816.pep
PFRLQEQPAFDKKQFISHXKXYIKNLXAKLEGDDLDVFKKNVESXATKYLLSKLKDLQFFVXGESMHDDGGVVFAYYKEGAADPTFLYFAHGLKEVKC

SEQ ID NO: 194399 - protein, 62 aa, Triticum aestivum
  unsure (1)..(62): unsure at all Xaa locations
  Clone ID: PAT_TA_88817.pep
LSCLPAIPYVILFLXFFLGRINATHITXTLQASVYQVXXLGMFSALRLASSSIXTWXEDSSK

SEQ ID NO: 194400 - protein, 164 aa, Triticum aestivum
  unsure (1)..(164): unsure at all Xaa locations
  Clone ID: PAT_TA_88818.pep
SSLPSPNSAATPSSTSQSRARPALPLLPRPHALTPSPQSSSLSXACLNPPLEPEPNQEQIQNASRTMSRVAGSRLLPRISALSFCTASPXTAAASSSSSTAAVASGSRHRLRRLPPTPEDHPPSXPKTXRQXVGXGSXSAXXXPAXANRXLGXNGXXVXAXXXS

SEQ ID NO: 194401 - protein, 82 aa, Triticum aestivum
  unsure (1)..(82): unsure at all Xaa locations
  Clone ID: PAT_TA_88819.pep
MGILALITGKAGAXGFGXASTAEXVTDGAXAXRLNVAITXGXLSGIGLXDIKSPRPXEEAHVGIAATNTKGCIXKQRKHHKK

SEQ ID NO: 194402 - protein, 135 aa, Triticum aestivum
  unsure (1)..(135): unsure at all Xaa locations
  Clone ID: PAT_TA_88820.pep
MDGGRAAAVGDPSPIAAPSNPPALSRPVXVSSFTHTPCYCEXXVYMLCNELIRTGVADPAGTDLYVVFISXXEKKVPLWHQKTGHSXDGFICWDYHXIXIQSXRSKXXSXFVWDXXSDLPFPSPXDPXKVSEAIQ

SEQ ID NO: 194403 - protein, 82 aa, Triticum aestivum
  unsure (1)..(82): unsure at all Xaa locations
  Clone ID: PAT_TA_88821.pep
ELLQSLCCGFSRVEYKXPKGSVIELSRESXHVLKICIEGEEVGSIQSKLLCKSLXDLYIGXXPFXENAKDDIXENIAXILKS

SEQ ID NO: 194404 - protein, 75 aa, Triticum aestivum
  unsure (1)..(75): unsure at all Xaa locations
  Clone ID: PAT_TA_88822.pep
GWHXLGQIPRXERTACFYEYXXSGPGALPSNRVXWCRQLLDVEAEQFXLAHTFIDPDVDRPWLLQMMAIRIPASA

SEQ ID NO: 194405 - protein, 72 aa, Triticum aestivum
  Clone ID: PAT_TA_88823.pep
RRKTLEELTKLMKTSHIQELTKLMRFHLTRRLQDFLIHLYLTFSSHWMGNRKKHKDYLTIIWKKTYLLIQDQ

SEQ ID NO: 194406 - protein, 146 aa, Triticum aestivum
  unsure (1)..(146): unsure at all Xaa locations
  Clone ID: PAT_TA_88824.pep
CRGTREGCLTSVARVRRDGRAPAAIGARAXRACDGCMRXRXRWXCAADDXYLCQAXDASVHSGNPLARXHHRVRLPSSVLAXRHLLPSATPNPDXPAWLHGLKAPGRAXRGSKPRWWAKHGGAPPKGRGVASGGSPDSRGPGSSVG

SEQ ID NO: 194407 - protein, 120 aa, Triticum aestivum
  unsure (1)..(120): unsure at all Xaa locations
  Clone ID: PAT_TA_88825.pep
MAMEAVGTXSSXSGLLAMLQEXXPELKLHTLXRLNSVXHLFWXEISTXVPXIEKLXXRXEXEQRXLAPLVVSKVIYYLGXXLNXSLSXALXAXXLXXVSDESXDYXHALLXKTXREXKYQ

SEQ ID NO: 194408 - protein, 151 aa, Triticum aestivum
  unsure (1)..(151): unsure at all Xaa locations
  Clone ID: PAT_TA_88826.pep
FFFFFLEASRDXFIEHQVQQALHSDYLFILSLPRSKPQKQARKSGKSRTQTGNQGIRLLATVLHTSTGTSYSYPQHVTCAKNTHHHHHQVTTLSINKTRRRLSLSLPSHHKLFLPSFVFGSGYSRKPSGGKWXAAVEAPIRILLFLKPLCE

SEQ ID NO: 194409 - protein, 141 aa, Triticum aestivum
  unsure (1)..(141): unsure at all Xaa locations
  Clone ID: PAT_TA_88827.pep
MATISAAAXTTVVARAAIARPQALGLPQLXDEEREGEVQLLQGRQGGDPCRRRPRGWRVPTRRGGRGDRRPRGPALALVDEADHGAPGLSLGLEQCWGVDPPWGVFGPHLGRSTYTSGAIKNVSRALSAYTFPSVPSQWSS

SEQ ID NO: 194410 - protein, 130 aa, Triticum aestivum
  unsure (1)..(130): unsure at all Xaa locations
  Clone ID: PAT_TA_88828.pep
MQIFVKTLTGKTITLEVESSDTIDNVKAKIQDKEGIPPDQQRLIFAGKQLEDGRTLADYNIQXKESTLHLVLRLRGGMQIFVKTLTGKTITLEVESSDTIDXVKAKXSRDKEGIPPDQQRLIXAGKXLED

SEQ ID NO: 194411 - protein, 134 aa, Triticum aestivum
  unsure (1)..(134): unsure at all Xaa locations
  Clone ID: PAT_TA_88829.pep
AVDFYLKKNRASPVSFVTXGXGVSXPGVIPVXXGGIHXWHMPAXDPKSFGXDXVXQXGGGTLGXPLGKXALGAAANRVALEACVQARXEGRDLAREGNEIIRAAXKWSPELXAACEVWKAXKFEFEPVDTXDSR

SEQ ID NO: 194412 - protein, 127 aa, Triticum aestivum
  unsure (1)..(127): unsure at all Xaa locations
  Clone ID: PAT_TA_88830.pep
MDSDYGVPRELSEVQKKRTLYXPELPPCLQGTTVRVEYGDAAIAADPAGAHVIKXAFPHTYGQPIAHFLRKTAVVPDAKVISEHQAVRVXIVFCGRQSPRGHNVVWGLYEAIKXHNQNNKLNGFLWR

SEQ ID NO: 194413 - protein, 52 aa, Triticum aestivum
  unsure (1)..(52): unsure at all Xaa locations
  Clone ID: PAT_TA_88831.pep
PSIRXRXAGLRMNRXXCTAAERGNXWEKXGXXVEETGHYRXXGEGREXESGR

SEQ ID NO: 194414 - protein, 88 aa, Triticum aestivum
  unsure (1)..(88): unsure at all Xaa locations
  Clone ID: PAT_TA_88832.pep
MGAIXAFSLMLLLACSPPVLGFTXSDFXXEFVFGVXTSAYQYEGXPLLXDGKSPSLWDTFTXHTGKCRCQNNKMSLVWGTTYKRAQWD

SEQ ID NO: 194415 - protein, 60 aa, Triticum aestivum
  Clone ID: PAT_TA_88833.pep
LRWNTTVLFYFSARARAHAAAGDQTDTLGGGELVMVLASPPHPRARLCRPASWAPAQLQL

SEQ ID NO: 194416 - protein, 58 aa, Triticum aestivum
  unsure (1)..(58): unsure at all Xaa locations
  Clone ID: PAT_TA_88834.pep
SLLKAFVLFTCIRYICFRCELYLGRKTLVLYPYVKFDSSELLHIYVVVDQKXKKKXKK

SEQ ID NO: 194417 - protein, 137 aa, Triticum aestivum
  unsure (1)..(137): unsure at all Xaa locations
  Clone ID: PAT_TA_88835.pep
MPTSSPGGSQRNQANPSMASAAAVVSLNVXGEXFQTTTATLSRAGASSPLASLGPSSPSXPHFLDGDPRLFAQLLSFLRHGAPPCSVLSLKPRSSLKGRHFALXGALLASLSRASSGRKKRNGCIIECYWNWVFVAT

SEQ ID NO: 194418 - protein, 131 aa, Triticum aestivum
  unsure (1)..(131): unsure at all Xaa locations
  Clone ID: PAT_TA_88836.pep
MAATVRRXASSVLSRFLLTKPSPSPASAAGNKSALLGAGAAALHKVQAPAPASAXAAARGXPFKPAVEVKHTQAXLSNXNFVDAASGKTFPXTLDPRTGEVIAARSPEGDKRRDIDRARWAAARKGLRRRA

SEQ ID NO: 194419 - protein, 123 aa, Triticum aestivum
  unsure (1)..(123): unsure at all Xaa locations
  Clone ID: PAT_TA_88837.pep
MSPSCWFLAFLLVWXLPLMXVMDEEQQGGDCSAMXCGNVNISDPFWXTXKVTGKSCGRPPYQDFDVACINHTSPXXRSSIPFXMGYXILNISXEXRNFYAVDLGKVNVVAPQAMRSTPQPLSV

SEQ ID NO: 194420 - protein, 159 aa, Triticum aestivum
  unsure (1)..(159): unsure at all Xaa locations
  Clone ID: PAT_TA_88838.pep
KKGGLYSLDVSSXVYKYKNTTVDVKLDTESNISTTLTVLDALPSTKLVTSVKLPDYNSGKVELQYFHENATFATVVGTKPTPVIDLSGTVGAQGVAFGAEAGYDTATGKFTKYTAAIGVTKPDYHAAFILADKGDTIKVSGVYHXDXKXKASAVAELTR

SEQ ID NO: 194421 - protein, 185 aa, Triticum aestivum
  unsure (1)..(185): unsure at all Xaa locations
  Clone ID: PAT_TA_88839.pep
RNEGGPKKRLQAKFKXXXPFXQNGXXDXXLXPPRGEEXQQXPGRHGXTGNRMNNFLXGXARKXXKGNVRKXLWGPVGXWVDWDXGGWXANVXKLPPXVWGNEXTXXXGXNQXLXPGGGXSNXQIXRFFEXKXXLGGKXGQTEFPLXLXXKKKPPLQYXKFGXPGXXSLGXXTFXXGFQXXXPSXN

SEQ ID NO: 194422 - protein, 113 aa, Triticum aestivum
  unsure (1)..(113): unsure at all Xaa locations
  Clone ID: PAT_TA_88840.pep
SIDXMYTVAIAXINRVFSCNVSVCVSPRRLSAPCGLMHCHSTPHHVKFQVFGSHFDRFNSHCSKRKRNRTHLMIDKHSPEGVRQPRRLPTHGPEVRETAAAMGPWLGQRXDAE

SEQ ID NO: 194423 - protein, 73 aa, Triticum aestivum
  unsure (1)..(73): unsure at all Xaa locations
  Clone ID: PAT_TA_88841.pep
EDIIPFFQNVTIXPKDCDTXQKWYIXLSGQVKXKXGKIDPYFXKLGDXMVTWIXEAWDELNPAGPAAGKDKAK

SEQ ID NO: 194424 - protein, 68 aa, Triticum aestivum
  unsure (1)..(68): unsure at all Xaa locations
  Clone ID: PAT_TA_88842.pep
ICXXXAGDGNEXQPPXXLLITGKCXCAWILNXSKYKTGMKFMKLGMLSMDXHQHLVVKILSQLGQVQA

SEQ ID NO: 194425 - protein, 88 aa, Triticum aestivum
  unsure (1)..(88): unsure at all Xaa locations
  Clone ID: PAT_TA_88843.pep
QNNYERIXRQACSXSCIFVLQQDXSFSTLXRASXAETTVANDLQKHTMQDVPXHHXLXGPXFLXAETIFTXISYLLLTXVXTXIGXGX

SEQ ID NO: 194426 - protein, 135 aa, Triticum aestivum
  unsure (1)..(135): unsure at all Xaa locations
  Clone ID: PAT_TA_88844.pep
MMAAAFSSTVGAPASTPTNFLGKKLXKQVTSXVNYHGKSSKANRFTVMXAXNLDEKRNTDXWKGLAYXISDDXXDITXGKGIVDSLFQAPTGDGXHXAVLXSXSTSSKGLKNYYFDXTMXGGFYIAPAFMGXACL

SEQ ID NO: 194427 - protein, 53 aa, Triticum aestivum
  unsure (1)..(53): unsure at all Xaa locations
  Clone ID: PAT_TA_88845.pep
AGDXXGPADLXCGVRTCLXLSSXAELXCGSGAASMXGERXXESRAVGXEGIRL

SEQ ID NO: 194428 - protein, 90 aa, Triticum aestivum
  unsure (1)..(90): unsure at all Xaa locations
  Clone ID: PAT_TA_88846.pep
AEMGLXFTKXLFXRLFXXKEXRIXMVGLXAXGXTTILXKLKLGEXVITIPTXGXXVETVXSXKNXNFTVWDVRGXRQNGPVGTSKTQGAP

SEQ ID NO: 194429 - protein, 54 aa, Triticum aestivum
  unsure (1)..(54): unsure at all Xaa locations
  Clone ID: PAT_TA_88847.pep
EXGXQXGWEGRGTXSXQXIHWGFNVASSLGGTMWFHXPXTYLSXXSPVXXSVCA

SEQ ID NO: 194430 - protein, 125 aa, Triticum aestivum
  unsure (1)..(125): unsure at all Xaa locations
  Clone ID: PAT_TA_88848.pep
MERVTKLSSEKAVVIFTTSNCPMSHSVTSLFSSLGVGAAVHELDKDPRGRDMERDLARRLGRTPPVPAVFIGXKLVGSTDRVMSLHLXGKLVVMLKAAGAMWALTVGCNIKFIPALAIFAPPHSV

SEQ ID NO: 194431 - protein, 120 aa, Triticum aestivum
  unsure (1)..(120): unsure at all Xaa locations
  Clone ID: PAT_TA_88849.pep
MAAXAATXTAXAXAVXAGEVISVHRLEXXWTMXXEEGNXXNKLVXIDFTATWXGPXRIMXPIFXDLPKKVPXLLFSSXXTVDEMXAHLLSSTVGTPEREDNGQGRLFGNCPKGWGTPPPS

SEQ ID NO: 194432 - protein, 141 aa, Triticum aestivum
  unsure (1)..(141): unsure at all Xaa locations
  Clone ID: PAT_TA_88850.pep
MXAAFSSTVGAPASTPTNFLGKKLKKQVTSAVNYHGKSSKXNRFTVMXAENIDEKRNTDKWEGLAYDISXDQQDITKGKGIVXLPLPXGPRAKGTNEGVXSSYXXSQXXTQRKYDFXKNMGXXSYIAXAFMDXLVCPISPK

SEQ ID NO: 194433 - protein, 94 aa, Triticum aestivum
  unsure (1)..(94): unsure at all Xaa locations
  Clone ID: PAT_TA_88851.pep
ATRGRSGDGFLADDKINKEAQELLKLTLCKTRVNLIVNTXFNRIFMDSNRSDPFNGLYVGAFNPYGLEVVQLHQKFGHXNXTHDVEFFCVRLTY

SEQ ID NO: 194434 - protein, 97 aa, Triticum aestivum
  unsure (1)..(97): unsure at all Xaa locations
  Clone ID: PAT_TA_88852.pep
PSTNCKYADLSHQSLFTXSQHPEPIFVYPPPPKILCLLCHTXGRNLGTTPAKPXTXKXEGAKRLPPKAIPGGEPXTPGASNQREAPWAKHHLLPQXA

SEQ ID NO: 194435 - protein, 150 aa, Triticum aestivum
  unsure (1)..(150): unsure at all Xaa locations
  Clone ID: PAT_TA_88853.pep
LVPPSLSPTPSAPAXRADPPPPPPSDHEAAPPAAQPQQAAPPAPPRLPLPLPRLLPPPRAPPPLRPPRLPPXPPPSSSSTPPSPRTPSPSPPPPTPPPPLLASRNPRVFSFSKRQRLPPSRRGPQSPWRVVVRGGAASFGETSSKGPSPG

SEQ ID NO: 194436 - protein, 163 aa, Triticum aestivum
  unsure (1)..(163): unsure at all Xaa locations
  Clone ID: PAT_TA_88854.pep
MAPKAEKKPAAKKPVEEEPAAEKAEKAPAGKKPKAEKRLPAAGKTSAKDXDKKAKKKSKKSVETYKIYIFKVLKQVHPDIGISSKXMSIMNSFINDIFXKLAXGEAAKLAXYNKXKPTSPPREDXDSVRLVLPGGGSXXNAXLRGXQKXXTKLLSPRPPHGGL

SEQ ID NO: 194437 - protein, 112 aa, Triticum aestivum
  unsure (1)..(112): unsure at all Xaa locations
  Clone ID: PAT_TA_88855.pep
ISKEFNKTQKSHVPNKELSLLDXYXXCXGMSXGLXXGARGGXXNLVTKWAVDNDXXACXSFKXNQPKTXVRXETTXGFXXMXXKWQXLCQHYVXGSEXRANANIWMGTPLIP

SEQ ID NO: 194438 - protein, 168 aa, Triticum aestivum
  unsure (1)..(168): unsure at all Xaa locations
  Clone ID: PAT_TA_88856.pep
MSPQTETKAGVXFKAGVKDYKLTYYTPEYETKDTDILAXAFRVSPQPGVPPEEAGAAVAAESSTGTWTTVWTDGLTXLDRYKGRCYHIEPVAGEDSQWICYXAYPLDLXTEGSVXNMFTSIVGNVFGFKALRALRLXEDLRIPPTYXKXFQGPPHGIKVXXRKVGPLG

SEQ ID NO: 194439 - protein, 95 aa, Triticum aestivum
  unsure (1)..(95): unsure at all Xaa locations
  Clone ID: PAT_TA_88857.pep
QFCFPLXSGXAWXXPPTHSARTXXRSVPSAXQSXGNVIAVDPSLSXPGSSSSAVSXRDTRAPXSEXXREACPXVERXPGEPGDXGVGXAPCXSWL

SEQ ID NO: 194440 - protein, 164 aa, Triticum aestivum
  unsure (1)..(164): unsure at all Xaa locations
  Clone ID: PAT_TA_88858.pep
EKCLRDAKMXKSTIHDVVLVGXSTKIPXVQQLLQDFFNGKEXCKSIXPDEAVAYGAAXQAXILXGEGNEKXQDLLLXDVTPLSLXLEXAXGVXTVLITTETTIPXXKXQXFSTXSDNQTGVVXKXFXGGGXRTXXNNLXPAXVEVXWNPXXAPRXVXXXKFGSI

SEQ ID NO: 194441 - protein, 152 aa, Triticum aestivum
  unsure (1)..(152): unsure at all Xaa locations
  Clone ID: PAT_TA_88859.pep
MGALSSAAVSVPSFAAGAKVAAPRSSRMVVRASLGKKAASAAVAMAASAMLLGGSAMAQDVLLGANGGVLVFEPNDFSVKAXEXITFKXNAGYPAQTWAFRRRTRWSGWSVSILPGREYLKRPPGEPFSANGSPGNGLAKTPGMPAPKKCLN

SEQ ID NO: 194442 - protein, 84 aa, Triticum aestivum
  unsure (1)..(84): unsure at all Xaa locations
  Clone ID: PAT_TA_88860.pep
RLGEXLXPQDEXVFHKTVAELLXPRVICXWXPRKSPXPGRGEPLWXSXYLRDXWXXTDLPGDQSTATSSSNKPPRERPYPVGKT

SEQ ID NO: 194443 - protein, 141 aa, Triticum aestivum
  unsure (1)..(141): unsure at all Xaa locations
  Clone ID: PAT_TA_88861.pep
MXXTTLSLHGLPSPTXKKLTSSFLGAPSSFLRPAXLAAAVTPARRVFAVRXMVXPKXGDKXKKVVGIIKXXLXAVKXTXGXPVGPALGXKGXNIMAXCKDYXXKTXDXXRLHXSXSEXNXFDEXXLSPLSLMTPFSCLQQV

SEQ ID NO: 194444 - protein, 52 aa, Triticum aestivum
  unsure (1)..(52): unsure at all Xaa locations
  Clone ID: PAT_TA_88862.pep
QTKTKAXVGFKAXVKDYKLXXYTPXYETXXTXILGXXXVSPQPGXPPXETRG

SEQ ID NO: 194445 - protein, 141 aa, Triticum aestivum
  unsure (1)..(141): unsure at all Xaa locations
  Clone ID: PAT_TA_88863.pep
DAXXHGTSSFPVAAVHRIGILYIXIFNTDRHGGXNVLXRKLDGGTGRFGCXXELFPIDXGLCLPDNLEXPYFQWXHWAQAXIXFSXXXLXXIXKLDSXKGCXMLPGEXPXXQEXCLPVPILXXIFLKGKVRFRAFAWEKGE

SEQ ID NO: 194446 - protein, 109 aa, Triticum aestivum
  unsure (1)..(109): unsure at all Xaa locations
  Clone ID: PAT_TA_88864.pep
LPAATRHRIKRHELVNPRNPNARPRALSHGHVNHVKVEEARRDPKIVMGTLXVNSVPASVLFDSGASHSFISEAFARKQXLSFXNMYPPLVGSSPGSRWTLMIAHNKSH

SEQ ID NO: 194447 - protein, 160 aa, Triticum aestivum
  unsure (1)..(160): unsure at all Xaa locations
  Clone ID: PAT_TA_88865.pep
MGKIKIGINGFGRIGRLVARVALQSDDVELVAVNDPFITTEYMTYMFKYDTVHXHWKHSDIKLKDDKTLLFGEKPVTVFGVRNPEEIPWGEAGADYVVXSPTGVLTDKDKXAAHFEGWXQXRWATXAPKQKMPPMFVGWGSTKDPDRLTLSSKMGHQLNW

SEQ ID NO: 194448 - protein, 84 aa, Triticum aestivum
  unsure (1)..(84): unsure at all Xaa locations
  Clone ID: PAT_TA_88866.pep
XGLSXGVRLPSPTXRXAKQVXREGVVRGGGGRRPPRGPWSHGQXXSSRSAVRSXGARRHRXGHQSWPKXPXALLXXSPXXGXNP

SEQ ID NO: 194449 - protein, 157 aa, Triticum aestivum
  unsure (1)..(157): unsure at all Xaa locations
  Clone ID: PAT_TA_88867.pep
MAPTVMASSATSVAPFQGLKSTAGLPVSRRSNGASLGSVSNGGRIRCMQVWPIEGIKKFETLSYLPPLSTEALLKQVDYLIRSKWXVPCLEFXSKVGFIFREHNASPGYYDGRXWTMWKLXMFXCTXRHXVINXGGGPRNYGPINRDSNGQVCISVL

SEQ ID NO: 194450 - protein, 174 aa, Triticum aestivum
  unsure (1)..(174): unsure at all Xaa locations
  Clone ID: PAT_TA_88868.pep
SHPTXSSSXIXXDLVPPSPHXLXLPYAPDQVXXVGIPSIHSQXRHPDPLLXPPTPIGGSHPSRSXMXSGMLSLTCTGLGDAKDDDXGGVVSYVKGTNRLGXGXNLLAFPRQGLRXGKPXXXGRRXGPGRXXRAERXRAAYGXYGXXEEAPGXSFXSXPKQSXSKXXXCCXXRQW

SEQ ID NO: 194451 - protein, 76 aa, Triticum aestivum
  unsure (1)..(76): unsure at all Xaa locations
  Clone ID: PAT_TA_88869.pep
LVKXLSFRWMFSPGLLYLEQFLQMLKYHVVLSXHFLQMILLALVNCSIWNSDSGGVFXPRSHLLRLGAPVEXMVKK

SEQ ID NO: 194452 - protein, 90 aa, Triticum aestivum
  unsure (1)..(90): unsure at all Xaa locations
  Clone ID: PAT_TA_88870.pep
WKRNQYLXXSHKYLQTPXSSQQDNRVGPLKHIVRLTLLIVLKQVKHNGMYKPVACLXTSYSFVXCVNWPEDTVVWGNSEXSXXLFGHDXH

SEQ ID NO: 194453 - protein, 72 aa, Triticum aestivum
  unsure (1)..(72): unsure at all Xaa locations
  Clone ID: PAT_TA_88871.pep
GAFPXFXLPKLRXXXSXXXIVXHHPHVXHLDCTKLVVXLVTSFXXPKXSNLFGQNFXXKEDXVLLXCRSPNX

SEQ ID NO: 194454 - protein, 190 aa, Triticum aestivum
  unsure (1)..(190): unsure at all Xaa locations
  Clone ID: PAT_TA_88872.pep
PGPIPXGDXQTPRGVSFEHEPSXGRGRAGAQSVDGSLFKGTPVPAXRVGXLXARSGTGGEGGVGXGAXKATALQGAXSVPXAWIPRLXXGQGXGDXNQRGKGEPXGRSPIYXGRSSADEXVSSHXATTKGPGDXPPNGANGGGPQTXNGVPKXFHLXTGPPGNLGFGRXSKVXLSGEGPXRXIGPXVQTI

SEQ ID NO: 194455 - protein, 101 aa, Triticum aestivum
  unsure (1)..(101): unsure at all Xaa locations
  Clone ID: PAT_TA_88873.pep
VWRAPLPXFPRRIAVSTSPQDSPXNRRLELSPGPPPPVAELLXSRXPATIHIIXDWGTSRIGREEXTXDTXGSXXGXKXIRGRPPAXXLLSGFXDQFXAXR

SEQ ID NO: 194456 - protein, 109 aa, Triticum aestivum
  unsure (1)..(109): unsure at all Xaa locations
  Clone ID: PAT_TA_88874.pep
PAAXRTKWDSPRACKEIPEXGGAPFPERVXLXERXGPFKPXPPPXGGMSPQPLKKXPLWQPQXXRLWLGKKXSXEACFXGXMFIXTTSGXREETGGXXXGTFYFGDXXG

SEQ ID NO: 194457 - protein, 170 aa, Triticum aestivum
  unsure (1)..(170): unsure at all Xaa locations
  Clone ID: PAT_TA_88875.pep
PTVMGSSGNSVAPFQGLKSTAXLPVSRRSNGASLGSVSNGGRIRCMQVWPIEGIKKFETLSYLPPLXSTEALLKQVDYLIRSKWVPCLEFNKVGFIFREHNASPGYYDGRYWTMWXLPMFGCNDATQVINRGGRRSRKEYPDAYVRIIRXPTNMRQGGSGGQHSKPTGAG

SEQ ID NO: 194458 - protein, 81 aa, Triticum aestivum
  unsure (1)..(81): unsure at all Xaa locations
  Clone ID: PAT_TA_88876.pep
AXRACFGLSRAPPGSSAPRASVRALRSPLLSELAGVRPVQARRSPLCTVVRPKPSSSPAPNRSPTRRLSASWQWRRMIFCN

SEQ ID NO: 194459 - protein, 69 aa, Triticum aestivum
  unsure (1)..(69): unsure at all Xaa locations
  Clone ID: PAT_TA_88877.pep
PPGRIFLLQNLEPGSPRGDVQARVGGHXEERAVPDRDKEQXXXDGAHLRPGGDPXGGGXXDQGPPATGV

SEQ ID NO: 194460 - protein, 58 aa, Triticum aestivum
  unsure (1)..(58): unsure at all Xaa locations
  Clone ID: PAT_TA_88878.pep
ERSKPAEXTRWXETSTSTXVIDPXSEFDXEXIERAIALSLLXEXHRKXKXTXKXLXLY

SEQ ID NO: 194461 - protein, 130 aa, Triticum aestivum
  unsure (1)..(130): unsure at all Xaa locations
  Clone ID: PAT_TA_88879.pep
LLLLPPPNQGTRREEGKGREKETPSARTGQQAPRRTAEMGLTFTKLFSRXFSKKEMXXLMDXLHAXGKTTXLYKLKLGEIVTTXPTXGVNVQTXXVXKXNSFTXFGMSXGGKIKPPGGGFFKTQRVLNFF

SEQ ID NO: 194462 - protein, 124 aa, Triticum aestivum
  unsure (1)..(124): unsure at all Xaa locations
  Clone ID: PAT_TA_88880.pep
PPPRSPTRRICQESRRGPNARKPCQGSKHARWDALGASRFPTSSGADGRRPKHIAGAVPGRRNVGLSSNLQRKEGTPTPEKVPPRKGPPRSRACGLQTWLKKNFNQKVPQGRWXWRIAGVHVIY

SEQ ID NO: 194463 - protein, 80 aa, Triticum aestivum
  unsure (1)..(80): unsure at all Xaa locations
  Clone ID: PAT_TA_88881.pep
RTMLISCVIHSDPXYVGTLRXXXVEVHFRARIVGSLKLEEPASISHPGHXFIXTASWFRYCPQKYSRPRSVHIYQXSFVD

SEQ ID NO: 194464 - protein, 83 aa, Triticum aestivum
  unsure (1)..(83): unsure at all Xaa locations
  Clone ID: PAT_TA_88882.pep
EEXVQRDYLTXKAKXKISELGVXSKKGWGTRXGLXXGKCTKXGNRXGMRGRXNPSLXEEYKINVICFXXKXKGXLXXRNLXLP

SEQ ID NO: 194465 - protein, 60 aa, Triticum aestivum
  unsure (1)..(60): unsure at all Xaa locations
  Clone ID: PAT_TA_88883.pep
PFXXSXGGCCXETPXXFXXLCCCCWSPLPCXQTWLINGXLGXRPXGFGXLGGXXRREKFL

SEQ ID NO: 194466 - protein, 69 aa, Triticum aestivum
  unsure (1)..(69): unsure at all Xaa locations
  Clone ID: PAT_TA_88884.pep
GGTYVTTNKKLKAGVXXLXLXLKDYKXXLLHPXSMETKDTDILXAFRVTSPRPGVPPERSRGLQPARIF

SEQ ID NO: 194467 - protein, 99 aa, Triticum aestivum
  unsure (1)..(99): unsure at all Xaa locations
  Clone ID: PAT_TA_88885.pep
XAPTPXPHGRRRRGGDAXERVRKGLASXKSVLLSSXXALRRXSLSCSAXSKXDRPRXSXXQTPDLAPGGXXRRXEVXXXXALXXXAINXSTVSGCXPKG

SEQ ID NO: 194468 - protein, 155 aa, Triticum aestivum
  unsure (1)..(155): unsure at all Xaa locations
  Clone ID: PAT_TA_88886.pep
SKAENRMPSGSXPLEGKSRPQTLTDXGLTRSNKVIPKERGKQAQSQMAPNEESGLSLPKQTXTGRVAGAKKRAKAKQASEKARAPSGSKXTKAERERPKSGTGSKRSGAPGXAQTAESGAQGTRXGPNQSNSPPIXIQENLGPSWXNXPILSXYH

SEQ ID NO: 194469 - protein, 74 aa, Triticum aestivum
  unsure (1)..(74): unsure at all Xaa locations
  Clone ID: PAT_TA_88887.pep
PAEGRGXXHRRXXHPPAFPXVTLPVSXLLPTTAXDAXXAGAXXALHXXXAGHHXXARAALRXPHHXARXHGAVV

SEQ ID NO: 194470 - protein, 82 aa, Triticum aestivum
  unsure (1)..(82): unsure at all Xaa locations
  Clone ID: PAT_TA_88888.pep
LXLAXEXKDPXGGXAALALRGGXPQRLNLXAAPSRPGXWETPALGQPXXLXAXCFAPIXNSLXNSLXAPGEPPXFLGAPPPP

SEQ ID NO: 194471 - protein, 59 aa, Triticum aestivum
  unsure (1)..(59): unsure at all Xaa locations
  Clone ID: PAT_TA_88889.pep
TPSSMLIDTRMRTLLXLPLISSSXVLFIYEXXXIGKVAIYRLISXWCGRLLQXVSKWKX

SEQ ID NO: 194472 - protein, 109 aa, Triticum aestivum
  unsure (1)..(109): unsure at all Xaa locations
  Clone ID: PAT_TA_88890.pep
LVRPXSVAFEVXDXFRQYKXXVYTXXHCXXTPXDVNHAXVLGVGYGVXNGVPNWLXKNSWGADXGXTMXYFXMGNGQXTCGWANCGVPTPIGGGKAPKSTPKSPNSPTK

SEQ ID NO: 194473 - protein, 135 aa, Triticum aestivum
  unsure (1)..(135): unsure at all Xaa locations
  Clone ID: PAT_TA_88891.pep
FSGLSLGXSIWSPAXAXPRARXADLFSPSPVPXNNNAAKMNXNGLXGPGLIGSGKLAFGATNTXKXDRYNXVXLPAAADANAKPYGNANGLYGAKPKNATNNXFGLNKMAAXGGGYXNFXGGXRRGXXSYFXKVH

SEQ ID NO: 194474 - protein, 163 aa, Triticum aestivum
  unsure (1)..(163): unsure at all Xaa locations
  Clone ID: PAT_TA_88892.pep
PLXXGPXXLXXHSXCPILGLSXGXLPQWAACRRGYXPXXGWAPLGGDXSDPTSYPPVGQXSTPPLPLGXTXPGGGFXGASKVEXRSRNRPXFANCFSHCFGIXFVARPIVHPVRGPALRTLPLDPPFAGPPVKQTNGVGPFRPPNFCCPGKVXHIEESDFLQE

SEQ ID NO: 194475 - protein, 151 aa, Triticum aestivum
  unsure (1)..(151): unsure at all Xaa locations
  Clone ID: PAT_TA_88893.pep
QTEXQSPFEMATNGXLSLGGRLPGGTNVGFKPSKERWPVKGIWKXVGFCLHPNSQRDGPLAKGRAXQTSTSPRSSINETNPWVKXWETGYAPNGWGLAXTLXTIAGQXFGXKLXDPXXXTRAGSWVRXXWRALAQXSSKXGXCWEXRXXXS

SEQ ID NO: 194476 - protein, 101 aa, Triticum aestivum
  unsure (1)..(101): unsure at all Xaa locations
  Clone ID: PAT_TA_88894.pep
MGXAFSSTVGXPASTPTNFLGKKLKKQVTSAVXYHGKXSKXNRFTVMXAXNIHXKRXNXKWEXLAYDISDDQQDITXGKGIXXSLXQGXXGXGTXXGVXSS

SEQ ID NO: 194477 - protein, 96 aa, Triticum aestivum
  unsure (1)..(96): unsure at all Xaa locations
  Clone ID: PAT_TA_88895.pep
XDSPGACKGNXRNEERXXXEPXLYPGQTGQXTXGPPSKQGWDYPGFRSKVGWLAFEFKQRAGFNLPLSKMRLPGTXTAATGTMWKLAYVRVDRPHT

SEQ ID NO: 194478 - protein, 150 aa, Triticum aestivum
  unsure (1)..(150): unsure at all Xaa locations
  Clone ID: PAT_TA_88896.pep
MLPXKPQLSSSLLAXTPLFNPASNLNXAKPIAASPSPRRRLXISAGSTXVSPGXTXLNRVDXLSEALPFIXXFKXKTVVVKYXGAAMKSPEXLQSSVDSXDLVLLSCVGLRPXLFHXGGXKIKSWXVRVRVEXQXPTAVNGLNKGGKWGW

SEQ ID NO: 194479 - protein, 96 aa, Triticum aestivum
  unsure (1)..(96): unsure at all Xaa locations
  Clone ID: PAT_TA_88897.pep
NNNGGNGNHHKQSPPTHAPPLPMGSTNTTNTTAGRRXHHQEPPQQSPPPRCSSAGRPDXNQVPQPPQPPPTXTTRXHHKAPPNATXISSPLWMREF

SEQ ID NO: 194480 - protein, 153 aa, Triticum aestivum
  unsure (1)..(153): unsure at all Xaa locations
  Clone ID: PAT_TA_88898.pep
NPRGVLNSXQKNVDCFXLLXPXXWXASFXWFXLXKKKNSFCKHHIKFLPVVSFLVPXPXRHSFXPHTSQGVXXGXLAXXSTIERQXXCXIQXLXPXQQXCGFFXPIFTLXPPXXRSXEXDXPVPTRKQEXLXAEGVGXFFLLGIWNGRLCFVP

SEQ ID NO: 194481 - protein, 87 aa, Triticum aestivum
  unsure (1)..(87): unsure at all Xaa locations
  Clone ID: PAT_TA_88899.pep
MATVMXKIKDIEDEXCXMTQKNKXTAHHXLGLLXAKLAKLRRXELLTPTXKXGGGAGXGFDVXRKSGHXRVGLVGFPSVXKSTFVQS

SEQ ID NO: 194482 - protein, 149 aa, Triticum aestivum
  unsure (1)..(149): unsure at all Xaa locations
  Clone ID: PAT_TA_88900.pep
VXTKXATMSXGXXKLWXRNQGNSXAXNXLKKAMVAGLGGXNXFGXIXPGNLLKANDNDTWXAYLXCXAGNSLASXKXPGXXFCNTNNLNGCRDARPTXTLQXRXKXXXKKRXQRNFXXXTFLPXRKXGXMQRRHGPXLGRGXFHPRGRF

SEQ ID NO: 194483 - protein, 138 aa, Triticum aestivum
  unsure (1)..(138): unsure at all Xaa locations
  Clone ID: PAT_TA_88901.pep
KXAEIXGGVGVXXSIKFXNQQHALGQRMLCXGARXSWRXVTRRCTNHXGEWGSSCSTSXXXRREPXXSKXQXXQWEXEXLTLXTKCXAXGFAVRDGXVMAFVXLWXGNLFCNVLYQWXNNXELXYLHXPTAXALXXQT

SEQ ID NO: 194484 - protein, 56 aa, Triticum aestivum
  unsure (1)..(56): unsure at all Xaa locations
  Clone ID: PAT_TA_88902.pep
XRXRTXVXGPAPHPPGRPXRPSSXPSGSGRRRTHXGGSRSGSGGRAXLRRRRXSAR

SEQ ID NO: 194485 - protein, 85 aa, Triticum aestivum
  unsure (1)..(85): unsure at all Xaa locations
  Clone ID: PAT_TA_88903.pep
FXGVKSXXSVSXSAXGXSPXSRGXNLVLSTCXTRVPPPPRINLSXXSPXXWXELPSWESXSPPPFFXXXWXXXPXPLXHTXLYVX

SEQ ID NO: 194486 - protein, 159 aa, Triticum aestivum
  unsure (1)..(159): unsure at all Xaa locations
  Clone ID: PAT_TA_88904.pep
MXPTVMGSSGTSVAPFXGLKSTAGLPVSRRSNXASLGSVSNGXRIRCMXVWXIEGIKKFETLSYLPPLXTEXLLKQVDYLIRSKWVPCLEFXKXGFIFREHNASPXYYDGRVXWQMWXXCYVPGAPTPTQVINGWGGGQKSNLDYVRHHSFRQQAKVQL

SEQ ID NO: 194487 - protein, 89 aa, Triticum aestivum
  unsure (1)..(89): unsure at all Xaa locations
  Clone ID: PAT_TA_88905.pep
KXXRXSAGFLFXHXRXGYPHSPGCXYPVSFQVGYSLFWHFXQLLTRNLLGTDSCXTNLLEXLLGHPLGKFHLVQQLIEWLLGXPCVQAS

SEQ ID NO: 194488 - protein, 80 aa, Triticum aestivum
  unsure (1)..(80): unsure at all Xaa locations
  Clone ID: PAT_TA_88906.pep
PPPGPXPPTPTXGXXRAPPLXPKVXDAFPPWSSEXATPXPXXSPSSRLSPLSHLXRRRCREVSRXGRPXLIPXPLSXLIL

SEQ ID NO: 194489 - protein, 138 aa, Triticum aestivum
  unsure (1)..(138): unsure at all Xaa locations
  Clone ID: PAT_TA_88907.pep
SSFHSYFAVSGRXLDWXFGKXXFARXDRXGGARDAXGRGDGXPGXGXRAAGGVQXXXRGPVAXXEXEPDGKXXSAPVGPXGKSGAGRDLGPXRKPLXAXDXRVWGXGPGXSPGPTQXFKGKXKITVTGPKXEGGGTXK

SEQ ID NO: 194490 - protein, 144 aa, Triticum aestivum
  unsure (1)..(144): unsure at all Xaa locations
  Clone ID: PAT_TA_88908.pep
MXPNVMGSSGTSVAPFXGLKSXAGLPVXRRSNXANLXSVXSNGXRIRCMQVWAIXGIXKFETLSYLPTLNTEALLKQVDYLIRSKWVPCLXEFNKXGFIFREHKXSPGYYDGXRYWTMXETAYVPGCTDPHKVXKPSGRSKKEP

SEQ ID NO: 194491 - protein, 143 aa, Triticum aestivum
  unsure (1)..(143): unsure at all Xaa locations
  Clone ID: PAT_TA_88909.pep
LTRLWPSVASLSRRXSSFAVVCSGXKKIKVDKPLGLGXXLTIDIDANGKKVXKKGVXQFVDKYGGNVDGYKPIYTPXEWSEVLVNRYAXGTXRGFLSXALTLAGAPRGGGGPPPSKKTXALAGRTIYVLKQGPGLCFAINVSG

SEQ ID NO: 194492 - protein, 159 aa, Triticum aestivum
  unsure (1)..(159): unsure at all Xaa locations
  Clone ID: PAT_TA_88910.pep
XPTNGWXARNEIDLAETPGGSSEXXKAQXKKRPPSNPPKFLXSWDVKVXKGWLQTINYXCSSQLTXLVVVCPRLPKQVLCQAKRVVKGXAQPKGLLXSARKGRLKPKXILKKXSLFVETXFSFFKXXVGPEKXFXNVRXKXESNPLGKFGNLTSEQIIN

SEQ ID NO: 194493 - protein, 166 aa, Triticum aestivum
  unsure (1)..(166): unsure at all Xaa locations
  Clone ID: PAT_TA_88911.pep
RETXVXAXXIXHLSXQLEWVMGSLSPFFLGNXXPKTVGWAXGLXXLCWXCCXXSLVPXFXPPXDRNXVGHWLFXSGLVVPRPCPLFLPPRPKPXWPWLFPSGXLSSSLSXFLPPXPKPXWPWLFLXGLLSSSLSPLLXPXPKPCWALGWLFTXGXLSSSXGPFSLL

SEQ ID NO: 194494 - protein, 139 aa, Triticum aestivum
  unsure (1)..(139): unsure at all Xaa locations
  Clone ID: PAT_TA_88912.pep
GKSPPTRERHLVLLLKMXIFXKTLTXXTITLEVESSDTIXNVKXKIXDNEXIPPDQXXXLIFAXKXLXDGRTLADYNIQKEXTLHLVLRXRGXMQIFXVENLTXXTILEEDTIKKDSQGSPGSASSSGKGTLRGGRTPL

SEQ ID NO: 194495 - protein, 139 aa, Triticum aestivum
  unsure (1)..(139): unsure at all Xaa locations
  Clone ID: PAT_TA_88913.pep
LPPPPPPPPASPVYTPLVSRGGRRXXCAVRTQXAGXGAAAADGAXSEHKSLXIMRKFSGAXRPAAPATFXCSDKXVTAVVIKGLADHKXSTREQPLWPCXITTGRPRAAQRGSGTCPFRPQCEKNGKEVMFSPRQTIFG

SEQ ID NO: 194496 - protein, 138 aa, Triticum aestivum
  unsure (1)..(138): unsure at all Xaa locations
  Clone ID: PAT_TA_88914.pep
RGRVASMACINTLQSCSMFKGAKXEXKRGKATGARSFGCRASTFMDGSGLRLGLDXKPDXIISXEVXRELLPPQLRRTPRLPPIPTTTATXTTFPRWRLTTGGAPARXHVDARADGHNGXSXGGGLXGXFNSCQGSRV

SEQ ID NO: 194497 - protein, 114 aa, Triticum aestivum
  unsure (1)..(114): unsure at all Xaa locations
  Clone ID: PAT_TA_88915.pep
MXXFXKTLXGKXITLEVESSENIDNVKXKXQDKXXIXPXXQGLIFAGXXLXDXRXLXDYNIXKESNXHXGSXAPWWXAYSNLTGENHPPPTPFIWEPNRREGCTGRGLNLLVKR

SEQ ID NO: 194498 - protein, 114 aa, Triticum aestivum
  unsure (1)..(114): unsure at all Xaa locations
  Clone ID: PAT_TA_88916.pep
GCRLTRPVKVVDIVDTFRLQGATXLFDXKQFISHMKXYIKNLSCXSLKGDDLDVFKKNVESXATKYLLSKLKDLQFFVGESMHDDGGVVFAYYKEGAADPTFLYFAHGLKEVKC

SEQ ID NO: 194499 - protein, 136 aa, Triticum aestivum
  unsure (1)..(136): unsure at all Xaa locations
  Clone ID: PAT_TA_88917.pep
LHXLPGVPLIELNPLXAKXIXXQXREXTHFEEXRILSPLLXXYPSGGFNQHQPNCYPFVLXXPQXXQXXLGCXGLGKXSAGPRLXFXVXGNLGGTTHSGXPVEVLXQKELXPXACCQGSXQRXIFGKSNPXLGFCS

SEQ ID NO: 194500 - protein, 99 aa, Triticum aestivum
  unsure (1)..(99): unsure at all Xaa locations
  Clone ID: PAT_TA_88918.pep
TKFNSPLETKELPAKAPPSRXHPSXRMNLHRTPPRXGRSLLSSPXIWWVGTPPXLSIYWTAPPTTPNDKXXLLSXIXNVVGXMXNIIIPDXXYHEXXPV

SEQ ID NO: 194501 - protein, 94 aa, Triticum aestivum
  unsure (1)..(94): unsure at all Xaa locations
  Clone ID: PAT_TA_88919.pep
NKQQWAPNGDGFLXATSXATXQGXQIXRRGWXIXXRSNKGRAQKXVNKXGEXLKXKGRCGALXGGXKXNFRTLCFLXXPLHXXGXLKTRAXXFF

SEQ ID NO: 194502 - protein, 87 aa, Triticum aestivum
  unsure (1)..(87): unsure at all Xaa locations
  Clone ID: PAT_TA_88920.pep
KFXQXCXXWKEXFAVCEXKHKLLKLKCXQXRFAXADWSQRVAVFCVMNLMCVEKHKRXWXXPVXKKRVVANXYQNLXXXNSCXLNLX

SEQ ID NO: 194503 - protein, 121 aa, Triticum aestivum
  unsure (1)..(121): unsure at all Xaa locations
  Clone ID: PAT_TA_88921.pep
LNPNRSCXSENLXSTKXKXTNGGXXPXLXRRIRRXKNNRRRGXPLLLLPLSLPXXQXPLXPGSLPLRVRRLLGLLXPRXRAERRPSDGRPPPMAISLXPXKGXRXRXSXTXSWGXIKCEGV

SEQ ID NO: 194504 - protein, 144 aa, Triticum aestivum
  unsure (1)..(144): unsure at all Xaa locations
  Clone ID: PAT_TA_88922.pep
RLXAPEHGXLLRHGXAPXRXXPPCCSSKTEXGIKQRPXXKGLLLWLLPNGGLNPVQEPPERVKEVXXIGXXNFVVXQXXSTTNPGXGGSTRESXPXSLLGQSGTAXTNNLLVPGXINQGXTRXPSXMGPKGXSPKIRXGXPNKX

SEQ ID NO: 194505 - protein, 95 aa, Triticum aestivum
  unsure (1)..(95): unsure at all Xaa locations
  Clone ID: PAT_TA_88923.pep
EXGXXPRPGNLLCFLKHXTAGQXHLXLKKIPAPGTAXASSSSIGLKLAHFKIKSXAWLPXXHPRRVSPKKSKENSPDGXIGXXGKEXVPXLWXKV

SEQ ID NO: 194506 - protein, 152 aa, Triticum aestivum
  unsure (1)..(152): unsure at all Xaa locations
  Clone ID: PAT_TA_88924.pep
MAATTNMXLSSPAIKLAGASYALGGGGRITMRKAAPKASASNSPWYGPDRVLYLGPLSGXEPPSYLSGEFRXDYXGWDTAGLSRRPXTFAKEPRGSKVIXXRWAMXLXALXWRSSPKLLARNGFQXPAXAXLVQRAGXSXXFKXRGGLXYLG

SEQ ID NO: 194507 - protein, 63 aa, Triticum aestivum
  unsure (1)..(63): unsure at all Xaa locations
  Clone ID: PAT_TA_88925.pep
ACRRQPPRXRPGPPPPPPSSPLAPATTPLPAPAPSAPASSAAPSRWXPPPTAPPPPXPPSPSR

SEQ ID NO: 194508 - protein, 149 aa, Triticum aestivum
  unsure (1)..(149): unsure at all Xaa locations
  Clone ID: PAT_TA_88926.pep
LNLEXNNFSGXIPESFGTFKXLQSLSLVNXLLGXKVPXFLXRVSTLREXNMSYNPFAPGPXXGELGDLPALXVLWXAGCKLVGSIPGSLGRVAKPQXELELSLXALXGXIPXQIGRXLXSAVQIEAVEXXALRGPIPKGIXEGSSRTSP

SEQ ID NO: 194509 - protein, 133 aa, Triticum aestivum
  Clone ID: PAT_TA_88927.pep
VSSGVKFKPTSGDLSTASTIAFDRKTATLRLPVVTLDGNTEVVLRNLVAYESSAASGPLVLTRYTELMNGIIDTDDDVALLRKRGVVLNHMKKRDGEAAKLWNGMSRSVALGAGLGTRVEEVKPLTTKVGWSR

SEQ ID NO: 194510 - protein, 173 aa, Triticum aestivum
  unsure (1)..(173): unsure at all Xaa locations
  Clone ID: PAT_TA_88928.pep
CLTSYTHHKFILALHSREVVLLSISRDDLGGMDDVLSQISEAFRLAGELMGELQATQNXPAYIAARCHGIVHAYNRAIRMLQQYGVGDVARKPRHVSSRPGSMDILRLGKHGAKAALASFSERLPAHFXPPGKEPIPQCRAXRCSGARSWRHKQYECXAGGRGVXRXRPGGPD

SEQ ID NO: 194511 - protein, 120 aa, Triticum aestivum
  unsure (1)..(120): unsure at all Xaa locations
  Clone ID: PAT_TA_88929.pep
EEVRFYQLEQQGCHRQLRVGAGATGLPCRQQQEPPGRAASCSGKPPRRAAEALEGTATPPPAAGAAADWGPRSGRRPLSSPPSXFSLXNKRVVSTHIVXTXFPNLNLXNFCGDNCFLNFG

SEQ ID NO: 194512 - protein, 131 aa, Triticum aestivum
  unsure (1)..(131): unsure at all Xaa locations
  Clone ID: PAT_TA_88930.pep
LAEPVRLPGCVPIPGPDILSPLQDKSNPCYRWMVHHGQRYRDAEAILVNSFDAVEPDAARALRAPEPXRPPVYTIGPLIKTXPRDDKEPRAAXLDWXLDRQPXKSVIFVSFGSGXSLPAEQDAGSSLGAGA

SEQ ID NO: 194513 - protein, 67 aa, Triticum aestivum
  unsure (1)..(67): unsure at all Xaa locations
  Clone ID: PAT_TA_88931.pep
YREGLMSPQTETKAGVGFKXAGVKDYKLXYYTPRXLKLRIXISXAXFRSKSSXXGVPPERKQGAALP

SEQ ID NO: 194514 - protein, 107 aa, Triticum aestivum
  unsure (1)..(107): unsure at all Xaa locations
  Clone ID: PAT_TA_88932.pep
CHLSIYRSIILDVLXTSDLXWNXRRSQDVRRAPPPAEAGGTLRHPEASGEIRRETRRASGALAGRVAGEAPASTERGNGEXPRSPAIXWWEAGGRERQVRGVDLSRQ

SEQ ID NO: 194515 - protein, 102 aa, Triticum aestivum
  unsure (1)..(102): unsure at all Xaa locations
  Clone ID: PAT_TA_88933.pep
FFFFFFFXSXKFXFFIHRXSIRXWLXXGQGAPFFFLXXNSXHFXRYEVFYXTINFTLAISXLNSVPXLIKXXKXXLFXPGLQAXXXLXGGRXSQSWFIXNQX

SEQ ID NO: 194516 - protein, 135 aa, Triticum aestivum
  unsure (1)..(135): unsure at all Xaa locations
  Clone ID: PAT_TA_88934.pep
QPVGSGACCWPGGHQGSRPCTYXPLSTEAXLXKQVDYXLXRPKWVXXLEFSKXGFIXREHNASXGYYDARYWTMWKLXPMFGCTDATQVINEVEEVKKEYPDAYVRIIGFDNMRQVQCVSFIAFKPPGCEESGKA

SEQ ID NO: 194517 - protein, 139 aa, Triticum aestivum
  unsure (1)..(139): unsure at all Xaa locations
  Clone ID: PAT_TA_88935.pep
MXTAYAPPMXXXVMXSGLXCSKPRGMSGASLXRRXRLVVKAVXSEKPTYQXVSKXIXGXXFIGXLETXVTSXPLVAWXLSXXPRXYATAVRPLLRXIEVGLAHGXSSXGPSALXGPLRXNTPIHGPRXALSAIARLPIL

SEQ ID NO: 194518 - protein, 76 aa, Triticum aestivum
  unsure (1)..(76): unsure at all Xaa locations
  Clone ID: PAT_TA_88936.pep
WCSXVTPAAFDXYVLETRHRRXMPTHISKHPREXRXPPXXAAPIPIHPWVGVRLGFHPPSIHWSGPDXLAXLRRPR

SEQ ID NO: 194519 - protein, 160 aa, Triticum aestivum
  unsure (1)..(160): unsure at all Xaa locations
  Clone ID: PAT_TA_88937.pep
INFLKVNVDNHKXITSKXAXTGMPTFLVFQRGEXIERVQGADMRKVQAIXQKLLPXTKDALADATTGENGTSHSSWGLXEXPPGYYDVTDQVXLXGLXXSNADLXFXXGSGXLFXDSKPTXLQNGETNXRTTTXXWXGEATQQPCLFPSSPRNKEPLINN

SEQ ID NO: 194520 - protein, 70 aa, Triticum aestivum
  unsure (1)..(70): unsure at all Xaa locations
  Clone ID: PAT_TA_88938.pep
TAQYSIFLQMVFXITFAPIVVFMVCSFFCFCSIXFVSTSIFFPVQPMIFDPPFXPGGVCLVYLFPVNIME

SEQ ID NO: 194521 - protein, 69 aa, Triticum aestivum
  unsure (1)..(69): unsure at all Xaa locations
  Clone ID: PAT_TA_88939.pep
MGASASAGSXRFKIFAXADXFGEPLKDAVVAHLRAHSSVAXVVEXGVXDKYXSRRRGALSRSPPRGRNG

SEQ ID NO: 194522 - protein, 95 aa, Triticum aestivum
  unsure (1)..(95): unsure at all Xaa locations
  Clone ID: PAT_TA_88940.pep
XXXGPIPALXXKXEVLXLXPIXFGGANLILFGAHXNLAGAVSXPPXYXXLXNLXCXXSPXRXGNXAGLAXHYTINSHLLPCFLGVPSSPHHPXTT

SEQ ID NO: 194523 - protein, 81 aa, Triticum aestivum
  unsure (1)..(81): unsure at all Xaa locations
  Clone ID: PAT_TA_88941.pep
VSKGRDXXRRGCXRXPLXPLKLXERESPRGXLTAENXXYAXHEXVRVXPXDASTLXPGXSRXPRGRGGCRRARRRGXGSLT

SEQ ID NO: 194524 - protein, 125 aa, Triticum aestivum
  unsure (1)..(125): unsure at all Xaa locations
  Clone ID: PAT_TA_88942.pep
MSVETERSSXESSGASGLHXRGKRPQPPXPGSEPERKXGSXSDPXWPSPNXGASDSXPSPKXQVVGWATVAVVPGRKSRGAGSSKDKQGWVDGGLTGSSKAWKALSYEQPRHARTRIPFRPKLGN

SEQ ID NO: 194525 - protein, 133 aa, Triticum aestivum
  unsure (1)..(133): unsure at all Xaa locations
  Clone ID: PAT_TA_88943.pep
TRTRARLCEDIKVPGKSSLPSLKTLLLLRXWXLIFPCSDFRHXVATPMLLLMXEYLMRCPIQSGRDAXVXSFLCSMXLRXTKESKKFCPEXXXFLQTXLVXSLKWRRXXXXINDQVYXRXTTLKPXXHXKKAM

SEQ ID NO: 194526 - protein, 106 aa, Triticum aestivum
  unsure (1)..(106): unsure at all Xaa locations
  Clone ID: PAT_TA_88944.pep
LILXWRKTXTRDVXICSSYXCXVWGRSRKSHIXGERXDHSPCDRHSELGVLMDQKVHQXVGVVPXRPRSGRPASAAGASXRSRCSTHPLXRXTSRRRSGSAARRVP

SEQ ID NO: 194527 - protein, 83 aa, Triticum aestivum
  unsure (1)..(83): unsure at all Xaa locations
  Clone ID: PAT_TA_88945.pep
QXVMAVDFAPLCRGGLXAATHGSCMSHASFNIRTTFLEGMQGSXFPHAGVCDAFVLLYQRVXXMRXKXCXXQCIAHVPVLLPI

SEQ ID NO: 194528 - protein, 85 aa, Triticum aestivum
  unsure (1)..(85): unsure at all Xaa locations
  Clone ID: PAT_TA_88946.pep
NFXXLXRIYSSXGGNSQXRKAFVTCFPXRFPFSQLGTXXPXPDYCYPFXWPVTXDVXMWMLLIXXHASMEYVLHQCRISLXLFNF

SEQ ID NO: 194529 - protein, 125 aa, Triticum aestivum
  unsure (1)..(125): unsure at all Xaa locations
  Clone ID: PAT_TA_88947.pep
SYRWQYYXRVTQVLAXIRFXFCARCWTSCGTTWWPGLARRRXSTSSAAXPPXKPSPSTQVQGRXLXQSPSMPTNPDHAGDXVVXXAGSMXGTCXCAFSTPGXKXATXRLGXQXSSXRPXSPXPPP

SEQ ID NO: 194530 - protein, 155 aa, Triticum aestivum
  unsure (1)..(155): unsure at all Xaa locations
  Clone ID: PAT_TA_88948.pep
MGFPPGLQGKFXNEGERGXEXXQXRKRRXPAEENLTAARPQKAXNGVIQPPXAGRGGNKEGTKAASAAPKSRXMSNLKAPXSKLLTGFPGGGRDQXXKFQTAVHPQXRAXSMEQRXKTAPPGSPIVPALSKLXXRGKXEXXRTICWWVVWDKSKE

SEQ ID NO: 194531 - protein, 123 aa, Triticum aestivum
  unsure (1)..(123): unsure at all Xaa locations
  Clone ID: PAT_TA_88949.pep
MARLNSKAVVAAVVLAAVVLMMAGREASAALSCGQVDSKLAPCVAYVTGRASSISKEXCSGVQGLNGMARSSSDRKIACRCLKSLATSIKSINNGXRSPALXRAKCXVXSVPFPQSAITKLAN

SEQ ID NO: 194532 - protein, 58 aa, Triticum aestivum
  unsure (1)..(58): unsure at all Xaa locations
  Clone ID: PAT_TA_88950.pep
GXFEQRXXPRXVPXXGVSLLFTIGEGXGFVRPLDPLTEXDMFLXXRNSXSPGXXYFWT

SEQ ID NO: 194533 - protein, 144 aa, Triticum aestivum
  unsure (1)..(144): unsure at all Xaa locations
  Clone ID: PAT_TA_88951.pep
PLLLPSPARCRKQPQPPPXHQPHLPPYXLDEFREAPRLPPXHLDDFRDPARLAPGHXDSLREHPPPPRQHLVGXGGGXPAPASHMGAXLXERIGAEIEGARAAPDKNSESLRTQRARARRSPARATGLARGPKKGDSRFPRGSV

SEQ ID NO: 194534 - protein, 75 aa, Triticum aestivum
  Clone ID: PAT_TA_88952.pep
TSRFLLVSRELRYLVIFFLLFSYDTRDKSLALYFGLVTLACLLDVNWSDMRKYVGWTIFVAIPHCLHSYKRRAVA

SEQ ID NO: 194535 - protein, 172 aa, Triticum aestivum
  unsure (1)..(172): unsure at all Xaa locations
  Clone ID: PAT_TA_88953.pep
KTXPXGGGKNALXXGXARVPXEXRPCSTMGSKQRQSXTXCVVPEPYHXIXXMTHSFIRXVEXXXRHQLXAXWXTSMRAINARQXWQLXTLQXPILXXHPXWSQXSXAWVSLRWSLCPKKFGIERXSPSACXNLTXFRGLRPXLGXXGXLXXRPXITKRXIXSTGSEXMXRVK

SEQ ID NO: 194536 - protein, 52 aa, Triticum aestivum
  unsure (1)..(52): unsure at all Xaa locations
  Clone ID: PAT_TA_88954.pep
WLTYYGILQLLRLQSGKKELKNCDVCLTCXYFFNXLSXWGKVVLFSRTKGLX

SEQ ID NO: 194537 - protein, 105 aa, Triticum aestivum
  unsure (1)..(105): unsure at all Xaa locations
  Clone ID: PAT_TA_88955.pep
ATRWXDVRXLGXXSAASKXVNGXVPHVXDXXVKIDRVVXAVDGDGEDXLXLTSPKXXDILSHFLKLXXFTIIXPFHKSXRGPTXPGGXSSRQLVHHXPAEXLXSF

SEQ ID NO: 194538 - protein, 127 aa, Triticum aestivum
  unsure (1)..(127): unsure at all Xaa locations
  Clone ID: PAT_TA_88956.pep
MXRLNXKXVVXAVVLAAVVLMMAGREASAALSCGQVDSKLAPXVAYXTGXASSISXECCSGVQGLXGMXRISSGRXDSXQGASXSLATTXSKSIXMGXVLGXPRQSXXVNXPFPIXKSTNXXNCLSI

SEQ ID NO: 194539 - protein, 101 aa, Triticum aestivum
  unsure (1)..(101): unsure at all Xaa locations
  Clone ID: PAT_TA_88957.pep
RPNTRGGVPXXASSRXAANXVGKGANSVAGALXSLITXPALAEKGGMXLAKGXFKFGVNXRVFPQFXDGCKTTAQLSAALIRLTYRAELVTGPPPQNXCLI

SEQ ID NO: 194540 - protein, 92 aa, Triticum aestivum
  unsure (1)..(92): unsure at all Xaa locations
  Clone ID: PAT_TA_88958.pep
MSLIKILSMVSCVQAFHCVCVIVCDXLFVCVTDCVCFFVCXXVQAPHCVCACVLTVNCVSFYDCDCALXCDCVCVCVCXLTGDCVSFCRALP

SEQ ID NO: 194541 - protein, 54 aa, Triticum aestivum
  unsure (1)..(54): unsure at all Xaa locations
  Clone ID: PAT_TA_88959.pep
XRIXNVTFLXTXKXCCLSSIKDVQKPFTXPGSNVXXQEERQXFTHXXKLHTWXG

SEQ ID NO: 194542 - protein, 120 aa, Triticum aestivum
  unsure (1)..(120): unsure at all Xaa locations
  Clone ID: PAT_TA_88960.pep
GNWASTTRSWAHDWREALEXTLAWLGPMAHNMMRWXADRSFEXQHXMEVQLXGGNGNGNVLLLQTLYFADRDKTEAVLCELLVGLNYICRYXAXSRARCSTAPAXVDFDDCTVDWHASMQ

SEQ ID NO: 194543 - protein, 133 aa, Triticum aestivum
  unsure (1)..(133): unsure at all Xaa locations
  Clone ID: PAT_TA_88961.pep
KXNRARGIFFHSRDWVSMPGVXPVASVVIHVLAYXQLLTEIXFGDDSXVLQFVGGTLGHPXGEMHPGAAANRVALEACVQAXXNEGRDLAREGNEIIRQLCKWSXPELAAACEVWKAIKFEFXPVDTYCVDKK

SEQ ID NO: 194544 - protein, 116 aa, Triticum aestivum
  unsure (1)..(116): unsure at all Xaa locations
  Clone ID: PAT_TA_88962.pep
YAXFSASNGEGGALHVLXXWSFXTFXFPNXXHASXSPIPSPPXXEQXSLKKPLTXPXNHXXHQNLFXXVLGGALXGVGLLXLVGXNSILLIRHSKRXTNEKTAVLFXQKXFPXMXS

SEQ ID NO: 194545 - protein, 107 aa, Triticum aestivum
  unsure (1)..(107): unsure at all Xaa locations
  Clone ID: PAT_TA_88963.pep
FKRYTEGLMSPQTETXAGVGFKAGVXXYKLTYYTPEXXLTXTDILXSIPXVSPHPGGSASETRGCKLEFLLGTLKLFVTDGYQVLIRYKTDAHILVALGKRTSPNGL

SEQ ID NO: 194546 - protein, 136 aa, Triticum aestivum
  unsure (1)..(136): unsure at all Xaa locations
  Clone ID: PAT_TA_88964.pep
VRGRMVGEEIPAPQTKWGMNTHPLMGLRSGDXLPLXREPLVDFFAQIPRLPELRNVLLLDGGDHPTCPTLRIPDKVGVISWGGKDENLXARAREWGRQREKAWXKGLNPYLFIKAVNIKALHTRPKNSLIPKGHAD

SEQ ID NO: 194547 - protein, 149 aa, Triticum aestivum
  unsure (1)..(149): unsure at all Xaa locations
  Clone ID: PAT_TA_88965.pep
LSNFSXKAXCGGGAVQIPGVVRPVPRXXXEEIXAXLLQVPSXAAXKLSGPPSSXXHXGXQARXSCRXRXXQLLPPRAXIXMDLXMTMPPGXRILSGXXLQSRLGNFVGHXDMXXLTEHTSXXXNTIPYSGQGXXKGCLQAVQITKAACP

SEQ ID NO: 194548 - protein, 56 aa, Triticum aestivum
  unsure (1)..(56): unsure at all Xaa locations
  Clone ID: PAT_TA_88966.pep
SRPRXDXSLLARXKXXDKGXXRXYFNXXSGIKKKKXKTPXLXPNFLASPGXIXLSF

SEQ ID NO: 194549 - protein, 131 aa, Triticum aestivum
  unsure (1)..(131): unsure at all Xaa locations
  Clone ID: PAT_TA_88967.pep
YPPKLSSIKRIXXWGCSSSKPCLPEGPLKINPARFMNKACEGFLSKEKMRXTLEGYQNXFYVNVEKXKSGXLGIHSVDPVTKNPXXLPXRWSSFVKQPARKGGLGSPTKIEGDGNQHWSLPRHXXYWAKNX

SEQ ID NO: 194550 - protein, 89 aa, Triticum aestivum
  unsure (1)..(89): unsure at all Xaa locations
  Clone ID: PAT_TA_88968.pep
MEPXXSXAVARQTWXLEXNIPAGASDPDAMXAIXXYXEAGNXRAHQEXPWGTXPQXFRRAXXSALALXKXVVHXRAGGXIXXXXLMQGK

SEQ ID NO: 194551 - protein, 108 aa, Triticum aestivum
  unsure (1)..(108): unsure at all Xaa locations
  Clone ID: PAT_TA_88969.pep
WSAXXLTTVPGPGXKEFNYKQDXSKTSXKEXCWKWVXXCSKEQXELGXXXIQTXXGDXEGKERSQXLPLVQGPGICXKQREXHXKSSMXFSWNXTAKXPIXKXPNXXM

SEQ ID NO: 194552 - protein, 59 aa, Triticum aestivum
  unsure (1)..(59): unsure at all Xaa locations
  Clone ID: PAT_TA_88970.pep
EESCXXNKRXPXXQLPGFSPMXLXXVXXFVWXPXXPYCXELDGXXNKGNVVNVFCXXPH

SEQ ID NO: 194553 - protein, 120 aa, Triticum aestivum
  unsure (1)..(120): unsure at all Xaa locations
  Clone ID: PAT_TA_88971.pep
GXPVGDXXAXRXXQTXXLXVLDVXQTPRTXSPGCPLXLXXRXLPXRPXNLPEDVXTXPSLXDVERQVPRTXXARXXXRGQPWXSPFLRFPPAITAAAXRRXRVWFWXWLPRXGIXPTPGX

SEQ ID NO: 194554 - protein, 62 aa, Triticum aestivum
  Clone ID: PAT_TA_88972.pep
REHVNVRCCIVLEFFYFMLIASSDAKTHGNKHTCYRRNKLLLQIKTACQALAPLFQFALLHC

SEQ ID NO: 194555 - protein, 105 aa, Triticum aestivum
  unsure (1)..(105): unsure at all Xaa locations
  Clone ID: PAT_TA_88973.pep
XLSGIPPGLAGFYNQQLRFNSRYEMNPKGLXPVXSYXEPVQRASNSTXKALSKWPTTCFNKPVQSIRNPATMKEGSNEVQEGSSDNPLSKFFFLPASSRHQDIIY

SEQ ID NO: 194556 - protein, 109 aa, Triticum aestivum
  unsure (1)..(109): unsure at all Xaa locations
  Clone ID: PAT_TA_88974.pep
PRTSGIPGAXXEFRHXGXLTXFCLGGVPXDSVXWLTLGGTRLXXCLKFELPRVRGXYHFXXPXCFQKXXPXLVQIXLGLSTKXENAPCKSLSPVTWSSLGYTGXTXGSS

SEQ ID NO: 194557 - protein, 110 aa, Triticum aestivum
  unsure (1)..(110): unsure at all Xaa locations
  Clone ID: PAT_TA_88975.pep
YCWXSKHECGYFFSIEERSCRSLLGRRRIDAHVPFGCXFHLGEKPDGLSLLTYDFLDCTHXARCXXHVXPLTLGVGACKKVPPSSRLHKHRMNFALGLLVLDCVEGSHSS

SEQ ID NO: 194558 - protein, 66 aa, Triticum aestivum
  unsure (1)..(66): unsure at all Xaa locations
  Clone ID: PAT_TA_88976.pep
MGGASPQASYMXXNLGISVPMMSSSPLXXNAPPEKKXVKNFAIDFLXGGVSAAVSKTAAXAPIEXV

SEQ ID NO: 194559 - protein, 161 aa, Triticum aestivum
  unsure (1)..(161): unsure at all Xaa locations
  Clone ID: PAT_TA_88977.pep
XDRPIEPRXXXTSLIGANLGTGPPPGGLAXSHIPADSVGVLXWLXVGAFVACXXGALGPGAEPPXLAVVMEPLLPEGGWGQPRLRGRCAVARLRQIWRLASTRGGRSWWWCSSAGDHGCGSAEAASGESPWAPVFSSMSWSLYQQWASIFSISLVRLSLLL

SEQ ID NO: 194560 - protein, 169 aa, Triticum aestivum
  unsure (1)..(169): unsure at all Xaa locations
  Clone ID: PAT_TA_88978.pep
WLVGNSVAPFXGLKSNAGLPVXSRRSNXASLGSVXSNGGRIRCNASVAIEGIKKFENLSXLPTLNTEALLKQVDXLIRSKWVPCLEVQQXLGSSSVEAQRIPLGYYDGRYWTNVGSCLCSGCTDATQVINEGGKKVKKGVPLTRYVPHHRDSTTFAKVQVRQAFIFKAN

SEQ ID NO: 194561 - protein, 169 aa, Triticum aestivum
  unsure (1)..(169): unsure at all Xaa locations
  Clone ID: PAT_TA_88979.pep
MSPQTETKAGVGFKAGVKDYKLTYYTPEYETKDTDILAAFRVSPQPGVPPEEAGAAVAAESSTGTWTTVWTDGLTXSLDRYKGRCYHIEPVAGEDSQWICYVAYPLDLFEEGSVTNMFXSIVGNVFGFKSPTCLYVWXDLRIXPPTYSKTFQGPPQGXTKVERDKLNXV

SEQ ID NO: 194562 - protein, 106 aa, Triticum aestivum
  unsure (1)..(106): unsure at all Xaa locations
  Clone ID: PAT_TA_88980.pep
GNXXLQANRIXMGSVLKQAKGLVVXPXVGPGRAGGCLMIGPAREGLXRALXVRGKVGLQSSAARGRXRYVDGGKGRSXNXAKGSCXLRRSRGLERQWXXQASSGXG

SEQ ID NO: 194563 - protein, 49 aa, Triticum aestivum
  unsure (1)..(49): unsure at all Xaa locations
  Clone ID: PAT_TA_88981.pep
SVFPXGVXXGASXXPGVXEIXSPKIXSKEEIAXRXXKMXAXVXTKXLWV

SEQ ID NO: 194564 - protein, 141 aa, Triticum aestivum
  unsure (1)..(141): unsure at all Xaa locations
  Clone ID: PAT_TA_88982.pep
MARLNXKAVAAAVVLAAVVLMMAGREASAALSCGQVDSKLAPCVAYVTGRASSIXKECCSGVQGLNXLARNSXGRKIACKCLKSLATSIKSINMGKVSGVPGKCXVKXVPSPSSMSNNCNKCQLSSIYNSLRASWRWRFFY

SEQ ID NO: 194565 - protein, 78 aa, Triticum aestivum
  unsure (1)..(78): unsure at all Xaa locations
  Clone ID: PAT_TA_88983.pep
MXAKCYXTVXDKYLAAVAKAKRKLRGFIAXKNCAXLMLRLAWXSXGXFDVGTKTXGAFXTMKXPAELAXGANAGLDIA

SEQ ID NO: 194566 - protein, 73 aa, Triticum aestivum
  unsure (1)..(73): unsure at all Xaa locations
  Clone ID: PAT_TA_88984.pep
ASSPXPYLXTAXMNMGAARVXAQTXPWCSSSPSYFCAVRRSVVGADASGTKYLSRIILVGDGWLVPEFLPAPG

SEQ ID NO: 194567 - protein, 77 aa, Triticum aestivum
  unsure (1)..(77): unsure at all Xaa locations
  Clone ID: PAT_TA_88985.pep
IXDQPWPACXDXPTSATSXGSDRSGRGEPVGCGXXETGIGGGDGGREEEPLGXGXXGEGXHGGVFFGGRGDLQRXRG

SEQ ID NO: 194568 - protein, 133 aa, Triticum aestivum
  unsure (1)..(133): unsure at all Xaa locations
  Clone ID: PAT_TA_88986.pep
IYTSPRATLQWRPPHPPPPPPPSPSPXPAPAPRAAPAAPPPPRAPRGLVVSSVVVVVRRRRRSPTPARAPRQDGPHPPPRGQAVRARAQRPTPSMLPGLLSPARTLNSLGKGDIPLRRRSRKDLQKTPKFNWC

SEQ ID NO: 194569 - protein, 89 aa, Triticum aestivum
  unsure (1)..(89): unsure at all Xaa locations
  Clone ID: PAT_TA_88987.pep
MAPTKGEGAAIXINLGTTYXCVGVWQXHXRXEXIXNDQGNRTTPSYVAFTXSEXLIXDAAKKXVAMXPINTVFXXKXLIGXKVXDAPXH

SEQ ID NO: 194570 - protein, 134 aa, Triticum aestivum
  unsure (1)..(134): unsure at all Xaa locations
  Clone ID: PAT_TA_88988.pep
MPPPPTTMTSATAPSLPYELLEEVFLRLPPEEPALLARASFASKFWLXLLSXPRFRRRYGEFHGAPPVLGFLCCRPCSIFPDEAGGTRKLRLHHEIRRARSRRRRTWGRGNAAMRLLGESVINMIGASFWENGR

SEQ ID NO: 194571 - protein, 144 aa, Triticum aestivum
  unsure (1)..(144): unsure at all Xaa locations
  Clone ID: PAT_TA_88989.pep
MSPQTETKAGVGFKAGVKDYKLTYYTPEYETKDTDILAAFRVSPQPGVPPEEAGAAVAAESSTGTWTTVWTDGLTXSLDRYKGRCYHIXPVAGEDSQWICYVAYPLDLFXEGSVTNMFTSXVGNVFGFKTLRALRLGDXRIPPP

SEQ ID NO: 194572 - protein, 67 aa, Triticum aestivum
  unsure (1)..(67): unsure at all Xaa locations
  Clone ID: PAT_TA_88990.pep
MXRXEEXAKFPXCDAXFDTIQXSKKKLPLTLHXXXXAXFXHIPIXXFPDXXIXXGYLQKKSLNLLSA

SEQ ID NO: 194573 - protein, 82 aa, Triticum aestivum
  unsure (1)..(82): unsure at all Xaa locations
  Clone ID: PAT_TA_88991.pep
KNHSNTSSKTIXKVFXLWGENTXKKXSVHLFQXKRWASTCXKRXNNTGXGXXGPQXCSXGADXXTXXPKGXINXXRITSPPP

SEQ ID NO: 194574 - protein, 143 aa, Triticum aestivum
  unsure (1)..(143): unsure at all Xaa locations
  Clone ID: PAT_TA_88992.pep
MSPQTETKAGVGFKAGVKDYKLTYYTPEYETKDTDILAAFRVSPQPGVPPEEAGAAVAAESSTGTWTTVWTDGLTXLDRYKGRCYHIXPVAGEDXQWICYVAXPLNLFXEGSVTNXFTSIVGNVFGFKTLXAXRLXGXXNPPT

SEQ ID NO: 194575 - protein, 79 aa, Triticum aestivum
  unsure (1)..(79): unsure at all Xaa locations
  Clone ID: PAT_TA_88993.pep
MSCCGGSCGCGSACKCGNGCGGCNMYPEVEAAGATLLVAATATXKAXSSGGMEXAAEDGGCGCTQCKFGTNCXCSCCSC

SEQ ID NO: 194576 - protein, 86 aa, Triticum aestivum
  unsure (1)..(86): unsure at all Xaa locations
  Clone ID: PAT_TA_88994.pep
NVYVHADPAVRXXDPPTPSFRGRFVXGKPTRRGEPSLITAARRLLXAXLLXDPANTYFXLLSQXXVXLHXFXRLYXAXFPKGAQHL

SEQ ID NO: 194577 - protein, 61 aa, Triticum aestivum
  unsure (1)..(61): unsure at all Xaa locations
  Clone ID: PAT_TA_88995.pep
XVHGRLNXXQGPTNSCTSXYLFXPPKTTKIPQQFHLFAGCPEAXTXTAGXRTTXVVCAAXG

SEQ ID NO: 194578 - protein, 82 aa, Triticum aestivum
  unsure (1)..(82): unsure at all Xaa locations
  Clone ID: PAT_TA_88996.pep
XIPXHLLXLXVGRQQQQXKFXPTTXXIXXYLGLQRSXVXQGTFXFSNKVLXRYPCQVCKSQSQLWLRFNQVRRRIRFRSIRS

SEQ ID NO: 194579 - protein, 117 aa, Triticum aestivum
  unsure (1)..(117): unsure at all Xaa locations
  Clone ID: PAT_TA_88997.pep
LIEFLRAFEHRRRASPSPCARPRRAASSSSSPSSRGRLFTSLCDNPPPTAALDALALLAVLGXLAFXGRALRXAAGARGRXTWCGXXPEEXXSYVVLXGGXXAXAXXXQXVXHXLSW

SEQ ID NO: 194580 - protein, 114 aa, Triticum aestivum
  unsure (1)..(114): unsure at all Xaa locations
  Clone ID: PAT_TA_88998.pep
MREXISXHIGQAGIQVXNACWELYCLXHXIXPDGQMPGDXTVGGXXDAFNTFXXETGXGKXVPPAVFVDFXPTVIXXVRTGAXRXXXHPEQLXNCKXGVGXNKFPXGXFHQWED

SEQ ID NO: 194581 - protein, 62 aa, Triticum aestivum
  unsure (1)..(62): unsure at all Xaa locations
  Clone ID: PAT_TA_88999.pep
FFLASPAGSGEQEKEKEXTXVDDFAFXPPSFYXQXGEGXCXTNGRPPPSFANSRRTDPLQDA

SEQ ID NO: 194582 - protein, 146 aa, Triticum aestivum
  unsure (1)..(146): unsure at all Xaa locations
  Clone ID: PAT_TA_89000.pep
MAGLLLLKLLPPSILSGATSTSTPRRRPAPIHHTTTRITSSSINATQSSSSSTTPATTSASSPAAVKLTYLQFNGWLWEXPAGFRVLVDPILVGNLDFGIPWXFDAAKERNSPNSQPNGTPGLLAEPAWVINQASTNQWELRTLNQ

SEQ ID NO: 194583 - protein, 144 aa, Triticum aestivum
  unsure (1)..(144): unsure at all Xaa locations
  Clone ID: PAT_TA_89001.pep
DSKGAGMGITTDDVIGECKLFYFAGAXTTSVLLTWTMILLCMHPEWQDRAREEVLRVLGAAGTPDXDGLSRLRVVTMVLHEVLRLYTPVTAIHRETYNPMELGGVRYPAGVVLMLPLLCVQHDXEVWGADAXXFKPXRFXXGIX

SEQ ID NO: 194584 - protein, 123 aa, Triticum aestivum
  unsure (1)..(123): unsure at all Xaa locations
  Clone ID: PAT_TA_89002.pep
FAWQQQLRXPVXXLXLPRLXQRXFMXPTITDAGSSFRXLRCGHQSPRTXAGFQHMPSWFQHLEATVPAFVTAGCSTAELHDAVAIDSPSMQACSPSSMRHIHHEDSSGSLLQQRQHGWEGRGG

SEQ ID NO: 194585 - protein, 130 aa, Triticum aestivum
  unsure (1)..(130): unsure at all Xaa locations
  Clone ID: PAT_TA_89003.pep
RGLAVVESYKSLKAGSEPSEEEEFLACVLGWGIEWLQAYFLILDDIMDNSQTRRGKPCWYRLPKVGLIAINDGLLLRSQISRIFKRYFYGKPYXVDLLDLFNEVEVXKTTSGEVVXTKLQQSEGXKNLSK

SEQ ID NO: 194586 - protein, 64 aa, Triticum aestivum
  unsure (1)..(64): unsure at all Xaa locations
  Clone ID: PAT_TA_89004.pep
FXIPXXEXIXPXSXXSGXXGKXXPXEGXLLGRXDGRDXDSPRRRRQGRGRKXIGGREVDSGWDF

SEQ ID NO: 194587 - protein, 96 aa, Triticum aestivum
  unsure (1)..(96): unsure at all Xaa locations
  Clone ID: PAT_TA_89005.pep
DFLVGGGVNXLGSHSLFLGLNYPINQEITVGKDLDGREALFDMENCVYTASPRSSGANSPDCQRYSLQPKEGENDKGIWINFDPWMSQLRQAVMWF

SEQ ID NO: 194588 - protein, 65 aa, Triticum aestivum
  unsure (1)..(65): unsure at all Xaa locations
  Clone ID: PAT_TA_89006.pep
LAARNMPSQXLXWRRGVXRSAGPRXTXGXGATTARTEKGARRLQCGGHWWLXSXEPWTXFXCVVE

SEQ ID NO: 194589 - protein, 128 aa, Triticum aestivum
  unsure (1)..(128): unsure at all Xaa locations
  Clone ID: PAT_TA_89007.pep
MXAXALHXTXSFLGTAPRRDDLVRSVGDFGGRIXMRRTVKSAPXXIWYGPDRPKYLXPFSEQTPSYLTGEFPGDYGWDTAGLSADPKTFXKKRELEVIHSPGXMLGALGCVFPXXLSXNXINSXKAVL

SEQ ID NO: 194590 - protein, 104 aa, Triticum aestivum
  unsure (1)..(104): unsure at all Xaa locations
  Clone ID: PAT_TA_89008.pep
SVPSPSPTKTTTSCQATTTTLSSWTKXTXCCRWEXVXCEKCYREGKRTRPPGGGNCXSXGLXPFLSSGXNSLQITSNLCLSXKXLQAPXLXGFWXSKSLTQXDX

SEQ ID NO: 194591 - protein, 92 aa, Triticum aestivum
  unsure (1)..(92): unsure at all Xaa locations
  Clone ID: PAT_TA_89009.pep
MAGPAGGRELPDTPTWAVGLVCAVMILVSXAMGHALHNLGHWFHKRHXXGXAXALEKIKXGLXLGGASXPXSSXVGQEPXSKICNLGGAKNP

SEQ ID NO: 194592 - protein, 90 aa, Triticum aestivum
  unsure (1)..(90): unsure at all Xaa locations
  Clone ID: PAT_TA_89010.pep
EKXFFAFFXSPXXFXFXFPVFGCXSLFCLXXIXXLVSXXNSLXXXPXFLRRXQTXQSQXFTXKDCXSIPRAXSQWIGXXCPYXKXTYLRK

SEQ ID NO: 194593 - protein, 124 aa, Triticum aestivum
  unsure (1)..(124): unsure at all Xaa locations
  Clone ID: PAT_TA_89011.pep
LAGHGSAPPPLPAQNGGFPHTILPKPLNLXKXTKLVDCCXGIGTSVLXALXGNXQVLCCCXWXKXXWWWXGAQGRDAPWASKFSKERERXPAGRXXGPXXPRXXEGRXXPXAXXWGRTXRHLXX

SEQ ID NO: 194594 - protein, 124 aa, Triticum aestivum
  unsure (1)..(124): unsure at all Xaa locations
  Clone ID: PAT_TA_89012.pep
MXSTFSXDETAPFFGFLXAAAGLVFSCMGAAYGTAXSGVGVAXMGVMRPELVMXSIXVPVVMGGVLGXXGLIIAVIISTGXKPKGKAYFLXDGXXAQLSSGLACGLPGLAGRAWATGNRRSRSR

SEQ ID NO: 194595 - protein, 105 aa, Triticum aestivum
  unsure (1)..(105): unsure at all Xaa locations
  Clone ID: PAT_TA_89013.pep
MKLIAAYLLAXLGGNSSPSAADVKNILDSXGAEADEEXLEFLLAELKXKDITQVIASGREKFAAVPSXGGAIAVGAPSAASGGAAATAAESKKEGEXXLXKKESD

SEQ ID NO: 194596 - protein, 145 aa, Triticum aestivum
  unsure (1)..(145): unsure at all Xaa locations
  Clone ID: PAT_TA_89014.pep
SFFEASKRSXXLVGTKXXPTRRXTEMTHFGVRIGLQAGSXLLNKLGILGLLGAPRGSAXFPXPPEXDPAASPXFITXNDRPXHQETPPAXEQASPPTXXMHAXFPARXCPALEXPRAGRGGGXXQWGREGREDGXLAXPWPGALV

SEQ ID NO: 194597 - protein, 79 aa, Triticum aestivum
  unsure (1)..(79): unsure at all Xaa locations
  Clone ID: PAT_TA_89015.pep
MSCCGGNCGCGTACKCGNGCGGCNMYPQAEGAGGNLLVSATXXXXXSSGXMEXAAENXGCGXTXXQSXAPXCXCSCCSC

SEQ ID NO: 194598 - protein, 158 aa, Triticum aestivum
  unsure (1)..(158): unsure at all Xaa locations
  Clone ID: PAT_TA_89016.pep
GASSFVSLSPPYSAGSPVTARKIDVVIVCLVIEGDSPSTGSAATVSSLPASAREATTARRRRASRWPSEKRRCSGSWELLTTTAMVAATTAKTMVTPSSSSRSXSSRGALLPAIFDAVFAPAHDKLRVVMLIDYICMSIFICTPTAKTMRCNANLDQI

SEQ ID NO: 194599 - protein, 158 aa, Triticum aestivum
  unsure (1)..(158): unsure at all Xaa locations
  Clone ID: PAT_TA_89017.pep
XPGALNFPRRXIXSXXGXXXXCLPXEINXFLFPPFXYPXXDPNXPRRRPGANRXGXXXDSPDPXTPPRNPGXDRAXXYRTGSKNRINETNRSERXGXLVCARGARXSGRKKGFSGRGSKQXXFLXPAXEGGAGRRTEXRGWGWGREQGEGEDGDQRGR

SEQ ID NO: 194600 - protein, 71 aa, Triticum aestivum
  unsure (1)..(71): unsure at all Xaa locations
  Clone ID: PAT_TA_89018.pep
XXGXRHGXARWRXPSXXXHPAENXAGLRSXRRXGSERXXPXSVLXXRGRRPSRXVACGGXAPXATDAGRGG

SEQ ID NO: 194601 - protein, 122 aa, Triticum aestivum
  unsure (1)..(122): unsure at all Xaa locations
  Clone ID: PAT_TA_89019.pep
PKPLPSFPFPSRTLFLLHDLSIFLDAMERSTQPWYSRLRSVQRPPCLVADQIRASSVVSHAGPRYCLPCFCCARTTTHPAKRPLIPSHVDRLPPNSPXSPRSFPDLSFTLTQVSGGLVVVVT

SEQ ID NO: 194602 - protein, 51 aa, Triticum aestivum
  unsure (1)..(51): unsure at all Xaa locations
  Clone ID: PAT_TA_89020.pep
NPSXSSSXXHRXGXYAIXIALXGFTAADXXYXLCLSRLYSXXGPVQRFXRV

SEQ ID NO: 194603 - protein, 84 aa, Triticum aestivum
  unsure (1)..(84): unsure at all Xaa locations
  Clone ID: PAT_TA_89021.pep
GHVDSSKLTPPGSTXWGGKGPMXVXSRLXXRNHELLXISLKGQRXYFVKNRSDXXXLWXXGWGXKHXTKLSKSSLXHGXIIKGN

SEQ ID NO: 194604 - protein, 62 aa, Triticum aestivum
  unsure (1)..(62): unsure at all Xaa locations
  Clone ID: PAT_TA_89022.pep
VIEEXPNTLVELIDWXQILGRXRGXAKRRXXSXXXGPAAAGRTXWXWEVASPMXFVTRNARS

SEQ ID NO: 194605 - protein, 141 aa, Triticum aestivum
  unsure (1)..(141): unsure at all Xaa locations
  Clone ID: PAT_TA_89023.pep
MATISAAAATTVVXRAAIARPQALGLPQLRTXSERVXCSYSKDAKEATPAAAVRGAGASLLXAXGAVTASAGPALALVDERMSTXGTGXXLGLXSXNLLGWDXXGVFGLIWVAXQTSXTPGLEXGTRXXGGLSLLSDSFPP

SEQ ID NO: 194606 - protein, 52 aa, Triticum aestivum
  unsure (1)..(52): unsure at all Xaa locations
  Clone ID: PAT_TA_89024.pep
LEFFFFFFENXIPLDXDXITAXXXSXSXHLXXLDIYGTRGSLTXXQHSXYCL

SEQ ID NO: 194607 - protein, 67 aa, Triticum aestivum
  unsure (1)..(67): unsure at all Xaa locations
  Clone ID: PAT_TA_89025.pep
AXXXKXXXCCXHXECSCXPXKIQLXEIXPSVSXPCNILCHRXQHLFLPVVTSVLNSCSMSSLKKKKK

SEQ ID NO: 194608 - protein, 140 aa, Triticum aestivum
  Clone ID: PAT_TA_89026.pep
LEPEDESSDSDDLNFITRSGNSEPLKNREKVDDLGLPSAYSEDDDYDSDEVIEMMQSSSDESNFTTSSDNPEDVKEKVDGLGLPSEDSEDDDYDPAGPGSDEDIGKKQSSSEKSHSSDKSENRKTKRKLMTSDYLLRTRG

SEQ ID NO: 194609 - protein, 97 aa, Triticum aestivum
  unsure (1)..(97): unsure at all Xaa locations
  Clone ID: PAT_TA_89027.pep
MXLFAAARRAVSSSLPLLRASASRGAAXRGXDLLHPLAAXAXRXMHFSSXXELXPXSDDELLRIINXXXKFADXCXDXDRXEEXPNXFXFRITDXXA

SEQ ID NO: 194610 - protein, 120 aa, Triticum aestivum
  Clone ID: PAT_TA_89028.pep
LAAAAVLSPMHFTYCTPGLIPYAARTVSTLQIYSVKIVGTDGKLKLPLHVYGIVAARDAVDYNRNILFSWRRENCQKLTPEACTILHSISRNFPLFFLHVHSFIRFNYNDDYDACILFCA

SEQ ID NO: 194611 - protein, 66 aa, Triticum aestivum
  Clone ID: PAT_TA_89029.pep
EKDLIRDTNLEYCEALRAAGKEVEVLINRGMSHSFYLNKFAVDMDPTTGERAQELIDAIKSFVARH

SEQ ID NO: 194612 - protein, 124 aa, Triticum aestivum
  unsure (1)..(124): unsure at all Xaa locations
  Clone ID: PAT_TA_89030.pep
MXIFVKTLTGXTITLXVESSDXIDNVKAXIXDKEGIPPXQQRLIFAXXXLEDGXTLADYNIQKXSTLHLVLRLRGGMHIXXXXLXGKTXTLEVESSDTIDNVXSXDQDXEGSSXTTXLIFAGTA

SEQ ID NO: 194613 - protein, 128 aa, Triticum aestivum; identical to SEQ ID NO: 127797
  Clone ID: PAT_TA_89031.pep

SEQ ID NO: 194614 - protein, 99 aa, Triticum aestivum
  unsure (1)..(99): unsure at all Xaa locations
  Clone ID: PAT_TA_89032.pep
RKCAAVVRRCDPAAGEASPASMDLSAASALAVLSKLQLLGFCVGLQIPDDAADPXGGVRHHPRRVPGRGLXRRXRCAPAXGXPRRLXPRGXXPXLXXXP

SEQ ID NO: 194615 - protein, 164 aa, Triticum aestivum
  Clone ID: PAT_TA_89033.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPISGAPTPHSDNEWRSQEGYLTVLRIIGSTTCPGQQLALSTGSREG

SEQ ID NO: 194616 - protein, 165 aa, Triticum aestivum
  unsure (1)..(165): unsure at all Xaa locations
  Clone ID: PAT_TA_89034.pep
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDXRYWTMWKLPMFGCTDATXCSTGGGKKIPDAIRVSLRNCQVSLTHRLGTGSRSRLTH

SEQ ID NO: 194617 - protein, 88 aa, Triticum aestivum
  unsure (1)..(88): unsure at all Xaa locations
  Clone ID: PAT_TA_89035.pep
CTKHPSATALKTSTCWRPKNSLLIXNCXXNXXXTFLGSLPXXKVLXILSDLFXXISXVVLHIIDSSXSSPRPLAXSRXNATRCPTXXG

SEQ ID NO: 194618 - protein, 171 aa, Triticum aestivum
  unsure (1)..(171): unsure at all Xaa locations
  Clone ID: PAT_TA_89036.pep
VKTLTGKTITLEVESSDTIDNVKAKIQDKEGIPPDQQRXFAGKQLEDGRTLADYNIQKESTLHLVLRLRGGMQIFVKTLTGKTITLEVESSDTIDNVKAKIQDXEGIPPDXQRLIFAGKXLEDGXTLRDYKFRXXHLNLARLRGGYLRWPGTCRGSCPPSLVWLTISGYFG

SEQ ID NO: 194619 - protein, 94 aa, Triticum aestivum
  unsure (1)..(94): unsure at all Xaa locations
  Clone ID: PAT_TA_89037.pep
CSRAVTNKSAYKPVACLSANNSHVYVWVSGYECMVEDLEPYCGYMAEIPFGNEYSSDHRQLQNAXYADITKFISXGAQFRXXXRGLSVSEILGN

SEQ ID NO: 194620 - protein, 111 aa, Triticum aestivum
  unsure (1)..(111): unsure at all Xaa locations
  Clone ID: PAT_TA_89038.pep
XXTVGRXPXXREXXVXVXGXGSHXXHXLCLIGXCRFHGXMNKRGGGQALMTMTDGXRDRCLSXTAMGXSXPXXXNIAEPAXIGSXRGSSGRXRXXQRXGAAAXCSSLPFXS

SEQ ID NO: 194621 - protein, 78 aa, Triticum aestivum
  unsure (1)..(78): unsure at all Xaa locations
  Clone ID: PAT_TA_89039.pep
LSRSPPIQSAAQQIDRSLXRMIYGXWSXLSSTVVXWGNVXAAGLAGIFLFGGKXKFHXYLSXXGERLRXHDRXMMGKX

SEQ ID NO: 194622 - protein, 60 aa, Triticum aestivum
  unsure (1)..(60): unsure at all Xaa locations
  Clone ID: PAT_TA_89040.pep
LFXPLIKXDNILNKYLHGGKSSSPEXXHDLKTTKRGKYKEVTXAVIHRRCMGLQNRPXSS

SEQ ID NO: 194623 - protein, 56 aa, Triticum aestivum
  unsure (1)..(56): unsure at all Xaa locations
  Clone ID: PAT_TA_89041.pep
TSYVGSPSXQVINELRSQEEYPXXYVRIIGFDNMRQVQCVSFXXFKPPGCEESGKA

SEQ ID NO: 194624 - protein, 154 aa, Triticum aestivum
  unsure (1)..(154): unsure at all Xaa locations
  Clone ID: PAT_TA_89042.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINKWRXVKKEYPDXYVRIIGSTHRK

SEQ ID NO: 194625 - protein, 149 aa, Triticum aestivum
  unsure (1)..(149): unsure at all Xaa locations
  Clone ID: PAT_TA_89043.pep
MANPRVFFDMTVGGAPAGRIVMELYKDAVPRTVENFRALCTGEKGVGKSGKPLHYKGSSFHRVIPDFMCQGGDFTKGNGTGGESIYGEKFADENXHKHTKPGSLHGNAGPTPXLPVLICTVPALVTASTLRVSGDSRTREPLSSHPDGA

SEQ ID NO: 194626 - protein, 45 aa, Triticum aestivum
  unsure (1)..(45): unsure at all Xaa locations
  Clone ID: PAT_TA_89044.pep
GLLXXXVXGGAGDPPXXRRYAVFAXDXTFLXTETTRRRLXTRPXS

SEQ ID NO: 194627 - protein, 73 aa, Triticum aestivum
  unsure (1)..(73): unsure at all Xaa locations
  Clone ID: PAT_TA_89045.pep
GGYVTTRHGTKAXVGFKAGVKDYKLTYYTPEYXTKDTDXLAAFXXSPQAWGSARXTXAAVAAIXLLXTSTXVW

SEQ ID NO: 194628 - protein, 100 aa, Triticum aestivum
  unsure (1)..(100): unsure at all Xaa locations
  Clone ID: PAT_TA_89046.pep
PVPPPPPATALPPPPRPPLPPLPPAPPPLPPPHPAPPPSPPXSPPRAAAATSGPAPAPAAVAMTTTSSSPRSPWSAASASSPRLRQNMSERRTLSRSLTL

SEQ ID NO: 194629 - protein, 62 aa, Triticum aestivum
  unsure (1)..(62): unsure at all Xaa locations
  Clone ID: PAT_TA_89047.pep
XXSGHENXSKDDHPVLRXSDLSGCSVPSXGXQPMARSSPFXTXXWXXGCACXRRTRARXWGV

SEQ ID NO: 194630 - protein, 125 aa, Triticum aestivum
  unsure (1)..(125): unsure at all Xaa locations
  Clone ID: PAT_TA_89048.pep
GAEPTLGPRPPPPPPPPAAPPSQPQVSEAAARRLREAEERLREAIQELHQSHGRDEEAXKGGGWGCCVHQGESCAAHAAGNLCQTFLLSYGVRVGIGIXLRAFKLARRSXYASLLDLKQLVSEKV

SEQ ID NO: 194631 - protein, 94 aa, Triticum aestivum
  unsure (1)..(94): unsure at all Xaa locations
  Clone ID: PAT_TA_89049.pep
MAETEYRCFVGGLAWATDDNNLQXAFSQYGEILDAKIIXDRETXRSRGFGFVTFXSEXSMLQXIXEMXXXXLXGXXITVNEAQXRXSXXWGXPR

SEQ ID NO: 194632 - protein, 155 aa, Triticum aestivum
  unsure (1)..(155): unsure at all Xaa locations
  Clone ID: PAT_TA_89050.pep
MAASMITSPIVAPTSLPSLSRRGSSFAVVCSGGKKIKVDKPLGLGGGLTVDIDANGRKVGKKGGYQFVDKYGANVDGYSPIYTPEEWSESGDRYAGGTTGLLIWAVTLAGLLGGGXLVYNTSALAGKHLLYTGPGLCLHARLTTSYSVNVVIIKL

SEQ ID NO: 194633 - protein, 114 aa, Triticum aestivum
  unsure (1)..(114): unsure at all Xaa locations
  Clone ID: PAT_TA_89051.pep
IVKAAMVSKVPAKLAGLLKTAIKNGAITIVGERIVSVSIDQLEAPLKEFFNNLPGAVELISDGVADIAEDGYRTVQSIAQEVINEAENIGKTIGHEFEHAGKLLFKKLKSGKXH

SEQ ID NO: 194634 - protein, 164 aa, Triticum aestivum
  unsure (1)..(164): unsure at all Xaa locations
  Clone ID: PAT_TA_89052.pep
PQLGTSPACASPQNGSELLASTTSDLDEKGVAFVQYIRLINRINQRYFQWITPPLTWRSAPNLGLAAIVASISIPQGDCSSVMPSVCGSWRWDXLGEASYHIIPAMMEELHWDLXCGXWIGLIIARRKXCGEQYVDDPSSKATIPFRRXHXPLGHYMWASSKRP

SEQ ID NO: 194635 - protein, 175 aa, Triticum aestivum
  unsure (1)..(175): unsure at all Xaa locations
  Clone ID: PAT_TA_89053.pep
RNPHLKTLALIPDPGEARWPTRRVFFDMTVGGAPAGRIVMELYKDAVPRTVENFRALCTGEKGVGKSGKPLYYKGSAFHRVIPDFMCQGGDFTRGNGTGGESIXTARIRRREFVHKHTKPGFSXREXXXKXKGXNFXRNVPCNXSTETLAFGKSSRHSNQGPDSSRIPMPNRRRG

SEQ ID NO: 194636 - protein, 173 aa, Triticum aestivum
  Clone ID: PAT_TA_89054.pep
IPIRPNSIPDTSTSPPPPPWRTAAASSSSSAPSSTAAAPPRRPAAPPRRVPAPAARPPPPPHRHRRGESYSPRSATTRPRPPPSTRSPSWPCSARWLGRALRQAAGPRSRGPGAAVPEELTRTWPRRRRRRVAAVGLSGSGGTRANEAAAAKSIQTTQTNPEKCPASSSASAL

SEQ ID NO: 194637 - protein, 70 aa, Triticum aestivum
  unsure (1)..(70): unsure at all Xaa locations
  Clone ID: PAT_TA_89055.pep
IASFXRXXAFPXSNWPXAXPPTRHRRSCPTWRRWWREWDGEGTSGRRRGGEREGVGGRGDGEGRRDGEGT

SEQ ID NO: 194638 - protein, 103 aa, Triticum aestivum
  unsure (1)..(103): unsure at all Xaa locations
  Clone ID: PAT_TA_89056.pep
PVYKGVLRDGQEIAVKRLSKTSXQGLVEMRNEVVLVAKLQHKNLVRLLGCCIQEEXEMLLVXXFLPNRSLNXXLFRFXRGRKELXWGTSGRGWKFFPPKPGGK

SEQ ID NO: 194639 - protein, 83 aa, Triticum aestivum
  unsure (1)..(83): unsure at all Xaa locations
  Clone ID: PAT_TA_89057.pep
LSSPPPLLPPQAAATAKAAWWCASAAQPPPSPSISAVPPSTSAPLRHPFNSTTIASCHXSIHTAAXSTTAXPRTSRPXGLFFF

SEQ ID NO: 194640 - protein, 138 aa, Triticum aestivum
  unsure (1)..(138): unsure at all Xaa locations
  Clone ID: PAT_TA_89058.pep
MARLNSKAVAAAVVLAAVVLMMAGREASAALSCGQVDSKLAPCVAYVTGKASSXSKECCSGXQGLNGLARNXPXDRKIPCKCLKXSLATSIKFXQXGXRXXXFPXKFGXXXPFPKRIXXNKMHIQLSECMDLRGAFNV

SEQ ID NO: 194641 - protein, 162 aa, Triticum aestivum
  unsure (1)..(162): unsure at all Xaa locations
  Clone ID: PAT_TA_89059.pep
MAPTVMASSATSVAPFQGLKSTAGLPVSRRSNGASLGSVSNGGRIRCMQVWPIXGIKKFETLSYLPPLXTEALLKQVDYLIRSKWVPCLELTXLGYLXXEXNASPGXTKGRXGTMWKLPMFGCTDATXVXXEVEEVKKXYXPYVRIXXFXICXKVXCVSSSL

SEQ ID NO: 194642 - protein, 114 aa, Triticum aestivum
  unsure (1)..(114): unsure at all Xaa locations
  Clone ID: PAT_TA_89060.pep
FIASEQKFITLFSAKQHLPWLLVVGNYYSSSRLPSKIVSSLSHLTSKPSFFIPLENILQLEHLSSPLLCFLXPEIQCILVYVPMGDNYLHAIPCRHALTXGVLTPCLDVSILTG

SEQ ID NO: 194643 - protein, 125 aa, Triticum aestivum
  unsure (1)..(125): unsure at all Xaa locations
  Clone ID: PAT_TA_89061.pep
MDQLPKLAANYAPLSPVGFLPRANAVYGDRASLVYGRVRFTWSQTHERCRRLASSLLLXSGPQERLVSVLAPNVPAXQMHFAVPWRRLSTRQHRSSRRASGRGNSLRCSMVKYLGYEAGPWPHGF

SEQ ID NO: 194644 - protein, 71 aa, Triticum aestivum
  unsure (1)..(71): unsure at all Xaa locations
  Clone ID: PAT_TA_89062.pep
LPMHVCVIQITHDMWHACTMRTYLEKVLAPCTRACMRMXVVVQYVXVGAIDRWGXLXGTGXRXDXLPXGLR

SEQ ID NO: 194645 - protein, 95 aa, Triticum aestivum
  Clone ID: PAT_TA_89063.pep
CSVRWCCRAVFSLTAVAHKKCAHKNSSKFYQTNTRSVMHPRQTSTRHSMMLETPSSLPSGMGSPLLVSGPPSISMRQPSLLALSTNFVCPPRTSI

SEQ ID NO: 194646 - protein, 98 aa, Triticum aestivum
  Clone ID: PAT_TA_89064.pep
PPCIVHKKSKQKIPSTTTRQGLPMISYLQLAKATDGFSSTNLIGSGSFGSVYKGVIDDQAEESTNLVAVKVLKVHTPGALKSFIAECEALRNVRHRNL

SEQ ID NO: 194647 - protein, 112 aa, Triticum aestivum
  unsure (1)..(112): unsure at all Xaa locations
  Clone ID: PAT_TA_89065.pep
ACGYQILVGPRPRPEPSCGHPXFELWCIGGNTTASMSGSPIHVHSIDYGTQSFVVYHTRVAAGTDGVCLADFNVSTSLALSPFRISPSNRALGFLFDCNGTEPRGSGYVPLQ

SEQ ID NO: 194648 - protein, 138 aa, Triticum aestivum
  unsure (1)..(138): unsure at all Xaa locations
  Clone ID: PAT_TA_89066.pep
MWQTWASILAVVRRSYIGVLTRARRRGRRRSGSVERQLLGAEIRNXAVGGPKRTGEVRVERWGDELRRAGFRPVSLAGSPAAQARLLIGMYPWKGYTLVEEDGCLKLGWKDLSLLTASSWEPTEDDHAAVAEQKRHDS

SEQ ID NO: 194649 - protein, 137 aa, Triticum aestivum
  unsure (1)..(137): unsure at all Xaa locations
  Clone ID: PAT_TA_89067.pep
LPSRRQRPDPTPHLPRSPARSPPASPRSTPTPAPPPLVLPXSTRPTPNASSLLPRMSRAATPPAAPSRPRPRPRLPRPEFPPLHLGQEVPHGRPPPSLYAPRGACPPSSSRPSSASSCRRLARTCDSRARKPGPNIS

SEQ ID NO: 194650 - protein, 157 aa, Triticum aestivum
  unsure (1)..(157): unsure at all Xaa locations
  Clone ID: PAT_TA_89068.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGXFRLHSVRDMLIKLSSQSSVRQKGSLLNTICAHPLPDHHKQYTQLTETQM

SEQ ID NO: 194651 - protein, 105 aa, Triticum aestivum
  unsure (1)..(105): unsure at all Xaa locations
  Clone ID: PAT_TA_89069.pep
XIHHSXDGFLFXTTVSXFLLLQRVAILLLPXPCSKHXEFLXRPRRLRCEHRLXSXXIKGPXDGNXGYCXGSRXRPXALASPPFFPVXKIIXLGCXXXLTVPRVQI

SEQ ID NO: 194652 - protein, 112 aa, Triticum aestivum
  unsure (1)..(112): unsure at all Xaa locations
  Clone ID: PAT_TA_89070.pep
SDERRSGEPFYSSGSSLRLLLFSLSFLAFLASRRRGCFYRAPSGCSRQQLVSLPCSXSLLLKKTGLFFISLILVRFLHKKFRFFILFWLEWRHNLYGAANXNSXVVSLXXDS

SEQ ID NO: 194653 - protein, 176 aa, Triticum aestivum
  unsure (1)..(176): unsure at all Xaa locations
  Clone ID: PAT_TA_89071.pep
PVDTTRMGNRVHIYKFHRIFISSHLNPYVNNVAYTQYSYRMRAIYITVPYTYVFLQTTGSRVPGLQPSSGKSSNLCPMTTRSSLTESWSSSKQKIQNSLAREQSALKNRTLGATSSGSRPEQLARWRHQRRCSQHRAGTRSRGDNEXEAXGTIGHXTXHSXTDKFRRXEGHASASX

SEQ ID NO: 194654 - protein, 128 aa, Triticum aestivum
  unsure (1)..(128): unsure at all Xaa locations
  Clone ID: PAT_TA_89072.pep
MAALSSAAVSVPSLAAKVAATPMRSSSSRMVVRASLGKKAASAAVAVAASXMLLGGSXMXXDVLXGANGGXLVFEPNDFSVKXXXXITFKNNAGFPHNVVFDKDAVPXGVDXXXSXXGXKPXXYFXXT

SEQ ID NO: 194655 - protein, 118 aa, Triticum aestivum
  unsure (1)..(118): unsure at all Xaa locations
  Clone ID: PAT_TA_89073.pep
PLCPGXSKQRNDSCFFSSASIXFFIDLMRRVPRAEETSAGEGGMHQDEREESSRGCKHLEEHVYSDSLWKKMYSVVGVYVLFVIIINEVHSGAMVVTEDASGKSNCDVSVNSLVWCLF

SEQ ID NO: 194656 - protein, 125 aa, Triticum aestivum
  unsure (1)..(125): unsure at all Xaa locations
  Clone ID: PAT_TA_89074.pep
HGRSQNQYVSNRLEVLDLSSXHLTGAIPAALNGLHSLSAFNVSNNDLEGPIPSGGQFNTFQNSSFDGNTKLCGIILDRNCSSAKVPQATILTKEEVFVIAFGAFFGVGVLYDQIFLSRFFLRTRR

SEQ ID NO: 194657 - protein, 168 aa, Triticum aestivum
  unsure (1)..(168): unsure at all Xaa locations
  Clone ID: PAT_TA_89075.pep
MLVYQDKLSGDELLSDSFPYRELENGVLWEVDGHWVVQGAVDVDIGANPSAEGGGDDEGVDDQAVKVVDIVDTFRLQEQPAFDKKXFISHMKRYIKNXTAKLEGDDLDXFKKNVSLPRIPLTQDFSLVGRHHMMAAGVTQEDSDHFCLDWLKSSQWNMLNLGADFPPA

SEQ ID NO: 194658 - protein, 133 aa, Triticum aestivum
  Clone ID: PAT_TA_89076.pep
RPPAALPPLLHAARLPRRSSRSLAPPLATGSALRRAEPPPAAAAVADVVTSPCLFSASPMCLPTTKPPPPHLLAARPGDAARRAPTPPPVGHRKTAVGRVHTLIHLHSPSFVSSAPRRTRPDALDLDGIHRGA

SEQ ID NO: 194659 - protein, 66 aa, Triticum aestivum
  unsure (1)..(66): unsure at all Xaa locations
  Clone ID: PAT_TA_89077.pep
RRXXRVRHRXGGRGARRSGGGVXPRRRGEEGQPXRXREQRHGRCLGFPXLXRGGGGGSVGDWALPS

SEQ ID NO: 194660 - protein, 124 aa, Triticum aestivum
  unsure (1)..(124): unsure at all Xaa locations
  Clone ID: PAT_TA_89078.pep
SQDARLDQRFSEAESGSCTEGTNATPCTKSYLSTLHLFVPGGSPRLQXTSPVPAFAPTKEFHMVVLFFSDESDVLTMPAAAAKFMWYYTSIFGRTMFVFILRYLLLLLLFCVSCMTTISHANEF

SEQ ID NO: 194661 - protein, 136 aa, Triticum aestivum
  unsure (1)..(136): unsure at all Xaa locations
  Clone ID: PAT_TA_89079.pep
EEGEYAQYSXXXQNXIXCLVXFNPLLRVPQGLYHIWICCLNRFSEKLGRDVVAEEAVGVGGVGPEEHQVGNHHCPEVSGGEVGGGLATGAGGRGEPVLEGEQGGDEEERQPRIGPRRHRRRGRDNARKASEGEVSS

SEQ ID NO: 194662 - protein, 68 aa, Triticum aestivum
  unsure (1)..(68): unsure at all Xaa locations
  Clone ID: PAT_TA_89080.pep
VTECXGPVSXXVHLGFPNISXKGFPRXLYRVLVDLRPKMQATVVRFESRIPPYTTFDHILSSYAQDTP

SEQ ID NO: 194663 - protein, 86 aa, Triticum aestivum
  unsure (1)..(86): unsure at all Xaa locations
  Clone ID: PAT_TA_89081.pep
ALHQFTRTLDKNLATNLFKMLLKYRPEDKVAKKERLLKRAQAEAEGKTVEAKXPIVVKYGLNHVTYLIEQXKAXLVXIAHDVDQVG

SEQ ID NO: 194664 - protein, 89 aa, Triticum aestivum
  Clone ID: PAT_TA_89082.pep
GEDEAPRRGASGCDPGGGGRGRRGRRGGGGGRRGRGAGSPQGLHVRPSVRRSLSPTYYPPLPAPARPPPPPRRRHPHRPRISSPAPTTG

SEQ ID NO: 194665 - protein, 84 aa, Triticum aestivum
  unsure (1)..(84): unsure at all Xaa locations
  Clone ID: PAT_TA_89083.pep
AGXXPXSAEPPDEMLEMPRFAASGSVDTGAALAGAGEERTWSSPGKFLGSRTGEAQEREQCRTKDASCRLIVQREVLGDDLLDG

SEQ ID NO: 194666 - protein, 127 aa, Triticum aestivum
  unsure (1)..(127): unsure at all Xaa locations
  Clone ID: PAT_TA_89084.pep
SQNARHNLLTQSFLFSRTPRSSSSPLIARDPLTARNADRQRVVVLQELRSSTHGTVPGSSYPNGLDRVPAIKKSFERCIPSLYPIFFKQPTLVPRSRSSSNRTGKWNYGKLSXKIRGQXQXXXNXXX

SEQ ID NO: 194667 - protein, 129 aa, Triticum aestivum
  Clone ID: PAT_TA_89085.pep
EFRQGFLHPSDRVPAERFSIPSRYDIRGCRHGRVLAVHREYAKLLVFAPLSGEVCTLSVPDEFRPPSCFRLNGAVLCDANDHGHVHGMCHLSPFKVVLLSKFSMEDRFITSVYSSSPKNGVSRSKEMLR

SEQ ID NO: 194668 - protein, 162 aa, Triticum aestivum
  unsure (1)..(162): unsure at all Xaa locations
  Clone ID: PAT_TA_89086.pep
MQIFVKTLTGKTITLEVESSDTIDNVKAKIQDKEGIPPDQQRLIFAGKQLEDGRTLADYNIQKESTLHLVLRLRGGMQIFVKTXTGKTITLEVESSDTIDNVKAXQDKEGIPGQQRLILLATLEDXAPRRLQHQKDHLTGAARGVCLYLRRTVLRGLVNASL

SEQ ID NO: 194669 - protein, 151 aa, Triticum aestivum
  unsure (1)..(151): unsure at all Xaa locations
  Clone ID: PAT_TA_89087.pep
SRLVSSLVPIPSPGTLPRSSPPRTHHPLSPRPVEGIPAPEDGCAVADGAGSAAVDGPTDVIIVGAGVAGSALAYTLGKDGRRVHVIERDLTEPDRIVGELLQPGGYLKLMELGLXDCVDEIDAHVPWYALSKMEEHKLLPLESSNWWQLGR

SEQ ID NO: 194670 - protein, 179 aa, Triticum aestivum
  unsure (1)..(179): unsure at all Xaa locations
  Clone ID: PAT_TA_89088.pep
GVNADLYTHADTIISNASCTTNCLAPFVKVLDQKFGIIKGTMTTTHSYTGDQRLLDASHRDLRRARAAALNIVPTSTGAAKAVALVLPNLKGKLNGXALRVPTPNVSVVDLVVQVSKKTLXEEVNQAFXXPXPTTQGHLDLXXPLVSSIQVLCLHIDAPNMVWEMVIRVHNGYPKGRIR

SEQ ID NO: 194671 - protein, 95 aa, Triticum aestivum
  unsure (1)..(95): unsure at all Xaa locations
  Clone ID: PAT_TA_89089.pep
RAESAKLAAERQLQAELRRRAGGEXASPPRTGLAEISTLXGGXXRGGNPHILSXPRAGYMPRADMAXMXXXXXAGQKXPFFPRMGIVLGQXXICL

SEQ ID NO: 194672 - protein, 126 aa, Triticum aestivum
  Clone ID: PAT_TA_89090.pep
ASVAAKVAIYTTLVNPLAKYALVVAPVAEAAEGALGVGKSAPLRALVRTVLVVGTAVVALAVPFFADVVGLTGALLSCTATMLLPCLCYLNVRSKIGGDKGMGLETAACLALSRLDRDCWAGNYIP

SEQ ID NO: 194673 - protein, 177 aa, Triticum aestivum
  unsure (1)..(177): unsure at all Xaa locations
  Clone ID: PAT_TA_89091.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNCXYFGCTDATQXDQRVEEVKKEYPDAYXRIIGFXTCAXXCVSSCLQHGLKIGRLTVTTAI

SEQ ID NO: 194674 - protein, 160 aa, Triticum aestivum
  unsure (1)..(160): unsure at all Xaa locations
  Clone ID: PAT_TA_89092.pep
MAAPTFLHCLLAIWLLSCAAHAQLSTTFYSASCPSLEAIVRTGMNKAVRNERRIGASLLRLFFHDCFVQGCDGSVLLDAGGEKQAAPNNGSIRGFGVVDAIKXRRGGACPGVVSCADILALTRAXGXFLLGGRLEMPLGRRTRHANRVWQANSAPTRLSR

SEQ ID NO: 194675 - protein, 92 aa, Triticum aestivum
  unsure (1)..(92): unsure at all Xaa locations
  Clone ID: PAT_TA_89093.pep
MAASLFRLSRPRRVLLPLSALRLPFSTQPLPQPRDPSSPNSNRGLPXFLSFLAAAAAXGITGSVALCDAXXXNGSXGXDITXLLVXGEXXCH

SEQ ID NO: 194676 - protein, 139 aa, Triticum aestivum
  unsure (1)..(139): unsure at all Xaa locations
  Clone ID: PAT_TA_89094.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNCXYFGCTDPPVINEXEXVKKDT

SEQ ID NO: 194677 - protein, 121 aa, Triticum aestivum
  unsure (1)..(121): unsure at all Xaa locations
  Clone ID: PAT_TA_89095.pep
THCLIQSNSGQHRYTFHVSQLXFHXGYSPVFSEXSSRARLHRGSPPTRAILNRRMVKKGNNSVVQVRVQWSSLSPASATWEDYNVLRLRYPTAPCWKNDAAAQGGATVTPDTSDTSVAVDM

SEQ ID NO: 194678 - protein, 108 aa, Triticum aestivum
  unsure (1)..(108): unsure at all Xaa locations
  Clone ID: PAT_TA_89096.pep
DXAPWYAIXCIXQQRCRETPVSHXGXPFQXGQYXSXAGSPXGRXRSGAWGMIRXXDYRRSSSGAAGWLGHRGIXGXGXGRGEXXRQRQQQQRAEGSNQSSSVRGRDAS

SEQ ID NO: 194679 - protein, 128 aa, Triticum aestivum
  unsure (1)..(128): unsure at all Xaa locations
  Clone ID: PAT_TA_89097.pep
DVEGDVQEVVQVQLTRFACGSLAIGFTANHAVADGHATSDILIVXGRAAQGLDIYAPSAHNHXDLFRSRDPLVVEFEHRNVGHRPATSNSRWWAPRGRQCDHHKVHPGGPAEPAAEAHGADDQISYKF

SEQ ID NO: 194680 - protein, 120 aa, Triticum aestivum
  Clone ID: PAT_TA_89098.pep
AEQALVEVESHFQLVSGLPVVDSARRCVGVIVKSDRVRASHGSKTLIADVMTSPAITLSCDKTVTDAAALMLKKKIHRLPIVNQDNQVIGIVTRDDVLRALGGMLNFKRCRIHARYLWIL

SEQ ID NO: 194681 - protein, 170 aa, Triticum aestivum
  unsure (1)..(170): unsure at all Xaa locations
  Clone ID: PAT_TA_89099.pep
KTITLEVESSDTIDNVKAKIQDKEGIPPDQQRLIFAGKQLEDGRTLADYNIQKESTLHLVLRLRGGMQIFVKTLTGXKTITLEVXESSDTIDNVKAKIQXQGGIPPDQXRLIFAXKQLEDGRTLADYNIKKDQPQLVLRLRWGNNVLXFTPWPPLCLSSFEWFLVIQMLV

SEQ ID NO: 194682 - protein, 164 aa, Triticum aestivum
  unsure (1)..(164): unsure at all Xaa locations
  Clone ID: PAT_TA_89100.pep
LTGKTITLEVESSDTIDNVKAKIQDKEGIPPDQQRLIFAGKQLEDGRTLADYNIQKESTLHLVLRLRGGMQIFVKTLTGKTITLEVESSDTIDNSRQRXKDKEGFPRDQQRLIFAGXQLEDGRTFTKHPEINLNLGSPPRGSIIALVWCPASSCPIVINRMTIP

SEQ ID NO: 194683 - protein, 53 aa, Triticum aestivum
  unsure (1)..(53): unsure at all Xaa locations
  Clone ID: PAT_TA_89101.pep
TESPRGFLAGGSARXVGEKREGIQARRGNXDXRVGLRXGGDGTHQPTAATGEA

SEQ ID NO: 194684 - protein, 118 aa, Triticum aestivum
  unsure (1)..(118): unsure at all Xaa locations
  Clone ID: PAT_TA_89102.pep
MSISVNGQSVVPPGFRFHPTEEELLTYYLAKKVASXRIDLDVIPDVDLNKLEPWDIQERCRIXTGPQNDWYCSAQGQEVPTGTRTTRNAPGLEGTAGTGIRRGRRWIQDSLKGGPTQI

SEQ ID NO: 194685 - protein, 66 aa, Triticum aestivum
  unsure (1)..(66): unsure at all Xaa locations
  Clone ID: PAT_TA_89103.pep
IRPTPFPKTYXRRFPETXXPSSXVLQLNTLKXXXHYVGXKHAHYALDYMPXSPDCTXSXXGXFWSH

SEQ ID NO: 194686 - protein, 62 aa, Triticum aestivum
  Clone ID: PAT_TA_89104.pep
ESCLAFLTQLADFFLPCIGILGRPKIVQLKIQRDALHPSTKEQSLPSPLHTGNGHQSTFFPT

SEQ ID NO: 194687 - protein, 130 aa, Triticum aestivum
  unsure (1)..(130): unsure at all Xaa locations
  Clone ID: PAT_TA_89105.pep
RKPVDFVGXXGXAIQLPKAXRRPGTRRGGXGARQSLIGISQXIPAAGXGPXVNPQTAERNNGQGRQAGGRQVKSNAQCSSPNNPPEGAPXQAXSAXECRLRLNLILNPVKILITLELQLSXFXGPFLGPX

SEQ ID NO: 194688 - protein, 60 aa, Triticum aestivum
  Clone ID: PAT_TA_89106.pep
PKCSHAFHQQCIDTWLKSHSNCPLCRSNISFVAVEVAPPEPEGRAPGPGETDRSTHQVVV

SEQ ID NO: 194689 - protein, 140 aa, Triticum aestivum
  unsure (1)..(140): unsure at all Xaa locations
  Clone ID: PAT_TA_89107.pep
DVRITALKRILQLVKSIRSGDSKNILHQWARASLHSVIMERLSVEEHPKCLYYSLRIIFSWNVECQFNNGEDCNTFLSIWDRLVLLNSTVSHAKTXREIILCCMGMCMKQFAKLMRDGVLPEGLKTSELSTPLGVSTKGI

SEQ ID NO: 194690 - protein, 85 aa, Triticum aestivum
  Clone ID: PAT_TA_89108.pep
MVKAVAVLTGSEGVKGTIFFTQEGEGPTTVTGSVTGLKEGLHGFHVHALGDTTNGCMSTGPHFNPAGHVHGAPEDEIRHAGDLGN

SEQ ID NO: 194691 - protein, 146 aa, Triticum aestivum
  unsure (1)..(146): unsure at all Xaa locations
  Clone ID: PAT_TA_89109.pep
RSPPPPSSPPPPSSSDGEDRISALPDTLLRNVVSRLPVKDAARTGALSHRWRGLWRATPLALRNAHSSGXPXPAATLVSRVLASHPGPSAPSASLRFPSTSPTRRSSRSWLANSPTRAGGLTSSTPLSFDVPVCPRPLRCGARSAL

SEQ ID NO: 194692 - protein, 85 aa, Triticum aestivum
  unsure (1)..(85): unsure at all Xaa locations
  Clone ID: PAT_TA_89110.pep
PPRATSASRSPRXRLLLXRSHGRRXRXGGAGVPGAGAGCGAGHRRGGDRXGARGVPERVPAAAAGAVPPNSPPRTLRRGAPGAPP

SEQ ID NO: 194693 - protein, 134 aa, Triticum aestivum
  unsure (1)..(134): unsure at all Xaa locations
  Clone ID: PAT_TA_89111.pep
NKXGLNFFLTQIXXKKXXGGVTFWGXKKGKGVLKKSXKPLFPKWGXLKKPXXXGXRXWSWKXXGXKSIXRTXTTFLMTTXSMTTSRGLTLTRMREHRYGXVCPHRXFERLQRGRVWGRWRSDRGWETEVERGMV

SEQ ID NO: 194694 - protein, 101 aa, Triticum aestivum
  unsure (1)..(101): unsure at all Xaa locations
  Clone ID: PAT_TA_89112.pep
LCIREVWHMPAXLTGIFXDDXVLQXGGGXLGHPWGMXLXSSLXXVALEACXQAXNEGXDLAXEXNEIXRAACKWSPELAAACEVWKAIKFXEFEPVDTIAK

SEQ ID NO: 194695 - protein, 71 aa, Triticum aestivum
  unsure (1)..(71): unsure at all Xaa locations
  Clone ID: PAT_TA_89113.pep
MASPSQSPSPLHPHQLQQHASPRXXTPTRSTXAPPPSMPPPPGXPXKAMDXXVTVSRGXHLXNXNWRXXXF

SEQ ID NO: 194696 - protein, 78 aa, Triticum aestivum
  unsure (1)..(78): unsure at all Xaa locations
  Clone ID: PAT_TA_89114.pep
FNRVCRDEAGARVAPRTIFTYGILMNCCCCAHRPDLGLALFGRFLRTGMKANETLPPPXLKCLCSAKRTDEAVNLLLQ

SEQ ID NO: 194697 - protein, 149 aa, Triticum aestivum
  unsure (1)..(149): unsure at all Xaa locations
  Clone ID: PAT_TA_89115.pep
XGCNGWXPVXXWXRSSIECQXWPYRCPXLGLXPEGXLSPLALRRAQDCDRSXEXWEGGLLXNVAGAAVDDRELSVPPRRGVIGGXGFGVYKEGPAVRLGVLAMDKCAVGPQAVLNAGSIGGVLGGRHSPNLGRLLLGEAAGEPRGALET

SEQ ID NO: 194698 - protein, 138 aa, Triticum aestivum
  unsure (1)..(138): unsure at all Xaa locations
  Clone ID: PAT_TA_89116.pep
MAGDDARTGEVAPAEEEPHVERLPADILAHVLSLLPSFHDLSMAGAVSRRWRRAVXRSLGTRXRLKPRRGNAPANESTARLLRAAVQLRDLHICWGCTSTDKAAPHLLRXXHRELTPLAXGVAGITDKALSSGLPSFI

SEQ ID NO: 194699 - protein, 169 aa, Triticum aestivum
  unsure (1)..(169): unsure at all Xaa locations
  Clone ID: PAT_TA_89117.pep
AQDTKNAMSGAADTAAAAAVAAVAGSSGPAAFAAQRTRGHRDRASRGIGRXSRPLSSLXASFSLVXRQRRRSRRXPGNPQHLXFKATXXKRRVXXLLNXPIXFCFGAQYKXQTRFSGNYPLAEXXGVXGXPLKAXAFCSQGQRCPAXGDLRXLLAVNXGIPKGQGXXMG

SEQ ID NO: 194700 - protein, 153 aa, Triticum aestivum
  unsure (1)..(153): unsure at all Xaa locations
  Clone ID: PAT_TA_89118.pep
MGIDLVAGGRNKRTKRVAPXSDDVYLXSSVXSTVSWVRXRTKXXFNAVILKESSMSXTNRPRLHAPLSXXXIXXGXKEIAVVVWYITDXHAVQRVPTMKVTLLGQKNNKISMLVGMLNFDNLPAQIGKKSVRDQESLRRTSKPCVNNNLQGRI

SEQ ID NO: 194701 - protein, 139 aa, Triticum aestivum
  unsure (1)..(139): unsure at all Xaa locations
  Clone ID: PAT_TA_89119.pep
RRSTLTRMSASSDSTTCARCSASASSPSSHRAARSPARPKQLTHDRPYIKCHCSFVNSDIALGFSFLHLSFLICSLKNMCMSMFMFQHGSXESMLRMRMLSVGMLYGTDAIILIQYVRLYTFKWXPMGNTPTTVLILLX

SEQ ID NO: 194702 - protein, 70 aa, Triticum aestivum
  unsure (1)..(70): unsure at all Xaa locations
  Clone ID: PAT_TA_89120.pep
KPXLLXPFPFPGNXFSFAXLNIPYQXXXFVXHIPXSEILXPKIITMVFXXLKIXGTFISITSNFGTEGXK

SEQ ID NO: 194703 - protein, 128 aa, Triticum aestivum
  unsure (1)..(128): unsure at all Xaa locations
  Clone ID: PAT_TA_89121.pep
LVVVKIHIQFHQHFEIQFILQYKRTFPCIVYCRKQCSQRLQDSSHHNTPYPTWESTVSCQCGDSSPSTLWNSTASKIAGMSLLTTGSTXPRHDGXQHLLHSLTXGFVNRASVPHPTLGRAXSGKHTCX

SEQ ID NO: 194704 - protein, 116 aa, Triticum aestivum
  unsure (1)..(116): unsure at all Xaa locations
  Clone ID: PAT_TA_89122.pep
MSPQTXTKAGVGFKAGVKDYKLTYYTPEYETKDTDILAAFRVSPQPGVPPXEAWAXXAAESSTGXTWTTVWXTDXLTSLDXYKGRCYHIRXLLGXTPNGXRYVPYPLDLXXVRQTY

SEQ ID NO: 194705 - protein, 168 aa, Triticum aestivum
  unsure (1)..(168): unsure at all Xaa locations
  Clone ID: PAT_TA_89123.pep
VERLKTGFEKFKTEVYDKKPDFFEPLKAGKAPKYMXVFACADSRVCPSVTLGLXEPGXAFNHPQTSANMGPSXTAKNNYAGXGIXASEYAVLCSQGLSHXWVIGHSASVDQVCXSKDGQTSFNXXKTVRXXSPAKKKCNDALHPFDTMNVSKKNELSSTLTTVKRFQR

SEQ ID NO: 194706 - protein, 167 aa, Triticum aestivum
  unsure (1)..(167): unsure at all Xaa locations
  Clone ID: PAT_TA_89124.pep
MVVPVIDFSKLDGAERAETMAQDXRRLRRTGGFFQLVNHGIPLGVPLPRQKGVLPKXTASREAASRSSRPVANLESCXGXPRREAVXPXDELMGRIFYSKDXQLPSDPPALKEQCGLRHSLPDHGAWSAGPLRLKAQTQFRTKGTIPAPGNGGKQPGVSFKSPSRGL

SEQ ID NO: 194707 - protein, 165 aa, Triticum aestivum
  unsure (1)..(165): unsure at all Xaa locations
  Clone ID: PAT_TA_89125.pep
MLDKLWDDVVAGPRPETGLDKAPPGRRHPTPPPSTQLXGKRLSIAVRCRTTPXTTPVTPXSSTPARAGGSVWRSXFQPGXNLGTKNLXANSXTARTQSPTVYDWFSTRRGQPPLNKTVGKQVLNNTRILRPLVNLRTYFCRAHWFLTSTRHAVLISRPNRSFPLP

SEQ ID NO: 194708 - protein, 109 aa, Triticum aestivum
  unsure (1)..(109): unsure at all Xaa locations
  Clone ID: PAT_TA_89126.pep
ISPGNLRSERSEGSLVLLLKMQIFVKTLTGKTITLEVESSDTIDNVKAKIQXDKEGIPPDQQRLIFAGQALEDGRTLXADYNIQKXPLSIXVKSXGGMXXFVKQRQTSP

SEQ ID NO: 194709 - protein, 99 aa, Triticum aestivum
  unsure (1)..(99): unsure at all Xaa locations
  Clone ID: PAT_TA_89127.pep
RKRGPXLFAXDGFXIXARSEXGNLRLRWGECVVPPEKSLTPRWREEEGRGPKRIPAISXATLELLPACDDDANACSTGRPQEARACFSRTKSYCVYGNE

SEQ ID NO: 194710 - protein, 113 aa, Triticum aestivum
  unsure (1)..(113): unsure at all Xaa locations
  Clone ID: PAT_TA_89128.pep
YCNARAKSSSISSVGNYGLRXPXLDESLPRTSASTGSCIVSXGICPMGQDVTGYNNWQERRDYXSXLCIEHCTSSTRTXVPSKTKQVAPSQIYWHYSEIXIGHXKQSQXPDIQ

SEQ ID NO: 194711 - protein, 69 aa, Triticum aestivum
  unsure (1)..(69): unsure at all Xaa locations
  Clone ID: PAT_TA_89129.pep
SILTAXYDIVVRLEFLLIIXTHSEHLXFXNLSLEVXNLRNASPGXHNLNCXLAVKNCTCESGYPYPRDV

SEQ ID NO: 194712 - protein, 121 aa, Triticum aestivum
  Clone ID: PAT_TA_89130.pep
ASPPPSGSPNFPAPPSLQSLARPPPPRYRPPPPPRPEIHRPRPPRRKRKAAPVRLLISSSRPLRTYSGVTTDSLRWSTYGRFKRWCQSSAGRHDLQACRRFTNRMNIFDNGKSPRRYTGKD

SEQ ID NO: 194713 - protein, 118 aa, Triticum aestivum
  unsure (1)..(118): unsure at all Xaa locations
  Clone ID: PAT_TA_89131.pep
MANPRVFFDMTVGGAPAGRIVMELYKDAVPRTVENXRALCTGEKGVGKSGKPLHYKGXSAFHRVXIPDFMFQGRRFTRGNGPAAIHLRREFPDEXFVHKHTKPGLSMGNAGPTQRPIL

SEQ ID NO: 194714 - protein, 164 aa, Triticum aestivum
  unsure (1)..(164): unsure at all Xaa locations
  Clone ID: PAT_TA_89132.pep
MAPTVMASSATSVAPFQGLKSTAGLPVSRRSNGASLGSVSNGGRIRCMQVWPIEGIKKFETLSYLPPLSTEALLKQVXDYLIRSKWVPCLRXNKLGHLXVEHNASPGXYYDGRYWXMWKLPISGCTDXQVINXVEEXKKXTLYFSRQMLQVGSHFNNRVQDPEG

SEQ ID NO: 194715 - protein, 163 aa, Triticum aestivum
  unsure (1)..(163): unsure at all Xaa locations
  Clone ID: PAT_TA_89133.pep
CVFXQYLFDGQFLFXVQGNHHXRSIRNVWSRYGXSGNATWDILYLVTRCSXTALLESYNSXNTWRAXTRPRXRQSPVTPNTANCSDAGTARDVMPPVALGEICRPGRASAACFRAAPAPSMLLVEPLLACRRARAPKALQLREGTPVVQVAEEGGEEDCTSTY

SEQ ID NO: 194716 - protein, 124 aa, Triticum aestivum
  unsure (1)..(124): unsure at all Xaa locations
  Clone ID: PAT_TA_89134.pep
TSKQGINNPQGTLSTGNITTHFLPTGHGVKLHQRHHRSASPRXNSTDLXFNKAKSTPLPWELXFPWERLTFLXILPXGPYCPLASPTIQXFLWNNTFGKRFXEYXXSXNTXKGXPYSNKQILAI

SEQ ID NO: 194717 - protein, 132 aa, Triticum aestivum
  unsure (1)..(132): unsure at all Xaa locations
  Clone ID: PAT_TA_89135.pep
ETFNVPAMYVAIQAVLSLYASGRTTGIVLDSGDGVSHTVPIYEGYALPHAILRLDLAGRDLTDSLMKILTERGTLHNLNPSGKLXGTSKEKLAYVALDYEQXWETAKNNPQFKKNYXLPDGXVITIGAKXSA

SEQ ID NO: 194718 - protein, 97 aa, Triticum aestivum
  unsure (1)..(97): unsure at all Xaa locations
  Clone ID: PAT_TA_89136.pep
GLTXSSGTAASPSLTKPASPLLGLDQTLPVRVINLHCYKASLXMKPHHCSKNAILTDHFVDFELSTKNXKVASKWIAHGSGCTSGHIXKWPLQTXXR

SEQ ID NO: 194719 - protein, 116 aa, Triticum aestivum
  unsure (1)..(116): unsure at all Xaa locations
  Clone ID: PAT_TA_89137.pep
FFSPXKXFXKXKXNXGGLKVXXKKLFXGPPNXVXPGDXKXNFXXXFFYPXXFXSPPLXKFPKFWPXRFXPFXXLQIWGLIANTLXEXYLFGIXPFGIXPQKAXXQXLXXXLXXVXV

SEQ ID NO: 194720 - protein, 148 aa, Triticum aestivum
  unsure (1)..(148): unsure at all Xaa locations
  Clone ID: PAT_TA_89138.pep
MQIFVKTLTGKTITLEVESSDTIDNVKAKIQDKEGIPPDQQRLIFAGKQLEDGRTLXADYNIQKDXTFNLXAKXXWWMQNXCEXITXKTXTLEVDSSGXIEXXKVQGQGGLASSNLAGTQGWPLAGKQGSPPGQWGKIWKPGKKTWRL

SEQ ID NO: 194721 - protein, 109 aa, Triticum aestivum
  unsure (1)..(109): unsure at all Xaa locations
  Clone ID: PAT_TA_89139.pep
GILKRLNGVPQVNPDVLFXEKIFIXKTFXPESXSKVCTFSNXXKXPKXXQIXIXXGGPVPIRXKGXYNPXXASVXTXDRENRGTNLXPGETPSQXGNTKSXPXPPKXXT

SEQ ID NO: 194722 - protein, 61 aa, Triticum aestivum
  unsure (1)..(61): unsure at all Xaa locations
  Clone ID: PAT_TA_89140.pep
VSXXFFFFFFFFFFLNNCXYLLTAXTGXYIQLHRXLRXXPXXYTXLVHILXCRKGFKKPRX

SEQ ID NO: 194723 - protein, 134 aa, Triticum aestivum
  unsure (1)..(134): unsure at all Xaa locations
  Clone ID: PAT_TA_89141.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGXTSQADCAVLIIDSTTGWFEAGISKDGKP

SEQ ID NO: 194724 - protein, 79 aa, Triticum aestivum
  unsure (1)..(79): unsure at all Xaa locations
  Clone ID: PAT_TA_89142.pep
FFFFFFFXSYHLHFLHQFXLTSNIXFXHXIPXHXRXDCCITXEXXRLKDNTCXFFLAXPXSNSPRTERYSNXDQKQXXT

SEQ ID NO: 194725 - protein, 143 aa, Triticum aestivum
  unsure (1)..(143): unsure at all Xaa locations
  Clone ID: PAT_TA_89143.pep
TGIAGTMGYIDPESVLAGRASVESDVYSFGVVLLEVASGKRPAQVQEGGDVIHLVQWVWDLYGTGSILDAADERLRGEFTGGEMERVMVVGLWCGXPDRGMRPSIXQAMNVLRFEAPLPSLPARMPVATYGPPTNTLNSGTWS

SEQ ID NO: 194726 - protein, 167 aa, Triticum aestivum
  unsure (1)..(167): unsure at all Xaa locations
  Clone ID: PAT_TA_89144.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATXXDXXVEXVKKEYLTLFAYRIDTCSSCVTHRKHGLQDPQG

SEQ ID NO: 194727 - protein, 104 aa, Triticum aestivum
  Clone ID: PAT_TA_89145.pep
MDPNMFTYKTNEALNVAHEVASEAGHEELTPLHLAAVLAKDRSGILRQAIAHASRWQRRRGQIRSERVRGQPRSRGFLPPLSQAGAGTTPSKLNSLFKSAAGIP

SEQ ID NO: 194728 - protein, 160 aa, Triticum aestivum
  unsure (1)..(160): unsure at all Xaa locations
  Clone ID: PAT_TA_89146.pep
MSPQTETKAGVGFKAGVKDYKLTYYTPEYETKDTDILAAFRVSPQPGVPPEEAGAAVAAESSTGTWTTVWXLDGLTSPDRYKGRCYHIEPVAGEDSQWICXSSLSLDLFERXSLTNMFTSXIXGNYLVQSLSALRLEDLRXPPTYQKFQSPXXGSNXXRN

SEQ ID NO: 194729 - protein, 90 aa, Triticum aestivum
  unsure (1)..(90): unsure at all Xaa locations
  Clone ID: PAT_TA_89147.pep
MADVEYRCFVGGLAWATDDQSLQNAFSKYGDVIDSKIITDRXETGRSRGFGFVTFASDEAMRQAIEAMNGQDLDXRNITVNEAXSRRSGG

SEQ ID NO: 194730 - protein, 142 aa, Triticum aestivum
  unsure (1)..(142): unsure at all Xaa locations
  Clone ID: PAT_TA_89148.pep
VATTDVVEACTGVNVAVMVGGFPRKEGMERKDVMTKNVSIYKAQASALEAHAAPNCKVLGCCQPXANTNALILKXLLHLSLEKNISCLTRLRPQQXLGQISEEIGGQXSDVEDAIIRGXNXSIXYLIXNNXTVKXPIGXKPF

SEQ ID NO: 194731 - protein, 93 aa, Triticum aestivum
  unsure (1)..(93): unsure at all Xaa locations
  Clone ID: PAT_TA_89149.pep
XRFVAEVPTRTQVFRRXSXXXKQGYGHWNXVFFSNSXEVTEARXXAIVGTXXHATWPAQFTGAWAXVTEASVETRSSXCLPLVSALERRCLEK

SEQ ID NO: 194732 - protein, 87 aa, Triticum aestivum
  unsure (1)..(87): unsure at all Xaa locations
  Clone ID: PAT_TA_89150.pep
GDGAADGLRLPPGPWQLPVIGSLHHLLLAGQLPHRAMRDLARRHGPAMLLRLGEVPTLVVSSXEGAPQVIXTQXXGFXKXALTATNG

SEQ ID NO: 194733 - protein, 156 aa, Triticum aestivum
  unsure (1)..(156): unsure at all Xaa locations
  Clone ID: PAT_TA_89151.pep
MQIFVKTPTGKTITLEVESSDTIDNVKAKIQDKEGIPPDQQRLIFAGKQLEDGRTLADYNIQKESTLHLVLRLRGGAKKRKKKTYSTPKKVKHEREKTRSPCWATTRWTTRXARWRSSQGVPKPDCGPGPHGGARRHPAMRLTTLPEAKAKMIIRG

SEQ ID NO: 194734 - protein, 167 aa, Triticum aestivum
  unsure (1)..(167): unsure at all Xaa locations
  Clone ID: PAT_TA_89152.pep
ISAVAGELVSQFISFLMNKYNSFSHARSEEEKAVERLQHLLMRAGTIVEEADARYITNSGMMMQLKTLSEAMYRGYRVLDNSRYHALQDSAGFDEVSINDSSRNSLYLAKRSRTTNVKATCLESHGALESLETAVVNMAEXVALLGGFDRSLIGIHVILHRQLMLGH

SEQ ID NO: 194735 - protein, 135 aa, Triticum aestivum
  unsure (1)..(135): unsure at all Xaa locations
  Clone ID: PAT_TA_89153.pep
NXXGRXSVAXXXEWRASXTACSTAGXVPTTSLASTSTIAGVGDXXAADSSSSXXIMTEPSSRLVLNSRXXGRWRPWRGRKALXEPDHXAFXVXCLQXPRAXKPGGPXXHVXXPXWXXXXAXXRVXGXXXGGASIX

SEQ ID NO: 194736 - protein, 191 aa, Triticum aestivum
  unsure (1)..(191): unsure at all Xaa locations
  Clone ID: PAT_TA_89154.pep
NIVAGSNEFKISLVITKVEDGITTSISSEVAALNYWEQEGEIMNFDIIVEPKDXMLQRISELHPSYMSMQYPLLFPYAEDGFRPEIEYEXKRGSKGKRKYVTMLEFYAYRIQQRLNQASTLQMSGRLFLQFLVDAAMCIEQWRLNWYRTNQGKLRTELYRGLHDAIENGDTRTEQVGQRIILPSSYNGSPR

SEQ ID NO: 194737 - protein, 57 aa, Triticum aestivum
  Clone ID: PAT_TA_89155.pep
PPFFSVKVYGVTKMCLKSELKLRMFLLIEIMHRLAKRERSTKRSKKQRHVDDFVVVA

SEQ ID NO: 194738 - protein, 138 aa, Triticum aestivum
  unsure (1)..(138): unsure at all Xaa locations
  Clone ID: PAT_TA_89156.pep
MARRSGGGRSSRPAPRAAPVRNPPAPARQAPPPATTXSSGGWVSXAGIGSTXAQGMAFGXLGSAMAHKAVDAVMGPRNSTIKCFGAADLMIQWALLMIVETFKGFKIDQQLKKCSTKGQFPLEKGFNNNLDWGNWPFN

SEQ ID NO: 194739 - protein, 52 aa, Triticum aestivum
  Clone ID: PAT_TA_89157.pep
QSSRKTKKYDYTRLPSSPQSFHGHLPSTTGRSLIGQRWPVARWSRRPLIGPS

SEQ ID NO: 194740 - protein, 142 aa, Triticum aestivum
  unsure (1)..(142): unsure at all Xaa locations
  Clone ID: PAT_TA_89158.pep
MLGVFSGEVVEVPAELVAAGSRTPSXKXTRASELVKRFLAGAEPAVSLELXXLXNSLXPXQTIPPPPKAFXSXDKSLLFQGILDNXGRLXQEIRLSKGRNKCPPDXGXKTLGGPNRNSNRNNWLKSNLPNNKAPGRQGVPSK

SEQ ID NO: 194741 - protein, 124 aa, Triticum aestivum
  unsure (1)..(124): unsure at all Xaa locations
  Clone ID: PAT_TA_89159.pep
MANPRVFFDMTVGGAPAGRIVMELYKDAVPRTVENFRALCNGEKGVXXSXKPLHYKXXXFNRVIPRLHVPXGGDFTRGNGTGXESIYGEKFPDEKFXXKHTKPGIXSMGKAGANTXGPSHLNVP

SEQ ID NO: 194742 - protein, 129 aa, Triticum aestivum
  unsure (1)..(129): unsure at all Xaa locations
  Clone ID: PAT_TA_89160.pep
MANPRVFFDMTVGGAPAGRIVMELXKXDXVPXXVEKFRALCNGXXGVXKXGKPLHYKGXSFQRVXPDFMFQXXEXNKGNGNGXESIYREEFXHQKXLXKXNKARILSMAXXGPQRSLDPIGPRPEGSKG

SEQ ID NO: 194743 - protein, 183 aa, Triticum aestivum
  unsure (1)..(183): unsure at all Xaa locations
  Clone ID: PAT_TA_89161.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGYYDGRYWXTMWKLPMFGCTDATQVINEVEXVKEGVPDAYXRIIGFDNMRXVQCVXXSPXTTGCKDPXKAKSSRQAY

SEQ ID NO: 194744 - protein, 75 aa, Triticum aestivum
  unsure (1)..(75): unsure at all Xaa locations
  Clone ID: PAT_TA_89162.pep
MMLVAKEFGALSPPGAVAAQRRWAPPSTARVSPRGGSPVGDLWLRTRXSXDGPGGKPAXSHXSDMDLACSSSNFR

SEQ ID NO: 194745 - protein, 117 aa, Triticum aestivum
  unsure (1)..(117): unsure at all Xaa locations
  Clone ID: PAT_TA_89163.pep
GVSLXFXRRIXGFPXVXFXXGQGPYIXFLGGPSLXLXXLFFXYTKXXVVNQXSLXFPHWLEGXXLLIAIXLLKSXAVRPXFLLLLLLVVQWILPMLCRXLSDVECLENFLIIVGFAL

SEQ ID NO: 194746 - protein, 106 aa, Triticum aestivum
  unsure (1)..(106): unsure at all Xaa locations
  Clone ID: PAT_TA_89164.pep
VRRKGALLGLTLRRRHVPAAEPSRRAPGPGGYRSGRAGAGAGGCCSGCGGASARTGGSRSGSGGASARTRASGXCRRLKRKDKARXRERPRGRKGRTRTGTAAARV

SEQ ID NO: 194747 - protein, 81 aa, Triticum aestivum
  unsure (1)..(81): unsure at all Xaa locations
  Clone ID: PAT_TA_89165.pep
MSCCGGNCGCGTACKCGNGCGGCNMYPEVEAAGATLLVSATATNKASSGGMEMAAENGGCGCTNXNCGTXCGGSCXXCINN

SEQ ID NO: 194748 - protein, 62 aa, Triticum aestivum
  Clone ID: PAT_TA_89166.pep
HMSTSCNLNSKKLLLDSNTIQEPNHRTFGMRSNTGLRYKNELSCHIFANATECAILPHFLPL

SEQ ID NO: 194749 - protein, 80 aa, Triticum aestivum
  unsure (1)..(80): unsure at all Xaa locations
  Clone ID: PAT_TA_89167.pep
LEFFFFFFFFFFFFFFFFFFFFKSPXSLXFHFIVAFILPXQLQCKPCSVAEILNGSASLLPFHLRPHTMFPIEIPITWGR

SEQ ID NO: 194750 - protein, 144 aa, Triticum aestivum
  unsure (1)..(144): unsure at all Xaa locations
  Clone ID: PAT_TA_89168.pep
LWGYPPVGNLRLGRNRXRTGTHRRXAGPRTPITPXPXPGPVPPPPSPXCSSRRAVARAPPGRSRRGTAWRRRCCSWPPLPLPSGIGRARGILWPARSWARRRCCSLPAAVSRVSCCRRRRRRSPAPAPAPWRALPSPEGAAPTA

SEQ ID NO: 194751 - protein, 100 aa, Triticum aestivum
  unsure (1)..(100): unsure at all Xaa locations
  Clone ID: PAT_TA_89169.pep
MSPQTETKAGVGFKAGVKDYKLTYYTPEYETKDTDILAAFRVSPQPGVPPEEAGAAVAAESSTGXTWTTVWTDGLTXLDRYKGRCYHIEPVAGGRQQXXR

SEQ ID NO: 194752 - protein, 138 aa, Triticum aestivum
  unsure (1)..(138): unsure at all Xaa locations
  Clone ID: PAT_TA_89170.pep
MALASTTASRLISRRLAAPLPPPPSSSCAAPRGGARPGPRRFAVRWEGRPRALLGGFSDAGEDASDDEDEEDGXGALSGGPPRQEKGCEDSSNSAAAAFSGPERWDVLGSGKPWXXFSSMVDDEFXQKLGIXKVQEGL

SEQ ID NO: 194753 - protein, 128 aa, Triticum aestivum
  Clone ID: PAT_TA_89171.pep
GSYPSLQFRFLGPKLRVNTSQVSSAQKPVVGLRLYLEGRKCNQLAIHVQHLSSVPSMLGDSMASSMSEWRESEDTDPGYIEAIQWNSYSCISTSVVNTTPSGSKRFLGEFHRHGANSSQRELGKEVLI

SEQ ID NO: 194754 - protein, 122 aa, Triticum aestivum
  Clone ID: PAT_TA_89172.pep
TYPAQVCFNIVWKCRPLTEDEFFPAIEENYYISKKFYFDLSYQQVVQLYGLFDKKRVEHPICNYSTSANLEKEHSSRRRSDKRSLTPNSPPFSADCSHTLIPRVPQRSQLSKQTALLLQACI

SEQ ID NO: 194755 - protein, 57 aa, Triticum aestivum
  unsure (1)..(57): unsure at all Xaa locations
  Clone ID: PAT_TA_89173.pep
FFXSRLPLQRLGRELEVEDLRHQLLRVAHGCLARVSGRGGAGRGIRFAAEVWWGSGL

SEQ ID NO: 194756 - protein, 163 aa, Triticum aestivum
  unsure (1)..(163): unsure at all Xaa locations
  Clone ID: PAT_TA_89174.pep
XSRQXXIEHGAEKGTEXCWNVAFAXLSFRSLLRSLFPESDNRRAEAWLLVVMLVAGTHEEXLEETQFSGEEDAGEAQAAHGLLLLAPASRRRVKLSGPSVQIEWGEGACGREAWAMGREARRGGARAGDEGGHLRVRRGAGLWRQEQGTWCGDGRGAALEEVG

SEQ ID NO: 194757 - protein, 141 aa, Triticum aestivum
  Clone ID: PAT_TA_89175.pep
VLPPPPPPHISPATSAANQHPLVLSILATSDEDERWPALGRCNHGEKLWRSGLLFLKADPILLLTPSFFAETFIFFLATMCFAFCWNQLQDGMGKKLLPWEEKASIGCEKASSGCSKTSSAMRKNSTVGKNFIGEKTSTGD

SEQ ID NO: 194758 - protein, 143 aa, Triticum aestivum
  unsure (1)..(143): unsure at all Xaa locations
  Clone ID: PAT_TA_89176.pep
MARLNSKAVAAAVVLAAVVLMMAGREASAALSCGQVDSKLAPCVAYVXRGRASSISKECCSGVQGLNGLARSSPDRKIACKCLKDLATKHQXINMGKXSGVPGXCGVSVPFPINISTTATCQLFIYNLPTASWTPAWTYFTLM

SEQ ID NO: 194759 - protein, 80 aa, Triticum aestivum
  unsure (1)..(80): unsure at all Xaa locations
  Clone ID: PAT_TA_89177.pep
HKLGQITELLQRGLSGRRETSIAQEDVIFNNLLCAICXDPSSPTPVXSLSNRSKILPHXIPFDFXANRXIDKHIKYKSXT

SEQ ID NO: 194760 - protein, 136 aa, Triticum aestivum
  unsure (1)..(136): unsure at all Xaa locations
  Clone ID: PAT_TA_89178.pep
MAEEKHHHHLFHHKKEGEDFQPAADGGVDMYGYSTETVVTATGNEGEYERITKEEKHHKHKEHLGEMGAAAAGAFALYEKHEAKEGPEHAHKHKIXEXVARRRSVXAGGXVFHEHXRRSKTQGGKEATARRTHTRS

SEQ ID NO: 194761 - protein, 108 aa, Triticum aestivum
  unsure (1)..(108): unsure at all Xaa locations
  Clone ID: PAT_TA_89179.pep
YRYNKLTGWKYTLYYTHQQYLQFQFXNSXIWXXIWEXGIXHXLTWKPPLXVKFXXAQIWFXPFAXPXSFXGPVKXXPFWXKXQCPXXQXPXKLXXKXXKPPQFXPXPX

SEQ ID NO: 194762 - protein, 111 aa, Triticum aestivum
  unsure (1)..(111): unsure at all Xaa locations
  Clone ID: PAT_TA_89180.pep
VFSACVQLRRPAALRGRRGLHLTRLAGAGVPARAPFGPFRRPGXRGGAGARAAKALARRNGRRRPVRPRLRRRLLRQLRRESLSAVKGRQVSWPXAFXQVQPAMENCXWXK

SEQ ID NO: 194763 - protein, 120 aa, Triticum aestivum
  unsure (1)..(120): unsure at all Xaa locations
  Clone ID: PAT_TA_89181.pep
HCLVXHGSXQKNXYFIPXKIYFAKGLLKGKXXVLHLPFGPGCXXGGQTPSVHGRLLHRRGTGRSSVVGDRQDGEDPTGARRRRDNGAAAATLKQRAAMDELDGVALAAARRGAERIRWER

SEQ ID NO: 194764 - protein, 43 aa, Triticum aestivum
  Clone ID: PAT_TA_89182.pep
VEEVKKEYPDAYVRIIGFDNMRQVQCVSFIAFKPPGCEESGKA

SEQ ID NO: 194765 - protein, 127 aa, Triticum aestivum
  unsure (1)..(127): unsure at all Xaa locations
  Clone ID: PAT_TA_89183.pep
MAPTVMASSATSVAPFQGLKSTAGLPVSRRSNGASLGSVSNGGRIRCMQVWPIEGIKXFETLSYLPPLSTEASLXVDYLIPXKLVXFLQLTXXGSXSLEHNASPXYYDGRYWAXWNFLFSGCTDAPY

SEQ ID NO: 194766 - protein, 119 aa, Triticum aestivum
  unsure (1)..(119): unsure at all Xaa locations
  Clone ID: PAT_TA_89184.pep
MSDTDEHHFESKADSGASKTYPQQAGAIRKGGHIVIKARPCKVVEVSTSKXLGKHGHAKCHFXVAIDIFXMGKNFEDIVPSSHNXDFPHVXRQDYQLIXDITDDGIQPSXTEXGNTKDD

SEQ ID NO: 194767 - protein, 62 aa, Triticum aestivum
  unsure (1)..(62): unsure at all Xaa locations
  Clone ID: PAT_TA_89185.pep
LPSSRSSXSHGADQGRXAGHRXRPRDQLLXRXRVATRPRPDXRQRPXXPHHALLXRLXRLRA

SEQ ID NO: 194768 - protein, 131 aa, Triticum aestivum
  unsure (1)..(131): unsure at all Xaa locations
  Clone ID: PAT_TA_89186.pep
MAPTVMASSATSVAPFQGLKSTAGLPVSRRSNGASLGSVSNGGRIRCMQVWPIEGIKXFETLSYLPPLSTEXLLKQVDYLIRSKWVPFLRVNKVGXLPVEHNASPGVXNNGRYWTXLELAMSXCTDAPXIR

SEQ ID NO: 194769 - protein, 164 aa, Triticum aestivum
  unsure (1)..(164): unsure at all Xaa locations
  Clone ID: PAT_TA_89187.pep
VVCLLLFPCAXFALGVGLQGHFCNSWYTHXLASSYXLEGCNFLTAAVSTLANSXAHSLLLLWGPXEAQGDFTRWCQLGGLWTFVALHGAFALIGFMLRQFELARSVQLRPYNAISFSGPIAVFVSVFLIYPLGQSGWFFAPSFGVAAIFRFILFFQGFHNWTLN

SEQ ID NO: 194770 - protein, 87 aa, Triticum aestivum
  unsure (1)..(87): unsure at all Xaa locations
  Clone ID: PAT_TA_89188.pep
DXNRXKRSALXIRVTXTVFPRTPLMNVLWXSXGGIXSTISXXLDXRSSPRLEQXXLRHAGWRQESLWXRIXMXDXXIXHIXFGIPXP

SEQ ID NO: 194771 - protein, 137 aa, Triticum aestivum
  unsure (1)..(137): unsure at all Xaa locations
  Clone ID: PAT_TA_89189.pep
CPXXXXKXGDXNAGLGRLAGXAXTXAPXXXSDRRAGTLXTXEARRXGYNRRXRXRXRGDXVSNPMRLLKLKPXMWLGHYRLSHMPXXTPATPXPAPRXGVRHRXIGXLLRPXRQAAAXAHRYMEPLKREDLYGSLRE

SEQ ID NO: 194772 - protein, 139 aa, Triticum aestivum
  unsure (1)..(139): unsure at all Xaa locations
  Clone ID: PAT_TA_89190.pep
MGKEKIHISIVVIGHVDSGKSTTTGHLIYKLGGIDKRVIERFEKEAAEMNKRSFKYAWVXLDKLKAERXRGVSPLDIALWEVGDHQSTPALSLDAPWVTRDFXPKNMIXWGLPKLDCAVLNMXPTTGXFLWDLPREGKP

SEQ ID NO: 194773 - protein, 74 aa, Triticum aestivum
  Clone ID: PAT_TA_89191.pep
CLRYFLPHLKECQEATITTNWTEFRRDTNVKEGDICLLLQIPGKAFHVGFYRSLLVLLHMLQLWLYFWTPLPEF

SEQ ID NO: 194774 - protein, 80 aa, Triticum aestivum
  unsure (1)..(80): unsure at all Xaa locations
  Clone ID: PAT_TA_89192.pep
GAXVEWXXAGEVVVVAMAGEAGEXGRSAXDVTQGVGEDRRHHTGRLMGGSALAAWGHKVXGVAWIWAWGVDQEEGGGDRG

SEQ ID NO: 194775 - protein, 139 aa, Triticum aestivum
  unsure (1)..(139): unsure at all Xaa locations
  Clone ID: PAT_TA_89193.pep
WRLRLWTTHIIGPLNSXPEAKIEYXKDQXVLPVQINGKPRGTXILVDKECSEDDVFPNSSLRRELSKYLDGKAIRKRIYVPGRILNVILRSTKGKDVIIALVFSIDLPQSPGRVVDRVSRSVNFHSFVVTFSAIGMYLL

SEQ ID NO: 194776 - protein, 112 aa, Triticum aestivum
  Clone ID: PAT_TA_89194.pep
IIFSSEEFHKTTQYGLSYVIGRNCRFLQGPKTNQFSIQRIKDKIEAGVEHCEVVLNYRRDGSPFMNLFMCAPLCDSKGKIRYFIGAQVDVSGPSKNALSHLDVLVARVRKCN

SEQ ID NO: 194777 - protein, 145 aa, Triticum aestivum
  unsure (1)..(145): unsure at all Xaa locations
  Clone ID: PAT_TA_89195.pep
MQIFVKTLTGKTITLEVESSDTIDNVKAKIQDKEGIPPDQQRLIFAGKQLEDGRTLXADYNIXKESTLHLVLXRLRGGMQFSVKTLTGKTIXTLEXXXSDTIRQRQGKFKDKEXIPRTTRLIFXAXKXLXDGRTLADYNIXEGTN

SEQ ID NO: 194778 - protein, 54 aa, Triticum aestivum
  Clone ID: PAT_TA_89196.pep
LKDLKKEFCCNGTVVQDTELGQVIQLQGDQRKNVSNFLVRAGIVKKEHIKIHGF

SEQ ID NO: 194779 - protein, 108 aa, Triticum aestivum
  unsure (1)..(108): unsure at all Xaa locations
  Clone ID: PAT_TA_89197.pep
MAPTVMASSATSVAPFQGLKSTAGLPVSRRSSSAGLGSVSNGGRIRCMQVWPIEGIKXIRDLSYLQPSPXGGLLKQVDYXIRSKXGACPXXTRLXFLFPLXXNSPGYN

SEQ ID NO: 194780 - protein, 149 aa, Triticum aestivum
  unsure (1)..(149): unsure at all Xaa locations
  Clone ID: PAT_TA_89198.pep
MRARGREARRGHWRDGSSXXXRGXSDLRARGXHVXGRGGPGLGSAGRRRLDRAAXGRRRWRVVEGEEGGXRHGKGRATNSRGXGLXPERGEISGGPGGGRGGGAGRRRGQCVGGRRGWTRREKARWGGGAPGGGGRRRQEKAWAVARLK

SEQ ID NO: 194781 - protein, 131 aa, Triticum aestivum
  unsure (1)..(131): unsure at all Xaa locations
  Clone ID: PAT_TA_89199.pep
MARGLKKHLKRLNAPSHWMLDKLGGAFAPKPSSGPHKARECLPLILILRNRLKYALTYREVQSILMQRHIMVDGKSALTRLPAGFMASXQSQXGENTXSLXTLPPPVKDISTLKVRQKDPYLNTWRTSVPN

SEQ ID NO: 194782 - protein, 76 aa, Triticum aestivum
  unsure (1)..(76): unsure at all Xaa locations
  Clone ID: PAT_TA_89200.pep
INXELHEXKANSXXEQNLQKLPCPAXXEMNPAVLVELGSAPLLAASHCGHFNDNRTRGLRESSWSPGLTGKGGSGR

SEQ ID NO: 194783 - protein, 80 aa, Triticum aestivum
  unsure (1)..(80): unsure at all Xaa locations
  Clone ID: PAT_TA_89201.pep
NQLQTLADPSIYGNNLGLCGFPLSACEPTLGQGAGDHKELRDLGLCYSVIIGIVFGSGFGLGAPXSLGAMALFRWLRLKD

SEQ ID NO: 194784 - protein, 111 aa, Triticum aestivum
  unsure (1)..(111): unsure at all Xaa locations
  Clone ID: PAT_TA_89202.pep
NLLRSKRSQGSLVPLLKMQIFVKTLTGKTITLEVESSDTIDNVKAKIXDKEGIPPDXQRLIFAGKQXQDGRTLADYNIQKGSTLTWGXXPLGGINIFEKPRENNPGGLPRK

SEQ ID NO: 194785 - protein, 118 aa, Triticum aestivum
  unsure (1)..(118): unsure at all Xaa locations
  Clone ID: PAT_TA_89203.pep
DVGTKGHGGIPAYIGVCIISAFFGTSDALVQGGLVGDLSLMCPEFIQSFLSGLAASGVITSALRLITKAAFENSQNGLRNGAMLFFSVXACSELACLLLYAFVFPKLPIVKYYRQKQL

SEQ ID NO: 194786 - protein, 85 aa, Triticum aestivum
  unsure (1)..(85): unsure at all Xaa locations
  Clone ID: PAT_TA_89204.pep
NVXTLWAPHKAEPACVSTCPSNKKDPRASPRPQYFPGGSYLPATTKMICLLKMSFYAVIRGPELMSRNKHMKRAIWKPARDREKR

SEQ ID NO: 194787 - protein, 99 aa, Triticum aestivum
  unsure (1)..(99): unsure at all Xaa locations
  Clone ID: PAT_TA_89205.pep
VCCXSXFXXEVXRXRVVDMSXVVDLAFRLSVEFPASGVSPQPVRHPHFSPAPRIEHPADSNGNTEMQTALESRSTPRPSNAAAVRDGDEDGEEEEEEEV

SEQ ID NO: 194788 - protein, 53 aa, Triticum aestivum
  Clone ID: PAT_TA_89206.pep
NYPRVYEVVSVNIFGQWLCLREQEKPICGLWSSLVKLNLNRQVDALLGYQKGG

SEQ ID NO: 194789 - protein, 155 aa, Triticum aestivum
  unsure (1)..(155): unsure at all Xaa locations
  Clone ID: PAT_TA_89207.pep
MESLALLSAKPGLSLRAGPRLPLPRLRAARASLSTASSSRPAXLQSPLLSSRPPSSQDAVLGYGLLKRRTSAGAGVSCSAADAAXVPQPPVQPEVKKFLGVGLXTLKKXXPLGLMFFCILXNYTSSGHKDVXVVPPRGEXGISLPKTGLPWHSIS

SEQ ID NO: 194790 - protein, 96 aa, Triticum aestivum
  unsure (1)..(96): unsure at all Xaa locations
  Clone ID: PAT_TA_89208.pep
ALKRALLDATADDAVSRVMAELKSAIEEQRYQDASRLTKLAGTSLVGWWVGYAKDTDDSIGRIVRITPGVRRYXAKNYSPRNWXXXLQGXIIWKXP

SEQ ID NO: 194791 - protein, 54 aa, Triticum aestivum
  unsure (1)..(54): unsure at all Xaa locations
  Clone ID: PAT_TA_89209.pep
VKLXLNXRIFGXEXLADIKYLLCPVSNYFLPQVWQEPIVSPVESGVAKSFICHN

SEQ ID NO: 194792 - protein, 148 aa, Triticum aestivum
  unsure (1)..(148): unsure at all Xaa locations
  Clone ID: PAT_TA_89210.pep
FVGLVVLLLSSPAPSAGDQLFCAGANSKYSPNSTYRTSLRFLADELTARAMKSHSATGTAGTGSDKVYGAVLCRGDSTGADCSRRLREAFGRTINADSTGAAACALHKDVALYSELYXLRFSDXDSSRNKRLVTTEPPAPMLGINCRN

SEQ ID NO: 194793 - protein, 142 aa, Triticum aestivum
  unsure (1)..(142): unsure at all Xaa locations
  Clone ID: PAT_TA_89211.pep
XFVXXRTRMAMXXPHVSHSQPPAGXAALFAHXXTXYNSSXLXLPLXRSAVXXVXLYXVSXDAAPGIVRPPLWXPWXTDGSXXSRRXTPEVYDLIKRXKRSIARALXNHVXXLHLTRXHGXARVXAHQKVLESHTGXALRRKX

SEQ ID NO: 194794 - protein, 155 aa, Triticum aestivum
  unsure (1)..(155): unsure at all Xaa locations
  Clone ID: PAT_TA_89212.pep
DQKSLAQPIPIGPGSSLSLPHPSFSTSXRXHXQAXVLVRLPPHXPSPSTTPXSPPSIXAVPPSXXTXHHQXHXRXPHATHHTEGRRCLIIARPMLVPPXSTCCFXXLTSAAVALLXLRIMLLSSETLIXLXQSXQXXAALLXXPPCTLWXLPXRL

SEQ ID NO: 194795 - protein, 72 aa, Triticum aestivum
  unsure (1)..(72): unsure at all Xaa locations
  Clone ID: PAT_TA_89213.pep
MDAGGAQPPDAXMAXAGAAAXXAXGSAPGXAMDNIQAXLXHGGRFIXYNIFGXIFEVTAXXXPPILXIXXGA

SEQ ID NO: 194796 - protein, 131 aa, Triticum aestivum
  unsure (1)..(131): unsure at all Xaa locations
  Clone ID: PAT_TA_89214.pep
MQIFVKTLTGKTITLEVESSDTIDNVKAKIQDKEGIPPDQQRLIFAGKQLEDGRTLADYNIQKESTFXLVLKLRGGMQIFVKTLTGKTITXEVESSDTXDKVKGKIQDKEGSSGQXRLIFAXXQLKDGRTF

SEQ ID NO: 194797 - protein, 109 aa, Triticum aestivum
  unsure (1)..(109): unsure at all Xaa locations
  Clone ID: PAT_TA_89215.pep
SSTRIYLEQNESCWHPRCRCCRWSPRNQKNRQPAAASXKLPPASSPGSXXXGTPNAXXHGCLNGRLKAGQGVPHKSPNNMIHSXSSRQTAVKRAXXAPRITLXRATXTX

SEQ ID NO: 194798 - protein, 153 aa, Triticum aestivum
  Clone ID: PAT_TA_89216.pep
SRVGRRRQSPLSARQSPPLPLCLRPRRHPPPPAARPRPHQRRPPGLGDASLHSPLLPRRLRSRRHPSVPAARPRTSPASSTWQSVTPALSDAAEGARRRIQAMACCLKTCCVNPRAPPGKDAMPLPSSLPILVLLSDRSSLNASTTRALVHVR

SEQ ID NO: 194799 - protein, 135 aa, Triticum aestivum
  unsure (1)..(135): unsure at all Xaa locations
  Clone ID: PAT_TA_89217.pep
MQIFVKTLTGKTITLEVESSDTIDNVKAKIQDKEGIPPDQQRLIFAGKQLEDGRTLADYNIQKESTLHLVLKLRGGMQIFVKTLNGXTINLEVESSDTIXNVKAKXKTRXXXPXDQXXLIFPGNNPGWRTLKIRH

SEQ ID NO: 194800 - protein, 139 aa, Triticum aestivum
  unsure (1)..(139): unsure at all Xaa locations
  Clone ID: PAT_TA_89218.pep
CLLIVLCRRRRTASDALSRLGRQGYKLDFQRRSYPGLPVLQVRQERCWPVWIQIHRGVHRRVHESSSWRPMSRVLCIHVDPTRWISISNVYSLMSWLSYPSCSNIKKASNGMVXXLGIPTVXFVATKGKCQCGXCNHPL

SEQ ID NO: 194801 - protein, 53 aa, Triticum aestivum
  unsure (1)..(53): unsure at all Xaa locations
  Clone ID: PAT_TA_89219.pep
XMLLKSFRXSCCCLFEILCNPKEALHREXDDVRLISYIQLQILKENNSNKARV

SEQ ID NO: 194802 - protein, 134 aa, Triticum aestivum
  unsure (1)..(134): unsure at all Xaa locations
  Clone ID: PAT_TA_89220.pep
PPKGHLTRCVAGEGSPSRSTXVVCSFHVPXAVHDSDGTWHAGALAAAAXNMCSALVFTVVGAXTSTVHYGLXYFSPVACNEEVQLDGRVVGRKGKLTAAVVRVRKMGSGELVAIGRQWMTPAWPTKSNKSRSKL

SEQ ID NO: 194803 - protein, 81 aa, Triticum aestivum
  unsure (1)..(81): unsure at all Xaa locations
  Clone ID: PAT_TA_89221.pep
XRIXMGSCSRDYYVNWISGCXXLICLXTNDXLFYHXXLLYXTFISLXXNSALAGLSSSRQXKLLLDVXXITXXEXLXNXLL

SEQ ID NO: 194804 - protein, 152 aa, Triticum aestivum
  unsure (1)..(152): unsure at all Xaa locations
  Clone ID: PAT_TA_89222.pep
SQLHFKMDHVRXDETLVFPRTSFGXXNLESANLKTMLTVCRSSSNPXLLLLGVPWWGLPRPPRWSYPSSCQDHLKGGDGTSWMVASGAGAAGGCGRCGGRGCARGARSRWPAVAASGTSWTAASRRGAAGGAAVMVADALGARGDDGRRRQE

SEQ ID NO: 194805 - protein, 138 aa, Triticum aestivum
  unsure (1)..(138): unsure at all Xaa locations
  Clone ID: PAT_TA_89223.pep
MARRSGGGRSSRPAPRAAPVRNPPAPARPAPPPATTQSSGGGIMSGIGSTIAQXGMAFGTGSAMAHRAVDAVMVPRTIQHETVVREAAASMTPMGQCCXDDKCGNLPKASKXCINNYXSHINNAXLLXMLNECPVGGL

SEQ ID NO: 194806 - protein, 67 aa, Triticum aestivum
  unsure (1)..(67): unsure at all Xaa locations
  Clone ID: PAT_TA_89224.pep
MECENGKVAGNGNGLCVAQPARADPLNWGKAAEXXSVSHLDAVKDGPRTRPVGDNGGPNTLPKPLFG

SEQ ID NO: 194807 - protein, 64 aa, Triticum aestivum
  Clone ID: PAT_TA_89225.pep
KITLAGNFYLYASIAAAGWVFMFCFLPETRGRGLEDTEKLFGGGDGVEKEDGHGHAESTELTTQ

SEQ ID NO: 194808 - protein, 58 aa, Triticum aestivum
  unsure (1)..(58): unsure at all Xaa locations
  Clone ID: PAT_TA_89226.pep
ARDPXSLRRVGVGVGVARRVGPTGIGGRRRRGGGVSGVVHSGGEGAMRSMGCDRVRSP

SEQ ID NO: 194809 - protein, 101 aa, Triticum aestivum
  unsure (1)..(101): unsure at all Xaa locations
  Clone ID: PAT_TA_89227.pep
VCXSPAARSWSLTLXQGXRGARGVRQELDDMRNPQDRNPQNRFKAGERRPEGGTRAQARRRTAQRDSGDGEAGTRTRARAHAASRPQQRWGRGRTRGRLGR

SEQ ID NO: 194810 - protein, 146 aa, Triticum aestivum
  unsure (1)..(146): unsure at all Xaa locations
  Clone ID: PAT_TA_89228.pep
DFMCQGGDFTRGNGTGGESIYGEKFADEKFVHKHTKPGILSMANAGPNTNGSQFFICTVPCNWARRQDVASGEVLXGHGRPSKNIREVGSRXXAPAPKQVVNRPTGGTLNSPARRSPSSVTPRLSRVLSILNKPVSCLPWPSDFRG

SEQ ID NO: 194811 - protein, 121 aa, Triticum aestivum
  unsure (1)..(121): unsure at all Xaa locations
  Clone ID: PAT_TA_89229.pep
LXVXFXQXXGTXPGVNPXAXSXIHXXXMPAXLXXIFGKDXXIXXLXEELLGXSXGKCTXVPAVNRVALEXYXQAXNEGXDLAXEGNEIIRAACKWSPELAAACEVWKAIKFEFXPVXTIDK

SEQ ID NO: 194812 - protein, 73 aa, Triticum aestivum
  unsure (1)..(73): unsure at all Xaa locations
  Clone ID: PAT_TA_89230.pep
AQERFSXSEQNXPFMGCMQSHIFGFDSSYXICVTVAFHYRSDRIIGLACPGRKLSTQFGQEGPRNIEKRSRRI

SEQ ID NO: 194813 - protein, 138 aa, Triticum aestivum
  unsure (1)..(138): unsure at all Xaa locations
  Clone ID: PAT_TA_89231.pep
PAAKPKAKAPAKKTAAKSPAKKAAAKPKAKAPAKAKAVAKPKAASKPKAAAKPKAKAAAKKAPAAATPKXPAAARKPPTKRATXXXKAAPAKKPXAKKARLARNNRLAGGIFTIPSAVRQTFYFAVMSFRIYHGIIVN

SEQ ID NO: 194814 - protein, 136 aa, Triticum aestivum
  unsure (1)..(136): unsure at all Xaa locations
  Clone ID: PAT_TA_89232.pep
MKMSPERKGAEDKEEGSRMASAALPEPGAVHPRNKGNFKYAFTCALCASMATIVLGYDVGVMSGASLYIKRDLQITDVQLEIMMGILSVYALIGSFLGAKTSDWVRRRVNVVFAGAILTXXSXLKGFXSTTQAHGR

SEQ ID NO: 194815 - protein, 123 aa, Triticum aestivum
  unsure (1)..(123): unsure at all Xaa locations
  Clone ID: PAT_TA_89233.pep
MAPTVMASSATSVAPFQGLKSTAGLPVSRRSNGASLGSVSNGGRIRCMQVWPIEGIKKFXTLSYLPPLKHGXLLKQVRLXLXRSKWVPCLEFNKLGSXSRXAQRTPGVXNGRYXTMWXLPXXR

SEQ ID NO: 194816 - protein, 95 aa, Triticum aestivum
  unsure (1)..(95): unsure at all Xaa locations
  Clone ID: PAT_TA_89234.pep
IFXRKXGNLNGXEKLXEDLEAEIDEXXEPLCYESWDVDXASTXYXQQVEAXXKKQFLEEQERQXLEAAKELEEMNDMASSPQKVKKKKKKVESSS

SEQ ID NO: 194817 - protein, 133 aa, Triticum aestivum
  unsure (1)..(133): unsure at all Xaa locations
  Clone ID: PAT_TA_89235.pep
STGGATTWHQALSLPPGSHGRTGPTGGISSLAPRICYPPPPPSPWRKPRACKKLGKIDLSDCEMYASCEPCPMCFXAPFRLSRLKRLGVWSXGKLVIAMGKLLQNANLGKVGMGPCLPENLLNTKGNFKCPKF

SEQ ID NO: 194818 - protein, 101 aa, Triticum aestivum
  unsure (1)..(101): unsure at all Xaa locations
  Clone ID: PAT_TA_89236.pep
DSRCKVNCYFFKCALTVISSSALIQAEQGILKCLKQWIQRSSSTGTPRSRTVSLALIXMAKLHLKYHLMGYLPMRIMNLRNLYIYVWFEYXIECLYFLMVQ

SEQ ID NO: 194819 - protein, 77 aa, Triticum aestivum
  unsure (1)..(77): unsure at all Xaa locations
  Clone ID: PAT_TA_89237.pep
YLPRSYHRNITWRSREKNCLALRKNKRVXCISGHQTYQEIRTPYLTLMCAXANQPVXPTLVSNYKGKWLYLXHSXTT

SEQ ID NO: 194820 - protein, 159 aa, Triticum aestivum
  unsure (1)..(159): unsure at all Xaa locations
  Clone ID: PAT_TA_89238.pep
MAPTVMASSATSVAPFQGLKSTAGLPVSRRSNGASLGSVSNGGRIRCMQVWPIEGIKXFETLSYLPPLNTEXLLKQVDYLIXRSKWVPCLRIQQVGSTFPXXHNATPGVXTIGXYWDNVETAISGCTDAXQXXNKLEEXKKDTLTLFRISGTTSSSCST

SEQ ID NO: 194821 - protein, 168 aa, Triticum aestivum
  unsure (1)..(168): unsure at all Xaa locations
  Clone ID: PAT_TA_89239.pep
QIFVKTLTGKTITLEVESSDTIDNVKAKIQDKEGIPPDQQRLIFAGKQLEDGRTLADYNIQXKESTLHLGAQGSVVGMQIFXVKDPHRQDITLGGLXPPDTIRQRQRLKIQXQGGHPFPDKQRLIFXAGXALQGXPTXADYNIQEXPPXLGLKSXXGSNFLKTHGKTS

SEQ ID NO: 194822 - protein, 52 aa, Triticum aestivum
  Clone ID: PAT_TA_89240.pep
SFVTNSITLLISTNFISAYPESLRIAANPYLLRAKIHRVPTIIQLDLTCSFI

SEQ ID NO: 194823 - protein, 123 aa, Triticum aestivum
  unsure (1)..(123): unsure at all Xaa locations
  Clone ID: PAT_TA_89241.pep
MAHARILLLALAALATATVAVASSSSSSSSFAVSNPIRPVTERAASTLESTVLXRSGINRFSDMSWEDSXATRXGAAQTCSGTLAGNXLMRDAAALPGDKDGXKIGXLTXFXDIPXGSRWTST

SEQ ID NO: 194824 - protein, 97 aa, Triticum aestivum
  unsure (1)..(97): unsure at all Xaa locations
  Clone ID: PAT_TA_89242.pep
KILVSSLKLKPVRRYISQHLGSGLLHNMMAKFLTHQMFEHYYNILWKRQSLQSQADINFHMNKMCQPCYEQERSPPHWDILXSTGLDXXNFFTLGGG

SEQ ID NO: 194825 - protein, 91 aa, Triticum aestivum
  unsure (1)..(91): unsure at all Xaa locations
  Clone ID: PAT_TA_89243.pep
XSHXPXPQQXSTTMTVXKXIIHSWARCFPLXPAXYXHNWSIQAFLXIXDVHTTRVXQFXSSVXXXDFXXMIGRTCVIKGWDEXIPTXKVGD

SEQ ID NO: 194826 - protein, 89 aa, Triticum aestivum
  unsure (1)..(89): unsure at all Xaa locations
  Clone ID: PAT_TA_89244.pep
WPXYGNDLIPFLXLXPXNLVNAXXCXSKLXRATCVLRCERLYLSPSELARIRARARHRRSHSSLVRHGRSSFELPRAAAPVYALPAAQC

SEQ ID NO: 194827 - protein, 134 aa, Triticum aestivum
  unsure (1)..(134): unsure at all Xaa locations
  Clone ID: PAT_TA_89245.pep
MAPTVMASSATSVAPFQGLKSTAGLPVSRRSNGASLGSVSNGGRIRCMQVWPIEGIKKFETLSYLPPLSTEALLKXVDYLIRSKWVXCLEXXKVGFIFREHNAXPGYYDGRYWXMWNCLVXVNDATQVXNEVEX

SEQ ID NO: 194828 - protein, 101 aa, Triticum aestivum
  unsure (1)..(101): unsure at all Xaa locations
  Clone ID: PAT_TA_89246.pep
XXRXWTXXXXLTWXGSTAXRRCSSCWRSTPXSRHXXRHHAXSRXRSLLKFXIIVSDYAYKLLXFPWKKEKFLQQTLIAQTEXESAELAXGXSXAAXVVXXP

SEQ ID NO: 194829 - protein, 68 aa, Triticum aestivum
  Clone ID: PAT_TA_89247.pep
EASTDGDVYSYGVLLLEIFTARRPTDNFIDGVTSLANYVKMAYPDKLLEIMDVRATYSGDMQSITDIS

SEQ ID NO: 194830 - protein, 141 aa, Triticum aestivum
  unsure (1)..(141): unsure at all Xaa locations
  Clone ID: PAT_TA_89248.pep
MRECISIHIGQAGIQVGNACWELYCLEHGIQPDGQMPGDKTVGGGDDAFNTFFSETGXAGKHVPRAVFVNXEPTVIDEXRTGAYXSLHLSNLXNGKEDAXTTSPWXYTIGRRLLISPXSTXSXXNXTGCRILVLKLWRGTV

SEQ ID NO: 194831 - protein, 80 aa, Triticum aestivum
  unsure (1)..(80): unsure at all Xaa locations
  Clone ID: PAT_TA_89249.pep
XGNXIIGNQREDXDXXVXQLSRYSACEGXTYRMSTYFRDKQRXRFCTHTSRSGTQDYHMHVLNEVTSLRLRGNCQSVRSV

SEQ ID NO: 194832 - protein, 117 aa, Triticum aestivum
  unsure (1)..(117): unsure at all Xaa locations
  Clone ID: PAT_TA_89250.pep
GKFPFPTSRLLPPKPPVVARHQSGRPPPRLPSTHAGHPAPAPLVPILLSLSSVLAVRRLARTRSGAPPFESPAPVSVPSTALPFLPYHLESLAXPSAXHXYRAGXXNWPXSXXXSXG

SEQ ID NO: 194833 - protein, 55 aa, Triticum aestivum
  unsure (1)..(55): unsure at all Xaa locations
  Clone ID: PAT_TA_89251.pep
MARLNSKAVAAAVVLAAVVLMMAGKEGSXXAVLPGKVDSKLXRFXAXYRGKGSXI

SEQ ID NO: 194834 - protein, 151 aa, Triticum aestivum
  unsure (1)..(151): unsure at all Xaa locations
  Clone ID: PAT_TA_89252.pep
MAAAFSSTVGAPASTPTNFLGKKLKKQVTSAVNYHGKSSKANRFTVMAAENIDEKRNTDKWKGFAYDISDDQQDITKXERASLDSLFQSAQWANXTHXGVLNSYEYVXSXGLKKYDFDNTWEXSNRSCFMDKLVXHLSKNXMXLPNIKIHS

SEQ ID NO: 194835 - protein, 141 aa, Triticum aestivum
  unsure (1)..(141): unsure at all Xaa locations
  Clone ID: PAT_TA_89253.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGVHLXREHNASPGYYDGRTGQCWKLPXFGCTNATQXXNXVEEAKKGT

SEQ ID NO: 194836 - protein, 78 aa, Triticum aestivum; identical to SEQ ID NO: 106977
  Clone ID: PAT_TA_89254.pep

SEQ ID NO: 194837 - protein, 36 aa, Triticum aestivum
  unsure (1)..(36): unsure at all Xaa locations
  Clone ID: PAT_TA_89255.pep
NLQMPSRPFFCDEGHIHTDDTYHLSSELTEISEXDD

SEQ ID NO: 194838 - protein, 79 aa, Triticum aestivum
  unsure (1)..(79): unsure at all Xaa locations
  Clone ID: PAT_TA_89256.pep
MSCCGGNCGCGTACKCGNGCGGCNMYPEAEAAGATLLVSATATHKASSGGMEXAAENGGCGCTQXCKCGTSCGCSCCXC

SEQ ID NO: 194839 - protein, 74 aa, Triticum aestivum
  Clone ID: PAT_TA_89257.pep
KVVAHAKGIHIQAGMDTEDYYVSFNMVFDDGRFKGSTLQVMGTVVAEGEWAILGGTGEFALARGVIYKTYSEIH

SEQ ID NO: 194840 - protein, 67 aa, Triticum aestivum
  unsure (1)..(67): unsure at all Xaa locations
  Clone ID: PAT_TA_89258.pep
SCLLLLSVGNILQCHLSCEFHLTEGVILLLNFRWTPTLPSTXXRYXXMLRRXFVLKKAGXTXQGPSP

SEQ ID NO: 194841 - protein, 90 aa, Triticum aestivum
  unsure (1)..(90): unsure at all Xaa locations
  Clone ID: PAT_TA_89259.pep
STSIKMNFKQKPSLDTKINSTKAKPKALLAASQATSLRRVRARNSRERRVSASLVLFIKRQTNKLYAVVEVYISSSQYFHHHHLLXXRGG

SEQ ID NO: 194842 - protein, 62 aa, Triticum aestivum; identical to SEQ ID NO: 185861
  Clone ID: PAT_TA_89260.pep

SEQ ID NO: 194843 - protein, 91 aa, Triticum aestivum
  unsure (1)..(91): unsure at all Xaa locations
  Clone ID: PAT_TA_89261.pep
GVSATAGQELPRXKGFPXPXXPXSTGSGKTWRRRGRSRSQRRRLSDQERPDTGTRPPAAQIHRRPAAHTARQRRPTAPRDAARRRGAPPAP

SEQ ID NO: 194844 - protein, 83 aa, Triticum aestivum
  unsure (1)..(83): unsure at all Xaa locations
  Clone ID: PAT_TA_89262.pep
QASADNHFFPLTDAILVTQFLSSLLNSTQVVSPRFIYVPNCLGAYAKXLTNSRGIXXYEXPKVTQAMLWGPKLIXPTDVHELN

SEQ ID NO: 194845 - protein, 52 aa, Triticum aestivum
  unsure (1)..(52): unsure at all Xaa locations
  Clone ID: PAT_TA_89263.pep
VPTSRNIEAYLAQLIXYQXXASXIHGCXNFXXWNRXFSLKASTILLKXQAXK

SEQ ID NO: 194846 - protein, 89 aa, Triticum aestivum
  unsure (1)..(89): unsure at all Xaa locations
  Clone ID: PAT_TA_89264.pep
QEGLVEGKEVELLTGGARRTTSRNLRKPQPGSYTXSHIEDQFSVGSCXLAFGLXXGQCGRLMGTSLEGKELEFYMRKLXQKKKGKGATA

SEQ ID NO: 194847 - protein, 131 aa, Triticum aestivum
  unsure (1)..(131): unsure at all Xaa locations
  Clone ID: PAT_TA_89265.pep
MAPTVMASSATSVAPFQGLKSTAGLPVSRRSNGASLGSVSNGXRIRCMQVXWPIXGIKNSKTLSYLPPLXTXGLLKQVDYLIRSSWVPCLQVNKVGSTSXXXNXTPGYXNGRYWXTXXKLPNXRVDTHKFS

SEQ ID NO: 194848 - protein, 152 aa, Triticum aestivum
  unsure (1)..(152): unsure at all Xaa locations
  Clone ID: PAT_TA_89266.pep
PXEEXQRPGXGGSXRNCQTPPRRMSASSDGDGVAXGEEEEEDGTNTGLSQADAVPLAXVDAVVXTTCRRTRRAETEPAEELPPSPAITLRHRLQVHAARMRWAGEGRRRNTSSRSSPGMASISPSRAGTRREFLRRRRRRRRRASPMAARIC

SEQ ID NO: 194849 - protein, 125 aa, Triticum aestivum
  unsure (1)..(125): unsure at all Xaa locations
  Clone ID: PAT_TA_89267.pep
RTKASSSATMSGRGKGGKGLGKGGAKRHRKVLRDNIQGITKPAIRRLARRXGGVEAHLRGSSTRETRGVLKIFLRRTXPRRPFTYTEHARRKDLNAMDFVXALKRQGRTSNGFXGKPPHLLPPNP

SEQ ID NO: 194850 - protein, 50 aa, Triticum aestivum
  Clone ID: PAT_TA_89268.pep
AGRSKKRNWHERHVTALDHDSFPAIQDQQIEGKLLVPYKNDTRFSQIWEK

SEQ ID NO: 194851 - protein, 88 aa, Triticum aestivum
  unsure (1)..(88): unsure at all Xaa locations
  Clone ID: PAT_TA_89269.pep
MQIFVKTLTGKTITLEVESSDTIDNVKAKIQDKEGIPPDXQRLIFAGKQXEDGRTLADYNIQKXSTLHLGAQXXXVDEXFVKXLTGKT

SEQ ID NO: 194852 - protein, 158 aa, Triticum aestivum
  unsure (1)..(158): unsure at all Xaa locations
  Clone ID: PAT_TA_89270.pep
PAPRMSGFSTATICALLLIFFHLPAPAVSLSFNYSTLSSADQNDIKIEGDASFSVGWIDISANRFGNIDYSNGRASVQCQADAALGTRRPARWQFTTRSRSPSPATSTAKGQGMAFSLPPTLLPPXPLHPLQLALNKPKRXSXGDRGHXFLRLXLTLQ

SEQ ID NO: 194853 - protein, 155 aa, Triticum aestivum
  unsure (1)..(155): unsure at all Xaa locations
  Clone ID: PAT_TA_89271.pep
VAVKDLKRGFVASNSKDDPAKEAANFTSQVIIMNHPGQIGNGYAPVLDCHTSHIAVXFAELVTKIRQAAGXKELGGLPNSXKNGDACIVKMIPNQPMVVGTFATXPPPXPFCFXLQXXNCGVGVNXAFXKXDQXGKGYGAIKNYSKLIMFNQHFY

SEQ ID NO: 194854 - protein, 85 aa, Triticum aestivum
  unsure (1)..(85): unsure at all Xaa locations
  Clone ID: PAT_TA_89272.pep
GQCLPPLHGCRLSLLPPPTTLRAGTIANHASPTGSRRNRRKPTVGPASPHLCAAPRRSGRVTARKTPSSPDSKCLTSVRSQXRGG

SEQ ID NO: 194855 - protein, 60 aa, Triticum aestivum
  unsure (1)..(60): unsure at all Xaa locations
  Clone ID: PAT_TA_89273.pep
RGVTSGIKEGWIRPSTNIYTNRIVHLFKNGKXXPXNDYNSRNPSNXKGYLTLTXGFXCXR

SEQ ID NO: 194856 - protein, 157 aa, Triticum aestivum
  unsure (1)..(157): unsure at all Xaa locations
  Clone ID: PAT_TA_89274.pep
KAEKKPAAKKPVEEEPAAEKAEKTPAGKKPKAEKRLPAGKSSAAAKEGGKAKKKAKKSVETYKIYIFKVLKQVHPDIGISSKAMSIMNPSSNDIFRETXPXEAAXLAKVQQEPTINFPGRXQTSVPLLFPGXLXQHASPXGTKASQFTLLIYYFWCF

SEQ ID NO: 194857 - protein, 94 aa, Triticum aestivum
  unsure (1)..(94): unsure at all Xaa locations
  Clone ID: PAT_TA_89275.pep
RFHLCLVVKVAVRCCSWLASSRSGAHPAGRSPRTPRPSPHASPLPGSSATYKPLRNPPSISFIFLHSRRRRLLRLIYSXXPAARPRSARSAAVX

SEQ ID NO: 194858 - protein, 127 aa, Triticum aestivum
  unsure (1)..(127): unsure at all Xaa locations
  Clone ID: PAT_TA_89276.pep
SGICFPLXNPFPGITLSTLECQWVSCEYAPPCKKSGTKQSIQTKRLHKLSSSDWALQXEDIGDEDDCGFGPGGASNXRRDPAEAVVDDPALPRRRGSASAGSRSTAGSPSSLNACLLAARLRGVGRG

SEQ ID NO: 194859 - protein, 100 aa, Triticum aestivum
  unsure (1)..(100): unsure at all Xaa locations
  Clone ID: PAT_TA_89277.pep
VMQGXLVEVKEEXGXDRNCTRRRYQLLLQRVEATDARAAASDSRFARLMDLFEGKLVTTTWSMLALGLLMLSCLDLGLMSFFGCVTGYVILVGASYELVV

SEQ ID NO: 194860 - protein, 75 aa, Triticum aestivum
  unsure (1)..(75): unsure at all Xaa locations
  Clone ID: PAT_TA_89278.pep
VSWANNLRLTLPESCVGKEKCPLRRPERQPWPVAGGYAHYDFQLDAWLRLHSTDEGNSYGGCLLDGMTSNFRXXT

SEQ ID NO: 194861 - protein, 123 aa, Triticum aestivum
  unsure (1)..(123): unsure at all Xaa locations
  Clone ID: PAT_TA_89279.pep
MANPRVFFDMTVGGAPAGRIVMELYKDAVPRTVENXRALCTGEKGVXGKSGKPLHYKGSAXRVIPDFKXQGGDFXPRGNXTGGXSIYGEXXADENXVHXTQXGISPWQXXAXXKVQFFXXTXP

SEQ ID NO: 194862 - protein, 147 aa, Triticum aestivum
  unsure (1)..(147): unsure at all Xaa locations
  Clone ID: PAT_TA_89280.pep
MDFSVSRRIVNMYGRCGXLKAAPEVSNRXXPKGSLTCIALIGSYAINQRHKEALDLFSWMLSNNLPPTIVTFNVVLEICDAAGLHDEALEIFDSMVQGYNLEASEENYDCIISLLTSAGRTAEAQRFADLKAALFSSPAPFLDFEQQ

SEQ ID NO: 194863 - protein, 67 aa, Triticum aestivum
  unsure (1)..(67): unsure at all Xaa locations
  Clone ID: PAT_TA_89281.pep
MAETXYRCFVGGLAWATDXNNLQQAFXQYGXILDAXIIXDRXXGRXRGFGFXTFXXXESMXQAIXDE

SEQ ID NO: 194864 - protein, 106 aa, Triticum aestivum
  unsure (1)..(106): unsure at all Xaa locations
  Clone ID: PAT_TA_89282.pep
ILGLELALRSCPLPPTPGAPFIGEPRRPFPVPIPRCASLYLGVILALLTFDAGDSVSMILYAFYCFLLLGSGSIESTLLRKLGLSIXLNSVGISWXKIFVLLXVRK

SEQ ID NO: 194865 - protein, 112 aa, Triticum aestivum
  unsure (1)..(112): unsure at all Xaa locations
  Clone ID: PAT_TA_89283.pep
REAPPGSGIGRKRRCRDAGAXXGLPDPAAAAGGGNRLLXGYLXHEFLXCGXVLGERRAPGGPDTGSEASHGRXQAXRYYAXATMVXVGGXCVPSXENPAHLAAWTLFRPTRT

SEQ ID NO: 194866 - protein, 149 aa, Triticum aestivum
  unsure (1)..(149): unsure at all Xaa locations
  Clone ID: PAT_TA_89284.pep
MAPTVMASSATSVAPFQGLKSTAGLPVSRRSNGASLGSVSNGGRIRCMQVWPIEGIKXFETLSYLPPLSTEXLLKQVDYLIRXKWVPCLQFSKLXHFXREHNASPGXYYDGRYWAMWXLPISGAPTHQVXXVEESRRIPDPIPHNGISD

SEQ ID NO: 194867 - protein, 160 aa, Triticum aestivum
  unsure (1)..(160): unsure at all Xaa locations
  Clone ID: PAT_TA_89285.pep
PSLVLFCATRAAVATALPSAWPTSSPRQISLFPRLPLRRLHHLRGPARAPSRCIAWIKSSSTSGRHSSPLRFVASKPSPSLLCTSTGSAMLESKELEIPRMIYVGFGFQGVIRRPKQEACFSSLHFWATFLXXLFNXGCTKYVAPLXSXSTIVXSLXAWL

SEQ ID NO: 194868 - protein, 61 aa, Triticum aestivum
  unsure (1)..(61): unsure at all Xaa locations
  Clone ID: PAT_TA_89286.pep
CPSAKKTTLLXSWSKPVAAILLXKAXXKQFQQDQRXTNFXTTHATDXPNWTXDIIKGMTIA

SEQ ID NO: 194869 - protein, 112 aa, Triticum aestivum
  unsure (1)..(112): unsure at all Xaa locations
  Clone ID: PAT_TA_89287.pep
KGKXVXAKXCPXPAVGLSTVVXFRGAEEARPRVSLCHCLRWTGRTGGRRKRACGAVAVDAVAGPLARRGGGRRHRRRKDAAWWSGDLHETAACGREQGKKRGGTGAPRWCVA

SEQ ID NO: 194870 - protein, 81 aa, Triticum aestivum
  Clone ID: PAT_TA_89288.pep
LGKAMNFMLLSLMYAYYCFEYKWNFFAVSLNHRLDFFESNWAFFAGFGYVHCCHHMVQNMCFIFLPQLANVLCKGNFCFPR

SEQ ID NO: 194871 - protein, 125 aa, Triticum aestivum
  unsure (1)..(125): unsure at all Xaa locations
  Clone ID: PAT_TA_89289.pep
XRVLENXECQAPSVDLXGNPCSXLRRTPFARXAVSNSRGSSVPVAAAXCRRMRPRHIAAYRQPRTRLCISTPRTGDHGLHHSQSDPERSVGIRRRRHWSRFQSPPTAAFHRKRRRRIASTPQAAP

SEQ ID NO: 194872 - protein, 109 aa, Triticum aestivum
  unsure (1)..(109): unsure at all Xaa locations
  Clone ID: PAT_TA_89290.pep
TKAGVGFKAGVKDYKLTYYTPEYETKDTDILAAFRVSPQPGVPPEEAGAAVAAESSTGXTWTTVWXTDGTYHLDRYKGRCYHIXPVAGERQQWVMYLINYRGSFKLLHW

SEQ ID NO: 194873 - protein, 45 aa, Triticum aestivum
  unsure (1)..(45): unsure at all Xaa locations
  Clone ID: PAT_TA_89291.pep
PLXNYXSVXSNGDLLXIIMYHVXLLXFDLGAAGKLFGLILCFMFS

SEQ ID NO: 194874 - protein, 166 aa, Triticum aestivum
  unsure (1)..(166): unsure at all Xaa locations
  Clone ID: PAT_TA_89292.pep
EKLLVYDYLPAGSLSAMLHGSRGSGRTPMDWDARMRSALSASRGLAHLHSEHKLAHGNVKSSNVLLRPDLDAAALSDFSLHPIYAPNSVRAGGRRYRAPEXVVDTRRAXLKAXLYPSXLSLLGVLNXXSRSKLPSRRTAEPLTSALHSLSPRLPSVDFTRLGQREE

SEQ ID NO: 194875 - protein, 79 aa, Triticum aestivum
  unsure (1)..(79): unsure at all Xaa locations
  Clone ID: PAT_TA_89293.pep
KSYREGLMSPQTETKAGVGFKAGVKDYKLTYYTPEYETKDTDILXAAFRVSPQPGVPPEEAXAAVAAELLRVHGTTVWD

SEQ ID NO: 194876 - protein, 142 aa, Triticum aestivum
  unsure (1)..(142): unsure at all Xaa locations
  Clone ID: PAT_TA_89294.pep
MANPRVFFDMTVGGAPAGRIVMELYKDAVPRTVENFRALCTGEKGVGKSGKPLHYKGSAFHRVIPDFMCQGGDFXRGNGTGGEXIYGENSPTRILHKHTSPDSLHGKPGPNTTFQFSXXXPCNWVDXNTCLASLKDDVSRQK

SEQ ID NO: 194877 - protein, 160 aa, Triticum aestivum
  unsure (1)..(160): unsure at all Xaa locations
  Clone ID: PAT_TA_89295.pep
FSRLVASKPPFNLAKPKPTPPPPPPPPPPPHSSHPIPPPPQPAMPPHGRRPAPPAPGGHVFPQAASTVLPDPARFFAPGLLSAPLPTNCFFQNFTLKNXDQPEYIHPYSVRSAAAXLTVCYPGRSHSPTFDIKTSRLSVSSPSERRRGATGRSLETLVTS

SEQ ID NO: 194878 - protein, 106 aa, Triticum aestivum
  unsure (1)..(106): unsure at all Xaa locations
  Clone ID: PAT_TA_89296.pep
MAPTVMASSATSVAPFQGLKSTAGLPVSRRSNGASLGSVSNGGRIRCMQXWPIQGIKXFEDPSYLPTLNKEASLKQVDYLFASSXXLPPVNKGXLTSLEXNATPGY

SEQ ID NO: 194879 - protein, 106 aa, Triticum aestivum
  Clone ID: PAT_TA_89297.pep
LFHLFFISLVFTCGELDPVAAICWQGGLVRARAKAAAIPPPSPRRAWCRLFQEGRRCRSCPPPQAGSDPGPRNPPSGTCHEHRRRSFKMQTHFGYRKTCYRCSRIR

SEQ ID NO: 194880 - protein, 62 aa, Triticum aestivum
  unsure (1)..(62): unsure at all Xaa locations
  Clone ID: PAT_TA_89298.pep
TLVAKLLSKKRTTKVDQGSILPDAHXIAPDLDGNIFPRRSRIXTPLQKXXXGCXPKAXNPXM

SEQ ID NO: 194881 - protein, 63 aa, Triticum aestivum
  Clone ID: PAT_TA_89299.pep
MDRLLIQDHDPFLLCCWFFSLCLETMELDLLIQGRYDGRGYPYIMAWPPSLVGDEAPELEGSE

SEQ ID NO: 194882 - protein, 140 aa, Triticum aestivum
  unsure (1)..(140): unsure at all Xaa locations
  Clone ID: PAT_TA_89300.pep
AHLPANFRKILLTQIKKLVAAGKLTKVKGSYKLAKAPAAVKPKTATKKKPAAKPKAKAPAKKTAAXSPAKKAAAEPKAKXPAKPSRREPKRRRAXRRXQPKGKFRQEXPSASTXXNFSRNXPQEGTVQKASKNPRQARKP

SEQ ID NO: 194883 - protein, 78 aa, Triticum aestivum
  unsure (1)..(78): unsure at all Xaa locations
  Clone ID: PAT_TA_89301.pep
MSCCGXNCGCXTACKCGNGCGGCNMYPEAEAAXATLLVSATATHXASSGXMEMADENGXCGCTQCKCXGTSCXCSCCS

SEQ ID NO: 194884 - protein, 104 aa, Triticum aestivum
  unsure (1)..(104): unsure at all Xaa locations
  Clone ID: PAT_TA_89302.pep
LPAAAAKKGGRKGXPAGXGXRSRTRDLFARPFRKKGYIPLTTYLRTYKVGEHSXVXVNGAVHKGMPHKFYNGRTGRVCNXTNAPSGXXINKQVGTRLSRXSFFD

SEQ ID NO: 194885 - protein, 80 aa, Triticum aestivum
  unsure (1)..(80): unsure at all Xaa locations
  Clone ID: PAT_TA_89303.pep
QLLQPXQXLXXISLXKRXCAXNFASXLPSRXLPXXLYLVXINYSXVPSKXXLSAWHHTTSITXIXHSGASXSIHLVASSH

SEQ ID NO: 194886 - protein, 140 aa, Triticum aestivum
  unsure (1)..(140): unsure at all Xaa locations
  Clone ID: PAT_TA_89304.pep
MAPTVMASSATSVAPFQGLKSTAGLPVSRRSNGASLGSVSNGGRIRCMQVXGPXEGIKNSETLSYLPPLSTEASSSXSTTLFRSKWXVPCLXFNKLXHLPVEHNAXPGVXDGRYWTMWKLPIFGARPTQXTRVXGVKKDT

SEQ ID NO: 194887 - protein, 143 aa, Triticum aestivum
  unsure (1)..(143): unsure at all Xaa locations
  Clone ID: PAT_TA_89305.pep
MAPTVMASSATSVAPFQGLKSTAGLPVSRRSNGASLGSVSNGGRXRCMQVWPIEGIKXFETLSYLPPLNTXALLKQVDYLIXRSKWVPCLEFNKVXGSIFRXANASPRVXTXGRXWTIWKLPNFGVRPTKFNKWRQEGYLTVG

SEQ ID NO: 194888 - protein, 130 aa, Triticum aestivum
  unsure (1)..(130): unsure at all Xaa locations
  Clone ID: PAT_TA_89306.pep
MSPQTETKAGVGFKAGVKDYKLTYYTPEYETKDTDILAAFRVSPQPGVPPEEAGAAVAAESSTXTWTTVWTDGLTSLDRYKGRCYHIEPVAGEDSQWICYVAYPLDLXKVPLLTCLLPLVTWVQKPYCLD

SEQ ID NO: 194889 - protein, 131 aa, Triticum aestivum
  unsure (1)..(131): unsure at all Xaa locations
  Clone ID: PAT_TA_89307.pep
MANPRVFFDMTVGGAPAGRIVMELYKDAVPRTVENFRALCTGEKGVXGRAASPLHYKGSAFHRVIPDFMCQGGDFTPGQRTGGXSIYGEXFANENFVHKHTKPGFSPWXTPGPNTNVPFFXLTSPICRRFL

SEQ ID NO: 194890 - protein, 115 aa, Triticum aestivum
  Clone ID: PAT_TA_89308.pep
GFAQSSTMPKQIHEIKDFLLTARRKDARSVRIKRTKDAVKFKVRCSRYLYTLCVFDADKANKLSQSLPPGSPSVPPPPSPFSRPVRFVMFSCLRYKINGWKIPIMRSVFRVPMHP

SEQ ID NO: 194891 - protein, 99 aa, Triticum aestivum
  unsure (1)..(99): unsure at all Xaa locations
  Clone ID: PAT_TA_89309.pep
XNNPAIPASVPYRRPPLQYVPKFRTRESAENIPEFRSWSLSVSSASAHKGLIHKXLCMVSDRQXFNXEYRCAXXNLYXHSMXIXYPNLTRNAKXHVPNY

SEQ ID NO: 194892 - protein, 142 aa, Triticum aestivum
  unsure (1)..(142): unsure at all Xaa locations
  Clone ID: PAT_TA_89310.pep
MAMASFRPLPLALLLAACLSALVLAVAHARTLRLEPTIRLPSQRAAGXEDDYSVRDXVGLLIAGSNGYYNYRNQXDILPRLQIMKKGCLKGXNIIIFMYDXLXQNPXNPKAGXIINXPQGGXFXLGSPRINWEVIQKLVLSL

SEQ ID NO: 194893 - protein, 167 aa, Triticum aestivum
  unsure (1)..(167): unsure at all Xaa locations
  Clone ID: PAT_TA_89311.pep
RXEXXVSLVACIFXGPGXGAAADXRGEKAQTRRVAGXLQSMGSSTACPRMSCLAPPLPAAAQHRHPMHSWNGRNSSARRXVPGGGYRRGRERPPNRYTTARTGNVSRRRRRWTRRRTSAVLDGSEDQEEYERVGRRVVRHACLGLGRMQIGKERKISKAAPFLELAK

SEQ ID NO: 194894 - protein, 107 aa, Triticum aestivum
  unsure (1)..(107): unsure at all Xaa locations
  Clone ID: PAT_TA_89312.pep
MAPTXGEGPAIGIDLGTTYSCVSVWXHDRVXIIANDQGNLNKPFVRSPLTDSGRLXXKFPXRTKXPXTPQXVFHXKRLXGKRXAXXPFQSDFKNLXLXVFPGPPNLF

SEQ ID NO: 194895 - protein, 173 aa, Triticum aestivum
  unsure (1)..(173): unsure at all Xaa locations
  Clone ID: PAT_TA_89313.pep
MAPTVMASSATSVAPFQGLKSTAGLPVSRRSNGASLGSVSNGGRIRCMQVXPSEGIKNSETLSYLPPLNTXGLLKQVDYXIRSKWVPCLXFKQVGFIFRXAQCVSPGYYDGRYWDNVELPMFGXCTDATQVXNEWRSQEGLPDAYVRIIGFDNMRKCNASAQCLQATGCDPAR

SEQ ID NO: 194896 - protein, 70 aa, Triticum aestivum
  unsure (1)..(70): unsure at all Xaa locations
  Clone ID: PAT_TA_89314.pep
MGIDLVAGGRNKRTKRVAPKSDDVYLKLLVKLYRFLXVRKDQEQFQRLLLKRXFMSKTNRPPLFMRRLSK

SEQ ID NO: 194897 - protein, 141 aa, Triticum aestivum
  unsure (1)..(141): unsure at all Xaa locations
  Clone ID: PAT_TA_89315.pep
IWHRQETCHSKVCKECQMPCLPLGNSMMKATPILCRCFRPGSSSIWRXPEHHMQFHKGNSQAAHFXQHDPSFSXGCNSXTLQANPKANQFSQPLTCXVTRTFSXPXDQHPXPXNSXSXXPMNWLRKXFKTLGXQEXKPPFX

SEQ ID NO: 194898 - protein, 101 aa, Triticum aestivum
  Clone ID: PAT_TA_89316.pep
TARLEDAVLRIDVVHANAGGGTKPLVGSARLPLRDVLDDAGLGGRASRTLRLKRPSGRPQGRLDVRVAVREGRPLLRPRLPAALRPEPAPVRPLRGPYGSG

SEQ ID NO: 194899 - protein, 48 aa, Triticum aestivum
  unsure (1)..(48): unsure at all Xaa locations
  Clone ID: PAT_TA_89317.pep
YTHWVRWLNFELMGARLSAPLGVILRDYGWTAGSRLYLLVFCXSXNRT

SEQ ID NO: 194900 - protein, 125 aa, Triticum aestivum
  unsure (1)..(125): unsure at all Xaa locations
  Clone ID: PAT_TA_89318.pep
MAASMITSPIVAPTSLPSLSRRGSSFAVVCSGGKKIKVDKPLGLGGGLTVDIDAHGRXXRQEGVYXFVYNYGATSNGTAHLNPGEWLNLVTVPRRNNGFLTGGNLARLLRGGSPRLKNKVLPKKY

SEQ ID NO: 194901 - protein, 124 aa, Triticum aestivum
  unsure (1)..(124): unsure at all Xaa locations
  Clone ID: PAT_TA_89319.pep
MMGRKALXYNXLNENVNXVXYXVRGELYLRXSELQKXXXRIIFXNVGNXHALXXKPLTFXRQVXVXLCXAPFLLXDPXVXLIFPXDCXXXGXHYLSLXRPEXLXXYSXFXMXPGVRXEXXXFXQ

SEQ ID NO: 194902 - protein, 156 aa, Triticum aestivum
  unsure (1)..(156): unsure at all Xaa locations
  Clone ID: PAT_TA_89320.pep
GDSGGAAAGTLEGPSPAPRSPRRRRRTPYHGGRRRRGMSARLFSFSKSDGLPIWPSSFYIPGLPIWAATVLLXAASRSGSANSSRFGKTPTLGLQLSPWIRYVQARLFGKXLKVXASLHAKQPTXCQYXAXLSPPLQXHHIACSXSWXNXKXEKIT

SEQ ID NO: 194903 - protein, 78 aa, Triticum aestivum; identical to SEQ ID NO: 106977
  Clone ID: PAT_TA_89321.pep

SEQ ID NO: 194904 - protein, 84 aa, Triticum aestivum
  unsure (1)..(84): unsure at all Xaa locations
  Clone ID: PAT_TA_89322.pep
CKGNXGQPKPNKPAAXKAXSPLLLKXKPSQXPLPXAWPXRXAPWQRXQXQRXWRXNNAXNXTXARYVTLPTITTEENEXXTVPG

SEQ ID NO: 194905 - protein, 98 aa, Triticum aestivum
  Clone ID: PAT_TA_89323.pep
EHTGTAQRCLRPINTDMLFLGPMFAVSPVLPFAFAAVLLLRRFSPISLPSRRQHQRSAARQHAARAEKAVREGEAQAANTRDLPWRPGWPSLQRAARV

SEQ ID NO: 194906 - protein, 124 aa, Triticum aestivum
  unsure (1)..(124): unsure at all Xaa locations
  Clone ID: PAT_TA_89324.pep
MRECISIHIGQAGIQVGNACWELYCLEHGIQPDGQMPGDKTVXGGDDAFNTFFSETGAGKHVPRAVLVNFEPXVIDXVRTGRXRQALQPEQLIXGXEDATNKFXRWHYTNXKEIVYXRLNCYKE

SEQ ID NO: 194907 - protein, 111 aa, Triticum aestivum
  Clone ID: PAT_TA_89325.pep
IVTLCAHPKEVKRQRDRERYAQNKDEINKRRHEAYKQKKIASAEISGAQTQLGVSQGNKDELHSSLYILLYINDLFFIYSGSNEINKDELHSPHNIFVYIMIYSSSTQAVM

SEQ ID NO: 194908 - protein, 157 aa, Triticum aestivum
  unsure (1)..(157): unsure at all Xaa locations
  Clone ID: PAT_TA_89326.pep
SRSLLSPIPPATSSPPRPRSAPAPTRPASRFGSRATTHPRIRPPRRHRSWIRPPCRLHEGMPSPRAPPSAATGGTPAHLPFLSSSPSFSLTPSLSVLPXVPAMAIMDSSHAARARHQSPXSTVRPESGWEQTRRALKPRSLXQSQICRXNFGXXXKX

SEQ ID NO: 194909 - protein, 89 aa, Triticum aestivum
  unsure (1)..(89): unsure at all Xaa locations
  Clone ID: PAT_TA_89327.pep
SSAQPPPSSSGVDVAVDXGKDYERXRLLLDAAIDXNLDLLXRMALELLXPXPSATXXDXTTXVWSTCGRAXHLXATNRKDRXLRYSSKD

SEQ ID NO: 194910 - protein, 93 aa, Triticum aestivum
  Clone ID: PAT_TA_89328.pep
KYVICSCICRVLQMYRGGGCRFGHYTNNLRKKLIWISLCDHALETRIGSYRERELRWFFSNRFRKFSLLVSPKFQLLANFWRTSSTSSHQSCT

SEQ ID NO: 194911 - protein, 140 aa, Triticum aestivum
  unsure (1)..(140): unsure at all Xaa locations
  Clone ID: PAT_TA_89329.pep
LFLAFTGLQANQGLGMVGASPSTLVTLTACSQTDPVTGACLGGTLHSPTFWLGVAGFLVTATCLARDVKGAMIYGIVFVTAVSWXKRXPSVTVFPDTPAGNAGFSXFKXVVDFHMIKXTGGQLNFGGFRHXNXWLAISXL

SEQ ID NO: 194912 - protein, 62 aa, Triticum aestivum
  unsure (1)..(62): unsure at all Xaa locations
  Clone ID: PAT_TA_89330.pep
EAXQXXNXGGGXAGGEXXEGXHXXSSAGSLGRSRXXRGXXGAGWGGRFWISLWVGAEGFGWR

SEQ ID NO: 194913 - protein, 106 aa, Triticum aestivum
  unsure (1)..(106): unsure at all Xaa locations
  Clone ID: PAT_TA_89331.pep
RDGTCGRRARGHPHRPFPRRAHTPHPTLGRASHGAWRADQNRRRXNPSRRSSPLLSSPPPTQFISRAPINPXPCATTTSNXQXQQQQCPPRLQDPQLNSHHAGAVV

SEQ ID NO: 194914 - protein, 117 aa, Triticum aestivum
  unsure (1)..(117): unsure at all Xaa locations
  Clone ID: PAT_TA_89332.pep
PAFRCPRDSCAPWRYGTXETAGVITWAQLGIHDKPVGLLNVDGYYDSLLAFIDRAVEEGFVAPAARKIIVAAPTPGELLAALEEYVPAHHDASSVKLSWESSVDTRTCSPSKPDISR

SEQ ID NO: 194915 - protein, 69 aa, Triticum aestivum
  unsure (1)..(69): unsure at all Xaa locations
  Clone ID: PAT_TA_89333.pep
TGWSQAAAARQSRRPQLTRRMLRKCKASSPASPTANKADREKEQGFLLLASXQRNGCWIPARFPWTQLL

SEQ ID NO: 194916 - protein, 118 aa, Triticum aestivum
  unsure (1)..(118): unsure at all Xaa locations
  Clone ID: PAT_TA_89334.pep
MAPTVMASSATSVAPFQGLKSTAGLPVSRRSNGASLGSVSNGXRIRCMQVWPIXGIKKXRDLVXTXNAXTREPSSKQVXXLFRSKWVXPCLQXXXVGFISRXXNXTPGYXNGRGQETA

SEQ ID NO: 194917 - protein, 82 aa, Triticum aestivum
  unsure (1)..(82): unsure at all Xaa locations
  Clone ID: PAT_TA_89335.pep
GGDXXXSPXFXSAPGPGXLTSGPCQXTTSPKFGGFKSSSGAGCGVRADLTDPVNLQSQGPDPRLRFRAVRTGRLDAQVLRGE

SEQ ID NO: 194918 - protein, 112 aa, Triticum aestivum
  unsure (1)..(112): unsure at all Xaa locations
  Clone ID: PAT_TA_89336.pep
FDRRSXKHLLGSLVPTNLTTCVQHXKLLXATPSPTPTXLRALPMQDQRPXGFSTRXPXTGNFXRXXSACAXGNWLFPRNKPARXKIXPREXFPRGPXGPXIXIQFWXVKXPL

SEQ ID NO: 194919 - protein, 148 aa, Triticum aestivum
  unsure (1)..(148): unsure at all Xaa locations
  Clone ID: PAT_TA_89337.pep
MASTSCFLHQSTARLAASARPAPAVGRTQLFVCKAQKNDEAAPDAAVVTSRRAALSLLAGAAAVAVKVSPAASAXGEAANVXFGKXKKNTDFVEXTGERGXKLIIPGKLEPNKEREFPXGQVLRYKDNFEATNNSPNQTDTRRHHDVP

SEQ ID NO: 194920 - protein, 100 aa, Triticum aestivum
  unsure (1)..(100): unsure at all Xaa locations
  Clone ID: PAT_TA_89338.pep
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEQXXSPR

SEQ ID NO: 194921 - protein, 59 aa, Triticum aestivum
  unsure (1)..(59): unsure at all Xaa locations
  Clone ID: PAT_TA_89339.pep
FFFFFFFAYEALIFKKIGSCQEYIIYIVTSPAGRVKKKAKQLXLLNLVQKXXVXTXXXS

SEQ ID NO: 194922 - protein, 145 aa, Triticum aestivum
  unsure (1)..(145): unsure at all Xaa locations
  Clone ID: PAT_TA_89340.pep
MALETCLRGWALHAPQAGIRERLSXGSYAPSRXXTAAPAVVSPXPYKYAXVAXRGPXRFLCKFKNVXXEXVIVADEXKNWDNMVNXRAXXPCWWSFWAPXCGPXPMIPXLLRXEXXIGKXKCCKVNTDXXPNIQQXRIRSIPPSQ

SEQ ID NO: 194923 - protein, 108 aa, Triticum aestivum
  unsure (1)..(108): unsure at all Xaa locations
  Clone ID: PAT_TA_89341.pep
MMESQALQAPKXEPQXAXAXANNPGXGVPPXFFPGKXXXTXXXKXLXLLXXXGXXLFVQIXPXSSNNXXSIXAKXIPFVXDVXXGGXNXQILPRXIGISLGFLXGKGX

SEQ ID NO: 194924 - protein, 92 aa, Triticum aestivum
  unsure (1)..(92): unsure at all Xaa locations
  Clone ID: PAT_TA_89342.pep
RNPRKXFXXXKGKFWGQFPGDYGXRXXCWXRPGAXFPIMNLDAGHRSSRRRLVLPXLAXTLGPFEHEQLCKVLMHXMDASCSSLLTASLSCV

SEQ ID NO: 194925 - protein, 87 aa, Triticum aestivum
  unsure (1)..(87): unsure at all Xaa locations
  Clone ID: PAT_TA_89343.pep
RSVEXXSLXXRXGIXXQLRQQPXGQXPVXXVVVXRQRPPELXPRLLXXLIAATALRPXXHAAAALHRLLSVLRDDVRQARXLIPRXY

SEQ ID NO: 194926 - protein, 84 aa, Triticum aestivum
  unsure (1)..(84): unsure at all Xaa locations
  Clone ID: PAT_TA_89344.pep
MGGGNAQKSKMAXRERNLEKXKGGKGNQLEGNKKAMNIQXKIXMQTFICTTSEAXCKENAKAKHXKKXXXQMVPXLKLVAHSER

SEQ ID NO: 194927 - protein, 126 aa, Triticum aestivum
  unsure (1)..(126): unsure at all Xaa locations
  Clone ID: PAT_TA_89345.pep
ALLRARTFSASTGQSGPCATAHHTRAARPRPRPRSRARAAGHGVPLRRPAGAGCSASASSWRSRASRIPAPSSAASWLLQFIFLKIVCSRSEALIPTEGLSSWVSFKQKAELKWLNQXLVKSGICQ

SEQ ID NO: 194928 - protein, 70 aa, Triticum aestivum
  unsure (1)..(70): unsure at all Xaa locations
  Clone ID: PAT_TA_89346.pep
GRSXEAARXGEXXERAEARLSGGGVKGRRRAGRAAEAGQRAEAGKLWCGWAGSWRSGSCILALGKRLCAA

SEQ ID NO: 194929 - protein, 162 aa, Triticum aestivum
  unsure (1)..(162): unsure at all Xaa locations
  Clone ID: PAT_TA_89347.pep
QXEXENFSIGPPTKEPKVPSSTXALLQLTQPPXNRLLEGHDAHGATAAQFEMDFGLSLGCGIRVDCRTSTAPPRRKVATLAITNVRPDPGIPPVPTPPPEPSCTRQTDEAGCRRGQREREGRGEELEPPDLTQGSTAWRPTPAGGSPPSRPSLRPALPPARA

SEQ ID NO: 194930 - protein, 116 aa, Triticum aestivum
  unsure (1)..(116): unsure at all Xaa locations
  Clone ID: PAT_TA_89348.pep
SLSPSPILLQLRPPPRPGRRGGAPSPPIHPPAPPSSSPSPHPPXPSTPPSPAPPSPATSTTAPRATLPAASSPMPLLLLFSFPRCSSSPRPCSLPSSPQPPRCCSSFSPKLLLLPL

SEQ ID NO: 194931 - protein, 103 aa, Triticum aestivum
  unsure (1)..(103): unsure at all Xaa locations
  Clone ID: PAT_TA_89349.pep
MSPQTETKAGVGFKAGVKDYKLTYYTPEYETKDTDILAAFRVSPQPGVPPEEAGAAVAAESSTGXTWTTVWXTDGLTILIVTKGRCYTSTCSGDSHSVRYLNH

SEQ ID NO: 194932 - protein, 90 aa, Triticum aestivum
  Clone ID: PAT_TA_89350.pep
RRGNVHRQLEHEASTSISYITHASVHGQSSRGYTFEACVVRTDQVRCGVGELDVLGTFVVEIVVVACSGSSKTEVVVHVFVEVRGQRHET

SEQ ID NO: 194933 - protein, 66 aa, Triticum aestivum
  unsure (1)..(66): unsure at all Xaa locations
  Clone ID: PAT_TA_89351.pep
DRAVNTPNSTIVKPAALRPIQLDQRFSTFFWNKSYHLGIHYILMNSIXLLQGKXXQXHLNXXXXTQ

SEQ ID NO: 194934 - protein, 87 aa, Triticum aestivum
  unsure (1)..(87): unsure at all Xaa locations
  Clone ID: PAT_TA_89352.pep
MARLNSKAVAAAVVLAAVVLMMAGREGLGGASCGQVDSKLAPCVXYPGKGVXINKECCSGLXGXNGLAXKNPDRXXLEVPQNLTIIQ

SEQ ID NO: 194935 - protein, 155 aa, Triticum aestivum
  unsure (1)..(155): unsure at all Xaa locations
  Clone ID: PAT_TA_89353.pep
NMGSAKKKALGVAALVAALVVMQLLVAAPTVMARQPHALEEEMAARSAKIAMERLILKTTXGDGLHLRGLRCATLVFAFAAVADACTPTAGSAQHSCLXPPMHASTLKCXDNYVPVGRVLSFPIHECXLFSVSPCMHQEVWIKACXTILGWXNNG

SEQ ID NO: 194936 - protein, 128 aa, Triticum aestivum
  unsure (1)..(128): unsure at all Xaa locations
  Clone ID: PAT_TA_89354.pep
MAPTVMASSATSVAPFQGLKSTAGLPVSRRSNGASLGSVSNGGRIRCMQCXPSEGIKNSETLSYLPPLKHGGLLKQVDYLDSVQSXVLCLXFNKSVYPSRLTQCVSPGTNNGRYWTMLXLLFSGAPTH

SEQ ID NO: 194937 - protein, 53 aa, Triticum aestivum
  unsure (1)..(53): unsure at all Xaa locations
  Clone ID: PAT_TA_89355.pep
SQMXFXYPSXXYDQNHAPCVCDNHHXDXXHPCXXPYXLYPSPFPYLLCPSPFP

SEQ ID NO: 194938 - protein, 125 aa, Triticum aestivum
  unsure (1)..(125): unsure at all Xaa locations
  Clone ID: PAT_TA_89356.pep
MARLNSKAVAAAVVLAAVVLXXAGREXASAALSCGQVXDSKLAXCXXLTGKRXSSIKQGLLLRLXRLNGLAXXTPNRKIRERXLKKXPXXIKSXINMGKVPGCPXNXVXLALXXNNSTNSTFQQN

SEQ ID NO: 194939 - protein, 68 aa, Triticum aestivum
  unsure (1)..(68): unsure at all Xaa locations
  Clone ID: PAT_TA_89357.pep
PESTRTHHVAPPPNPSPRPPPXLPPQPARPPPRPAPGPLPLHGAAFRWPFFSSGGRGRNLGLHPIHGF

SEQ ID NO: 194940 - protein, 68 aa, Triticum aestivum
  unsure (1)..(68): unsure at all Xaa locations
  Clone ID: PAT_TA_89358.pep
CNGIYRXGDSXKPTXLWNALLTPIFKRWXXGXIFFMXSSXGCXCLPTGKSXLGYGLRCVKINPGKSLQ

SEQ ID NO: 194941 - protein, 91 aa, Triticum aestivum
  unsure (1)..(91): unsure at all Xaa locations
  Clone ID: PAT_TA_89359.pep
VLRXFKFLPSGXFRXGRLSPXKPEEASFXKWKXPFSPVNSSKARAWSQTCPQRKAPPRXSLPXIISTTAARTTAAGHSLAVETSHGSLAAS

SEQ ID NO: 194942 - protein, 85 aa, Triticum aestivum
  Clone ID: PAT_TA_89360.pep
GCYRCGKGGGFWGRGDKEACLACGARYCSACVLRAMGSMPEGRKCLSCIGRPVAESEAECPWAEAHALLAATDLRRKVELLIKQR

SEQ ID NO: 194943 - protein, 130 aa, Triticum aestivum
  unsure (1)..(130): unsure at all Xaa locations
  Clone ID: PAT_TA_89361.pep
PTPMSASTPPAPSASDSATPVLPYPLTQQPSXPTTPPPPLLLPXVSSFHPISSDAXLGKYAXXTFHPPSSRRXSCRXYYASAAASPSXXSRLPSSKFLSKFKSARPVSTLQKPLLXPNXNXLAXIXDSRF

SEQ ID NO: 194944 - protein, 119 aa, Triticum aestivum
  unsure (1)..(119): unsure at all Xaa locations
  Clone ID: PAT_TA_89362.pep
VVEVSTSKTGKHGHAKCHFVAIDIFNGKKLEDIVPSSHNCDVPHVDRQDYQLIDITDDGYVSLLTESGNTKDDLKLPTDDVLLGQXKTGFADXKDLILSVMSAMGEEQICAVXEIXCGK

SEQ ID NO: 194945 - protein, 94 aa, Triticum aestivum
  unsure (1)..(94): unsure at all Xaa locations
  Clone ID: PAT_TA_89363.pep
EALLKQVDYLIRSKWVPCLEFSKVGFIFREHNASPGYYDGRYWTMWKLPMFGCTDATQVINXVEXVKKEYPEXFVRIIGFQNNAQVXXFSFXAX

SEQ ID NO: 194946 - protein, 103 aa, Triticum aestivum
  unsure (1)..(103): unsure at all Xaa locations
  Clone ID: PAT_TA_89364.pep
XNGSGLMAICVWGKXKSGHSXGKLTIFKSCSIGSHKTYSPLXKLVTSIGSFGWQATQSFCAKLXXRGVKXFXCLXKSHIXELCASKFQSTIKCDAADLKNNRP

SEQ ID NO: 194947 - protein, 167 aa, Triticum aestivum
  unsure (1)..(167): unsure at all Xaa locations
  Clone ID: PAT_TA_89365.pep
MAPTVMASSATSVAPFQGLKSTAGLPVSRRSNGASLGSVSNGGRIRCMQVWPIEGIKKFETLSYLPPLSTEALLKQVDYLIRFKWVPCLEFSKVGFIFREHNAXPGYYNGRYWXTMWKLPMFGMHRPTQVIXQVEEVKKEYXDAYVRIIGFDNIVRCMRQLIASSNG

SEQ ID NO: 194948 - protein, 173 aa, Triticum aestivum
  unsure (1)..(173): unsure at all Xaa locations
  Clone ID: PAT_TA_89366.pep
XGVXKRXGGSFPGXXXPFGSAGCFXGEAGTFXWXXGRXLLLXLLEXXVFLKAXAFLCXCLGKXGGAXAFLGALGLPGLGRSCXAWGSFVSXRLSGCRGAFLLGXXKPWTGQAPWTRLPPGAGXFXRLSWPPWAATGVSTAGAFLRQRGRRVLDISGGHXRRGCKKMPGVEEGG

SEQ ID NO: 194949 - protein, 96 aa, Triticum aestivum
  unsure (1)..(96): unsure at all Xaa locations
  Clone ID: PAT_TA_89367.pep
CEVEWCTACMRLVMNMVAGDLLMRRVSVPEAAQPGTEQCLIRSRISCSASPFRLSTHLMRLLAGFIFPSIQLLYRAQYNTGSHIHMPPDGCDFXIS

SEQ ID NO: 194950 - protein, 160 aa, Triticum aestivum
  unsure (1)..(160): unsure at all Xaa locations
  Clone ID: PAT_TA_89368.pep
LRAAPQAASLRSFSLRSAPAVPRLLAVAASTRVSCSAPSKPGSKGGPSVGAMGVEEEQDVQQPDGGGKPVAATAKPPPPESDQQKPSNPRVSTCSTDKDDGSLSAGCATAWSLTQXRICIGFPKHCAAFSRPLCLKTDKGPSNEPPSLHNKNGLISKFSV

SEQ ID NO: 194951 - protein, 57 aa, Triticum aestivum
  unsure (1)..(57): unsure at all Xaa locations
  Clone ID: PAT_TA_89369.pep
LXQYTWXKQLETWXKASGIXGGPKNEAPTXISRMQYRKXFRKAMSKYFLTVPDQWTS

SEQ ID NO: 194952 - protein, 70 aa, Triticum aestivum
  unsure (1)..(70): unsure at all Xaa locations
  Clone ID: PAT_TA_89370.pep
MAMAXQASAXXRHLIXAVWSPXAKPXPATLAMXSSARGPAPLCAADSXXRDXXGEXSGXXPAGFVQPQLX

SEQ ID NO: 194953 - protein, 138 aa, Triticum aestivum
  unsure (1)..(138): unsure at all Xaa locations
  Clone ID: PAT_TA_89371.pep
EDAAGATAHCNFSPTRPPPRPTPAAAGISRICALAFALTADRRAVAGLAARKEGEGPKEDMDPPSPIRPPSAHPPSIRASSLRHRSTLHIGNSSXRPSVNLGSRRVFSSXSIXNNCIEFCSILVTVXSERNLVYCCTC

SEQ ID NO: 194954 - protein, 88 aa, Triticum aestivum
  unsure (1)..(88): unsure at all Xaa locations
  Clone ID: PAT_TA_89372.pep
MGGLSMEHPWAFAFGLLGNVISFSSLLXAPIPTFYRIFKSKSTEGFKSVPYVWAFXAXXWIFYHWVKTVRAPHSINLPVRHQDVKSCT

SEQ ID NO: 194955 - protein, 68 aa, Triticum aestivum
  unsure (1)..(68): unsure at all Xaa locations
  Clone ID: PAT_TA_89373.pep
LITFFSXYXSHLLFHPFLLEHTYCXPXSSSPSALLQTASAHVCKQVLAFATSEAKRERERWLGTHLRT

SEQ ID NO: 194956 - protein, 122 aa, Triticum aestivum
  unsure (1)..(122): unsure at all Xaa locations
  Clone ID: PAT_TA_89374.pep
IRRRVASSSPFPFRLIAHLLSPTPSAILEIDFLKPLIAGSGXKEEARRYYEDYVVNSHGICDKSVVLLLSHKENDPEKKVTSLHTGYHFCIWGEIMLYHDDVSIYFEFEDSCMLKRIFLKNK

SEQ ID NO: 194957 - protein, 133 aa, Triticum aestivum
  unsure (1)..(133): unsure at all Xaa locations
  Clone ID: PAT_TA_89375.pep
MAPKAEKXPAXKKPVEEEPAAXKAEKTPAGKKPKAEKXXPAGKXXAAAKDGGXAXKKAKNSVETXKIYIFKVXKQVQPDIGISSKAMFIKNSFINDIFHKLAXGKALNLXKYNKIPTXTSPEIQXFLRLVLPG

SEQ ID NO: 194958 - protein, 107 aa, Triticum aestivum
  unsure (1)..(107): unsure at all Xaa locations
  Clone ID: PAT_TA_89376.pep
MHRLLRAAAAAAAGLATATTRRHRAPSWGAAAARWFSVEREAMSYDVVIVGAGPAGLAAAIRLKQLCRAXDNDLSVCXLQKGAEVVXVLSGNVFEXPRALDNSTRSE

SEQ ID NO: 194959 - protein, 140 aa, Triticum aestivum
  unsure (1)..(140): unsure at all Xaa locations
  Clone ID: PAT_TA_89377.pep
ARRILLPRRLKMQIFVKTLTGKTITLEVESSDTIDNVKAKIQDKEGIPPDQQRLIFAGKQLEDGRTLADYNIQKESTLHLVLRLRGGMQXFVKTXTGQDHHLEVEXSDTXDNVKGKIQDKEGIXSGQQRLXXXGKQLEDG

SEQ ID NO: 194960 - protein, 85 aa, Triticum aestivum
  Clone ID: PAT_TA_89378.pep
LEILCDVLLPPLGVYLRHGCYSTRFWISVPCTVLGYFACLFFVTAPFMGYLHDYLALLGALVLLCNCNKGCYCTNCSPSLSPPLR

SEQ ID NO: 194961 - protein, 103 aa, Triticum aestivum
  Clone ID: PAT_TA_89379.pep
RNPLLHDPDANNCRDWASLGEGPAGLIADFVLANDVADYVRFRAVCGPWRRCCTDPRGHGALDRRFHPRRWVMLREKSAYARRFLNVSTGECIQTEILGLRRA

SEQ ID NO: 194962 - protein, 148 aa, Triticum aestivum
  unsure (1)..(148): unsure at all Xaa locations
  Clone ID: PAT_TA_89380.pep
MAPTVMASSATSVAPFQGLKSTAGLPVSRRSNGASLGSVSNGGRIRCMQVWPIEGIKXFETLSYLPPLSTEXLLKQVDYLIPSXWVPCLRFNKLGSXSRXEXNASPGXYYDGRYXAMLELLXFRXXRXXKVXNKVEEVKKXYLTSWQK

SEQ ID NO: 194963 - protein, 84 aa, Triticum aestivum
  Clone ID: PAT_TA_89381.pep
KGKAFQYKKWMKARRRRILLGSGCHGRRMPRPLCWRLDRRNRGREGLGQRVGRLVVDSLLAVRREVWCEGERCHCDGDAGVICL

SEQ ID NO: 194964 - protein, 113 aa, Triticum aestivum
  unsure (1)..(113): unsure at all Xaa locations
  Clone ID: PAT_TA_89382.pep
CVQXPXPAXFFEPHXLSRPNXAXRDSXGFPXSXVLGEEAVGAPRWCCRPRRRRRWRASAASRRWRGGATGAPAQRVRGGGWRERSRRWTGARGGARAAHGGGGSAPSCRSRLE

SEQ ID NO: 194965 - protein, 128 aa, Triticum aestivum
  unsure (1)..(128): unsure at all Xaa locations
  Clone ID: PAT_TA_89383.pep
GRVXSMACINTLXSCSMFKGAKAEAXXGKXTGAGXFGCRASTFMDGSGLRLGLDXEPRRHHLRXVARELSLLKLRXPPXLPPXPSKQAXSSSHLPTLPIXQRGRPXRGMSTPXXWQKXSKRWWRLKAF

SEQ ID NO: 194966 - protein, 106 aa, Triticum aestivum
  unsure (1)..(106): unsure at all Xaa locations
  Clone ID: PAT_TA_89384.pep
PXSPXPXVGPSPCGPFXHWPRPAKPAGSADRDPGGDGSESAAGWGIXWWKRASERVVGTGHGRRLRVRRGRALGLGFGLGIPLPSPWPLGGGCGRRRVTCRARPLI

SEQ ID NO: 194967 - protein, 126 aa, Triticum aestivum
  unsure (1)..(126): unsure at all Xaa locations
  Clone ID: PAT_TA_89385.pep
MADQLTDDQIAEFKEAFSLFDKDGDGCITTKELGTVMRSLGQXNPTEAXLQDISMEXDAXDGNGTIXSQXXLNLMXARKLKGXDQXEXSRGLKGXXXRDKGLISXXXPHMSXKLGGKLXHEGTNIR

SEQ ID NO: 194968 - protein, 66 aa, Triticum aestivum
  unsure (1)..(66): unsure at all Xaa locations
  Clone ID: PAT_TA_89386.pep
MPAGXGLRSRXRXLFARPFRKKGYIPLTTYLXTYXVXEHVXVKVNGAVHKGMPHXFXHXRTGRXWR

SEQ ID NO: 194969 - protein, 89 aa, Triticum aestivum
  unsure (1)..(89): unsure at all Xaa locations
  Clone ID: PAT_TA_89387.pep
ISPXPRWXVKLGPTCRSRHQGTGDAFRRHRHLNESGHDEASTASSCKTGGRHRRNHVVIDLRCLTCPTLCMCVYVCTYPARIYVCMYMY

SEQ ID NO: 194970 - protein, 122 aa, Triticum aestivum
  Clone ID: PAT_TA_89388.pep
RVYDGELWNGAYFDYDNSGSTNSKSIMADQLAGQWYARACGLEPIIEEEKARSALATVLDYNVMRDHGGGHGVGDPGPHLPGLYRGRVHGAVRPHPVHAHRAALHLVPNSARASLFFFFFSL

SEQ ID NO: 194971 - protein, 170 aa, Triticum aestivum
  unsure (1)..(170): unsure at all Xaa locations
  Clone ID: PAT_TA_89389.pep
AKATLSLPPSLSRPPVSAHLLRLRRRRTHRGSSDSPDQERRAGRKSTYAGGEEMGLTFTKLFSRLFAKKEMRILMVGLDAAGKTTILYKLKLGEIVTTIPTMGFXVETVEYKNISFTVWDVXGQXDKIRPLVEDYFXXHTXSHLLLLDNNDKXRVVKQGMXLHRMLNRMT

SEQ ID NO: 194972 - protein, 164 aa, Triticum aestivum
  Clone ID: PAT_TA_89390.pep
REISAQFHARPCAALRRSSVCTTTRPPRSSSKGRHRGHPRRRPARRDGRRAVADRGRLPARRGAHGRPPRGPERPGLPRRAMLRHCPRLQHGHPHAAAPRRGRRERGRGASARRRRAAGPPAPAQHGGSSRRQPASRGNRDRLQERSTCWRCASATAVARCPGT

SEQ ID NO: 194973 - protein, 58 aa, Triticum aestivum
  Clone ID: PAT_TA_89391.pep
SLSERCSYFTLVPSPFRQGGRRRTRTPLARSPPAVAVAFFFFGLIFLIPKVNAWVPFS

SEQ ID NO: 194974 - protein, 134 aa, Triticum aestivum
  unsure (1)..(134): unsure at all Xaa locations
  Clone ID: PAT_TA_89392.pep
MASTFSGDETAPFFGFLGAAAALVFSCMGAAYGTAKXSGVGVASMGVMRPELGDXKSIVPVVMAGVLGIYGLIIXAVIISTGIKPKAXPIPLPRYAHXSSXLACGXXGLAAGMGIGSSGXPGSRAXAQQPTFVX

SEQ ID NO: 194975 - protein, 102 aa, Triticum aestivum
  Clone ID: PAT_TA_89393.pep
KKIIAITAMMLATAFIVAAEQEAGACIVETSDVPGAANPCICSENCACAGKCILNAGDGAGDVQTCFVECVLKNGCGGCPVPWTRPLPATLDQDPEPESDKA

SEQ ID NO: 194976 - protein, 177 aa, Triticum aestivum
  unsure (1)..(177): unsure at all Xaa locations
  Clone ID: PAT_TA_89394.pep
RPPVSAHLLRLRRRRTHRGSSDSPDQERRAGRKSTYAGGEEMGLTFTKLFSRLFAKKEMRILMVGLDAAGKTTILYKLKLGEIVTTIPTIGFNVETVXEYKNMSFTVWXDVGGQDKIRPLWXRHYFQXNTQGLIFVXVDSNDRDRVVEXARDEXHXMLNEDXLRDAVLLVFANNKSP

SEQ ID NO: 194977 - protein, 117 aa, Triticum aestivum
  unsure (1)..(117): unsure at all Xaa locations
  Clone ID: PAT_TA_89395.pep
AGDTLTEGQVLAVSDKLVSTNGKFALGFFQLAASTVSKSENSTGSSWYLGIWFNKIPIFTVVWVANREKPIXPPQHELNKLKFSSDGQLVIVTSRADAVTESLVWXSTHIVNRTQSK

SEQ ID NO: 194978 - protein, 82 aa, Triticum aestivum
  unsure (1)..(82): unsure at all Xaa locations
  Clone ID: PAT_TA_89396.pep
PVWXCSKVREXWYCYKXFFGKIVCVPLKRSQWDHWWYYRGAGYESPDKXSQLSLNPGGKYILAGSGIVXLPESRRDAAVIWS

SEQ ID NO: 194979 - protein, 145 aa, Triticum aestivum
  unsure (1)..(145): unsure at all Xaa locations
  Clone ID: PAT_TA_89397.pep
MQIFVKTLTGKTITLEVESSDTIDNVKAKIQDXEGIPPDQXRLIFAGKQLEDGRTLADYNIQKESTLHLVLRLRGGAKKRXKKTYTKPKIQKHXHXKVXLAVLQFYKVXDATGKVTKXLRMSAPNAECGAGTSRATLQRHTGGSG

SEQ ID NO: 194980 - protein, 147 aa, Triticum aestivum
  unsure (1)..(147): unsure at all Xaa locations
  Clone ID: PAT_TA_89398.pep
MQIFVKTLTGKTITLEVESSDTIDNVKAKIQDKEGIPPXDQQRLIFAGKQLEDGXRTLADYNIQKXESTSNFVLRSXGGMQFSVKTLTGKDYHPXRVESLTPSDNVKGKIQDKEGFPPDKXRLIFAXXKQLEDGPNLADYNIQKDQP

SEQ ID NO: 194981 - protein, 51 aa, Triticum aestivum
  Clone ID: PAT_TA_89399.pep
NFARTSGTQTSYLLVFFEFTVYQEQMNIQHINKAALKYQSYREVRKSEATK

SEQ ID NO: 194982 - protein, 148 aa, Triticum aestivum
  unsure (1)..(148): unsure at all Xaa locations
  Clone ID: PAT_TA_89400.pep
AVLRLVKSLGAKVVVSVDRGCDRTELPFAAHLFQAFQSTVFLLESVDAVGTDPDTAGKIERFLVQPAVEQCVVGRHRASIEKAPLPWRAVFASAGFTPVQAXXFAESQAESLLHKVPVRGFRVEKRAPGXLCLYWQRAELVSVSAWRC

SEQ ID NO: 194983 - protein, 118 aa, Triticum aestivum
  Clone ID: PAT_TA_89401.pep
SRLRSSLLSAATPRTLAVPSCICPPPPSWSVPSPSSSHELAEEKRGDATTWSSAGGEPRRGGGGDDPRWAKIWTGCLCPASSLPPRPCSPLTSPSASLHKWCRHVQDQFKRQESTTRA

SEQ ID NO: 194984 - protein, 128 aa, Triticum aestivum
  unsure (1)..(128): unsure at all Xaa locations
  Clone ID: PAT_TA_89402.pep
LELVEVQSAKSMDCTRELGCWQQXAXRRPRPSSLPGQVPWGGWVVAGILAGGGARVVALLACRLAENRSHLLWALRDQVAARGRTKSAVSSVQGSVVDRGQQLGDWTLLDPSRASWAATVNTSVAPSF

SEQ ID NO: 194985 - protein, 84 aa, Triticum aestivum
  unsure (1)..(84): unsure at all Xaa locations
  Clone ID: PAT_TA_89403.pep
TRRSRARGQKRLKSQSLDEDEKIWWPATRRRHATRGRRPAAQQHHTRLDRRQTDDILTQRTMCLLMIXVHGLIDXXLQSQVHTP

SEQ ID NO: 194986 - protein, 71 aa, Triticum aestivum
  unsure (1)..(71): unsure at all Xaa locations
  Clone ID: PAT_TA_89404.pep
PXIPQPQCALHRPKRPKPVTTSTMAYFDGIGQSKRPNITLCHIQTAPSPVPSQKGMLAPSVTGRNHPNPEW

SEQ ID NO: 194987 - protein, 99 aa, Triticum aestivum
  Clone ID: PAT_TA_89405.pep
ILWYIRCYRVNYQFTLHDTLIFFVFVSILFMVEKWFLHHFVDVKLKHFCMPIEYMLVQPIFQITFLYCAAYYSFFLQGNNTKAPHEYLSVQLIFHFCIL

SEQ ID NO: 194988 - protein, 147 aa, Triticum aestivum
  Clone ID: PAT_TA_89406.pep
DFMQKLETDNSWAQDERKATAWAILENIDSKGIFHCPERFDMPDKLAEHTSQCKFRILNCTNDGCVASFCAIHTEKHDAVCPFKLLPCEQLCEQHVMRSEMDKHCGTVCPMKLTNCPFFRIGCETAFHSVLLITIVRGSTNPFYVAR

SEQ ID NO: 194989 - protein, 170 aa, Triticum aestivum
  unsure (1)..(170): unsure at all Xaa locations
  Clone ID: PAT_TA_89407.pep
CLSAGQGNVSNGKDPINTVDKINEASYEIDKQISELTCGRTMKAGEAAGTTECKSNKICVEHYGSSENAEPMLDDSQGVGNSELSCNGGSKDEGSLIGTSQVEVDSMTQIQKMPPSDVSRDIKQQGNGMLVHPVSMEQEQHSSTLRKFKSLXGMRRKDGFGVIHESNWLT

SEQ ID NO: 194990 - protein, 158 aa, Triticum aestivum
  unsure (1)..(158): unsure at all Xaa locations
  Clone ID: PAT_TA_89408.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITYDGYVKLLTXSGXTKDDLKLPTDDFCLXQIKXGFADGKDLIXVCDVAMGEEXXCAXKEIR

SEQ ID NO: 194991 - protein, 92 aa, Triticum aestivum
  Clone ID: PAT_TA_89409.pep
PHLTFLNVLVDPKSIAPVTVGSIVLSLSGFISLSRQNLQFLSFQIYQTHRIVLYSFRMLAVGCNNCPKRSKLLFCRPRGGACGWRHRRCRRP

SEQ ID NO: 194992 - protein, 71 aa, Triticum aestivum
  unsure (1)..(71): unsure at all Xaa locations
  Clone ID: PAT_TA_89410.pep
XIVEMLMXLPSQXRRLLVMMTTMFPLLKGFPRQIIXPEGKNDPTQLPLQDGYASSRKSSPSFFLSQNDTYT

SEQ ID NO: 194993 - protein, 125 aa, Triticum aestivum
  unsure (1)..(125): unsure at all Xaa locations
  Clone ID: PAT_TA_89411.pep
GLPSECVLYYRPGDVPRQSSMVFYENCGLQNLYDIARYCQSKKNCRRGAFFQHFGEAVQECNVSXGMCDNCVSSIELKDIDATYHTKITVSLLQEMQQNDQRATLLQLVDKFKTKWKHXVVQMKX

SEQ ID NO: 194994 - protein, 114 aa, Triticum aestivum
  unsure (1)..(114): unsure at all Xaa locations
  Clone ID: PAT_TA_89412.pep
MXPVKLYXATLSWNVTRCVAALEEXGVXYELVPINFGTGEHKXPDHLARNPFGHVXXLQDGDLYLFESRAICKXACRKSKPXXLXXGDIKESAMVDXWLEVXXHQYXAALSPPR

SEQ ID NO: 194995 - protein, 97 aa, Triticum aestivum
  Clone ID: PAT_TA_89413.pep
YRISHLTRGCGGPRRPSRAASFQCAILFRSVAAPLRSAFAAPPYGPNQLWNFWSLVPGRLWGSTDSVTKARLVRRCAVTRSISSDSRPGRQRITLLA

SEQ ID NO: 194996 - protein, 111 aa, Triticum aestivum
  unsure (1)..(111): unsure at all Xaa locations
  Clone ID: PAT_TA_89414.pep
ASAGXHXWXXPPLXEIXGXDSVLQXGGGTLGXXWGNAPGAAANRVALEACXQARNEGRDXAREGNEXTRAACKWSPELAAXCEXWXXXKFXFEPXDTIAKXIKLKIKKRRY

SEQ ID NO: 194997 - protein, 61 aa, Triticum aestivum
  unsure (1)..(61): unsure at all Xaa locations
  Clone ID: PAT_TA_89415.pep
CHFPLEDITAGGFVQTXQSINQKXNISRVKQTAXHNHIXMYTLASTTXGLLDPSAAVXRFS

SEQ ID NO: 194998 - protein, 152 aa, Triticum aestivum
  unsure (1)..(152): unsure at all Xaa locations
  Clone ID: PAT_TA_89416.pep
XGEXWEISSHERXVCSVPDTCVCXSCXGYPAHPSSWTRVGSGGAPGSSTSQAASQSXCAVARSCRRQRRVRXAGEHRGARGVVTAVRDMTAARRKIRGSCGLLRTRSGELREGVEMFDCVLDQVFDEVIRGRNEMLGIFRDKVLTKLNRGEF

SEQ ID NO: 194999 - protein, 85 aa, Triticum aestivum
  unsure (1)..(85): unsure at all Xaa locations
  Clone ID: PAT_TA_89417.pep
DDXXXXRXWPFXXXIGWRIXSXXEXXTNPNXAGTAXXXVSDDPXSTMKSPXLEKXFWRXWSXGWPRVRLXHEAAVXDVRHAFXFP

SEQ ID NO: 195000 - protein, 91 aa, Triticum aestivum
  unsure (1)..(91): unsure at all Xaa locations
  Clone ID: PAT_TA_89418.pep
MGSXSXSLDGLLLXDVLCLQLXVHSRAQLRVGFYNTXCPNXXAIVRQDVTADFATNSGVAAGLIXLHFHHCFXXGCDSSVLLSVKAASGAR

SEQ ID NO: 195001 - protein, 136 aa, Triticum aestivum
  unsure (1)..(136): unsure at all Xaa locations
  Clone ID: PAT_TA_89419.pep
STAISPLLSPLLSPMHRMAHFPLLPALALAVTCALVPFTVADPQATQLNLGCSQYNATPTAAFLAALNSTFAELRANLSAGSGFATAAEPRAAAPAFALAQCRPYVTGRDASPASTPPRRASXRXGGXKGGPXXXG

SEQ ID NO: 195002 - protein, 52 aa, Triticum aestivum
  unsure (1)..(52): unsure at all Xaa locations
  Clone ID: PAT_TA_89420.pep
SXAISPLLSPLLSPRHRXXHFPLLXALSLAVXXALVPFTVAEXQAXQLNLGV

SEQ ID NO: 195003 - protein, 57 aa, Triticum aestivum
  unsure (1)..(57): unsure at all Xaa locations
  Clone ID: PAT_TA_89421.pep
TXRSLXTXFIPEVIXKDIXNATSGIFPLQNLYVRXVXILMAPKXXXGXXMXGYGDYK

SEQ ID NO: 195004 - protein, 61 aa, Triticum aestivum
  unsure (1)..(61): unsure at all Xaa locations
  Clone ID: PAT_TA_89422.pep
GACCVISRSAWSGFGGCRDWDSVNLLLGFTPSTIWKSSFPANVILVGIYGAERCSAVTRIX

SEQ ID NO: 195005 - protein, 118 aa, Triticum aestivum
  unsure (1)..(118): unsure at all Xaa locations
  Clone ID: PAT_TA_89423.pep
LAHALLDHSNSRFILLSESHVPLFDFPTVYSYLTNSTKVYMESYDEPGGTGRGRYKRGMAPTITPWQWRKGXQWFEMDRALAIDIVADNVYFPVFKNXCKRNCYTDEHYIPTSSTSAT

SEQ ID NO: 195006 - protein, 38 aa, Triticum aestivum
  unsure (1)..(38): unsure at all Xaa locations
  Clone ID: PAT_TA_89424.pep
GVXGXIXGGEXVVMNXFYNXXCIIIELQWCLFHVTIWS

SEQ ID NO: 195007 - protein, 66 aa, Triticum aestivum
  unsure (1)..(66): unsure at all Xaa locations
  Clone ID: PAT_TA_89425.pep
PPFWGGXXFXGXLGIRLCIDAXSIVNPFRWXFLVEMELDGLIWRSVWHYTSEGRASLYYSNTNLIR

SEQ ID NO: 195008 - protein, 64 aa, Triticum aestivum
  unsure (1)..(64): unsure at all Xaa locations
  Clone ID: PAT_TA_89426.pep
SRVFFFFFFFFFFFFFFFFFLXLXIXTYXDSCVXXNXXVXYKQVLQQKXGEPWXGTLDEXGXXG

SEQ ID NO: 195009 - protein, 68 aa, Triticum aestivum
  unsure (1)..(68): unsure at all Xaa locations
  Clone ID: PAT_TA_89427.pep
GXGLLGGGXAPEDEERVAGXXAEXXVGGRERGGGGESTDKLEVVVRLGGGGGAAEETGEEEVPHRGER

SEQ ID NO: 195010 - protein, 117 aa, Triticum aestivum
  unsure (1)..(117): unsure at all Xaa locations
  Clone ID: PAT_TA_89428.pep
AKTSEPVMAGSSSPHPNPLPTPAVPSQSLTPTPPTLGADGAVGAEEEAQGEPPEERGGHGQDLREAPLHGGAAAGQPPRPPGSRXLRRLHRCXXRXGXFXDPRXCPSNYXXXXFGDN

SEQ ID NO: 195011 - protein, 103 aa, Triticum aestivum
  unsure (1)..(103): unsure at all Xaa locations
  Clone ID: PAT_TA_89429.pep
QACLWSLALSPRLPSPRGHNTYQTNTSLSYQLHPSLANHSLLPPPPPLRLLRCSWPRAQTRSAWTWTRXSSXXXSSXARRXXXWLXRRXVLAXXGXARGGXFR

SEQ ID NO: 195012 - protein, 114 aa, Triticum aestivum
  unsure (1)..(114): unsure at all Xaa locations
  Clone ID: PAT_TA_89430.pep
ERGRDVSSVLDQYGRFVKPAFDDFVLPSKKYADVIIPRGGDNHVAIDLIVQHIRTKLGMHDLCKVFRNVFVVQSTFQIRGMHXLIRDXDITTPDXALXNXIXXWDXXWLAHFPF

SEQ ID NO: 195013 - protein, 145 aa, Triticum aestivum
  Clone ID: PAT_TA_89431.pep
IRASPPRSARPPWSAVFSSAGAALGRRRPMPWSPPSRTTWHGHLPASPASGPLCNQICKSVPRSAGLHGYPSSRAPAPRAAAAPSHAMVASLQNVVPCPPPCLSRKWADAPPTYRLMEGAADSFMPRLTAPDSILCCCISTHSEI

SEQ ID NO: 195014 - protein, 69 aa, Triticum aestivum
  unsure (1)..(69): unsure at all Xaa locations
  Clone ID: PAT_TA_89432.pep
XSXSIAAPKMSSCAMKWPIRNXGAGTPXNXPPSSXTXSXLTSNRTPGGVSSRPXGXXLXSAXSXCXXLT

SEQ ID NO: 195015 - protein, 84 aa, Triticum aestivum
  Clone ID: PAT_TA_89433.pep
PPCSYIVTKDYGHLDMLDNNASKLMTCVCKDGGGCKDKMRRCVSGIMVAFLNATIGEKHGDLEAILRDPTVAPATLDPVEHRLA

SEQ ID NO: 195016 - protein, 104 aa, Triticum aestivum
  unsure (1)..(104): unsure at all Xaa locations
  Clone ID: PAT_TA_89434.pep
MATTAMALSPSSFAGKAVKDLPSSALFGEARVTMRKTAXKXNPVXSGSPWYGSDRVLYLGPLSGDPPSYLTGEFPGDYGWXTAGLSADPXTSXKTGIGGFGNGA

SEQ ID NO: 195017 - protein, 58 aa, Triticum aestivum
  unsure (1)..(58): unsure at all Xaa locations
  Clone ID: PAT_TA_89435.pep
XNPPXGKXXIXXXKXXXTLFSMTIFPXXGVXATVPFVKSIFDKSGTFSVMSYPLMVWE

SEQ ID NO: 195018 - protein, 59 aa, Triticum aestivum
  unsure (1)..(59): unsure at all Xaa locations
  Clone ID: PAT_TA_89436.pep
MALLPRTARLALLSASPRTYSAAAAAGASPTPPAPYAGXPPPXAGXKXXXFVXPRVEXL

SEQ ID NO: 195019 - protein, 75 aa, Triticum aestivum
  Clone ID: PAT_TA_89437.pep
MSCNCGSGCSCGSDCKCGKMYPDLTEQGSAAAQVAAVVVLGVAPENKAGHFEVAAGQSGEGCSCGDNCKCNPCNC

SEQ ID NO: 195020 - protein, 123 aa, Triticum aestivum
  unsure (1)..(123): unsure at all Xaa locations
  Clone ID: PAT_TA_89438.pep
MVKFLKPGKAVILLQGRYAGKKAVIVRVFEEGTRDRPYGHCLVAGLAKYPKKVIRKDSAXKTAXXSRXKVFLXLVXFTHLXPTRYTLXXXLKEVAPARRLLTPVAPQGAATRGARRECSHLKR

SEQ ID NO: 195021 - protein, 128 aa, Triticum aestivum
  Clone ID: PAT_TA_89439.pep
GPETGGTRDVQEGRDSVVRENLHVTAQESSDKGSSAPAESSHVIAHPGSRRRVVPMKDDASGEVPVAFVVPSSDSADMTEDEIKQYVAKQVVFYKRLQKVFFVSPIPKAPSGKILRKDLRAKLAVGSC

SEQ ID NO: 195022 - protein, 75 aa, Triticum aestivum; identical to SEQ ID NO: 106874
  Clone ID: PAT_TA_89440.pep

SEQ ID NO: 195023 - protein, 152 aa, Triticum aestivum
  unsure (1)..(152): unsure at all Xaa locations
  Clone ID: PAT_TA_89441.pep
MSPQTETKAGVGFKAGVKDYKLTYYTPEYETKDTDILAAFRVSPQPGVPPEEAGAAVAAESSTGTWTTVWTDGLTSLDRYKGXCYXIXPVAGEDXQWXCYVAYPLDLFEEGSVXNXFTSIXVTYLVQSLRAYVWGSXXPYLSKLPSPPHGIN

SEQ ID NO: 195024 - protein, 140 aa, Triticum aestivum
  unsure (1)..(140): unsure at all Xaa locations
  Clone ID: PAT_TA_89442.pep
IXXFPIXXPSXSTRXEXSCPGAXSQVVEDCRNLEPGRTRVXRTSTPGPXLQRPXTXVISRXEEALEEVSRALMDRLDHGAAGSGTEWGRPPGSRAGETSRTAGAASPGLVGWGRAWELGDGEQGRGGRRRDETGWRTNLG

SEQ ID NO: 195025 - protein, 58 aa, Triticum aestivum
  unsure (1)..(58): unsure at all Xaa locations
  Clone ID: PAT_TA_89443.pep
EIXQFXKCEXNPMXXXSWXXRXRRSXRYPNXXCXTSSPNTYLNPXERNWTRTGNRGXX

SEQ ID NO: 195026 - protein, 59 aa, Triticum aestivum
  unsure (1)..(59): unsure at all Xaa locations
  Clone ID: PAT_TA_89444.pep
LXCPWVXXDXSQXTTGXFXDCNSNXLVAVPGSLVLHLSGCYVSXXXPXXKSHLXXIFXG

SEQ ID NO: 195027 - protein, 84 aa, Triticum aestivum
  unsure (1)..(84): unsure at all Xaa locations
  Clone ID: PAT_TA_89445.pep
ARPITRXKXKYMQCSPVVPSTAMAPSSLVGSPMSVNARLWSLAXXPAXXHLEXVAAVQVILPXPVAXPRSCSAXRARXGASPXN

SEQ ID NO: 195028 - protein, 93 aa, Triticum aestivum
  unsure (1)..(93): unsure at all Xaa locations
  Clone ID: PAT_TA_89446.pep
SPPRSATARAPIPAPSSAGRGISTCADRGVGGGGGGGGGGGGGCXRHGCAAGXGXGRLXLXHQXXPHXGQRCWKSCLLLRXSDGXSLRSFXXT

SEQ ID NO: 195029 - protein, 68 aa, Triticum aestivum
  unsure (1)..(68): unsure at all Xaa locations
  Clone ID: PAT_TA_89447.pep
FRSMSGIPXPXXWXTLARSGRSPTALMWLDGTCLDCATRSLRRGFAAIAGAMLLSRNDTMCAYVLPGC

SEQ ID NO: 195030 - protein, 66 aa, Triticum aestivum
  unsure (1)..(66): unsure at all Xaa locations
  Clone ID: PAT_TA_89448.pep
LEFFFFFFFFFYXXXHIHXIYXAXLXIRHQHXYIXIXCLTLFXXXEGFHKXNVXIXNXNXXRXGTK

SEQ ID NO: 195031 - protein, 98 aa, Triticum aestivum
  unsure (1)..(98): unsure at all Xaa locations
  Clone ID: PAT_TA_89449.pep
FSGFTGSMETVLKVLKDGLSTLHVPYPYGFAIILLTVLIKGATFPLTKKQVESALAMRSLQPQVXAIXERHAGDQERIXLETAHLIIVALINGGQVTS

SEQ ID NO: 195032 - protein, 87 aa, Triticum aestivum
  unsure (1)..(87): unsure at all Xaa locations
  Clone ID: PAT_TA_89450.pep
RIPPTPTVSPPPPQLDKKKRESRTRWECSRSVSGEGEFLRSESEQAGALGIGGYHTFFPXXFSXCSKWVKGVAKILPVLFPXXNPPR

SEQ ID NO: 195033 - protein, 100 aa, Triticum aestivum
  unsure (1)..(100): unsure at all Xaa locations
  Clone ID: PAT_TA_89451.pep
ALASSAVGAYLHIALNIGGMLTMLACVGTIAWMFSVPVYEERKRFGLLMXEXPLXGASXXPXIXGAIXFDPCXLXXGFVXNXXLFGXFXGPPGLYGPPPG

SEQ ID NO: 195034 - protein, 111 aa, Triticum aestivum
  unsure (1)..(111): unsure at all Xaa locations
  Clone ID: PAT_TA_89452.pep
QAPTAEPHGAGAADDQAGAGAPPAVVPGKEFTRTCKGLVVVLIGGYVLLQLLPSSXNYFXIIXAKTIPXVWTVFTAGYIEHXLXGAIGXPLXLXXXGKVLXPIWGXKXFLX

SEQ ID NO: 195035 - protein, 162 aa, Triticum aestivum
  unsure (1)..(162): unsure at all Xaa locations
  Clone ID: PAT_TA_89453.pep
LSDIDKLKTEVIGLKGRIDKKSAYLQELQDQYAGLQNLVERNEQLYGSGDAPSGGVALPFILVQTRPHATVEVEISEDMQLVHFDFNXTPFELHDDSFVLKAMGFSGKEETDGTVALVANAVECSSASNVYGRRSXHPAGXMELATNSPPIPWILKGVQHNT

SEQ ID NO: 195036 - protein, 106 aa, Triticum aestivum
  unsure (1)..(106): unsure at all Xaa locations
  Clone ID: PAT_TA_89454.pep
FFLCVASCIVTISFRTTGFIAKAHEICVALVMVITTLLMTIVMLLVWKVNIWWIAAFFVVFMSTEXVYLSAVLYKFTQGPYFPLEMSXVXMXXMXVXTTAKGVHKV

SEQ ID NO: 195037 - protein, 120 aa, Triticum aestivum
  Clone ID: PAT_TA_89455.pep
DQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVGGLFEAE

SEQ ID NO: 195038 - protein, 101 aa, Triticum aestivum
  unsure (1)..(101): unsure at all Xaa locations
  Clone ID: PAT_TA_89456.pep
MARGLKKHLKRLNAPSHWMLDKLGGAFAPKPSSGPHKARECLPLILILRNRLKYALTYREVQSILMQRHIMVDGKVRTDKTYLLGSWTSFHPKTGENYXLL

SEQ ID NO: 195039 - protein, 116 aa, Triticum aestivum
  Clone ID: PAT_TA_89457.pep
MQCSLQLKSHPSAVLALLVRDGWSTLFCSLLVYGFWSLGLNCRFLWSHLAERQDGSGTLLCVSSSMTYAMMLCMLHSTVPVAGRCTAIVWPTSDGDAVNVKYELCRFRMVFCQMNM

SEQ ID NO: 195040 - protein, 89 aa, Triticum aestivum; identical to SEQ ID NO: 117638
  Clone ID: PAT_TA_89458.pep

SEQ ID NO: 195041 - protein, 139 aa, Triticum aestivum
  Clone ID: PAT_TA_89459.pep
EVLAAVSTAARRGNAPVCGQLAARARAIGKESDRNRRCLAAAGAARQLSSAFQSLAGEPVEGTSAAVLVALGKILAALTVFFPLDDEARRCIASPASLKTLVSVLSHGDLAARASAAIVASSPPPTTPTYLETACEGAR

SEQ ID NO: 195042 - protein, 87 aa, Triticum aestivum
  Clone ID: PAT_TA_89460.pep
LGMNIWRVETSCVYIHAGTNQVSGPTSAARPLDSPHTIDVDRHSVHAYACPPAAPSYAPINGLAHVHDKVLHISTRHLILLLTSCST

SEQ ID NO: 195043 - protein, 43 aa, Triticum aestivum
  unsure (1)..(43): unsure at all Xaa locations
  Clone ID: PAT_TA_89461.pep
LCSXQKPXHPCSFRKEVLALLCSDLGPSSSRIVQRNLQIXLGX

SEQ ID NO: 195044 - protein, 115 aa, Triticum aestivum
  Clone ID: PAT_TA_89462.pep
KKVKRAVEFTAEDDDFLEEFRQGMAGLRGMAEEVRQSSSKMGAFGKYLFSPDIHDADEYSPSFPEGIESVKRKLSRNDESWVVNTWAYEEKAVALNACLNAYNADLIQMKAYPWL

SEQ ID NO: 195045 - protein, 125 aa, Triticum aestivum
  unsure (1)..(125): unsure at all Xaa locations
  Clone ID: PAT_TA_89463.pep
RRLGPHRFHAHDQNHLQIRRPAESLPAVGTPETDADAASSFQERAKDILVVVSGLLFGFGCGALTAASMYLVWVPRRLHRRRQPYXESTXTTKDDDGAXXPKKAVNHPGGFPGKNTRIGSSSEFG

SEQ ID NO: 195046 - protein, 96 aa, Triticum aestivum
  unsure (1)..(96): unsure at all Xaa locations
  Clone ID: PAT_TA_89464.pep
MAETEYRCFVGGLAWATDDNNLXQAFSQYGXILXAKIINDRETGRSRGFGFVTFGXEESMRQAIEEMNSXDLDGRXITVNEAQSRRSXGGGXXRRY

SEQ ID NO: 195047 - protein, 127 aa, Triticum aestivum
  unsure (1)..(127): unsure at all Xaa locations
  Clone ID: PAT_TA_89465.pep
IPHSLSPDPLRRRASSPWQPPTRRRASARWTRRRWWPTSGRPRRWPPASAAASTTSPSRRSATATSIRXISTXEARXFXFXQGFPXXAXLGXLAITKXRXNFKGXAXGKXGXCPEIPXXKFTGXXST

SEQ ID NO: 195048 - protein, 123 aa, Triticum aestivum
  unsure (1)..(123): unsure at all Xaa locations
  Clone ID: PAT_TA_89466.pep
RDGAACFLNMGSLSAGCEGAPLLPLLFVLVNMGFNISLLHLLKISSAVASCLASTFSVPLSIYAFTLPLPYIGVAXTSLPVRCKRCILNRRLLNAQLPAKKGESKNDNLHSSYPHTRWSSTCL

SEQ ID NO: 195049 - protein, 103 aa, Triticum aestivum
  unsure (1)..(103): unsure at all Xaa locations
  Clone ID: PAT_TA_89467.pep
MKGTKLAAILILQAVLVMGVLSHVNADFFPKCCNNCRSFSGVDVCDDAHPKCPKGCSACRVVSTSPEMXRCXDINQRSTDCXGPCKRVRKPEIFPKINKRTNK

SEQ ID NO: 195050 - protein, 81 aa, Triticum aestivum
  unsure (1)..(81): unsure at all Xaa locations
  Clone ID: PAT_TA_89468.pep
WVICPGDFELXRGXVERRAIMRXXEXNCXFXEXEMGDQLLXVRKDDGESVKVPCVSGVSLXCSLTVISRCKMWHEQCVLVC

SEQ ID NO: 195051 - protein, 95 aa, Triticum aestivum
  unsure (1)..(95): unsure at all Xaa locations
  Clone ID: PAT_TA_89469.pep
MSCCGGNCGCGSGCKCGNGCGGCKMYPEMDEGVTTTSQTLIMGVAPSKGTPSFXEAAAETGADNGGCKXCGPNCNLQPLQLQDSIKSKRMCNGPN

SEQ ID NO: 195052 - protein, 84 aa, Triticum aestivum
  unsure (1)..(84): unsure at all Xaa locations
  Clone ID: PAT_TA_89470.pep
LQYGKALYRTKTLSRTAQPVWNDKFEFDEIGGGEYLKVKCYNLDTFSDDSIGSARVNLEGLXDGASRDVWVPLEKVDPGXFKAP

SEQ ID NO: 195053 - protein, 63 aa, Triticum aestivum
  unsure (1)..(63): unsure at all Xaa locations
  Clone ID: PAT_TA_89471.pep
MXKQGGKAKPLKQAKVAEKDYXENDLAYLQKXKDEQKALXELKAKXGQXGALGGSGLKKSGKK

SEQ ID NO: 195054 - protein, 100 aa, Triticum aestivum
  unsure (1)..(100): unsure at all Xaa locations
  Clone ID: PAT_TA_89472.pep
PPPKIEAGSIMMNAEXRLNKNKRIGEVXPGVEVGDMFYFRIEMCLVGLNSQSMAGIDYMSAKFGNEEDPVAISIVSAGVYEDAEDDDPDVLVYSEQVKSF

SEQ ID NO: 195055 - protein, 75 aa, Triticum aestivum
  unsure (1)..(75): unsure at all Xaa locations
  Clone ID: PAT_TA_89473.pep
RSTPSKSRIQPERPVKDRASISNSQPGNASPHHDTEGPGEETMQGIVMEQEXLSDSEEESQHVXFECEEMDHSED

SEQ ID NO: 195056 - protein, 142 aa, Triticum aestivum
  unsure (1)..(142): unsure at all Xaa locations
  Clone ID: PAT_TA_89474.pep
ETGRHVRMLTHEIRSTLDRHTILKTTIVELGRTLGLEECALWMPSRSGSSLQLSHTLRHQITVGSSISINLPVINXVSSSNRTIIYRTXPLWHGSXLAGQFFHQKLAAMXNTLXKLXNXQIKDGQXXXKXYAXPELQKMQGT

SEQ ID NO: 195057 - protein, 92 aa, Triticum aestivum
  unsure (1)..(92): unsure at all Xaa locations
  Clone ID: PAT_TA_89475.pep
RVILSQACSFFLVRXRRTGGRWPGRTRGSGALGPALNGGGGGGGPDRGACHPRRHRDHQPRRHVRACLQPAEQRGLRAAGSGDLRPERGGHR

SEQ ID NO: 195058 - protein, 147 aa, Triticum aestivum
  unsure (1)..(147): unsure at all Xaa locations
  Clone ID: PAT_TA_89476.pep
VADQLXHHCGXPTPVLFCXNNPIPXWXLNPKIXMLRTVVGYIAKDGTVIHXLVVVQXDPLPXEFXRTGTLERLYHCRYPADSSFDGVGVPRTTCRPPRGSRSGAVYVPSGLRRCKHGSHVSKTCVTCIKTWFTSHSSWGCVSNSIWL

SEQ ID NO: 195059 - protein, 136 aa, Triticum aestivum
  unsure (1)..(136): unsure at all Xaa locations
  Clone ID: PAT_TA_89477.pep
WLEIVFNIVTITGGLILVTMLIGNIKVFLNATTSKKQAMHTRLRSLEWWMKRKELPQSYRHRVRQFERQRWAATRGVDESKXCATPRXLRRDIKXHXARLVRQVPSSXXGHSSXRNXRPRRSLIXPKGXNILPEGA

SEQ ID NO: 195060 - protein, 159 aa, Triticum aestivum
  unsure (1)..(159): unsure at all Xaa locations
  Clone ID: PAT_TA_89478.pep
WAPRRRRLYQVPPSSSSSRRPPSTCPPRCAAGSHRGRRKCTHRRHRPSRRRWLMQALEGMRVRRQVTTXTGGTTTGFLSAVAARCLXPQCQQAFXYPVNXQLLXRFGKPALVXXNNGDGLGXXGGQGRXPXAAGSXQRGFLSWPXXLPWALLNXXXAPG

SEQ ID NO: 195061 - protein, 102 aa, Triticum aestivum
  unsure (1)..(102): unsure at all Xaa locations
  Clone ID: PAT_TA_89479.pep
HVDAQQRLIRIAFSCLERPGGGPGGGHRARPGRRRSRGGXYPGSEEERGGEGEEPDERAPAGGGGGHGGASGGHSNAGGGGRPWRSDLRRWGYVCGMWGWAS

SEQ ID NO: 195062 - protein, 65 aa, Triticum aestivum
  unsure (1)..(65): unsure at all Xaa locations
  Clone ID: PAT_TA_89480.pep
AAAYGSRRKRRGRRVVCGVESGAAHPAGGGDGSGWVGXGGGDGGPPSSIWIGEKDLDRGGSAAKE

SEQ ID NO: 195063 - protein, 160 aa, Triticum aestivum
  unsure (1)..(160): unsure at all Xaa locations
  Clone ID: PAT_TA_89481.pep
VLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIKQRYRXAADMIKKGKMCCLLINDXDAVRSGLGGNTQXTVQQPNGXXHLXEIADAPQSSVPF

SEQ ID NO: 195064 - protein, 141 aa, Triticum aestivum
  unsure (1)..(141): unsure at all Xaa locations
  Clone ID: PAT_TA_89482.pep
MGKIKIGINGFGRIGRLVARVALQSDDVELVAVNDPFITTEYMTYMFKYDTVHXHWEXSDIKLKDDKTLLFGEKXVTVFXVXNXGVPWGXAGADYLWIHRCLTDKDKAAAHLRWCQGHLCPSKPFVVQHSLCPNATGHNAP

SEQ ID NO: 195065 - protein, 196 aa, Triticum aestivum
  unsure (1)..(196): unsure at all Xaa locations
  Clone ID: PAT_TA_89483.pep
INLSTLHIENNQFGGNIPAAAVGLREFIAGNNNFSGEMPASLGKGMPLLQAMNLSGNQLXGGIPSSVAKLRLLTQLDLSRNQLAGEIPAELGAMRVLSALDLSVXTSYLANIPPPLXRATAHFLNLSSNNXMGXVPARSPTAAYGTPREPRLCHLSWAPFSRCLGIKALSRGSASQWLQSSGSCLTGLSHVKERRR

SEQ ID NO: 195066 - protein, 142 aa, Triticum aestivum
  unsure (1)..(142): unsure at all Xaa locations
  Clone ID: PAT_TA_89484.pep
FINNMSQLSDLLAYHSGNSIEAILQSFRHTFTKKSYKRAVSDFYSDLGNYVYQQRSNNNIYQLNMSFSKTSIKIIEGKINIVHFADLSSAILHQKDERHILRIIHPLHXEKILLIQHQWAHRKXKHHXRKITPELEGFDXTA

SEQ ID NO: 195067 - protein, 132 aa, Triticum aestivum
  unsure (1)..(132): unsure at all Xaa locations
  Clone ID: PAT_TA_89485.pep
ELSSPDLSLLSTRSLGLERARRAKTISRPTVIPSSHPPHCYTSLYHNGWPIHGAPLGIRLRPTRQRDLFLRASWAPMPTFYRIFKSKSTEGSSPCPTSWPVQRDAVXILRTGSRPVXAPHQASTLPVRHLNV

SEQ ID NO: 195068 - protein, 192 aa, Triticum aestivum
  unsure (1)..(192): unsure at all Xaa locations
  Clone ID: PAT_TA_89486.pep
CDRXXSLDKXPLXLXPVFXGXCXKVXCXGGPVFFXXGVPQXCSXEAGDAGLALXXGAXLFLXLPGXAGFXXAKASLFLSWTXXCAXVSFXXLAFXFGGSCWLGLLGILRLGGGPGPPPWSPTTSTGAAGASTSVSAGAGTSSVFATSSAATGVSTAGASSVSAADGFCTSAVAIAVVDARKCLEWLAEASAT

SEQ ID NO: 195069 - protein, 100 aa, Triticum aestivum
  unsure (1)..(100): unsure at all Xaa locations
  Clone ID: PAT_TA_89487.pep
EGGHLAXKALILVXGLXDXPXDSHAQXPQXXRLXHQQAMILHQIXALXILGYXXHFXHQLRPKVMINFLEXFLRITXITXNLQQTDPLEWXPPCPXXGQL

SEQ ID NO: 195070 - protein, 134 aa, Triticum aestivum
  unsure (1)..(134): unsure at all Xaa locations
  Clone ID: PAT_TA_89488.pep
QDKEGIPPDQQRLIFAGKQLEDGRTLADYNIQKESTLHLVLXRLRGGMQXFVKTLTGKTITLEVESSDTIXTTSKAKIQDKEGIPPDQQRLIFCWQTLXDXRTXADYNIQXGSHPPGAQLGMKFLKPDRDTWIL

SEQ ID NO: 195071 - protein, 122 aa, Triticum aestivum
  unsure (1)..(122): unsure at all Xaa locations
  Clone ID: PAT_TA_89489.pep
VSLASGHVVSALLLLALAAELYYSSCTSAASDDRAASXKPPPRLLLPPAAXXFCLKKPPXRSTXRKSQPTXXKSSQQGQDTHKGEAXIXGIXRPGCXTTXXTRXLIXTXXVRRPTSDCDXQT

SEQ ID NO: 195072 - protein, 188 aa, Triticum aestivum
  unsure (1)..(188): unsure at all Xaa locations
  Clone ID: PAT_TA_89490.pep
NLEDHKKHLQQVFQILREHQLYVKLSKCSFAQQRLEHLGHIISDKGVATDPSKTTAMVNWPVPTTVTELRGFLGXLTGYYRXFVQHYGIIAKPLTNLLKKKAFNGTAEAQTAFDLLKQAMTSTPXLGITXFNKPFXIQTHACDPVWSILHRKPVLTTTISRANNRNDIRKILYMALKEHQGPLINDTD

SEQ ID NO: 195073 - protein, 115 aa, Triticum aestivum
  unsure (1)..(115): unsure at all Xaa locations
  Clone ID: PAT_TA_89491.pep
PSNLVQVSLFRALHEKEVRSKGGFTRSQFXLVAFVCSFVYYIFPGYLFQMLTSLSWICWVFPNSVFAQQLGSGLYGLGIGSIGXDWAPSPPNSGSPSANPGSPTAIPARSQHQVR

SEQ ID NO: 195074 - protein, 115 aa, Triticum aestivum
  unsure (1)..(115): unsure at all Xaa locations
  Clone ID: PAT_TA_89492.pep
VXYQSXSNLVXSQHXSLHWCXLFXPQCLFELGKTLLXSCLILNTIQTLYFVQLXXYQLXXFTTAFHXSLFNNSNISFNNSCYILEPRQGREAETGGLGDARPPTGGSTPPARRRK

SEQ ID NO: 195075 - protein, 64 aa, Triticum aestivum
  Clone ID: PAT_TA_89493.pep
LMAVTGEHLVHPCCKVSILISSWMKACYGKNLSESHDCRSDLASFFIFALDSYSLTISPKFRKH

SEQ ID NO: 195076 - protein, 115 aa, Triticum aestivum
  unsure (1)..(115): unsure at all Xaa locations
  Clone ID: PAT_TA_89494.pep
GTRKEDLWFSSSPVSSYYLAEEARGHRPVGGPQHVARARPGAQQRRVGVGVAHPEPRAARAQPAVVVVGPHAQSPPPSYGRSSPCSXXTAGXXRGXXPXXQSRFPXKXIQXXXLA

SEQ ID NO: 195077 - protein, 126 aa, Triticum aestivum
  unsure (1)..(126): unsure at all Xaa locations
  Clone ID: PAT_TA_89495.pep
MSDTDEHHFESKADSGASKTYPQQAGAIRKGGHIVIKARPCKVVEVSTSKTGXKHGHAKCHFXVAIDIFNGKELXGYRPSSHNCDFPNVDRXDYQLIDITDDGKSXFLTXNWNTXDDXTSHGELGN

SEQ ID NO: 195078 - protein, 146 aa, Triticum aestivum
  unsure (1)..(146): unsure at all Xaa locations
  Clone ID: PAT_TA_89496.pep
GGAFAPKPSSGPHKARECLPLILILRNRLKYALTYREVQSILMQRHIMVDGKVRTDKTYPAGFMDIISIPKTXENYRLLYDTKGRFRLHSVRDXDAXFKLCKXRSVHXAKKGIPXLNTYDGRTXRYQDLSIKGNDTIKLRLETTRC

SEQ ID NO: 195079 - protein, 128 aa, Triticum aestivum
  unsure (1)..(128): unsure at all Xaa locations
  Clone ID: PAT_TA_89497.pep
EVIAEEKPSASTEKRKFQAQETVANTEPIKRQRRWAADSGNVPERQPLSQSGSDARKDILQSALKRSXGRSDSTASGXSPKREDLPPSQETGKTSLRIHRFXPIYLNXXRXLGXTVXLXSRWLIQTGS

SEQ ID NO: 195080 - protein, 63 aa, Triticum aestivum
  Clone ID: PAT_TA_89498.pep
FFFFFFYIIAGMILQVLRHLCARSIFPSEKVSSQQCTSWPHALNYMCSQPRKESKSKWLVSVS

SEQ ID NO: 195081 - protein, 132 aa, Triticum aestivum
  unsure (1)..(132): unsure at all Xaa locations
  Clone ID: PAT_TA_89499.pep
MSXHXXXKAGVGFKAGVKDYKLTYYTPXYETKDTDILAAFRVSPQPGVPPEEAGAAVAAESSTGTWTTVWTDGLTSLDRYKXGRCYHIEPVXGEDSQWIRYVAYPLDLFEXGSVXTNMXTSIXSNVFGFXSP

SEQ ID NO: 195082 - protein, 66 aa, Triticum aestivum
  unsure (1)..(66): unsure at all Xaa locations
  Clone ID: PAT_TA_89500.pep
MAEXEYXCFXGXLAXATDDNXLXQAFXXYXEILXXKIINDRXXXRSRGFGFVXXRSDESIRHXIDD

SEQ ID NO: 195083 - protein, 158 aa, Triticum aestivum
  unsure (1)..(158): unsure at all Xaa locations
  Clone ID: PAT_TA_89501.pep
GGLAFGSVLGLLFAPPIIQNLGWESVFYIFGLLGIIWCLVFESVQELQPGDNEDILNLENTSAGSNGHMTDSLKDVPWGGILXKQAVWAMIYTXLCGSWGTILLVLASNILNEGLNFNXTDLQGCNPPLWAGNTLMQHFKTTNGLHVRKIQQCSVPQL

SEQ ID NO: 195084 - protein, 166 aa, Triticum aestivum
  unsure (1)..(166): unsure at all Xaa locations
  Clone ID: PAT_TA_89502.pep
MANPRVFFDMTVGGAPAGRIVMELYKDAVPRTVENFRALCTGEKGVGKSGKPLHYKGSSFHRVIPDFMCQGGDFTKGNGTGGESIYGEXFADEXFVHKHTNPGSLHGNAGPNTNVPFSSAXPCNWSTHLPPSRQGWTLQEIKRGSPNGLSNNITSNLAAVLLPFRH

SEQ ID NO: 195085 - protein, 74 aa, Triticum aestivum
  unsure (1)..(74): unsure at all Xaa locations
  Clone ID: PAT_TA_89503.pep
NXXXWXPPAYAPRSARDPHGRLGPRLDPGGRAGDPTGGSRGGKWGAWPGGSGAARRHEGSAPRRPLLSSSYLPS

SEQ ID NO: 195086 - protein, 167 aa, Triticum aestivum
  unsure (1)..(167): unsure at all Xaa locations
  Clone ID: PAT_TA_89504.pep
MSPQTETKAGVGFKAGVKDYKLTYYTPEYETKDTDILAAFRVSPQPGVPPEEAGAAVAAESSTGTWTTVWTDGLTSLDRYKGRCYHIXPVAGEDSQWICYVAYPLDLFEXGSVTNMFTSIXGNVXGSKXYXPXVWXSNNPPTYQKXPRXPHGIQVERDSTVWRLNGL

SEQ ID NO: 195087 - protein, 110 aa, Triticum aestivum
  unsure (1)..(110): unsure at all Xaa locations
  Clone ID: PAT_TA_89505.pep
TGLFPSWTMKXSPIVXTCXTFDXCYFWGHNLVFRSLPRIWYPLAQPAPETVLLPLDVPVXLLRLNAFRGDPASSGFEWHFTPNHNSSADSSTSVGSDLCLVSSKLHPGHG

SEQ ID NO: 195088 - protein, 164 aa, Triticum aestivum
  unsure (1)..(164): unsure at all Xaa locations
  Clone ID: PAT_TA_89506.pep
MSPQTETKAGVGFKAGVKDYKLTYYTPEYETKDTDILAAFRVSPQPGVPPEEAGAAVAAESSTGXTWTTVWXTDGLTSLDRYKGRCYHIRACCWGRQPMVCYVXYPLDLFXKGPXXTXYSNGRNLLVQTLAQRWEHNPPTNQNSAASQKEWTNLMGINKWDPKL

SEQ ID NO: 195089 - protein, 98 aa, Triticum aestivum
  Clone ID: PAT_TA_89507.pep
EAQLPPSPSPADAPPTSPPSPADAPSCSTSWLGRRMPPPPGFPTTPFDPAPQRAPPFGSPTPTRAAKPTASAPRSNPPLNPSYPLHNNGKNNCAIFVV

SEQ ID NO: 195090 - protein, 117 aa, Triticum aestivum
  unsure (1)..(117): unsure at all Xaa locations
  Clone ID: PAT_TA_89508.pep
NFIGLWLFDSFVENNVXLTLQYLLEXYLCEALVTCTKPRGSARLXCCXXQSGLLXHKXXVSVNNXGHVTMXXTXILVXHPQSXGHELLLXYLKPXAQXRLXVDSEPHXGIKXLXXTX

SEQ ID NO: 195091 - protein, 99 aa, Triticum aestivum
  Clone ID: PAT_TA_89509.pep
VVCRPRVLGPRASPASGGDSCLHRLSPPRAGLGHRQRRVVMGLFVGRRLQPVYICANFMISLCQALQNYKIIVFFALLCSTPSAWKFIASLFLQNEGSY

SEQ ID NO: 195092 - protein, 89 aa, Triticum aestivum
  unsure (1)..(89): unsure at all Xaa locations
  Clone ID: PAT_TA_89510.pep
IHIXXVAYNIVFLGXFMLPDWDMFHSLHPAGDYHXSARAIXGGPXYVSDXPGKHXFELLRXMXXPXGXVLXARLPXRPXXDCLFAAXAR

SEQ ID NO: 195093 - protein, 80 aa, Triticum aestivum
  Clone ID: PAT_TA_89511.pep
SACKPRVLQAPMHEHHHMWTEPTVFFNDDLTANSFRLSNHPPFLSLLLKTSCNHCSVGSHCHIQSEKLYAKFCLTKKRGG

SEQ ID NO: 195094 - protein, 74 aa, Triticum aestivum
  Clone ID: PAT_TA_89512.pep
PCRAHGEIRSRSAPATRTRRSVPRCEGGRRCLSFAGLRRLARRTGHTIFASNRAAPLAISFRRSSIETAASWDQ

SEQ ID NO: 195095 - protein, 64 aa, Triticum aestivum
  unsure (1)..(64): unsure at all Xaa locations
  Clone ID: PAT_TA_89513.pep
TXDNAQXYXLXLIKHVGXGXPKRPSAXEAYVXAMXXEDKKGPAEIEKHFXLXXPXKXPAYPXSF

SEQ ID NO: 195096 - protein, 166 aa, Triticum aestivum
  unsure (1)..(166): unsure at all Xaa locations
  Clone ID: PAT_TA_89514.pep
MVDIHECAVVLVQEPDHAAAAAANPDPSSISASAWRPFEDAAAAVVGRIQPSVSSEDRRAAVVHYVQRLIRCSVGCEVFPFGSVPLKTYLPDGDIDLTAFGSTSSDENLANXVRAVLESEELXKDAEFEVKDVQYIXAEVXLVKCLVQNNVXTFFILVDLYCFLNR

SEQ ID NO: 195097 - protein, 94 aa, Triticum aestivum
  unsure (1)..(94): unsure at all Xaa locations
  Clone ID: PAT_TA_89515.pep
KITSPLAILWKSFSLVFFAEWGDRSMLATIALGAAQSPLGVASGAIAGHLXVATLLAIIGGAFLANYLSEKLGWPAGRSAVFVIRRRHAFPACS

SEQ ID NO: 195098 - protein, 122 aa, Triticum aestivum
  unsure (1)..(122): unsure at all Xaa locations
  Clone ID: PAT_TA_89516.pep
ARTGQQAPRSRAGAEMGLTFTKLFSRLFAKKEMRILMVGLDAAGKTTILYKLKLGEIVTTIPTIGFNVQTVRLQEHYFTVWDVXGQDKFRPXXEHYFKNTKVHFCWDTMTEAFCSKNDFNRC

SEQ ID NO: 195099 - protein, 87 aa, Triticum aestivum
  Clone ID: PAT_TA_89517.pep
STGSNRIMKGLREGDPICISDSEETFKWKPMDCLSKTQEIESKRKWETAADSTAAFAVTNMKAMGRRYNEHIACILWYKGISKMAHG

SEQ ID NO: 195100 - protein, 153 aa, Triticum aestivum
  unsure (1)..(153): unsure at all Xaa locations
  Clone ID: PAT_TA_89518.pep
DADGGAAPPSCRVAEMQMESEHLRAAAGAEMEMEPEHLRAAAGAAPLPSCKCDPPRKMGPKVFSLHKLGKRNMTHTFEWVGWEPKTSXMLNTXAXAAHPWVAVXWXQLLAVFXPLNTWXDGISLTLRXICYXNVSPWTFXFRFKXLSRMQKKK

SEQ ID NO: 195101 - protein, 74 aa, Triticum aestivum
  unsure (1)..(74): unsure at all Xaa locations
  Clone ID: PAT_TA_89519.pep
GXEAELXXHXVVXAVLGEXVXXEXAEXGXDXGXDVTXSGXRAACXSXXPSXXXXAPARXLPPPPXQPGPXLTSC

SEQ ID NO: 195102 - protein, 134 aa, Triticum aestivum
  unsure (1)..(134): unsure at all Xaa locations
  Clone ID: PAT_TA_89520.pep
QLLSRCFLPGRRSSSGQVLRASSPSGKVWPTSWASSPAAWLVAGHRRAAGWRSPRLLRPAAAAHVDLTKGSFSGCLPWDQPTVLGGPLXADPGFLGVVPLLSVREMTFGXFVLICMIPLPLVWLAMGGQYLGKL

SEQ ID NO: 195103 - protein, 82 aa, Triticum aestivum
  unsure (1)..(82): unsure at all Xaa locations
  Clone ID: PAT_TA_89521.pep
GXVKXPPSXXKLDQSSSXWCIIXXFXXMPSLXFKLASFQACSIHGXIVXVMLCCXVVESFXSXXVGLSPGNHRAALQVLGKG

SEQ ID NO: 195104 - protein, 106 aa, Triticum aestivum
  unsure (1)..(106): unsure at all Xaa locations
  Clone ID: PAT_TA_89522.pep
LPHDSLAALAXKHDAPLXLLXLGSXPTLVVSSADAARAAFQHNDRAMSGRPALYAAARFSYGLQNISFAPPEGAFWRSXRRACLSELLGRPAFSPGSRQKAKAPPF

SEQ ID NO: 195105 - protein, 81 aa, Triticum aestivum
  unsure (1)..(81): unsure at all Xaa locations
  Clone ID: PAT_TA_89523.pep
AARGLAFLHSDKAKVIYRDFKTSNVLLDSSYNAXLSDFGLAKDXPTGDKSHVXTRVMGXHGYAAPDYLXTGHLTAXFFKLS

SEQ ID NO: 195106 - protein, 68 aa, Triticum aestivum
  unsure (1)..(68): unsure at all Xaa locations
  Clone ID: PAT_TA_89524.pep
VFFFFXXFFFFFGFXFFFYNSXRRLITXVSANKPDHPRPXXXXSRXXIXXVSSPLXTQYKNWXLPNHQ

SEQ ID NO: 195107 - protein, 150 aa, Triticum aestivum
  unsure (1)..(150): unsure at all Xaa locations
  Clone ID: PAT_TA_89525.pep
ISVPMMSSSXLFANAPPXKKGVKNFAIDFLMGGVSAAXSKTAAAXIXRVKLLIQNQDEMIKAXRLSEPYKGIXXDCFGRTIKDXGFGSLWXGNTANSXRYFXIKALNLASKDYSKXXXNFXKDKDGYXNCPVXLAXGGAAGAPPLLGPWT

SEQ ID NO: 195108 - protein, 99 aa, Triticum aestivum
  unsure (1)..(99): unsure at all Xaa locations
  Clone ID: PAT_TA_89526.pep
TLPXARPXXPDPIVRXWXPPSTRRXPRRRPRPSTXTPSXASPXPPPPPRPTSXSPGAPNNSPSXLPPTPXAXRQQXGGXEPLWECIPKGNGMHPEDYGS

SEQ ID NO: 195109 - protein, 116 aa, Triticum aestivum
  unsure (1)..(116): unsure at all Xaa locations
  Clone ID: PAT_TA_89527.pep
MAPTKGEGPAIXIDLGTTYSCXGXWXHDRVXIIANDXGNRXTPSYXAXTDSXRXIGXAAKNQVXMNPINTVFNXKRLIGXRFXXAXVKSDIXMWPYRLXXWPXKQPMIXVHXRVKF

SEQ ID NO: 195110 - protein, 99 aa, Triticum aestivum
  unsure (1)..(99): unsure at all Xaa locations
  Clone ID: PAT_TA_89528.pep
LELAXXTSPVLFLLXAVFXAGXSXXTFNIKXNCGFXIWPAXIPVXGGFXLGXGXTSXINVPAGTQXXRXWAXTGCPXNGGXXSCQXGXAXXTTXSSXGG

SEQ ID NO: 195111 - protein, 77 aa, Triticum aestivum
  unsure (1)..(77): unsure at all Xaa locations
  Clone ID: PAT_TA_89529.pep
GFPGCRISAXGFXXXNXIFXRXRXSDDHLGWVXPATADKVPGAGPDPFNGAKSXRDLXEIASTNYTGKPTVPVLWKT

SEQ ID NO: 195112 - protein, 153 aa, Triticum aestivum
  unsure (1)..(153): unsure at all Xaa locations
  Clone ID: PAT_TA_89530.pep
RFLTPAAAPPCSGFSAASSPSSSRLGPPLPSPISAASSLPPRRSSPRTLASRWRTTSSTPAASPGPRHSRPPPSSTTSGPPLIPTPSSPSSPASALXAHSPPSVAKDPILCAGVEKTYPRRTASSRLRARLARGRHSVAINVSYILTLGAELA

SEQ ID NO: 195113 - protein, 68 aa, Triticum aestivum
  unsure (1)..(68): unsure at all Xaa locations
  Clone ID: PAT_TA_89531.pep
PPWRRWTSISLDPAASTPNPPEMDPPWPDPPGXDRAXPSSPPGAPPRSNLQRHFHGQPQSRVGIDNVG

SEQ ID NO: 195114 - protein, 101 aa, Triticum aestivum
  unsure (1)..(101): unsure at all Xaa locations
  Clone ID: PAT_TA_89532.pep
MSCCGGNCGCGTACKCGNGCXGCNMYPEVEAAGATLLVSATAXHXASSGGMEMAAXNGCCXCTXCKCGTSCXCSCCSCYIHHRSCMHRVRSSSIRILLPYM

SEQ ID NO: 195115 - protein, 115 aa, Triticum aestivum
  unsure (1)..(115): unsure at all Xaa locations
  Clone ID: PAT_TA_89533.pep
MPTTFGSKRIWYMQILLDSKQTGCFCSQHMCLLSTPCPIRTNGDDPRPVKRRXRKGXVKXCPPPXRDXRLPELLEXXRDXXGIXAGXXLPNRTXSXHGXANRIPQSPXHGNPKPX

SEQ ID NO: 195116 - protein, 102 aa, Triticum aestivum
  unsure (1)..(102): unsure at all Xaa locations
  Clone ID: PAT_TA_89534.pep
EPGGFPGXXNLLXRXRPSANXRCRXPLPXPATYFCRCSPPESSPRGPVVAVGXCICCCCRRXHLLLLSAXASXTVRXCSLCCCCSSYVXYGKGXLXPFXXLX

SEQ ID NO: 195117 - protein, 55 aa, Triticum aestivum
  unsure (1)..(55): unsure at all Xaa locations
  Clone ID: PAT_TA_89535.pep
KXKRKEHHGXTNYYXWDLXCIXSEKIXFSQSKXDVIVVXXVYVIYXVXGXXXGYX

SEQ ID NO: 195118 - protein, 172 aa, Triticum aestivum
  unsure (1)..(172): unsure at all Xaa locations
  Clone ID: PAT_TA_89536.pep
RGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLPDYNIXKESTXHLVLRLLEHQIFVKTSLEDITLEWII

SEQ ID NO: 195119 - protein, 136 aa, Triticum aestivum
  unsure (1)..(136): unsure at all Xaa locations
  Clone ID: PAT_TA_89537.pep
AYQHGAIRIELPEKNSHSRIIVTTRIEAVAQGXSASEYFVHHMKPLEPEASKKLFVKRVFGSVENGTCPLEIKGTMDTILKKCGGLPLAIVSIASLLPTYRSAEGIKMWERVSRSIGSQMESNPTLEGMRQLITLS

SEQ ID NO: 195120 - protein, 106 aa, Triticum aestivum
  unsure (1)..(106): unsure at all Xaa locations
  Clone ID: PAT_TA_89538.pep
VCPGNVKGLTNLXVPVXSIVMHNXTFFFIIPSVIFNGGYVLLQSTPQYQQSRNRADXAAVASIXRFXTVXHPXPXNSACXXRXQTPDXDIIPLXLXVXXRXXNQXC

SEQ ID NO: 195121 - protein, 58 aa, Triticum aestivum
  unsure (1)..(58): unsure at all Xaa locations
  Clone ID: PAT_TA_89539.pep
MGTESRKVTAFRIPITXLXSRTXLXPAGXXSPVXCGXLDGAXWXXARRFSKGFWGRGR

SEQ ID NO: 195122 - protein, 193 aa, Triticum aestivum
  unsure (1)..(193): unsure at all Xaa locations
  Clone ID: PAT_TA_89540.pep
SGKSTLIQALFRIMDPTVGQITVDGVDICTIGLHDLRSRLSIIPQDPTMFDGTVRHNLDPLGEYTDNQIWEALDHCQLGDEVRRKELKLDSPVVENGENWSVGQRQLVCLGRVILRRTKILXVLDEATASVDTATDNLXQKTLQQHFSGATVITIAHRITRPHSDISCFLTWMVWTQTQQVAGDNPFQTVRIT

SEQ ID NO: 195123 - protein, 167 aa, Triticum aestivum
  unsure (1)..(167): unsure at all Xaa locations
  Clone ID: PAT_TA_89541.pep
EQLTTTITPPVIRSPEKKPATWDQPPTAADQSNFFTNLQPIVSQTSSVSVSFSAPKQNPATALDTILSGNSSSIDSVQLTQATRPLRRLHIENITGSASEDMLLGCLNXLLLSSGVNRIQRSKQPCLSCTINKEKXQAFVEFXTQEDATAVFFDGNLQVTREPPKNI

SEQ ID NO: 195124 - protein, 54 aa, Triticum aestivum
  unsure (1)..(54): unsure at all Xaa locations
  Clone ID: PAT_TA_89542.pep
LDDXLXGMSTAYQXXVLAGWICILQXDYDDDXPXXINQXVXEXLGEKKKKKKKK

SEQ ID NO: 195125 - protein, 138 aa, Triticum aestivum
  unsure (1)..(138): unsure at all Xaa locations
  Clone ID: PAT_TA_89543.pep
FCXRSLIXESSPFPPLCPYQFRRNSPPNVXGCVYLFLETVTXGPLMXFPCXLNGSGXRHLMVAVCLVLKSSSLLARLCFPLDAPRSLWLPXRIRSPACGARSEWGEPGGGRRRSRRCGARWAPEAVAAAGGGAGSRRA

SEQ ID NO: 195126 - protein, 79 aa, Triticum aestivum
  unsure (1)..(79): unsure at all Xaa locations
  Clone ID: PAT_TA_89544.pep
MGDDXGXKLVKSLRGAAXKYVXVGFFLGFXIVLXTYFTLSXXFXXSXPKAIXXTSXXHPTPNAPAVGVQAAAAPRRHLC

SEQ ID NO: 195127 - protein, 78 aa, Triticum aestivum
  unsure (1)..(78): unsure at all Xaa locations
  Clone ID: PAT_TA_89545.pep
LGYKVRASDMADVAQKLEXLEMAMGMGGVGXAGAXPDDSFATHLATDTVHYNPTDLSSWVXSMLXELXXPXXXLFFFF

SEQ ID NO: 195128 - protein, 61 aa, Triticum aestivum
  unsure (1)..(61): unsure at all Xaa locations
  Clone ID: PAT_TA_89546.pep
VFFFFFFFFFFFFLRWQRCFXWXTQIHXXQIVLRILCACAXTXPSVAFTYQXXFXSXVWTM

SEQ ID NO: 195129 - protein, 158 aa, Triticum aestivum
  unsure (1)..(158): unsure at all Xaa locations
  Clone ID: PAT_TA_89547.pep
RKRKELLSSAPWRTGEAEEDDEASRMSREGKVTVTSNPGETPTMNMPRSKRPDLHLAVDDFQGGRDXPPSLRYSLXKRNSXSLRRFSRWDTLCQALPPVMAYSFSPLTLXFPSKIFTXFWDXRRISNXQNSXGLGNQDTPRVSLITDHGHCSLETFIS

SEQ ID NO: 195130 - protein, 52 aa, Triticum aestivum
  unsure (1)..(52): unsure at all Xaa locations
  Clone ID: PAT_TA_89548.pep
NXEXXEXPXPRADEAXVLPQXXGRRXRXPPXPAAAGRXLXPKXAXWLGRVRS

SEQ ID NO: 195131 - protein, 58 aa, Triticum aestivum
  unsure (1)..(58): unsure at all Xaa locations
  Clone ID: PAT_TA_89549.pep
MADVEYRCFVGGLAWAIDXQSLQNAFSXYGDVIXSKIINDRXTGXYRGFGFXXFXRTR

SEQ ID NO: 195132 - protein, 181 aa, Triticum aestivum
  unsure (1)..(181): unsure at all Xaa locations
  Clone ID: PAT_TA_89550.pep
TRRLPAMYSCSERDRSAAAARIMESSAKYQPCNTAATRTAAGQVPSDAQRQQQQPSPRRARRKHPASAXRRSSTTVGGDRRVQFPRHGAXXNRFPPAASSGPLPRRAQAATTAGXSGXCATLATPEFXPPGFXTXAHSXPGXNSXIDXXEKHPGVXLXKXWNSPAIXLLGIFXXSFXNILQ

SEQ ID NO: 195133 - protein, 69 aa, Triticum aestivum
  unsure (1)..(69): unsure at all Xaa locations
  Clone ID: PAT_TA_89551.pep
LVDVTPCGLXTICSXKLXXNGGKCDCXREQRLHQWRCXHHXXVXVSXXXGXPHVFWLRTHILLPSSSFD

SEQ ID NO: 195134 - protein, 111 aa, Triticum aestivum
  unsure (1)..(111): unsure at all Xaa locations
  Clone ID: PAT_TA_89552.pep
QLPXILGQXARRNEAYCXXIRIGRGXSKVSXESXWXFCXKRGRKGLNXXXVIAATLVSFSLLERQNCSSHPVAIXKSWHALRWGLCSFVSSSKSARHVGRRSGHIHFISLV

SEQ ID NO: 195135 - protein, 73 aa, Triticum aestivum
  unsure (1)..(73): unsure at all Xaa locations
  Clone ID: PAT_TA_89553.pep
CNQSVXXXFGXXWXXTMVXGNWETXXLEXLGIIICIIRILWSMGXRILNXPWXIFSKNCXQXKSKESCXXITC

SEQ ID NO: 195136 - protein, 137 aa, Triticum aestivum
  unsure (1)..(137): unsure at all Xaa locations
  Clone ID: PAT_TA_89554.pep
TDNSCEVMEGPSETYCGEADVSDKEAQTEQFGFYLTNERDDVQRTKIEMNDLDLLEAKPNRLHVSVNWQHSASXQYDVSMLNNLXPEIHKLEVYSQKEPKFXSLHVCPRAFPKRGALGAKGHLYCPLLQKHQQAMKN

SEQ ID NO: 195137 - protein, 200 aa, Triticum aestivum
  unsure (1)..(200): unsure at all Xaa locations
  Clone ID: PAT_TA_89555.pep
LLGSSTSVSSLKHLHPPPVSKLLPCLFYVVDTKLGAGAAEIDDGLCYEEIPPLAAAPELLLTVVLRHRHRLQLRRRARRPLPQDFLRSVGDPRRRTDILRGISDNATKGYICXSTGVTXXPPDKKXPVSXPPSPFPGACGLPNITAXPQLSTNFPDGPXGTRCNPVXNSLTXLXXSGXXPRXGRWFXKPYWETXTEILXL

SEQ ID NO: 195138 - protein, 150 aa, Triticum aestivum
  unsure (1)..(150): unsure at all Xaa locations
  Clone ID: PAT_TA_89556.pep
MSPQTETKAGVGFKAGVKDYKLTYYTPEYETKDTDILAAFRVSPQPGVPPEEAGAAVAAESSTGXTWTTVWXTDGLTXLDRYKGRCYHIXPVAGXKDSQWVCYVAYPLNLFXKGPLLTFYSHVSNLFXNPTALWEYIPLLIQTSKAPVPI

SEQ ID NO: 195139 - protein, 174 aa, Triticum aestivum
  unsure (1)..(174): unsure at all Xaa locations
  Clone ID: PAT_TA_89557.pep
GCCNELNAAYAADGYARARDGGVGACAVTFTVGGLSAINAVAGAFSENLPVICIVGGPNSNDYGSNRILHHTIXGIPDFTQXELRCFQELTCYQAXGEQLXRMHMEQIDTAIPTGTEXKQPVYININCNXPSIPHPTLTAPVLSSLPQNVKQMTWDNNGTLFLNKFWGQNANKL

SEQ ID NO: 195140 - protein, 210 aa, Triticum aestivum
  unsure (1)..(210): unsure at all Xaa locations
  Clone ID: PAT_TA_89558.pep
TSSPPHPSERPHAPAPLTMTQEDAHAPVNFWGEHPAMEAEYYAASGAEGDPPTSPRPDDAGARRSSRRPGAPVAGWGRXARGPRASVFMGQWVTETHLLDFPSTASSXPLXXXCXAPTPPATPSQRLQASPDFKSRFHSSFFGPFXXPRXPVXXXFGXXXGHSAXTRNXEMAGLLWXIQVXXSPCRSXLLXRRHSSAGTXNXRPKPXPNX

SEQ ID NO: 195141 - protein, 158 aa, Triticum aestivum
  unsure (1)..(158): unsure at all Xaa locations
  Clone ID: PAT_TA_89559.pep
EVRKLTHKVGQTEGEKKEKEDQISRCEAYIDGMESKLQVCQQYIRTLXETSLQEEMARHAPLYGCXVEALSLGGALRPFANIQRADLRQFHTIXERKGNTISLSVPWLVPLLLPWCLAFLIDSHSSHTLMAPNGNGTLTMRWALNTNHKSTAGAQPFG

SEQ ID NO: 195142 - protein, 90 aa, Triticum aestivum
  unsure (1)..(90): unsure at all Xaa locations
  Clone ID: PAT_TA_89560.pep
MKGTKLAAILILQAVLVMGLLSHVNADFFPKCCNNCRSFSGVDVCDDAHPKCPQGCSACRVVSTXSPEMWRCADMKSNVDXTCGGTCKKY

SEQ ID NO: 195143 - protein, 136 aa, Triticum aestivum
  unsure (1)..(136): unsure at all Xaa locations
  Clone ID: PAT_TA_89561.pep
MECENGQVAANGDGLCVAQPARADPLNWGKAAEELSGSHFDAVKRMVEEYRKPVVTMEGASLTIAMVAAVAAGSDTRXRARQSARGRVKESXDWVMNXMMNGTTVTCHNGFGQLSRRTKEGXLSKESSILKTDGRR

SEQ ID NO: 195144 - protein, 105 aa, Triticum aestivum
  Clone ID: PAT_TA_89562.pep
FFFFLAAQSHTSIYEGLDHCTVDFLFISYYYSKPARMKERRHRFFVCMPSGASKQPRLHRSFLHKLNQWARALFHPLPAYNTRAISFRNWVPAGLAIDDGDAVVE

SEQ ID NO: 195145 - protein, 98 aa, Triticum aestivum
  Clone ID: PAT_TA_89563.pep
MFLGQAVYGPIINCIFFSYNAGLQGETIPEIIARLKRDIIPTIKSGLIYWPLCDFITFKFIPVHLQPLVSNSFAFLWTIYLTYMAGLKKPSVEVITNS

SEQ ID NO: 195146 - protein, 161 aa, Triticum aestivum
  unsure (1)..(161): unsure at all Xaa locations
  Clone ID: PAT_TA_89564.pep
KLHSPPLFSLLPSPASSPLPLLVWISGSEIESQEFPILIAPPCAPDNPSALPSQLPDPIRLPSPPALTPIGAGRTAWTPAPTASAPSXEVATAAALTARPPGPPRAAAFGRWXRXPRRGTXNXXGRAPPXXPLXPQVAXAGXXLLTLXVDLAXXPXTTLPV

SEQ ID NO: 195147 - protein, 169 aa, Triticum aestivum
  unsure (1)..(169): unsure at all Xaa locations
  Clone ID: PAT_TA_89565.pep
GMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPTDQQRLIXAGKQXEDGXLADYNIQKDPHILRLPVAITPGMVCFRPKSGNGSGRSI

SEQ ID NO: 195148 - protein, 180 aa, Triticum aestivum
  unsure (1)..(180): unsure at all Xaa locations
  Clone ID: PAT_TA_89566.pep
QRHLFTYHSPSNQKQAWKFSSKHVKWDSSEATQHSTKHPTAFPSPNGTTSKAEMQRPPKEATPFASFALARSASHHLSSIYHPSSGVEHPKTEASRYXTKAKQDFCXXXILIRRENXSNLXPTFNXSPKNSXQTHXTYSXNTKYXRTTKRXNGTGTXLVWGLRXTLSCKXPFPLXIRYTL

SEQ ID NO: 195149 - protein, 89 aa, Triticum aestivum
  unsure (1)..(89): unsure at all Xaa locations
  Clone ID: PAT_TA_89567.pep
AKPPNPGQXXXXNVXLSNXSRLXLXXASXXXPRXVXXPSQVXTVKWLXISKXRRSEXPAPIXQIEVGQVMHLCYNIFLRQRKKKMACHK

SEQ ID NO: 195150 - protein, 136 aa, Triticum aestivum
  unsure (1)..(136): unsure at all Xaa locations
  Clone ID: PAT_TA_89568.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYXPSKLKDLXFXVGKTS

SEQ ID NO: 195151 - protein, 118 aa, Triticum aestivum
  unsure (1)..(118): unsure at all Xaa locations
  Clone ID: PAT_TA_89569.pep
LLLRPSEVPPARCSSWRCWCWPRGARARXSRAPRCXTRXCRASGTCXQXGXFRXXFCGGIKKLVSXXRSTXRXXQHLXLPQXRPSXXAGGXYVXRFXXLPGIXXXSPXALLTATXIDA

SEQ ID NO: 195152 - protein, 157 aa, Triticum aestivum
  unsure (1)..(157): unsure at all Xaa locations
  Clone ID: PAT_TA_89570.pep
VKTLTGKTITLEVESSDTINNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLXADYNIQKESNLQLXVLKLRGGMQIFVKT

SEQ ID NO: 195153 - protein, 123 aa, Triticum aestivum
  unsure (1)..(123): unsure at all Xaa locations
  Clone ID: PAT_TA_89571.pep
KNEFWYRTLAGVCTVPTECYFALKSWNAQQAGAAAVLITDTVDEQLLTMDTPEASPDSRYLDKLNIPSALVNRAFGESLKRMAEKATXGEVLVVKLDWRRSATGLEYNSGQHNNNAALITALR

SEQ ID NO: 195154 - protein, 119 aa, Triticum aestivum
  unsure (1)..(119): unsure at all Xaa locations
  Clone ID: PAT_TA_89572.pep
MDALERGERAPLLPKSHGPKVQEDDSLQLQVPLLKHKKRGGSKAPAVILLFECLESTGFNGISTNLVMYLENVLHXNNLAKRLQRRNWFGTXYSTPSSGISPIXLXXYXTSRLLATSRM

SEQ ID NO: 195155 - protein, 134 aa, Triticum aestivum
  unsure (1)..(134): unsure at all Xaa locations
  Clone ID: PAT_TA_89573.pep
FGRVYKGVLPLSKSEIAVKRVSHDSKQGMKEFIAEVVSLGRLQHRNLVQLLGYCRRKGELLLVYENMSNGSLDKYLHANDCLLDWTTXFRIIKGISSGLXXLQQEWEKVVIHRDIXGNNVLLHNXMNVRLSDFG

SEQ ID NO: 195156 - protein, 59 aa, Triticum aestivum
  unsure (1)..(59): unsure at all Xaa locations
  Clone ID: PAT_TA_89574.pep
RCTCILPCPLPLLPSKSRNPFXSPPLFXTRHAPLNXFPLXAVTSXRXPSXXGVSXSYPX

SEQ ID NO: 195157 - protein, 166 aa, Triticum aestivum
  unsure (1)..(166): unsure at all Xaa locations
  Clone ID: PAT_TA_89575.pep
FAIVAHMFNGFSELALATIKLPVFFKQRDYLFFPAWAYAIPTWILKIPISCVEVAITVFLGYYVIGFDPDVGRLFKQYLLLLFVNQMAAGLFXFIATLGRTMVVANTLGXFALLVLLRAQWIVLSHHDVXKWWXWGYXMSLLXYAMNAIAVNXSLGENGKRFPRVK

SEQ ID NO: 195158 - protein, 102 aa, Triticum aestivum
  unsure (1)..(102): unsure at all Xaa locations
  Clone ID: PAT_TA_89576.pep
EPRCHHLRGVARELLPPQLRRPPRIPPVTAXXATTTTIPCRXXGSSXCXSCXPGNPPLXLLLPXGFCTPLIPXLXXLPXRXXLXSXXTPPLXKASSFDPXAN

SEQ ID NO: 195159 - protein, 116 aa, Triticum aestivum
  unsure (1)..(116): unsure at all Xaa locations
  Clone ID: PAT_TA_89577.pep
MAADGGRWVGLAVDFSXGNRAALXWAADNLLRAGRXNLLLPASXSKXPDYEQGENLLLEGSXXXLIPLSEFLNXXLQXIMGXKPDSXNLGIXXLXRTXXVXLVSXSFWNSPKTFQT

SEQ ID NO: 195160 - protein, 108 aa, Triticum aestivum
  unsure (1)..(108): unsure at all Xaa locations
  Clone ID: PAT_TA_89578.pep
GNGRGDXNGHHAGGAGDPRAVRAGAXPGRVPARVPLRGPXXLLTKXXGXYLRDXKGPXXXEFFHPNPFXGKXXMXGTETWRXTLQPLHGKLXIXHXRGXNXKNPXHRG

SEQ ID NO: 195161 - protein, 123 aa, Triticum aestivum
  unsure (1)..(123): unsure at all Xaa locations
  Clone ID: PAT_TA_89579.pep
MKSPLRKFRGLALPHHHKEKKDQRPPPAKLDNLVDAAQEMEEMRTCYDSLLSAAAATTNSVYEFAEAMEEMGTCLLXEKTALDXHDDDSXRXADDLGKVNLTTKXVDNXRTNXLNSITNPXGF

SEQ ID NO: 195162 - protein, 153 aa, Triticum aestivum
  unsure (1)..(153): unsure at all Xaa locations
  Clone ID: PAT_TA_89580.pep
MASPGPGTASTVTSSSAGSEATRAPPAALTEERNRKRKESNRLSAQRSRARKLLXVDELEAXAAALRARNCAVAAAAXXAARRCAVVQAENXLLHAPAXELGARLESLAEADQVHGRRRHGCFLNPARQRQHAQPILTMNYPTTLIHMWVKCV

SEQ ID NO: 195163 - protein, 87 aa, Triticum aestivum
  Clone ID: PAT_TA_89581.pep
YVNLGDQGSGPAQLDWEQRLAISLAAARGVQAIHLAGPSSCHGNIKSSNILLTGTHNACVSGAWAWITLGYLLQCLPATVHPEATPQ

SEQ ID NO: 195164 - protein, 56 aa, Triticum aestivum
  unsure (1)..(56): unsure at all Xaa locations
  Clone ID: PAT_TA_89582.pep
MGLLLLLQVLVAAAXARAPAXXAWGKEGHYMTCKIADXFLISXASAAVXELLXSWV

SEQ ID NO: 195165 - protein, 90 aa, Triticum aestivum
  unsure (1)..(90): unsure at all Xaa locations
  Clone ID: PAT_TA_89583.pep
MKGTKLAAILILQAVLVMGLLSHVNADFFPKCCNNCRSFSGVDVCDDAHPKCPQGCSACRVVSTSPRNXWRCADMKSTVDGTCGGPCKXY

SEQ ID NO: 195166 - protein, 96 aa, Triticum aestivum
  unsure (1)..(96): unsure at all Xaa locations
  Clone ID: PAT_TA_89584.pep
MKGTKLAAILILQAVLVMGVLSHVXNADYFPKCCNNCRSFSGVDVCDDAHPKCPKGCSACRVVSTXPEMLRCADMKSTVDGTCXGPARITGSVKPT

SEQ ID NO: 195167 - protein, 209 aa, Triticum aestivum
  unsure (1)..(209): unsure at all Xaa locations
  Clone ID: PAT_TA_89585.pep
XVXGXQXXTSXXVXIXSXAEXXTXESXHQXPXLXXLLHPVIAAKXNTCSDXEIXRXVETLXMSSSCXCXYTXFTQYAVIXAACPXREELGGXVGVVVGEVVVAVAVIAGGEPSLPAAVEVVVRXSRWRRACRPRSPSPPRRRQRSPPLAAGASGAARIGRIGAAPTTRREQSGPGRGGAAAPTRVRGRGGEGEEDAPVSGGMGGVGRNG

SEQ ID NO: 195168 - protein, 162 aa, Triticum aestivum
  unsure (1)..(162): unsure at all Xaa locations
  Clone ID: PAT_TA_89586.pep
AHPDGSVVYVAFGSFTVFDPRQFRELAKGLELTXRPFLWVVRPDFTTGGLSXAWFDEFTNRAAVNGRGMIVSWCPQQQVLAHRAVACFVSHCGWNSTWRGSXMXVPILCWXYXXDQFANXSYICDIWXXGLAVXPGEDGVXTNXEXIAKLGLGIRXQGIXXR

SEQ ID NO: 195169 - protein, 136 aa, Triticum aestivum
  unsure (1)..(136): unsure at all Xaa locations
  Clone ID: PAT_TA_89587.pep
MATXTETFAFXAEINQLLSLIINTFYSNKEIFLRELISNSSDALDKIRFESLTDKSKLXXQPELFIHIIPDKATNTLTIXDSGIGMTKXDLVNNLGTXARSGTKELWRAFAAGXXXSMIGQXXVGFXSANLXAERX

SEQ ID NO: 195170 - protein, 39 aa, Triticum aestivum
  unsure (1)..(39): unsure at all Xaa locations
  Clone ID: PAT_TA_89588.pep
IIKVFKHFLLEXMXLXSXYQKSLDRNFLACPCMLSSXSP

SEQ ID NO: 195171 - protein, 46 aa, Triticum aestivum
  unsure (1)..(46): unsure at all Xaa locations
  Clone ID: PAT_TA_89589.pep
XLNSLSLSLFSLTXNTFYKKSPXMLACWGCQIXXXTKQKXPKXXPT

SEQ ID NO: 195172 - protein, 124 aa, Triticum aestivum
  unsure (1)..(124): unsure at all Xaa locations
  Clone ID: PAT_TA_89590.pep
TMAVSTRMALLIAVCFLGCYVFVPSLAASGDFLQCLSSSIPSXRVFTPDSPSFTSVLXVVHPEPQVLHPDXXEAALHRDAHQRVXXPXRGALPAXSXRXXSXYAXGGDNXQGLSTGQAXKXFXW

SEQ ID NO: 195173 - protein, 89 aa, Triticum aestivum
  unsure (1)..(89): unsure at all Xaa locations
  Clone ID: PAT_TA_89591.pep
MKGTKLAXXLILQAVLVMGLLSHVNAXFFPXCCXNXRALSGGQXLEKXPTPMXPQGVAPXFPXXSXXPPKXGPCPXXKSHVXGTPWGGL

SEQ ID NO: 195174 - protein, 122 aa, Triticum aestivum
  unsure (1)..(122): unsure at all Xaa locations
  Clone ID: PAT_TA_89592.pep
YNXQXGXXXYXSXGTNTSNGSLXRQRXRXIXXNLXXXDPNLTKGWXXKPGXPKVXRXVRVNXXXSPGNQRVSXEXHAXGVSXXFGXGXAKVKXXXQPLKXXNAXGXXXCRWXNXXXEWGPPX

SEQ ID NO: 195175 - protein, 89 aa, Triticum aestivum
  unsure (1)..(89): unsure at all Xaa locations
  Clone ID: PAT_TA_89593.pep
EKLPCSLPLLRPSSSPASAPLSVIGWPRLRRRRSPPAPRRKPRPASRSXXFXIQSXXXEKGXXXQIXPTGXNXXXAXXNKXXGXRKFXF

SEQ ID NO: 195176 - protein, 81 aa, Triticum aestivum
  unsure (1)..(81): unsure at all Xaa locations
  Clone ID: PAT_TA_89594.pep
QFTIRXXTRKGPLRGEDFTLLXAMXNAXFWXLFFSLXLGXGXXPTVLXNLGQFESXSXGFEDSHIFXSMISIXXFPGXXSP

SEQ ID NO: 195177 - protein, 108 aa, Triticum aestivum
  unsure (1)..(108): unsure at all Xaa locations
  Clone ID: PAT_TA_89595.pep
GGSWNFLXXLXXXGXXKPXXTLTLWFKLYGGLYXVEKSLXLGXLKTLGLLGFDYXGLIFXYPKXLLVWKTCWLNILNIYRTFPLGPGRWDTAAXIPFSGLVCRALLEL

SEQ ID NO: 195178 - protein, 92 aa, Triticum aestivum
  unsure (1)..(92): unsure at all Xaa locations
  Clone ID: PAT_TA_89596.pep
MVKYSRDPSNPTKSAKACGKDLKGPTLKNTXRETSVWLLPQGMPFXQRXKXGTXXDFPPPKSKPIPFRRXCKRFGPNXQVKKXQANWQGPRA

SEQ ID NO: 195179 - protein, 57 aa, Triticum aestivum
  unsure (1)..(57): unsure at all Xaa locations
  Clone ID: PAT_TA_89597.pep
XKAHGPFHLVHTRGQEMLCYKRFLSRGTSSWMLHXTTLVNCLQXETCVGYICVHDYX

SEQ ID NO: 195180 - protein, 78 aa, Triticum aestivum
  unsure (1)..(78): unsure at all Xaa locations
  Clone ID: PAT_TA_89598.pep
CLRVEPFLSLNGTTFLVXXLFCSYEKXFVHXNIYMLEHNSXRITFXIMLXYXVXNXFGSTSXLXAXEXCKGALLPHVR

SEQ ID NO: 195181 - protein, 116 aa, Triticum aestivum
  unsure (1)..(116): unsure at all Xaa locations
  Clone ID: PAT_TA_89599.pep
VRWCATCCLLPHEHQQRPPPPPTPPSNLSPPWRRPPSSAGIAQGRKDPILRGDGRVTTRIPTPSSQLRRPALDPKEGNHGADVAXRRAELFKTSTVKXIAVTGWEFNKLSANLLRC

SEQ ID NO: 195182 - protein, 87 aa, Triticum aestivum
  unsure (1)..(87): unsure at all Xaa locations
  Clone ID: PAT_TA_89600.pep
VNEINLYPNWTYANQTIRAXQRWXIGRFPXGPTGERAVAXPXQRPLPXHXLXLGQRCAFXPRPRRTQGRPEAPPGRGDTPRXRPXGK

SEQ ID NO: 195183 - protein, 57 aa, Triticum aestivum
  Clone ID: PAT_TA_89601.pep
KTVVMKTSKCIEEKSYGCNELVESSPLKNRACKKFSGVHLKEEGSALSKKKKKKLET

SEQ ID NO: 195184 - protein, 192 aa, Triticum aestivum
  unsure (1)..(192): unsure at all Xaa locations
  Clone ID: PAT_TA_89602.pep
KAEQKLIVVVLSVDHTPPGLLPPPPPPSMPPSSAPPMPSPMSPPSMTPPSAAPMPSPMSPPSMTPPSAAPMPSPMLPPSMTPPSAAPMPNPVSPLPXTPPSAAPMPNPMVLLSMTQHPPRRCRDSPLSMNGVRANRSTVSDSVPGNPRTATTSVGNWRVIPGPSNNTAGPAPRITPGTGVRSYGTKMQAGLL

SEQ ID NO: 195185 - protein, 148 aa, Triticum aestivum
  unsure (1)..(148): unsure at all Xaa locations
  Clone ID: PAT_TA_89603.pep
MAAQGLLSGRQLLGRPLQSSISRSSSSRKSAFVVRASSSPPAKQNDNRQLWFASKQSLTYLXDGTLPGDFGFDPLGLSDPEGTGGFIEPRWLAYGEXIFNGRTAMMGVGGMIAPGGLGRWGLVPPETXIPWVKAGAIPPAXTTILGRP

SEQ ID NO: 195186 - protein, 182 aa, Triticum aestivum
  unsure (1)..(182): unsure at all Xaa locations
  Clone ID: PAT_TA_89604.pep
KLGACTLWSTGSRANCDYRHGIGAAEHTAPGTRVGVSARETVAQHTAKTRDMGPLAQAEQPRHSRLNRPALAVGRSPMRTPCTGCVVPXRLTSPKAXHPKCYIRPTYXLXPVGPETYTLXPVRXECVTGGTXATXGKTGTHTREDATWWSSAEVSCLRLHIXXTXDSNVLTRRIQYFXFIRI

SEQ ID NO: 195187 - protein, 142 aa, Triticum aestivum
  Clone ID: PAT_TA_89605.pep
RTPPPSSQSPCCRRHLLPVPAPPPPPRPRLVGERERRRPQRLRLFPPPPSSFAPRPRRAAPARCRCYLFPPNHHCPQQQGIKIKSPPLPSTPPPRATEIQADPNSMGTPATPRPASASRHVSRSARRLQPLRCATRSTIVST

SEQ ID NO: 195188 - protein, 111 aa, Triticum aestivum
  unsure (1)..(111): unsure at all Xaa locations
  Clone ID: PAT_TA_89606.pep
PGCSTXXDVLAAVXDRSLVLRXVRQPXGGXFGXAWDFIHTXRSGMLPCWSSCSQRLGGSALLPFTRRRRSGGYEMVSSILXENGILGNSERGQSWSSMGQQCAGSQEKSIA

SEQ ID NO: 195189 - protein, 133 aa, Triticum aestivum
  unsure (1)..(133): unsure at all Xaa locations
  Clone ID: PAT_TA_89607.pep
GGHRRAAAPLRPPPPHEAAPPGAPSPRRLSGSPPLAPLSPIPILDRGTKSAGAPPPHAARLPVIPPSPTASKTASPTSASSPSSSTPSHEDPESPVTPPRCSTPEPPRRTASPSRAVQXLPPPSPLPVPYAPY

SEQ ID NO: 195190 - protein, 75 aa, Triticum aestivum
  unsure (1)..(75): unsure at all Xaa locations
  Clone ID: PAT_TA_89608.pep
GRPRGTPPPPPPRPSSTSSRRSAPPARAPSRPPPCCSRAXTSRPRAPAPARTARRXPXRASRSRPPRPQPWRXPR

SEQ ID NO: 195191 - protein, 97 aa, Triticum aestivum
  unsure (1)..(97): unsure at all Xaa locations
  Clone ID: PAT_TA_89609.pep
MKGTKLAAILILQAVLVMGVLSHVNADYFPKCCNNCRSFSGVDVCDDAHPXCPKGCSACRVVSTXPEMWRCXDXKSNVQRNCRWPCXNYSVKQHDFA

SEQ ID NO: 195192 - protein, 110 aa, Triticum aestivum
  unsure (1)..(110): unsure at all Xaa locations
  Clone ID: PAT_TA_89610.pep
KATNPITVNKIIPTFNKEYVFFSVSPELKVTRILALSGVLLXLXSPSPSWNSXYPNSSSSATGNSPHLAILILLWAFHNFWENPRLLNYSVAFNNXSKTTVNVKITRVEG

SEQ ID NO: 195193 - protein, 133 aa, Triticum aestivum
  unsure (1)..(133): unsure at all Xaa locations
  Clone ID: PAT_TA_89611.pep
ITVQIYHIIYFTTNNHPIIYLSSGVNNQMAMMLPAPAAAAAAAPPASSWRARPAPSGTPAWTAWALQRARTSNXLQERDLRVRXTXTXKAPSIIHXXPNXQDXXYRXSPXKSPTLGXXKALKXSTRXAVXNRL

SEQ ID NO: 195194 - protein, 152 aa, Triticum aestivum
  unsure (1)..(152): unsure at all Xaa locations
  Clone ID: PAT_TA_89612.pep
MANPRVFFDMTVGGAPAGRIVMELYKDAVPRTVENFRALCTGEXKGVGKSGKPLHYKGXSAFHRVXIPDFMCQGGDSPRGNGTGGDPSTARIRRTRILHKHTNPGSLHGNAGPTQTVPFFIXXSLQVHLFSRDGLLKNTKRVPNGTVQTSLI

SEQ ID NO: 195195 - protein, 159 aa, Triticum aestivum
  unsure (1)..(159): unsure at all Xaa locations
  Clone ID: PAT_TA_89613.pep
LFCSLFFHVYAEGVPKRILMLRNSLGKMLQVVYRITLYHVGPPWEFRRLLSSKGVLTEHNEWDWCFSTLLSIAVGICFPALAPANLLMYVSCTVQLPXKHYQMFNXLXVQXDXIXLIRMDCECVAFQXNGLLNFDRXTCFGPSVCKLNVNLGNQEFWVR

SEQ ID NO: 195196 - protein, 106 aa, Triticum aestivum
  Clone ID: PAT_TA_89614.pep
SSSAKDVGQGTQCDHHQVDLIYWGFIVVSLGPPPPGISLLDIVTVFAVSSQDLSSGTAAGELDGGANDGNAGAATGDAQSAGAAGGDDGAATGDAQSAGAGAPTTS

SEQ ID NO: 195197 - protein, 88 aa, Triticum aestivum
  Clone ID: PAT_TA_89615.pep
KKCEGLPLAINAISSLLSTGKTKEEWYQVRSSICYAQGKNSDIDAMNYILSLSYLDLPHHLRYCLLYLTMFPEDYRVEMGALKYTAGF

SEQ ID NO: 195198 - protein, 79 aa, Triticum aestivum
  unsure (1)..(79): unsure at all Xaa locations
  Clone ID: PAT_TA_89616.pep
QXPSRRLPFSPSYGFXSXSSXFTXAXXRRSRHSLPRRRPPARPVPAXGXHLSHSRLXRAGGACAYTXDGXALXSPCCAG

SEQ ID NO: 195199 - protein, 64 aa, Triticum aestivum
  unsure (1)..(64): unsure at all Xaa locations
  Clone ID: PAT_TA_89617.pep
VGHFNNLFVSRHWVDWWYNWKXSYANTWQFPTHPGTMXTCLPTTFPHRSVLFQKQRYPGCMTKL

SEQ ID NO: 195200 - protein, 148 aa, Triticum aestivum
  unsure (1)..(148): unsure at all Xaa locations
  Clone ID: PAT_TA_89618.pep
ENCTSWLLSCFQTGDSPNQPHPADPMTVPLLSGNTTTVTESQSSTSHVYHSQGTVVKPEHPTAESPSGRTKLILPVLPKDPSLPGYSDSRWCNHNDNWKLTNHMFKHXHGTQQLDIRPSSPTSKKPPLQFGRQRNYNYXHIKKRYHIS

SEQ ID NO: 195201 - protein, 113 aa, Triticum aestivum
  unsure (1)..(113): unsure at all Xaa locations
  Clone ID: PAT_TA_89619.pep
MASKWVRPEVYPLFAATGVAIGICAFSLLXRNITGNPEXRVNKMGKGSGSAXRTMRRXRRYARHGXRAYVQDKTPKXMPXGTNXSFNQPKNGTLYPVLWTPQFITGCGKQTII

SEQ ID NO: 195202 - protein, 96 aa, Triticum aestivum
  Clone ID: PAT_TA_89620.pep
MKGTKLAAILILQAVLVMGLLSHVNADFFPKCCNNCRSFSGVDVCDDAHPKCPQGCSACRVVSTSPEMWRCADMKSTVDGTCGGTLQRSTDRFKPA

SEQ ID NO: 195203 - protein, 62 aa, Triticum aestivum
  unsure (1)..(62): unsure at all Xaa locations
  Clone ID: PAT_TA_89621.pep
QTASSCSASDXMXAVGLLGVCPXPXARWXGXTGGGFTGXLVXGAGXPAXAPFXRFRLPXXXG

SEQ ID NO: 195204 - protein, 135 aa, Triticum aestivum
  unsure (1)..(135): unsure at all Xaa locations
  Clone ID: PAT_TA_89622.pep
FKSYREGLMSPQTETKAGVGFKAGVKDYKLTYYTPEYETKDTDILXAFRSXSQPGXVPPXEAGAAXPAXXXTXTWXXGFXLDGLTXLDRXXDXAFKSXPVAGEXTQXSVXSLPLPXXEKGSVTKCYSHXXXLFGL

SEQ ID NO: 195205 - protein, 85 aa, Triticum aestivum
  unsure (1)..(85): unsure at all Xaa locations
  Clone ID: PAT_TA_89623.pep
MKGTKLAXILILQAVLVMGLLSHVNADFFPKCXNNCRSXXGGRLCHXAQPXVFPRXVRXXRVXHENVPPIHACWCEVIGSRHYSP

SEQ ID NO: 195206 - protein, 68 aa, Triticum aestivum
  unsure (1)..(68): unsure at all Xaa locations
  Clone ID: PAT_TA_89624.pep
EGRFRPEDDTPTALTSSSENRSNLAHVPNVVLPDEFPQVSAPMLMAXXGLTXXXAISSESGLQIFNXF

SEQ ID NO: 195207 - protein, 158 aa, Triticum aestivum
  unsure (1)..(158): unsure at all Xaa locations
  Clone ID: PAT_TA_89625.pep
RIRRPWRPPTRRRPSRTKPSSSADSKAKKGLLDKRFWKRKKSPNRLVVXEAXNDDNSVVALXPDTMEKXQLFRXXNVLLKGKKRKXTICNVLADEXXXXPQXXXDKTFRKKFXXKLGNXGLFTNAPDXKNGKRXXXLPIXKXFKGFKFFFFKQSLRPF

SEQ ID NO: 195208 - protein, 94 aa, Triticum aestivum
  unsure (1)..(94): unsure at all Xaa locations
  Clone ID: PAT_TA_89626.pep
VXEAHLGFVPGEALEVNFTLEVXXIPDDTXSTAXXRXRILRLVKGLXPTVLTLVXHESTTNXAXFXHWFAXXLDSXAVIFQXIDLXLXMDXXXR

SEQ ID NO: 195209 - protein, 83 aa, Triticum aestivum
  Clone ID: PAT_TA_89627.pep
DRHQELIFLWRNFGTGMIFAGLFAVEIFIIICSLVTNDQSCRQSDGKVELTCSLPYYVLAPRNLPVCTKRSLSDVSIRVRGLN

SEQ ID NO: 195210 - protein, 118 aa, Triticum aestivum
  unsure (1)..(118): unsure at all Xaa locations
  Clone ID: PAT_TA_89628.pep
QHQISTFXGLAXYEXXNFMDXEXXXIXXYDXTGPXAXXSLGXAAGXXRCGEDGAEVXVGRGRPGYRXXRGRAXTSSWRPCWXRFRRRTKGGRRRRIGHVSWSLLAAAWRGSEGREELA

SEQ ID NO: 195211 - protein, 125 aa, Triticum aestivum
  unsure (1)..(125): unsure at all Xaa locations
  Clone ID: PAT_TA_89629.pep
DLPYSIQLLSLXAXSTESPHRKXXCXRRRARHRVFDFFRDACRAIPSIKEEAAARQSLIGISQSTPAXGEALXVKSXNFIDGQXXEDSGEKRXHIQNXAESHLPRKCXIPRKRXGLNLSXNDPLA

SEQ ID NO: 195212 - protein, 91 aa, Triticum aestivum
  unsure (1)..(91): unsure at all Xaa locations
  Clone ID: PAT_TA_89630.pep
MKGTKLAAILILQAVLVMGVLSHVNADYFPKCCNNCRXFSGVDVCDDAHPKCPKGCSGCRVGSNEPPKLWRCAXMKSTVXDGTCGXPCKXY

SEQ ID NO: 195213 - protein, 147 aa, Triticum aestivum
  unsure (1)..(147): unsure at all Xaa locations
  Clone ID: PAT_TA_89631.pep
SVEPSAAAPPSALSFLLRSKMKFIAAYLLAYLSGNASPSAEDLTSILESVGCEIDNEKMELMLSQVKGKDITELLGCWXGEFAAVHLGGGGVAVSTAAPAAXGGAAAPAADXKKEESXXEKKRVDDDMGSSXRQVGTCVRTLGKEID

SEQ ID NO: 195214 - protein, 95 aa, Triticum aestivum
  Clone ID: PAT_TA_89632.pep
VNLELDNFIGCDRLPPLGCLEKLRSLTLRQMPDLKTVHQDISGGSNCLPMLQTLKIGSMPNLERWTTAHAPAAHAAHVRILPDLQTTQGFGLSKA

SEQ ID NO: 195215 - protein, 157 aa, Triticum aestivum
  unsure (1)..(157): unsure at all Xaa locations
  Clone ID: PAT_TA_89633.pep
LIFAGKQLEDGRTLADYNIQKESTLHLVLRLRGGMQIFVKTLTGKTITLEVESSDTIDNVKAKIQDKEGIPPDQQRLIFAGKQLEDGRTXADYNIQEGXTLQLVLRSVXGMQIFXKTSTGKTXLEVXTPTHXNVKAXSRQGGIPPDNNPVFNNGRRT

SEQ ID NO: 195216 - protein, 129 aa, Triticum aestivum
  unsure (1)..(129): unsure at all Xaa locations
  Clone ID: PAT_TA_89634.pep
MLDKLWDDVVAGPRPETGLDKLRRAAATQPLAINTAAGEAIKQSPSMPTTPDHPVTPSAVERPPAWRXVXAERFPTPGSNLATKNLRGNSXDGPQPTPQPLHXFXRTRDQNTLIRPTAFNFTMLRLWVT

SEQ ID NO: 195217 - protein, 94 aa, Triticum aestivum
  Clone ID: PAT_TA_89635.pep
GIPPDQQRLIFAGKQLEDGRTLADYNIQKESTLHLVLRLRGGMQIFVKTLTGKTITLEVESSDTIRQREGERFKDKEGIPPGPSSAHLWLGKHF

SEQ ID NO: 195218 - protein, 71 aa, Triticum aestivum
  unsure (1)..(71): unsure at all Xaa locations
  Clone ID: PAT_TA_89636.pep
SYKRDANLXHFDVTFFRVALFNLNVVLYLSVYSAXSTIXVRXIFSSXRIDXLFAYLLNKSXMLYXTIQLAV

SEQ ID NO: 195219 - protein, 146 aa, Triticum aestivum
  unsure (1)..(146): unsure at all Xaa locations
  Clone ID: PAT_TA_89637.pep
NXXRXXQXIXDXLKTVQXLXFCVGPLFSXMAGLDRYXXTLCVTGTXMAAAEDXEXSNWGHXLFRPXEXGGGGLGXEGIGVXGFXKNGSKWRRIIRGLKDTGVHRLPGGGGGGRNPRTWNLHRVPGHRRRYPLFSATVKSNSGRCRA

SEQ ID NO: 195220 - protein, 45 aa, Triticum aestivum
  Clone ID: PAT_TA_89638.pep
CVCISAGYGCPALYMRHVPCMHDLVNPMSNSWCKCHVHISVIKLL

SEQ ID NO: 195221 - protein, 131 aa, Triticum aestivum
  unsure (1)..(131): unsure at all Xaa locations
  Clone ID: PAT_TA_89639.pep
KVFXXLALLGMXPEFGLNLGGKKCXHFGXNXSSVXLFXXLXDLNCYVKLXYIQRLIGGLPFLALAGDAEPSLLRSRSPSLKVPLCVRNCRWWSSLGGQRELARLLHRRRRRRPAGSLVDGRDGRGRTAGAC

SEQ ID NO: 195222 - protein, 87 aa, Triticum aestivum
  unsure (1)..(87): unsure at all Xaa locations
  Clone ID: PAT_TA_89640.pep
ASPNREFPXXPASSCCCPSQQRNKAKKGKTLIDSGEPALPSHCLFLPNSHMDRMNRPMAFXTSXPRVDSRXHKGXXXLGLPPXKXXX

SEQ ID NO: 195223 - protein, 117 aa, Triticum aestivum
  Clone ID: PAT_TA_89641.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDWHIPLTGQICWPAVSQW

SEQ ID NO: 195224 - protein, 103 aa, Triticum aestivum
  unsure (1)..(103): unsure at all Xaa locations
  Clone ID: PAT_TA_89642.pep
SSVGFPXCRRIQGGRSNGARAGSALLSXSRRRPCSACRRLLLLLRVLVGRRAAPAERAERGGGLRPRRAGGEVRWPWRRRVHRRDLQPAPQQAHRVLASVATN

SEQ ID NO: 195225 - protein, 138 aa, Triticum aestivum
  unsure (1)..(138): unsure at all Xaa locations
  Clone ID: PAT_TA_89643.pep
EIVGPSFEALMKSLPNLPPNYKQAADFDWALHPGGSTILTGVERRLGLTPEHMRGSYDIYMNHGNSSSATIFSVLSRFRDKDMDECAPSGKVKDFXVACAFGPGVTIETCMLKRNLNHVARPLLNIGEIHHQKLKAAE

SEQ ID NO: 195226 - protein, 63 aa, Triticum aestivum
  unsure (1)..(63): unsure at all Xaa locations
  Clone ID: PAT_TA_89644.pep
TRPSTRIAKRYCWAACKXELLMSFSSVNDLLVQELXGYLPFTXHXDYLXSIPHVQVXVRPQRF

SEQ ID NO: 195227 - protein, 109 aa, Triticum aestivum
  unsure (1)..(109): unsure at all Xaa locations
  Clone ID: PAT_TA_89645.pep
MIQMSPRYQANLNYAEYKXLRVLDLKECADVKAQHVGKICDLLLLKYLSLGDSIDKVPRKIAKLKWLETLDMRRTQVVMLPIEVLHLPGLKHLLGKFQLLEGDCTHKSF

SEQ ID NO: 195228 - protein, 161 aa, Triticum aestivum
  unsure (1)..(161): unsure at all Xaa locations
  Clone ID: PAT_TA_89646.pep
NLLRTIDGKLAYLDFGMMGEFRQELRDGFIEACLHLVNRDFDGLAKDFVTLGLLPATAQKDEVTKALTGVFESAVNKGVQNISFGXICQGILGQTMYKFXSRSFILSLVIRILAVLEGLQQLQPNYKXXHSYPWIARKXLTDXHLTSSNGHLLYKEGLPDR

SEQ ID NO: 195229 - protein, 163 aa, Triticum aestivum
  unsure (1)..(163): unsure at all Xaa locations
  Clone ID: PAT_TA_89647.pep
GKSTTTGHLIYKLGGIDKRVIERFEKEAAEMNKRSFKYAWVLDKLKAERERGITIDIALWKFETTKYSCTVIDAPGXHRDFIKNMITGXTSQADCAVLIIDPXTGGLXLVSPKDGQTLEHLSLASSWGEAXDCCCNKMDATSQISQALTINFKSLKKALQPDK

SEQ ID NO: 195230 - protein, 91 aa, Triticum aestivum
  unsure (1)..(91): unsure at all Xaa locations
  Clone ID: PAT_TA_89648.pep
PSAEVKXLRQXXSNLVXGFVIXEQRGXPQRXXXLKLPVHGXHNIVAXSSPAQPVAASHFEVCVLAGNSDAISGCTIMPSRNRRCIIHGRWL

SEQ ID NO: 195231 - protein, 132 aa, Triticum aestivum
  unsure (1)..(132): unsure at all Xaa locations
  Clone ID: PAT_TA_89649.pep
MKGTKLAAILILQAVLVMGLLSHVNADFFPKCCNNCRSFSGVDVCDDAHPKCPQGCSACRVVSTSPKCGACADMKSTVXDGTCGGPGKXTDRVNAMIFPPKINKPGIVIWLSCLAMLQVGLRRGFPPPLGLG

SEQ ID NO: 195232 - protein, 124 aa, Triticum aestivum
  unsure (1)..(124): unsure at all Xaa locations
  Clone ID: PAT_TA_89650.pep
PVAGQLKLDYSIRRVQPLQNLCSRINQSDQLARVDVKGLXKHPQAILSPVEEQIATIYTGTRGYLDSLEXEQVNNFLDELRKHLKDTXKPQFQEIISSSKTFTEQAEILLKEAIQEQLERFSLQ

SEQ ID NO: 195233 - protein, 78 aa, Triticum aestivum
  unsure (1)..(78): unsure at all Xaa locations
  Clone ID: PAT_TA_89651.pep
CMLVXKIGXASVHLCXVEYVVCLLMLVRLLCCRWXIGRCTGRMYGXKIYHCSLHFLLYTMGVSLKEDLQRLLFIGKEI

SEQ ID NO: 195234 - protein, 142 aa, Triticum aestivum
  unsure (1)..(142): unsure at all Xaa locations
  Clone ID: PAT_TA_89652.pep
DYVWVHDYHLMALPTFLRRRFNRLRIGFFLHSPFPSSEIYRTLPVREEILKALLNCDLIGFHTFDYARHFLSCCSRMLGIXEYQSKRGYIGIXVLGRTVGIKXMPMGNHMDSIXSGSVLPDRNWRFPELXHXXRXNVLXRVG

SEQ ID NO: 195235 - protein, 152 aa, Triticum aestivum
  unsure (1)..(152): unsure at all Xaa locations
  Clone ID: PAT_TA_89653.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWXXYVAYPLDLFEEGSVTNMFTXIXSNYLGSKPXXLRWRXYESPYYXKFXXPPXXP

SEQ ID NO: 195236 - protein, 89 aa, Triticum aestivum
  Clone ID: PAT_TA_89654.pep
HLQRRPNRPNTSPMPSWSAAAACGESPPAAALTPTCCGSSTKTARGARVGRERDAEDDEGRILLRRPFLVRFPAARRRWSSGATAGGGE

SEQ ID NO: 195237 - protein, 142 aa, Triticum aestivum
  unsure (1)..(142): unsure at all Xaa locations
  Clone ID: PAT_TA_89655.pep
ATRHSTAAHRTSVATHRQQPPVFVEGGGHHSSSALKAYNAHTTQGTNAAGTMASLSAAAAGAPPPAMFRSTASVASLSSTTSTEEDGTSLYHHHLKGHNNPAVMQLHSSNARHAAQHQFLGNGRHPDXMTXPGDWAYSQLQT

SEQ ID NO: 195238 - protein, 72 aa, Triticum aestivum
  unsure (1)..(72): unsure at all Xaa locations
  Clone ID: PAT_TA_89656.pep
MAXXEYRCFVGGLAWATXDXNLXQAXSXYGXILDXKIINXRQTXRSRGFGFVTFGSXRXXXLXPSRXXNGXE

SEQ ID NO: 195239 - protein, 62 aa, Triticum aestivum
  unsure (1)..(62): unsure at all Xaa locations
  Clone ID: PAT_TA_89657.pep
PLVLAXXTFWEFVVLFXYXNVPLLVXLXLVQVXFAXNCXTWSWTLFRXTVWLVSLXQLATAL

SEQ ID NO: 195240 - protein, 88 aa, Triticum aestivum
  unsure (1)..(88): unsure at all Xaa locations
  Clone ID: PAT_TA_89658.pep
GSGSVRVREXLXXSRVSVVRXGEKGRDPWXTRXXXAXXXASPXPPTTTTSXRXSATYGEILPRQHXXRPRXXXVPWIRXXHLXAXXSR

SEQ ID NO: 195241 - protein, 113 aa, Triticum aestivum
  unsure (1)..(113): unsure at all Xaa locations
  Clone ID: PAT_TA_89659.pep
SYFCYKADCWRRNSQNESRISCPYDDDEAYQTFTKESVQFAKFSLRCRDXXPGGKCGIPSQSIVCNESITLYDRCPQEWCKSKTISDDNXTXAMPSXYHGNAMTKTSQHPKQQ

SEQ ID NO: 195242 - protein, 58 aa, Triticum aestivum
  unsure (1)..(58): unsure at all Xaa locations
  Clone ID: PAT_TA_89660.pep
NTEXXXPEVXYXLISRXPLVDXLGPHPISXXXVQTXGXGYXNGXLFSLXKKKKKKTRD

SEQ ID NO: 195243 - protein, 170 aa, Triticum aestivum
  unsure (1)..(170): unsure at all Xaa locations
  Clone ID: PAT_TA_89661.pep
RNPSRSVEPSAAAPPSALSFLLRSKMKFIAAYLLAYLSGNASPSAEDLTSILESVGCEIDNEKMELMLSQVKGKDITELLAAGREXFAAVPSGGGGVAVSSCCPCCXGXAAAPATESKERREXXEKEESDDDMGXSVRLILGNLCNLGQEQNVLITNCEGKILKVTVRLG

SEQ ID NO: 195244 - protein, 139 aa, Triticum aestivum
  unsure (1)..(139): unsure at all Xaa locations
  Clone ID: PAT_TA_89662.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGXSXFSTEMGXTKDDLNFQXNXXCLAIXNXFANGXAIHG

SEQ ID NO: 195245 - protein, 87 aa, Triticum aestivum
  unsure (1)..(87): unsure at all Xaa locations
  Clone ID: PAT_TA_89663.pep
SPHCHVGATSFTANHPHQSPLWHCFPSLGRPANARAWEARXSFKPRRLHINLQLGPSQFLDSSRYHPGPMGSNWADGSGILGGETGG

SEQ ID NO: 195246 - protein, 151 aa, Triticum aestivum
  unsure (1)..(151): unsure at all Xaa locations
  Clone ID: PAT_TA_89664.pep
APRSFVATGVELAAPPPSVAGNGRIRWIPSRSAALRRSRRTAPPHSPDLFTPPASPASAREREDDAIGRRRPHGPQTAKAQLCQPPASLASPSALTTPRPSVTSAHQIQPTYVSLPSCSPLLHRSRPSAVFRYVXMXRILRRSRCLLXGLV

SEQ ID NO: 195247 - protein, 79 aa, Triticum aestivum
  unsure (1)..(79): unsure at all Xaa locations
  Clone ID: PAT_TA_89665.pep
YRCFVGXLXWATDDQSLQNAFSKYXDVIDSKIITDRETGRSRGFGFVXFXXXSXAMXXAXXAMNXQXLXXRNITSRSPV

SEQ ID NO: 195248 - protein, 80 aa, Triticum aestivum
  unsure (1)..(80): unsure at all Xaa locations
  Clone ID: PAT_TA_89666.pep
MTLCADFDALRASAADVRIVTSDGQSIAAHSCVLASASPVLXERMIDRAXRRGWXADCTIRVLRRLLSTPSAFLHFLLLP

SEQ ID NO: 195249 - protein, 85 aa, Triticum aestivum
  unsure (1)..(85): unsure at all Xaa locations
  Clone ID: PAT_TA_89667.pep
LKKFSGXPXXNFRLXVSXXKICCXXIXIKXPXLGLIXNRXENCXLNQXXXAXPXAAXVSSGXRRRARDRAAIPDLSQEAKGGKQI

SEQ ID NO: 195250 - protein, 149 aa, Triticum aestivum
  unsure (1)..(149): unsure at all Xaa locations
  Clone ID: PAT_TA_89668.pep
SDRVLYLGPLSGDPPSYLTGEFPGDYGWDTAGLSADPETFAKNRELEVIHCRWAMLGALGCVFPELLXARNGVNSARLVVKAGPRFSSEGGSDYLGXPSWVHRKDPFHLGCKLVLMGPFEVRVXRRPLANXXTVYPGGXHPXLAXDPSF

SEQ ID NO: 195251 - protein, 63 aa, Triticum aestivum
  unsure (1)..(63): unsure at all Xaa locations
  Clone ID: PAT_TA_89669.pep
MADQLTDDQIAEFKEAFSLFDKDGDGCITTKELGTXMRSLGQNQREAXLQDMINEXDADGNGH

SEQ ID NO: 195252 - protein, 137 aa, Triticum aestivum
  unsure (1)..(137): unsure at all Xaa locations
  Clone ID: PAT_TA_89670.pep
SFLYMGRLLEGFGVGVISYTVPVYIAEISPQSTRGALGSVNQLSITLGIFLXAYVLGMFVPWXRLLAVLGTLPCTLXIPGLFFIPGSPRWLAKINXTDDFRTLXQXLRVSETDITAEXNDIKRVLXLQTKXTSFSKS

SEQ ID NO: 195253 - protein, 91 aa, Triticum aestivum
  unsure (1)..(91): unsure at all Xaa locations
  Clone ID: PAT_TA_89671.pep
QHDVVKGDPLSYDEAPTSSITELRRAETEEGDSRRKRXPAAKRARCTNAKTLGGRNGSSVPQERXXEKRRMXPXLIRTXFXLILXQLGLVR

SEQ ID NO: 195254 - protein, 53 aa, Triticum aestivum
  unsure (1)..(53): unsure at all Xaa locations
  Clone ID: PAT_TA_89672.pep
LKXSPAAPAPIAARNQRETPEPEEEXXMSXYNQHPPVGAPPPXGYGDXXGYTP

SEQ ID NO: 195255 - protein, 133 aa, Triticum aestivum
  unsure (1)..(133): unsure at all Xaa locations
  Clone ID: PAT_TA_89673.pep
MANPRVFFDMTVGGAPAGRIVMELYKDAVPRTXENFRALCTGEKGVRQERQALHYKGSRSRVDSPTSISXGXDFTKXNXTRGXPXYXEXXAQPXFXPQEXKPGIFSMXRRPKXTXHFSSXXPCICTELRQASA

SEQ ID NO: 195256 - protein, 94 aa, Triticum aestivum
  unsure (1)..(94): unsure at all Xaa locations
  Clone ID: PAT_TA_89674.pep
SXSLXTATGGXQXRVLXFTXXCTXPSNERLEVQGRVVCPRGCSKPLLLRINFCMELCQLKTFYWMYPDGWSHFGGIMYLLELKKKKKNSRLGLS

SEQ ID NO: 195257 - protein, 157 aa, Triticum aestivum
  unsure (1)..(157): unsure at all Xaa locations
  Clone ID: PAT_TA_89675.pep
AVAASHPVSAMMELGEGLCKLRRLRLEDDDDXQGPFSRFRDEVAAVLSFLYRTQKELAACNDELCLAMDGSATSXYQLLGDSASGQRLYRQGVDAGRRPRASSSPAAHPATTRFSMHGELSLHPREHISTALRAHDILLVHFGGNSYPSFILSKLSS

SEQ ID NO: 195258 - protein, 182 aa, Triticum aestivum
  unsure (1)..(182): unsure at all Xaa locations
  Clone ID: PAT_TA_89676.pep
ITLEVESSDTIDNVKAKIQDKEGIPPDQQRLIFAGKQLEDGRTLADYNIQKESTLHLVLRLRGGMQIFVKTLTGKTITLEVESSDTIDNVKTKIQDKEGIPPDQQRLIFAXGKQLEDGRTLAXDYNIQKXLPPTGCSXSXXXMQIFVKTSTGKDITWRWLGHIMLRKVKIRRDPPDNLISPE

SEQ ID NO: 195259 - protein, 183 aa, Triticum aestivum
  unsure (1)..(183): unsure at all Xaa locations
  Clone ID: PAT_TA_89677.pep
VMMMTTILVTIIMLLIWQVNIIVVLCFLTLFLGLELFFFSSVLGSVADGSWVLLVFAAVLYLVMYIWNYGTKLKYETEVKQKLSMDLMMDLGCNLGTVRAPGIGLLYNELVXGVPAXFGHFLTTMPAIHSMIIFXVCIKWVPVPCRXPKNEKVLFRXVCPKNYKCSLQCYGDKYQENPNIEQS

SEQ ID NO: 195260 - protein, 111 aa, Triticum aestivum
  unsure (1)..(111): unsure at all Xaa locations
  Clone ID: PAT_TA_89678.pep
IFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXKESTLHLVLRLRGGQ

SEQ ID NO: 195261 - protein, 180 aa, Triticum aestivum
  unsure (1)..(180): unsure at all Xaa locations
  Clone ID: PAT_TA_89679.pep
ETGRHVHMLTHEIRSTLDRHTILRTTLVELGRTLGLAECALWMPSRSGTALHLSHTIHNSAPIGLVVPINLPVVSKVFNKXIRAESIPHTSPLGXQIKADTSRYVXPPEVRSCPEFHWLHLTISEINDWPELSAKSXIMVLMLPPDSARNGXPMIGXVEIVAXQGGIARPSAIWIMRAVN

SEQ ID NO: 195262 - protein, 129 aa, Triticum aestivum
  unsure (1)..(129): unsure at all Xaa locations
  Clone ID: PAT_TA_89680.pep
TLNISSLPALPPTGPKPRSRVLEIVLPIASATVVLAVGIAAYILVRRRLRYAEVREDWEVAFGPQPFSYKDLYQATKGFSETNLLGAGGFGSVYKGVSXKPDMDTEXRQTGFPXXPRKGMKDPRVPNNG

SEQ ID NO: 195263 - protein, 134 aa, Triticum aestivum
  unsure (1)..(134): unsure at all Xaa locations
  Clone ID: PAT_TA_89681.pep
MGKIKIGINGFGRIGRLVARVALQSDDVELVAVNDPFITTEYMTYMFKYDTVHGHWKHSDIKLKDDKTLLFGXKKPVTVFGVRNPEEXPWGEAGCRLLCGSNGVLTDKDKAAAHLKVGAKKWTLPKQRSLLCWQ

SEQ ID NO: 195264 - protein, 65 aa, Triticum aestivum
  unsure (1)..(65): unsure at all Xaa locations
  Clone ID: PAT_TA_89682.pep
CSSLHIAELPTQFAVHKFIDSKIHHFXPVYPASIVTSSLSTCALRIRNGXQPDICSKIKVKEADP

SEQ ID NO: 195265 - protein, 177 aa, Triticum aestivum
  unsure (1)..(177): unsure at all Xaa locations
  Clone ID: PAT_TA_89683.pep
VTSILAAHPTEPVRSFSTYRLSFRRQDEDAVDGWLRDLANRGIEKLVLYFNEKRQQKVPESLFACASLKRLKVINGTFPDATEAAASLAVLAKIDLSDVKISEDSLNSLLSNCRALXERLKDHFHQQVRXLHIRXPEPQXPEHXGDFXXVFNGRRSRLEQVSGIPESNHIKITSKGF

SEQ ID NO: 195266 - protein, 142 aa, Triticum aestivum
  unsure (1)..(142): unsure at all Xaa locations
  Clone ID: PAT_TA_89684.pep
FSYREGLMSPQTXTXAGVXFXAXVKDYKLTYYTPXYXTXDTDILAAFRVSPQPVVPPEEARAAVAAESSTXTWXXVWXXGLTSLDRYKXLCYHIXPVXXEDXQXVCYVXYPLXLXEXXXVTNXXTSIVGNVFXFXXLRALFG

SEQ ID NO: 195267 - protein, 166 aa, Triticum aestivum
  unsure (1)..(166): unsure at all Xaa locations
  Clone ID: PAT_TA_89685.pep
SPQTETKAGVGFKAGVKDYKLTYYTPEYETKDTDILAAFRVSPQPGVPPEEAGAAVAAESSTGTWTTVWTDGLTSLDRYKGRCYHIEPVAGEXDSQWICYVAYPLDLFEEGPVTNMFTSXVSNVXGFKSLXRAXTWEDLTNSPTNSKTFXKARLNGXKXKRXNXNX

SEQ ID NO: 195268 - protein, 71 aa, Triticum aestivum
  Clone ID: PAT_TA_89686.pep
RQDQLSPRLHNIGLFHPHRPPSPESQARKSGGSSSWVFNTPQVSLTLPKHKAQVFFISRHLLPRLLLLKLV

SEQ ID NO: 195269 - protein, 128 aa, Triticum aestivum
  unsure (1)..(128): unsure at all Xaa locations
  Clone ID: PAT_TA_89687.pep
LADYNIAGQLHCYCQAKXELLLVYEYMSNGSLDRHLYGDGEKPVLDWDKRFRIIKGIASGLLYLHEECEKVIIHRDIKASNVLLDSEMNGRLGDFGLARLYDRGANPQTTHVVGTIGYLAPELGRTSK

SEQ ID NO: 195270 - protein, 51 aa, Triticum aestivum
  Clone ID: PAT_TA_89688.pep
NSQGASTSSVVCDEERIKGDITMKVGSRGNKAYSRTLIQYVYYGRFSFLKK

SEQ ID NO: 195271 - protein, 101 aa, Triticum aestivum
  unsure (1)..(101): unsure at all Xaa locations
  Clone ID: PAT_TA_89689.pep
VKMSRGGSAGGGQSSLGYLFGDGEPAKPAAAPAXSQHLLRNQHWAAADVTKQIPAGIPGSRANNYYRADCQNTGNFLTDSFNQVHAAPGGXSSXWYXFGGK

SEQ ID NO: 195272 - protein, 81 aa, Triticum aestivum
  Clone ID: PAT_TA_89690.pep
RTSLEFFFFFLSGIIFFLLFERKSISHSFSISSLFSLEQLLHRPLLLRHQPFYSLRSELHVVEMDVFRCILILRYIHFRDK

SEQ ID NO: 195273 - protein, 128 aa, Triticum aestivum
  unsure (1)..(128): unsure at all Xaa locations
  Clone ID: PAT_TA_89691.pep
MSDTDXHHFESKADSGASKTYPQQAGAIRKGGHIVIKARPCKVVEVSTSKTGXKHGHAKCHFVXIDIFYGKEXFEDIVXSSHNCDSPKFYRXDYQXIYITYXXISASLLKSGNTKGDLNFPLISAWPV

SEQ ID NO: 195274 - protein, 108 aa, Triticum aestivum
  unsure (1)..(108): unsure at all Xaa locations
  Clone ID: PAT_TA_89692.pep
GLSRLTQPSRSSASRRNPTGARRIEGTRPRCRRCSPLLAAAGPSFSGASSLRGSLGLDGARCPDRXGATCSRTCPRRSSTRYRPVGVKGLGAVGCEHYGHANHTXSCR

SEQ ID NO: 195275 - protein, 66 aa, Triticum aestivum
  Clone ID: PAT_TA_89693.pep
TNKLLLNIICACPWRQCATVEHVAHVAHVPDTNAFSGGSKCSCAGRKFTIYMSLYELIDFHFFLYT

SEQ ID NO: 195276 - protein, 103 aa, Triticum aestivum
  unsure (1)..(103): unsure at all Xaa locations
  Clone ID: PAT_TA_89694.pep
MAAKGSDGICVAQPRSADPLNWGKAAEELSGSHLDAVKRMVEEYRXPVVXMEGASLTIAQVAAXAXADXARVNSRSARGXVKESSDWVMTTWRTDDTMGHTRT

SEQ ID NO: 195277 - protein, 117 aa, Triticum aestivum
  unsure (1)..(117): unsure at all Xaa locations
  Clone ID: PAT_TA_89695.pep
SCSWFPFARGIKLAKLMGXLKLQTGADVHNSLVVALPKSVIFDCRXRRAXAQXXRXNQGRQGTWXGRRRCSAGRRTXXLQGRRRRSDAGIKSPCREASMQCRAGDERQGEGRGTQLG

SEQ ID NO: 195278 - protein, 170 aa, Triticum aestivum
  unsure (1)..(170): unsure at all Xaa locations
  Clone ID: PAT_TA_89696.pep
APXFFXFFNIRXMESSPSRSVAXLKVNIGGPLLITLTXLTFPGSVIVYKVAXAPVSXYIXTYSPASSLHSDEERTATQNESIKKEQGRNACVCGSSRRLIRRMPACPARTRTRASMACSLMRSRVADGHGVGRMARPRREHDRRADGGGDHVARDRVAHGRPSVHAHHPG

SEQ ID NO: 195279 - protein, 156 aa, Triticum aestivum
  unsure (1)..(156): unsure at all Xaa locations
  Clone ID: PAT_TA_89697.pep
KLGAAGGWXVTWXALKQRVPSNGLCGXKNAICEYHRPSRCXCAPGFTAKLQRXWRRERFXVGQGAYTGFYGYDLGVQPSPSRSQYCKXSCLNTCSCIAFSYRTDGQGRCYPKGLLFNGYTSPAFPGSIYLKVPGDLNATAPTPSAGLDCNIMVPAL

SEQ ID NO: 195280 - protein, 91 aa, Triticum aestivum
  unsure (1)..(91): unsure at all Xaa locations
  Clone ID: PAT_TA_89698.pep
DXTTDTGGRXFRFRNESACXXLTSARGIKSFDRRPXNTSGNGQAAPAGMHRRQPTPQVSDKPTTIQGWSTLVTTSTADVDNFCFDMNLNQL

SEQ ID NO: 195281 - protein, 84 aa, Triticum aestivum
  unsure (1)..(84): unsure at all Xaa locations
  Clone ID: PAT_TA_89699.pep
RSRVHASPNIIIVIMVSLYESSIPVFIKNLKVLAALLAKGSAHSGVTEKQLLESRLISRHGKPHLPXSKSSGYLQGLALXRRLG

SEQ ID NO: 195282 - protein, 121 aa, Triticum aestivum
  unsure (1)..(121): unsure at all Xaa locations
  Clone ID: PAT_TA_89700.pep
MAPKAAEKKPAEKTTAGKKPKAEKRAPASKEAGGEGKTRGRKKGSKAKKXLETFKIYIFKVLKQVHPDVGISSKGISSIXSFIKRILXEVPRXFGKLGRXNKEXTSLPGVXNFVRLSSPGE

SEQ ID NO: 195283 - protein, 109 aa, Triticum aestivum
  Clone ID: PAT_TA_89701.pep
CHLPPPTFVGAPFPAPDRRSGRTAPPPSCRRGSLHTTLLAWLPPRIRSRRPPSAASPFPSSATRSSSCPPPTTPSRRPPAPPSLWIQAALASPRCAAAGFKAAPISRAA

SEQ ID NO: 195284 - protein, 99 aa, Triticum aestivum
  unsure (1)..(99): unsure at all Xaa locations
  Clone ID: PAT_TA_89702.pep
XTAGDQAKEGSKLDGSGRSLGQGKVGEGEGWRKGRREGKKRARGGRRLEHVRKEGINWKEKKLRRGIWPESGRLEEWEKGIGKGLGQRSRKGKAKKSGE

SEQ ID NO: 195285 - protein, 159 aa, Triticum aestivum
  unsure (1)..(159): unsure at all Xaa locations
  Clone ID: PAT_TA_89703.pep
FKSYREGLMSPQTETKAGVGFKAGVKDYKLTYYTPEYETKDTDILAAFRVSPQPGVPPEEAGAAVAAESSTGYMGQLFGTDGLTILDXRYKGRCYHIEPVAGEDNHGXVXYLSIRLXEXGPVXNMLIPLXXTIWFXTLXXQWGYNPPLIKSKAAHGSSR

SEQ ID NO: 195286 - protein, 70 aa, Triticum aestivum
  unsure (1)..(70): unsure at all Xaa locations
  Clone ID: PAT_TA_89704.pep
MDYLFHLIKLLLKSDINFGDTKLAPXLGQLLQTCCGFHWDXDVFNSVSTLXLXRLVNYNILVXRSRLIPF

SEQ ID NO: 195287 - protein, 138 aa, Triticum aestivum
  unsure (1)..(138): unsure at all Xaa locations
  Clone ID: PAT_TA_89705.pep
WWVTKFAPLLKKLSNYEVINFDKEEEVHCFPGGQLGLYRDRDLIIGPHPTRNPHNYTMVDYNRFLRRAFGLPRDAPAVLGEXDGVKPKMLKXERKGNPKXLNLRAXXASXXDSVQGNCGRPGQRPKRSSPQLVLITPG

SEQ ID NO: 195288 - protein, 116 aa, Triticum aestivum
  unsure (1)..(116): unsure at all Xaa locations
  Clone ID: PAT_TA_89706.pep
MLDKLWDDVVAGPRPETGLDKLRRAAATQPLAINTAAGEAIKQSPSMPTTPTTPVTPSSXDAAAWRQRVAERFPPREQPGHQKLGANLFDRPQPXSPTVYDWXLYSDETRTRSNTA

SEQ ID NO: 195289 - protein, 173 aa, Triticum aestivum
  unsure (1)..(173): unsure at all Xaa locations
  Clone ID: PAT_TA_89707.pep
YTPEYETKDTDILAAFRVSPQPGVPPEEAGAAVAAESSTGTWTTVWTDGLTSLDRYKGRCYHIEPVAGERQPMXICYVTYPLDLFXEGSXVSNKFTSIVGNVFXVSKALLXQXLEDLTIPPYXSKTFQRPAQGTQVERIIXQLXPXLMGXXIXPKLGYPQKYGXXXXNXHLGX

SEQ ID NO: 195290 - protein, 154 aa, Triticum aestivum
  unsure (1)..(154): unsure at all Xaa locations
  Clone ID: PAT_TA_89708.pep
NPLPSRVPTSTSGQTWTPQPPEPGERGRRGAAGRKAGGPRKKSVTRSVKAGLQFPVGRIGRYLKNGRYAKRVGTGAPVYLAAVLEYLAXELLELAGNAAKDNKNPASCPRHLLLAXRNDXELGKCWRRHIAKAAANINPFCPKRTPNAIPRQLT

SEQ ID NO: 195291 - protein, 94 aa, Triticum aestivum
  unsure (1)..(94): unsure at all Xaa locations
  Clone ID: PAT_TA_89709.pep
GXXKXKXGXXMEXRXRGXDXGRAAEPWSXXAGXSGXQIRXAXRXLRRGXGXGSGSEAAKEPGEGGEGARTLKTGRWVGWGRRRKDREGGRVAAG

SEQ ID NO: 195292 - protein, 61 aa, Triticum aestivum
  Clone ID: PAT_TA_89710.pep
AQLGPVGWEVASKRIEQVIPPGTAFGRGWVGDSESPNSFQATCTNFISDTNTTTKQHSGIE

SEQ ID NO: 195293 - protein, 101 aa, Triticum aestivum
  unsure (1)..(101): unsure at all Xaa locations
  Clone ID: PAT_TA_89711.pep
MKGTKLAAILILQAVLVMGLLSHVNADFFPKCCNNCRSFSGVDVCDDAHPKCPQGCSACRVVSTSPEMWRCADMKXTVDGTCGGTCKXTDRSCRHDMFRLK

SEQ ID NO: 195294 - protein, 168 aa, Triticum aestivum
  unsure (1)..(168): unsure at all Xaa locations
  Clone ID: PAT_TA_89712.pep
QIFVKTLTGKTITLEVESSDTIDNVKAKIQDKEGIPPDQQRLIFAGKQLEDGRTLADYNIQKESTLHLVLRLRGGMQIFXVKTLTGKTITLEVXESPTQSDNVKAKIQXDKEGFPRDQQRLIFAGKQXEDGPTXADYNIQKXPPPTGLFVALCPVFDCWLWSGRCLRQ

SEQ ID NO: 195295 - protein, 147 aa, Triticum aestivum
  unsure (1)..(147): unsure at all Xaa locations
  Clone ID: PAT_TA_89713.pep
MANPRVFFDMTVGGAPAGRIVMELYKDAVPRTVENFRALCTGEKGVGKSGKPLHYKGSSFHRVIPDFMCQXGGDSPKGNGTGGXSIYGEXFADEXFVHKHTKPGSLQGQRGPNTTSNSSERPPAIRTCFPPRMDSIRRSPTDCQTIS

SEQ ID NO: 195296 - protein, 165 aa, Triticum aestivum
  unsure (1)..(165): unsure at all Xaa locations
  Clone ID: PAT_TA_89714.pep
RAGKHGVKPHHPFRAGPRCHPGKKNRSTLANPRRPTRASPKTRSVEPPCSNLRQRLRTASTPSIRRGGRTTATAPPPQPADMAPVEAAARSPSLPRPAPLRSQIGPXPPPKSQPPSPTTSTHHHLPPPPGREDPAEVAARGPRCHRARSGRGAASRPRARPASSQ

SEQ ID NO: 195297 - protein, 139 aa, Triticum aestivum
  unsure (1)..(139): unsure at all Xaa locations
  Clone ID: PAT_TA_89715.pep
VEPSAAAPPSALSFLLRSKMKFIAAYLLAYLSGNASPSAEDLTSILESVGCEIDNEKMELMLSQVKGKDITELLAAGREKXAAVPSGGGXLAVXAAAPAAGGAAAPAAESKKEEKXWEXEESDDYMGSSCSTKLWGTCV

SEQ ID NO: 195298 - protein, 163 aa, Triticum aestivum
  unsure (1)..(163): unsure at all Xaa locations
  Clone ID: PAT_TA_89716.pep
PHPISPGNLRSKRSQGFLVLLLKMQIFVKTLTGKTITLEVESSDTIDNVKAKIQDKEGIPPDQQRLIFAGKQLEDGRTLXADYNIQKEXTLHLVLRXRCGMQIFVKTXTGKTITWSRXSDTXDNVKXKIQDKEGSPGQHSHFAXXSRGWRTLLTTNQKHLCQV

SEQ ID NO: 195299 - protein, 139 aa, Triticum aestivum
  unsure (1)..(139): unsure at all Xaa locations
  Clone ID: PAT_TA_89717.pep
MQIFVKTLTGKTITLEVESSDTINNVKAKIQDKEGIPPDQQRLIFAGKQLEDGRTLXADYNIQKXPPSTWVLRLRREACSFCQDLTGKTSLGVXPPDTSTSXGKIQXKEGSPGQQRXILAAXIRMRHGYKSQPTGSLEF

SEQ ID NO: 195300 - protein, 79 aa, Triticum aestivum
  unsure (1)..(79): unsure at all Xaa locations
  Clone ID: PAT_TA_89718.pep
MSCCGGNCGCGTACKCGNGCGGCNMYPEAEXAAGATLLVSATATHKASSGGMDXRXENGGCGCTQCKCGTKLRCSCCSC

SEQ ID NO: 195301 - protein, 129 aa, Triticum aestivum
  unsure (1)..(129): unsure at all Xaa locations
  Clone ID: PAT_TA_89719.pep
VIDAPGHRDFIKNMITGTSQADCAVLIIDSTTGGFEAGISKDGQTREHALLAFTLGVKQMICCCNKMDATTPNYQKAXRYEEIVKEXSSYLKEVXYNPYKVXFVPISGFEGDNMIKKSTNXXWYXGQPS

SEQ ID NO: 195302 - protein, 88 aa, Triticum aestivum
  unsure (1)..(88): unsure at all Xaa locations
  Clone ID: PAT_TA_89720.pep
SVFYLPAVFPTFLCAASLRHAAPAPVRHCLPLQPYSIHLPLSSSNLSSSLYDYSISHRSTFSQFIFSTSFRGHHEICXFSLAAAASLP

SEQ ID NO: 195303 - protein, 79 aa, Triticum aestivum; identical to SEQ ID NO: 185883
  unsure (1)..(79): unsure at all Xaa locations
  Clone ID: PAT_TA_89721.pep

SEQ ID NO: 195304 - protein, 163 aa, Triticum aestivum
  unsure (1)..(163): unsure at all Xaa locations
  Clone ID: PAT_TA_89722.pep
MDCSSSKETPPHKAWWTGETVAVVTGANRGIGHALAARLAEQGLSVVLTARDEARGEAAAAELRARGLPSVRFRRLDVTDSASVAAFASWIRDDVGGLDILVNNAGVSSTXLXTNSVEHAETVLXTNFXGAKMLIXALLPXFRRSSGTSGSEPQSNLSHIMLL

SEQ ID NO: 195305 - protein, 76 aa, Triticum aestivum
  unsure (1)..(76): unsure at all Xaa locations
  Clone ID: PAT_TA_89723.pep
MRECISIHIGQAGIQVGNACWELYCLEHGIQPDGXMPGDKTVXGGDDAFNTFFSETGXAGKHVPRAVFVDFRSHCD

SEQ ID NO: 195306 - protein, 108 aa, Triticum aestivum
  unsure (1)..(108): unsure at all Xaa locations
  Clone ID: PAT_TA_89724.pep
MRAVAIASPGGPEVLEEREVEDLAAPGDGEVLLGLAAAGVNRTDTVQRQGXPAPSGASPYPGXVLRSILALGXNVNRAGPPRQVCALLNGGGYPRMXXPAXCSPRVSL

SEQ ID NO: 195307 - protein, 130 aa, Triticum aestivum
  unsure (1)..(130): unsure at all Xaa locations
  Clone ID: PAT_TA_89725.pep
MSPQTETKAGVGFKAGVKDYKLTYYTPEYETKDTDILAAFRVSPQPGVPPEEAGAAVAAESSTGXTWTTVWXTDGLTXVLDRYKGRCYHIEPVAGEDSQWICYVLXPLDLXXRRSLTNMLLPLGNVLQKP

SEQ ID NO: 195308 - protein, 159 aa, Triticum aestivum
  unsure (1)..(159): unsure at all Xaa locations
  Clone ID: PAT_TA_89726.pep
GDHREDGHGVEEEPEEEEETAGGFPEVKRLVNSHTLADTKKLQLDGGARLRPRRXEEDGDSCRFGASTLTSESTSKSSVEWQSSTVTTGKDAYSDLFSSSSRRSSARWESYTLFRKYDEDMVYFQRVGAXSSPRXIXKSXKCQPRPCPTYAQAVMAAQG

SEQ ID NO: 195309 - protein, 130 aa, Triticum aestivum
  unsure (1)..(130): unsure at all Xaa locations
  Clone ID: PAT_TA_89727.pep
GQEGQSQRRRELRVPGVHIHGWKRAPARARREPRRHHLRGVAEELSLLSYNXSARTSSQQQQQQHRLPXLXLXNGGRXCAKAFXPRSXXTADKPCEVXTLQLVSSSRFQKPCKSXGHLXAFLXVKRSKXL

SEQ ID NO: 195310 - protein, 157 aa, Triticum aestivum
  unsure (1)..(157): unsure at all Xaa locations
  Clone ID: PAT_TA_89728.pep
NKSVLYISLHRHEDGSFYPGTGAADEVGVLDGKGFSVNIPWSCGGVGDNDYIFAFQHVVLPIATEFAPXDITIISAGLDAXKGDXLGCCDVXPAXYPKMTPXVNCLLXKKMLGILXGRYILRPXSSSATEVVKVPLPGRPNYQMQQHIQRRHQTSSG

SEQ ID NO: 195311 - protein, 96 aa, Triticum aestivum
  unsure (1)..(96): unsure at all Xaa locations
  Clone ID: PAT_TA_89729.pep
EENWSRVFFFLSCSFPCAGSLLILLDVCAVYQQGASEGLLTNELEDCFVLGTHMIKEEMGXPGCAMXSKGESSXFLSSXLTXKIISRFPCIFKLGP

SEQ ID NO: 195312 - protein, 93 aa, Triticum aestivum
  unsure (1)..(93): unsure at all Xaa locations
  Clone ID: PAT_TA_89730.pep
KKHFESLPNHTGYSNTMAASVACAFFFDARAGGRAGHPGAGRLPRLRQARWXRHDSQVTRGTXLCNKDSGXQXTRPFPPSKRRRCTXLXRNPG

SEQ ID NO: 195313 - protein, 107 aa, Triticum aestivum
  unsure (1)..(107): unsure at all Xaa locations
  Clone ID: PAT_TA_89731.pep
MGRVIRAQRKGAGSVFKSHTHHRKGPARFRSLDFGERNGYLKGVVTDXIHDPGRGAPLAKVTFRHPFXRYKHXKESSVAXXGMYTXXXVYGGRRXTSPLVPPASLVP

SEQ ID NO: 195314 - protein, 79 aa, Triticum aestivum
  unsure (1)..(79): unsure at all Xaa locations
  Clone ID: PAT_TA_89732.pep
XRARSAPRGRPXRRAXRARRXGRRRGVPPXAXPRRTPWAVPXSXIRXXEGGREGSGVGDTATNRPDVRWTGSRFRVALP

SEQ ID NO: 195315 - protein, 63 aa, Triticum aestivum
  unsure (1)..(63): unsure at all Xaa locations
  Clone ID: PAT_TA_89733.pep
TRRREGEXXRXXAQHLATEAGRLRRXXXAXPAPAPPRERAVAIFLPLAALAWSGSAACARRLL

SEQ ID NO: 195316 - protein, 105 aa, Triticum aestivum
  unsure (1)..(105): unsure at all Xaa locations
  Clone ID: PAT_TA_89734.pep
MGYYDDGHCESGGSAEPAFTHNTVTIPCHHIRXLGDLLILQGRPCQVIRISTSGGXLGQHRYPGVDLITKQLHEEPXXSNQVLMLSVXTMLRPIFKQYRXLDLQE

SEQ ID NO: 195317 - protein, 91 aa, Triticum aestivum
  unsure (1)..(91): unsure at all Xaa locations
  Clone ID: PAT_TA_89735.pep
MKGTKLAAILILQAVLVMGVLSHVNADFFPKCCNNCRSFSGVDVCDDAHPKCPKGCSACRVXVSTSPEMWRCADMKSTVDGTCGGXPCKKY

SEQ ID NO: 195318 - protein, 69 aa, Triticum aestivum
  Clone ID: PAT_TA_89736.pep
QGNVMKQSKHTHIPSSKLNTRLVALVLRTISLKQINSKHRAVMMHQACIWMNVQKEPNTQLSMMQEEHL

SEQ ID NO: 195319 - protein, 99 aa, Triticum aestivum
  unsure (1)..(99): unsure at all Xaa locations
  Clone ID: PAT_TA_89737.pep
MKGTKLAAILILQAVLVMGLLSHVNADFFPKCCNNCRSFSGVXVCDDAHPKCPQXGCSACRVVSXKPRKXWRCADINSTFEREPAVGPCKEVLIGFMPA

SEQ ID NO: 195320 - protein, 88 aa, Triticum aestivum
  unsure (1)..(88): unsure at all Xaa locations
  Clone ID: PAT_TA_89738.pep
EDVFKYMPREAVDREETAAGWIRSEGDAFLHGALPCLVDGPGRRVRSFSPXEEXYDQLTIEAXXPXRSXXXIQXXPXGCNPXPQGLPF

SEQ ID NO: 195321 - protein, 106 aa, Triticum aestivum
  Clone ID: PAT_TA_89739.pep
LMNPPERASRCPGASKVGNSESLVKRGPMARHQVLEGAAHGKEVRRRESTVVAGGAPKAELAGSIPGRGGLGVGRRSGAEMSATVGRIRGGMGHASSPAVLMKVVG

SEQ ID NO: 195322 - protein, 69 aa, Triticum aestivum
  unsure (1)..(69): unsure at all Xaa locations
  Clone ID: PAT_TA_89740.pep
RSSTLGYVSCIVDDDLHRRYDGHDDEPSEWISQGYYITQIVLLFRLDGLTHVVSFELCFCSFPIELVFX

SEQ ID NO: 195323 - protein, 91 aa, Triticum aestivum
  unsure (1)..(91): unsure at all Xaa locations
  Clone ID: PAT_TA_89741.pep
CLSCITERRSLSXDXLXNFSTFNMIFEVISAYRNVGLSIGYSCARLPHPEKQSVCQDMPYSFSGWWSDQGKVVLVLVMLCGRLKCFHRQRS

SEQ ID NO: 195324 - protein, 161 aa, Triticum aestivum
  unsure (1)..(161): unsure at all Xaa locations
  Clone ID: PAT_TA_89742.pep
DLSDAGSGEQISLATHPSMAAVYSQSQANGVDMADIQDLTNISHMLLSLLPFASPPEVAQLAVALWVLGSTTLVLALTILFHLPPAGPVFGRCAASLLRHSRGRPPRRRAGGAGDRALPAPQAAXAASSPSPPNSCPALXYPPPRHLXMLSFKTKXKSWXX

SEQ ID NO: 195325 - protein, 147 aa, Triticum aestivum
  unsure (1)..(147): unsure at all Xaa locations
  Clone ID: PAT_TA_89743.pep
MSRRTPNPAAERAAQNAQTIKSLLKLEGNKICADCKRNKHPRWASWNLGIFICIRCSGIHRGMGTHISRVKSVDLDAWTNEQLESVLKWGNSRANKYWESKLAAGHVPSDSKIENFIRTKYETKXWVMEGQFQDSSAPXADEDEDVQ

SEQ ID NO: 195326 - protein, 67 aa, Triticum aestivum
  unsure (1)..(67): unsure at all Xaa locations
  Clone ID: PAT_TA_89744.pep
SLPGLAAFASLFHVGIAAVLLLYVLFWVKLXLFTTLKYLSFLGVFLVFVGHRTLSHLSNTAAKQKTA

SEQ ID NO: 195327 - protein, 137 aa, Triticum aestivum
  unsure (1)..(137): unsure at all Xaa locations
  Clone ID: PAT_TA_89745.pep
MARLNSKAVAAAVVLAAVVLMMAGREASAAXSCGQVDSKLAPCVAXERGRASXLSKECCSGVQGLNGLARSSPDAKIACKFLKDLATSINXSTWASLRRXPQFGVRLPFPITFHNCNISTIYIYLPTAAMTPCVDLF

SEQ ID NO: 195328 - protein, 124 aa, Triticum aestivum
  unsure (1)..(124): unsure at all Xaa locations
  Clone ID: PAT_TA_89746.pep
TSALRPHRDLLATFGFCARSRQRQLSSTSCGRLSTTPISFRFRTPAAPPSFSLRLCPIPTGFILSFAPPKTTAKYAXPCFALSGRTLNPIPXHXTPTVPCQSXXRHSPAVXRGLXSRPXCGLGX

SEQ ID NO: 195329 - protein, 87 aa, Triticum aestivum
  unsure (1)..(87): unsure at all Xaa locations
  Clone ID: PAT_TA_89747.pep
RADAXKSAAAVPNGXPRMPGGRVALALPCSAPTLPSFPLGRNRRAVGERLGRRPVLLGPHGRRCGRRLLAGRRPSGLWASGMEGKGV

SEQ ID NO: 195330 - protein, 97 aa, Triticum aestivum
  Clone ID: PAT_TA_89748.pep
GQNEVLNRQVVKSDSATIKIPELDFEIPPEAQRGTLSTVEGIIMRAVEELQALQDERKVNLWACMLIVQAYSLISIDHLSDMTSSLGASRKRVLKKA

SEQ ID NO: 195331 - protein, 126 aa, Triticum aestivum
  unsure (1)..(126): unsure at all Xaa locations
  Clone ID: PAT_TA_89749.pep
GKRXGEPPXLGXEAWXPPRGCXLSFEEXXXGXRPGRTGSTRASSRTTXXDGDAGEXAXPQAVQGPRPAGVALEVEAXXXXXRXXPXXDPXSXGXAAWRRRRAXCVWXWXLGXRIVXEFMQPRGDPT

SEQ ID NO: 195332 - protein, 145 aa, Triticum aestivum
  unsure (1)..(145): unsure at all Xaa locations
  Clone ID: PAT_TA_89750.pep
ASCPLRHSPAASGATSHRINPQNLAAVAPGRRRRRRRRSHERLPVPGGHDPPLLGHRPPPQDLRQQSCSRVSXKTXSCTWRCSVARYLXSSTTNLALXSVMKXSSSQLRRISGNRATQGRXLRRTKLRTLLXARLVASXKTXPRE

SEQ ID NO: 195333 - protein, 80 aa, Triticum aestivum
  unsure (1)..(80): unsure at all Xaa locations
  Clone ID: PAT_TA_89751.pep
MSCCGGSCGCGSACKCGNGCGGCNMYPEVEAAGXAPSSFAATATHKASSGGMEIAAENGXGCXCTNAKCGTSFRCXCCSC

SEQ ID NO: 195334 - protein, 109 aa, Triticum aestivum
  unsure (1)..(109): unsure at all Xaa locations
  Clone ID: PAT_TA_89752.pep
GYLPGRMAPLLAFYGVMSLAFVALAAFWFLRYARFWREVVPLQNFVTVVIALGMVEXVTTWYLDLADSAIRIRPAXTXFWAALPGGSPHGVPPADLSSPKGTACAAIEG

SEQ ID NO: 195335 - protein, 52 aa, Triticum aestivum
  unsure (1)..(52): unsure at all Xaa locations
  Clone ID: PAT_TA_89753.pep
MEAPPGPEPMMLDAPPPLAAAVPAHAAAEKARTXGGYPVTGHIIXXTIGGXN

SEQ ID NO: 195336 - protein, 96 aa, Triticum aestivum
  unsure (1)..(96): unsure at all Xaa locations
  Clone ID: PAT_TA_89754.pep
TWXPXCRLLLLDGIRRPKACHSXASPYARAPQFCXPCRVRGXHEAAAAAEALPVSFECIFDHSRSLANRVMQSIQEDARCCARADATAIGYVIPES

SEQ ID NO: 195337 - protein, 137 aa, Triticum aestivum
  unsure (1)..(137): unsure at all Xaa locations
  Clone ID: PAT_TA_89755.pep
CXWPCXXPDXVLLLXSAXLXHAAFLNXACCRSPHSQTSVLMLTPSSSGKPPLLPRLFSKRVGSLRPDXGQVRPXHXRWNFSSRHDSGEDRSANLXAGAPCPNSGSGRSSSLLSPASSPPRRDSGEDRGASSPPRRSS

SEQ ID NO: 195338 - protein, 133 aa, Triticum aestivum
  unsure (1)..(133): unsure at all Xaa locations
  Clone ID: PAT_TA_89756.pep
GNQTNANPKSPIRAALFPLDXGXLDXVCGXXXRCCSSXGXCPXYXARLPPXSQKLRTXVPIRXKKFXHYQTISPRVNLICFXXKLVSXXVCLKXGPQXNVYFQFXFLGXSXHQQTSLKDNNPFCXTEKLKXSS

SEQ ID NO: 195339 - protein, 134 aa, Triticum aestivum
  unsure (1)..(134): unsure at all Xaa locations
  Clone ID: PAT_TA_89757.pep
WISAPPRSPSSCCFCCSLLRVRPARLAEPRRRTWGSAGRPPPLLLLLLGLVVATALAADSASASEGDADSLXKACFERCQRTXXLKEXVKQCVLPTDDXPADKEWYXITFXLQWKDWTAXRMPYIDMERNRKGK

SEQ ID NO: 195340 - protein, 109 aa, Triticum aestivum
  unsure (1)..(109): unsure at all Xaa locations
  Clone ID: PAT_TA_89758.pep
EYIVRRPWRAAAAAWPVCCSPPCCACSCRSXAARSSXWGSTXXPAPXPSNLREGPXRARLRXKLXXPXXXPXHIXKSXSQXGDXPXXVXLTRGXDPXXXXPPKXPAXGX

SEQ ID NO: 195341 - protein, 101 aa, Triticum aestivum
  unsure (1)..(101): unsure at all Xaa locations
  Clone ID: PAT_TA_89759.pep
FQLRYLKVSTFPSSIDLPAEVRGLVHLETLEISGGARSIPSDIVCLPRLSRLILPIQPCPPQGISNIKSLRALHCXNISLEDIKGLVSLPPKNFKDLYYLR

SEQ ID NO: 195342 - protein, 80 aa, Triticum aestivum
  unsure (1)..(80): unsure at all Xaa locations
  Clone ID: PAT_TA_89760.pep
SYQLXTPGFXTFXGPEATXXAADDEASXFXVPXPXXXLXLPAFLXXRPIGKLRXRGLPERERGGXGGGGAKAVVVGVGGD

SEQ ID NO: 195343 - protein, 109 aa, Triticum aestivum
  unsure (1)..(109): unsure at all Xaa locations
  Clone ID: PAT_TA_89761.pep
TLQSPSSNNTRXQRLTARYXKXCKCMLSXDXQQTQTHXSTEXXETAKPFSSPASXTXPLXRGVWAKALRXTCHFPPARAAXKFGLDXAMRXXAPSLREMAXIGPXSVLY

SEQ ID NO: 195344 - protein, 133 aa, Triticum aestivum
  unsure (1)..(133): unsure at all Xaa locations
  Clone ID: PAT_TA_89762.pep
FTMSPRARPERWTNEGGKESFRRSQDXGKKXRFTPNLALLQXXRTALKSGRRSPAPXPFQPERPHVDPAGIGERRPPPAQGNLGSSWRDLGGRSREDPPASLAPRSERQIQGGRQEDGRRIGGLLGIEGRRSE

SEQ ID NO: 195345 - protein, 64 aa, Triticum aestivum
  Clone ID: PAT_TA_89763.pep
MFVGDVRDTLAELGNGLPSIAAGVGMVYAHPVARFELNFSLPLVARKGEKGRKGLQFGVGINFL

SEQ ID NO: 195346 - protein, 90 aa, Triticum aestivum
  unsure (1)..(90): unsure at all Xaa locations
  Clone ID: PAT_TA_89764.pep
MKGTKLAAILILQAVLVMGVLSHVNADYFPKCCNNCRSFSGVXVCDDAHPKCPKGCSACRVVSTSPXNVGAARDIKSTVDXTCGGACKXY

SEQ ID NO: 195347 - protein, 159 aa, Triticum aestivum
  unsure (1)..(159): unsure at all Xaa locations
  Clone ID: PAT_TA_89765.pep
GNGPPTNFLIKDXXFXKKXFKFXREXFXFRPNCNWVSXGEXFKPLFCXGXTLCRWEVLXXXXLXAPEFXPGSKPSGSWGTACAGDRXKFPRQXSRSDXXLQRHSSRPVPLHVEXRGRASXLDAAGSPSPVVRFAIATPXSIPSPADAITMGAXIFAAEP

SEQ ID NO: 195348 - protein, 108 aa, Triticum aestivum
  unsure (1)..(108): unsure at all Xaa locations
  Clone ID: PAT_TA_89766.pep
FPTMPQDXLALFAPAASKGHLWNGLPGXDIDCGVLRTATSTTAPPPTLSATLTNGTQGLPPCLSKLVGFHSSHDFRDASTVTTVGGCSSACLRILLQSHRLRRYRYDC

SEQ ID NO: 195349 - protein, 116 aa, Triticum aestivum
  unsure (1)..(116): unsure at all Xaa locations
  Clone ID: PAT_TA_89767.pep
SDLTXDLLFAFVFPSDLLHGFTSLSPLGQLVASMQGFGYPXTNSCSGNLNTEEEDDGRKTKRSSCFLVDFLSGGRGERRKALWLASEWNCPSYLRSSHIRFAQIARPVVDSLPLLF

SEQ ID NO: 195350 - protein, 87 aa, Triticum aestivum
  unsure (1)..(87): unsure at all Xaa locations
  Clone ID: PAT_TA_89768.pep
DHIHNGKAVAVLTGSEGVKGTIFFTQEGDGPTTVTGSVTGLKEGXHGFHVHALGDTTNGCMSTGTTLQPFLSCAWGPEDSAMLILGM

SEQ ID NO: 195351 - protein, 124 aa, Triticum aestivum
  unsure (1)..(124): unsure at all Xaa locations
  Clone ID: PAT_TA_89769.pep
LYTNHIYYFLVISSFISDQPTXRELIRRLSFSDRVSDGSGGVPRGCVPVLVVGDGXEKCERSWVRVGGPAAPVACSASXEWRRQDSGYKQEGTSRVPCAVHHXRQASLPRPLPRTTDNKLFPAY

SEQ ID NO: 195352 - protein, 147 aa, Triticum aestivum
  unsure (1)..(147): unsure at all Xaa locations
  Clone ID: PAT_TA_89770.pep
RSPPTDPPPPPAFSPRHAAPTXPPPADPXRRKPPPATPPAAPSQIRLDYPPXTAPAPSRGHPRILATPPSQHSCAPPPPPGSRSSATRSFLPSPPSSSXASLAGAGAGCSPRFPPLGPASGRRAPPPPPAAGAVLIPGSSILAMCGR

SEQ ID NO: 195353 - protein, 108 aa, Triticum aestivum
  unsure (1)..(108): unsure at all Xaa locations
  Clone ID: PAT_TA_89771.pep
AAHTLIPWSGSAXSRSTARGXNGVLPPLLPSLSLPSXFSLSCRSNRAPXASPFACRSSPPRERKVKGRRRRRSGEQGRRGGGGNAGEGRRGGERGSRGAEGLVVRGCE

SEQ ID NO: 195354 - protein, 113 aa, Triticum aestivum
  unsure (1)..(113): unsure at all Xaa locations
  Clone ID: PAT_TA_89772.pep
MNSLQSFLAVAPVKPAAAAARLPSSRRARVSACLATPVPAPXTPAXAXXAXXELSAAXRAVMADEXKYIVGTYXRAXVVFVAGXXXKLYDIXXXEYXXXAAXIXXNVFYGPEV

SEQ ID NO: 195355 - protein, 177 aa, Triticum aestivum
  unsure (1)..(177): unsure at all Xaa locations
  Clone ID: PAT_TA_89773.pep
ENSIPLPCFLYSPPPASSPLPLLGWISGSEIESREFPILIAPPCAPDNPSAPPSQLPDPIRLPGPPPLTPIGAGRTAWTPAPTAWAPSASRRRRVSSPGSPGLPKGRGSAGGAVIPRREHDDEGGPPRALALXAGRRTXAEGGPGQLHXAFPXXAXAPKGSKRRGAEWIPSRRQSIL

SEQ ID NO: 195356 - protein, 115 aa, Triticum aestivum
  unsure (1)..(115): unsure at all Xaa locations
  Clone ID: PAT_TA_89774.pep
WPSPXGVVIXXFXAPLKGXXFXPXXSGQPXXXKTXXXXLGXKXQDLFPKXXGXPLDASXKFLTPPXVXLXQXPSPXXLCWXGPXLXMPPXCPLTXKEGVLIHFLXFCTLAERVKC

SEQ ID NO: 195357 - protein, 47 aa, Triticum aestivum
  Clone ID: PAT_TA_89775.pep
KKSERYKHYTRTHPTGRASLMSSSKHCLTRLGISSSQRRLSLLSPLR

SEQ ID NO: 195358 - protein, 42 aa, Triticum aestivum
  Clone ID: PAT_TA_89776.pep
NSNSGPVVRLNNVHEQLIPDETATPTSLGIYPTRTLICSSCE

SEQ ID NO: 195359 - protein, 180 aa, Triticum aestivum
  unsure (1)..(180): unsure at all Xaa locations
  Clone ID: PAT_TA_89777.pep
LIFAGKQLEDGRTLADYNIQKESTLHLVLRLRGGMQIFVKTLTGKTITLEVESSDTIDNVKAKIQDKEGIPPDQXQRLIFAGKQXEDGRTLADYNIQXESTLHLGAQVRWWHAXFRXRPLPGKTITXESXPPDTSTTSKAKFXDKEXSQPDNXSXFSGXHLRMAXLGGYNTRXXTXLGAP

SEQ ID NO: 195360 - protein, 56 aa, Triticum aestivum
  unsure (1)..(56): unsure at all Xaa locations
  Clone ID: PAT_TA_89778.pep
RAAPSAXTRGGGAVVGAVILVGFWLLGGGVGGGGGVSRDHRHHSPVEQCLTPGPGW

SEQ ID NO: 195361 - protein, 176 aa, Triticum aestivum
  unsure (1)..(176): unsure at all Xaa locations
  Clone ID: PAT_TA_89779.pep
TKLTTLNLFENNLSGNIPRELGYLVNLEDFDLSENTLSGSIPNSLGNLTKFTTLHLFQNLLSGQIPRELSYLVILRXLDLSNNTLSGSIPRNLGNLTELTILHLWXNRLSGQIPRELGTLVNLRELXILSNNTLSXPIPIIIGNLTNHLFALSRTTSXKIHEDYVRLQWLAKQPQV

SEQ ID NO: 195362 - protein, 90 aa, Triticum aestivum
  Clone ID: PAT_TA_89780.pep
EINQRRCQSSITDHSNPRRPNGNIRMRGRSGREGSRGCVRWGGGKTADTSRGGEEGGLDGEPPLVGRTVVVVSPRAAGAGERAPGSDGRR

SEQ ID NO: 195363 - protein, 174 aa, Triticum aestivum
  unsure (1)..(174): unsure at all Xaa locations
  Clone ID: PAT_TA_89781.pep
MAPTVMASSATSVAPFQGLKSTAGLPVSRRSNGASLGSVSNGGRIRCMQVWPIEGIKKFETLSYLPPLSTEALLKQVDYLIRSKWVPCLDSTSWFIFXREHNASPGVLXDGGYWTMWNCXYFGXTGPTQVINEVEESKKDXPDAYFRIIXSTTSSRAWLNSSPTGSKIRKAKYH

SEQ ID NO: 195364 - protein, 111 aa, Triticum aestivum
  unsure (1)..(111): unsure at all Xaa locations
  Clone ID: PAT_TA_89782.pep
GGGRRRRCHLXIRRXXAATXXRSRGASXXGRTARRXXGVTXXARSPXXPXRPPARGRGGTSSPARRXPPTGSASRXCCRSPPPWLPVVLYRXXLYSPLGLELTRAAAVWTG

SEQ ID NO: 195365 - protein, 116 aa, Triticum aestivum
  unsure (1)..(116): unsure at all Xaa locations
  Clone ID: PAT_TA_89783.pep
LGTSSGHLVLLSGRNRENMSEELAMLGRSRVRGDSSQSYQQTIIDSSPQMSIDDLLKEINGANGMPVLFRPFLRWAASGRASTREWLQNWPCKSATTMXLAKRSSRFPAWVXXXVH

SEQ ID NO: 195366 - protein, 96 aa, Triticum aestivum
  unsure (1)..(96): unsure at all Xaa locations
  Clone ID: PAT_TA_89784.pep
MQIFVKTLTGKTITLEVESSDTIDNVKAKIQDKEGIPPDQQRLIFAGKQLEDGRTLXDYNIQKESTLHLVLKLRGGMQFFXVKTLTGKTITLGGPL

SEQ ID NO: 195367 - protein, 94 aa, Triticum aestivum
  unsure (1)..(94): unsure at all Xaa locations
  Clone ID: PAT_TA_89785.pep
QMRRTVXSWRGEPRTVLALKXLQFFMXXGGRDGCRRPRLNLPMAPAAERSSCLPPWASSSXVGTRGRSRDPGLRRRPTEKGASGGGMRPSGYRR

SEQ ID NO: 195368 - protein, 120 aa, Triticum aestivum
  unsure (1)..(120): unsure at all Xaa locations
  Clone ID: PAT_TA_89786.pep
LVHLATLQSVLGLVLQPATNEEPAFLLFPLFSPPTKQKYFILFFIACLCHLIVFAPYVKDTCMHSGVINPIDDVSTCMCKGSTWQAMRNVIISIYXRRTXEPNPAXNXNXQGXXFCPGKX

SEQ ID NO: 195369 - protein, 124 aa, Triticum aestivum
  Clone ID: PAT_TA_89787.pep
GKLPDSMSKFANLTDLLMSGNQLTGSIPTSVNVLQKLNSLNLSGNRMSGTIPPSSIGLLPSLTILDLSGNEITGVIPPDFNNLKLNNLNMSSNQAHRVGAALAAERGIRDQFLGNHGSVLKVPE

SEQ ID NO: 195370 - protein, 46 aa, Triticum aestivum
  Clone ID: PAT_TA_89788.pep
ETLLQGSLHMNTLVSIFWWSNTWEQSPKHLNHSVTANCCKDKKINS

SEQ ID NO: 195371 - protein, 127 aa, Triticum aestivum
  unsure (1)..(127): unsure at all Xaa locations
  Clone ID: PAT_TA_89789.pep
MQIFVKTLTGKTITLEVESSDTIDNVKAKIQDKEGIPPDQQRLIFAGKQSEDGRTLXADYNIQKEXLHWVSSPLWYAVLWSKTSTGKTITLRFXSSXTNLNVEGKISRXGRIPPGQXACXFPGTLQD

SEQ ID NO: 195372 - protein, 39 aa, Triticum aestivum
  Clone ID: PAT_TA_89790.pep
YKYNIVAKCSITERLMWCKDWHLVSRDPFKQGVLMVCML

SEQ ID NO: 195373 - protein, 166 aa, Triticum aestivum
  unsure (1)..(166): unsure at all Xaa locations
  Clone ID: PAT_TA_89791.pep
ERHSLCFLRRTPPAALCGAGRTPPAAFSRAGRILSRHDVSAPLPLPAPPPPPPPQPHPVSYPHDGLASPALIPTTASPRHLLSPPRTCLAANPWXFLNLICRRIKLAXXKFKCQIAXQXSXEXLELXNSXXSIKXPXGRVXFRRFGCXTYKXSLEXSFPXEXXWKX

SEQ ID NO: 195374 - protein, 59 aa, Triticum aestivum
  unsure (1)..(59): unsure at all Xaa locations
  Clone ID: PAT_TA_89792.pep
RKSFRRRSFERXRPKFSQPPLDVMXFSFQYIQFKXXGLQXNVVCISLHLXGYYSPAPGN

SEQ ID NO: 195375 - protein, 78 aa, Triticum aestivum
  unsure (1)..(78): unsure at all Xaa locations
  Clone ID: PAT_TA_89793.pep
XEYEVLQFPHWSWTYWILRHPRFRGHSFPRNYKIFLLQLLVSWHTMCHLIPINTGGLNKHSPGLVELVSAKEHVFIRA

SEQ ID NO: 195376 - protein, 62 aa, Triticum aestivum
  unsure (1)..(62): unsure at all Xaa locations
  Clone ID: PAT_TA_89794.pep
KLRRDEQRHRAYACVCGQQCLYQYVVSSVAVFSLSRKIGVACCSAIRNTSVNKQLYELCLXA

SEQ ID NO: 195377 - protein, 117 aa, Triticum aestivum
  unsure (1)..(117): unsure at all Xaa locations
  Clone ID: PAT_TA_89795.pep
MATXISKKKKFVSDGVFYAELNEMXTRELAEDGYSGVEVRVTXIRTEIIIRATRTXNVLGEKGRXIRELTSVVQXRFNFPENGFNFXRXEVVHRGSAPSAQAESLRFKLSASVRKAS

SEQ ID NO: 195378 - protein, 73 aa, Triticum aestivum
  unsure (1)..(73): unsure at all Xaa locations
  Clone ID: PAT_TA_89796.pep
PKVVRGDPARKGEAAAKTSAPAAAPPPPQPHHHHHHHVASTISVSDSSLKFTHVLYNLSPGELYEQAXQXQKG

SEQ ID NO: 195379 - protein, 90 aa, Triticum aestivum
  unsure (1)..(90): unsure at all Xaa locations
  Clone ID: PAT_TA_89797.pep
LPQASLQSTSSYPAFPFCYRKVILFCTRIDKPEINHASGLPPXPKSPGDQIMGAGPRRGGAGGRPASKRQNGGSGSGKDPRARAWLYRSS

SEQ ID NO: 195380 - protein, 149 aa, Triticum aestivum
  unsure (1)..(149): unsure at all Xaa locations
  Clone ID: PAT_TA_89798.pep
MANPRVFFDMTVGGAPAGRIVMELYKDAVPRTVENFRALCTGEKGVGKSGKPLHYKGSAFHRVIPDFMCQGGDFTXRGNGTGGESIYGEXFADEXFVHKHTKPGILSMXANAGPNTNGXQFFICTVPCXWSTETRVFGESSDGLSRNRE

SEQ ID NO: 195381 - protein, 161 aa, Triticum aestivum
  unsure (1)..(161): unsure at all Xaa locations
  Clone ID: PAT_TA_89799.pep
AXEGKLYKVKSKKRKKEKKEGSQPGDGLGLRXLHEQIAAWSPPRGSHRAVPSHPPLQVAFMAYSEPPLELVLSALHPARCPRLHPLRVAAALDRLYSLVTLLTPALSTRNQTSRETWIRIHQEWPRTGQASNHAGPASSPLRATRASSGSRGYDRLPRPGR

SEQ ID NO: 195382 - protein, 124 aa, Triticum aestivum
  unsure (1)..(124): unsure at all Xaa locations
  Clone ID: PAT_TA_89800.pep
MARLNSKAVAAAVVLAXVVLMMAGREASAAXSCGQXDSKLAPCVAYXTGRASSISKECCSGVXGLNGLARSNPDRKIRXEVPXELATSXKFIXMXQVPGLPXSSRLAFPTSQQLNIHSLINLPI

SEQ ID NO: 195383 - protein, 93 aa, Triticum aestivum
  unsure (1)..(93): unsure at all Xaa locations
  Clone ID: PAT_TA_89801.pep
KLFXFDXDXNXNLILSESLLFXHLADRIKGPXLHXXKXXXIXTXLVEGLVYLHKHPMLAIXHXDLTPNXXIXECDMTLNISXFXSXXTLXPXV

SEQ ID NO: 195384 - protein, 96 aa, Triticum aestivum
  unsure (1)..(96): unsure at all Xaa locations
  Clone ID: PAT_TA_89802.pep
VSXRLATLVSLLVQQVXLVPVAMAQTNNLTAGDALKPPRYITXPSGXXAFGFRALDSDPTKFVXATWYRFADDAXSSXXXPXXVVWFLKKTXIGTG

SEQ ID NO: 195385 - protein, 173 aa, Triticum aestivum
  unsure (1)..(173): unsure at all Xaa locations
  Clone ID: PAT_TA_89803.pep
YGRPRRNPTRSGSIESVQEAQLTTVGGNLANKSVGKSDKESTTLEEATPGSAVSDKSSPGRGFPGSLMSDTTTPRREFLGSVTSGATTPTTLTPKSEVVLGQFVSPPTARSDMFDTNNVGDXHRSRRLRGSSWRTCXTXTTPREDGKXDXXLGXVQILRVVPKSPGXWASNPS

SEQ ID NO: 195386 - protein, 46 aa, Triticum aestivum
  Clone ID: PAT_TA_89804.pep
SFVETQFGIQYMAPRIVLAVTVEVRAMSNRYEITLIKKRSYAVINY

SEQ ID NO: 195387 - protein, 79 aa, Triticum aestivum
  Clone ID: PAT_TA_89805.pep
VTCCSCLWNKKFMLLNIVSSAVLCGLWICRNALVFNRKNWISVKQAGHLIVGYLVDWAKPLKEILGGMQPCPGICYSGN

SEQ ID NO: 195388 - protein, 119 aa, Triticum aestivum
  unsure (1)..(119): unsure at all Xaa locations
  Clone ID: PAT_TA_89806.pep
XEVAPTLLVLLPXLSTPLIKRTVTVVVPSPSCDWKFTVVSIHVWEKGTRRKVDIKVLKTIVKVSHYHFIPCNMKQNRIIAKDYHSFALCCKCFCHVAHIVVIRRGGAADDLSQCTNIML

SEQ ID NO: 195389 - protein, 78 aa, Triticum aestivum; identical to SEQ ID NO: 106977
  Clone ID: PAT_TA_89807.pep

SEQ ID NO: 195390 - protein, 191 aa, Triticum aestivum
  unsure (1)..(191): unsure at all Xaa locations
  Clone ID: PAT_TA_89808.pep
RGXLHSGMWRQXWAFXIPVGRDXEAIVGTQFSSQSVNEPVARYRSYRRLVPAPPDHLYXSSLSLSLSRRSDRLSAGRCLMHAEIGAPSPASGAGAGSPSCREPGASGDGLHRRRRRSGEMRRCRCRRRWRRPRSGPRLRWEPVAVTAAAAGSRGPRGVGGSPRKSRGWAGVGKVTPLTPGWHQACCLRRRL

SEQ ID NO: 195391 - protein, 151 aa, Triticum aestivum
  unsure (1)..(151): unsure at all Xaa locations
  Clone ID: PAT_TA_89809.pep
ARAPQCRRLPPPVLAAASGGGKRGRDPEEDVYVDNLHSHKRYLSEIMASSLNGLSVGDSLADNIMESPARSESSSCVRDEIISQYSPMSEDSDDYRYFDTQLNPNGSQGDAMXNPSTSPXSSPHRSKTQAVPHSPQGPQGPPRGLKVPSHQ

SEQ ID NO: 195392 - protein, 165 aa, Triticum aestivum
  unsure (1)..(165): unsure at all Xaa locations
  Clone ID: PAT_TA_89810.pep
MQIFVKTLTGKTITLEVESSDTIDNVKAKIQDKEGIPPDQQRLIFAGKQLEDGRTLADYNIXXESTLHLVLRLRGGMQIFVKTLTGKTITLEVESSDTXDNVKARSRTRRDPPDNSASSSLEALEMAHLADYTSEGSPSLVLSSGSDFSVTEDIPVISNKLKADR

SEQ ID NO: 195393 - protein, 127 aa, Triticum aestivum
  unsure (1)..(127): unsure at all Xaa locations
  Clone ID: PAT_TA_89811.pep
PRVPRRRPRPREHESPEPRPGAHESPEPHPAPLPAPQQPRRPPPPPPPAPPLAPPGGXPTPPAPPRRRNGSARAARPTPTLPPPAGASRRATRACASRPRTAPRRRRGSVRGGGTAGPGTRRVLVDD

SEQ ID NO: 195394 - protein, 140 aa, Triticum aestivum
  unsure (1)..(140): unsure at all Xaa locations
  Clone ID: PAT_TA_89812.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNCXYFGCTDXTQVINXVEXVKKDT

SEQ ID NO: 195395 - protein, 169 aa, Triticum aestivum
  unsure (1)..(169): unsure at all Xaa locations
  Clone ID: PAT_TA_89813.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGSGGXGGGGGYGGXGGGGYGRKRWRLRQAVVVRGSAVARLRAARGYARVVVRGNLWRTRGSEEPRASV

SEQ ID NO: 195396 - protein, 161 aa, Triticum aestivum
  Clone ID: PAT_TA_89814.pep
QTQRSHSFSLGKHHAGAPDPRAQPCPPCTSSWAWAPPARRSRPPTSSCSSSAPASSPSPSSSSTPTTSASSPSSPAAAPAPRPTTPSSCRSSTPTPPRRPRRRSSTRRARADRHPDDAGQVRAAELLRTVTAAAEETRLAARGLASLASHSASRVCGLNIL

SEQ ID NO: 195397 - protein, 48 aa, Triticum aestivum
  Clone ID: PAT_TA_89815.pep
LEFFFFFFISFLFYLYLLFFIFSFIYLSIVSTGSNSNLIAFHTSQAAG

SEQ ID NO: 195398 - protein, 114 aa, Triticum aestivum
  Clone ID: PAT_TA_89816.pep
LTSSHAILGKLTEFATNLTTSRSETTIQDDRRSKTGQKDTKHHHINKASLTLAPAILHEHYYYHYSSRSVYHEHYHYDYSTRLPTRSSPGNTSLRSSSFSLGTVTLSTPFFISA

SEQ ID NO: 195399 - protein, 139 aa, Triticum aestivum
  unsure (1)..(139): unsure at all Xaa locations
  Clone ID: PAT_TA_89817.pep
MAPTVMASSATSVAPFQGLKSTAGLPVSRRSNGASLGSVSNGGRIRCMQVWPIEGIKXFETLSYLPPLSTXGLLKQXDYLIRSKWVPCLDSTRXGFISREHNAPWXHDGXYWTMWNCLFRVNDPHNDNKWRRQEGYLTF

SEQ ID NO: 195400 - protein, 181 aa, Triticum aestivum
  unsure (1)..(181): unsure at all Xaa locations
  Clone ID: PAT_TA_89818.pep
LVSTATLSAASYSSVCPKPGHADDRYTDGNEILLLTSFFQISTGYFSEGADSLFSATDDDDLYGSYRSFSLFPHGASHTSDQALVHLTAATLTLTGPASXTYGRPGRRRNYTDTGSISFVLDGSILRLTRTLHGRETESPPTVSTTRLVLRSRPDVLLTILRDGSSARGISLVRRGETTVA

SEQ ID NO: 195401 - protein, 184 aa, Triticum aestivum
  unsure (1)..(184): unsure at all Xaa locations
  Clone ID: PAT_TA_89819.pep
PWRRSAGPARRRTSRGALFSHLRRQRRSTSSSTGTWGGAARRRCAMAEEGGRRSAPPRSSPPPPSPPTTTPRRPVLTTTPSTRRPSTTPSSPNPRQLLPLXXIRMVWRLFLKGRTRTAVITXLLRASGGFLDEVRSXXLIDHLGSFFGXRFXEXXFIXKXAVRXLDLNLHXQGHILKEPLWGNX

SEQ ID NO: 195402 - protein, 86 aa, Triticum aestivum
  unsure (1)..(86): unsure at all Xaa locations
  Clone ID: PAT_TA_89820.pep
APVRRPNFGPVVPAASYQRPIEQLIAVRFXPFLSTXVSSFXKNSIMLHGXRCANQKYAPMXRCXRLLLVSXRCGAXLRXXPCGTEQ

SEQ ID NO: 195403 - protein, 77 aa, Triticum aestivum
  unsure (1)..(77): unsure at all Xaa locations
  Clone ID: PAT_TA_89821.pep
QIRSSHPRRICXSRXRXTQRSVRAGGTMEXNGISGXTXEAXARXPXXVAILVTPXMGHXXXLAXLXKXLXALXXVTG

SEQ ID NO: 195404 - protein, 90 aa, Triticum aestivum
  unsure (1)..(90): unsure at all Xaa locations
  Clone ID: PAT_TA_89822.pep
XXXXICLPQNWYKLAVXFXNHELVCLSFCAICTDQLRLVGPILKPQKQRFYIHIGFLTKYICRGESHLLSGSLTWATHLAISSRDGGCLR

SEQ ID NO: 195405 - protein, 138 aa, Triticum aestivum
  unsure (1)..(138): unsure at all Xaa locations
  Clone ID: PAT_TA_89823.pep
MYPTSLLSILVSLFLFHQRVHAECEPVACGNFTIKYPFWLGTRSRPPPEPYCGHPSFELWCIGSNTTASMSGSXIHVHSIDYXAQSFVVVHSRXAAGMDGVCLADLTSRQLASAVKIANNVPGSVNATDEHPETKARG

SEQ ID NO: 195406 - protein, 93 aa, Triticum aestivum
  Clone ID: PAT_TA_89824.pep
QIPCGDGCNRAQPPLGFASAIEVITGGYGGDGDLRDKGRIARPSFWRMGETLCRGASTCSSTSSRARARAQLRRLHDAADHVSDCWLCCIGQF

SEQ ID NO: 195407 - protein, 59 aa, Triticum aestivum
  unsure (1)..(59): unsure at all Xaa locations
  Clone ID: PAT_TA_89825.pep
XPSPPLAPLMHERSPGPSLAAXRLPSPXSLXLLLLISLSXLXXWFTPXVXPQGLLGVLP

SEQ ID NO: 195408 - protein, 186 aa, Triticum aestivum
  unsure (1)..(186): unsure at all Xaa locations
  Clone ID: PAT_TA_89826.pep
SVSPSHFFFPANRSYHLKXCRRCLLSSSCILLFPSLYLFFSFLCTPMXFFGPTRKRNLSSSSSSFLTWWXSPRSLSSCLERTPAARRFHRLRRTPPSWADCAAPQCPRKRRRLLRPLLRWGEARVSAFRGRFWGVMGERPEGPSWWTRRNNDRGFRPRDEGCPHQRRRSGGGAGALAPIGRWGRGR

SEQ ID NO: 195409 - protein, 61 aa, Triticum aestivum
  Clone ID: PAT_TA_89827.pep
NVFHLKLRFEVCPSLVETGDLRPAAGDFDHLSEHNCCVNRRVDYLAKDGVFRRVNRSEEQK

SEQ ID NO: 195410 - protein, 98 aa, Triticum aestivum
  unsure (1)..(98): unsure at all Xaa locations
  Clone ID: PAT_TA_89828.pep
SPPPRALRLPPLPRVTADASIPPHDHPTYPPSLPPLAPAPRGTQNTPASNARRCHRRYRPSSSRHRVPAISTRPAIFGHXVLSNTGQKWRMCSMPKNS

SEQ ID NO: 195411 - protein, 127 aa, Triticum aestivum
  unsure (1)..(127): unsure at all Xaa locations
  Clone ID: PAT_TA_89829.pep
WSVPSPEPFQCLVCQRNGNPPILENGXFPXXSELGGTSKXSGGQGTARSTFARLSLPGRHISLPNLARATAISPTARGHEWPPPHPARLQPPRPPPRFPLPCAAAPSVTLRMLPPTAPPYAAMTGHR

SEQ ID NO: 195412 - protein, 165 aa, Triticum aestivum
  Clone ID: PAT_TA_89830.pep
MALTDDHDEYAKLVRGMNPPRVVIDNEASDDATVIRVDSVNSHGTLLAVVQVIADLNLVIRKAYFSSDGSWFMDVFNVTDRDGNKVLDTPTISYIQTTWKPRIATTRRLATRWASCRRRSTLDRPGTDRRACSPSVACSRIRVRNPTWTTAVRRSTTGPGGHQTG

SEQ ID NO: 195413 - protein, 98 aa, Triticum aestivum
  unsure (1)..(98): unsure at all Xaa locations
  Clone ID: PAT_TA_89831.pep
MADVEYRCFVGGLAWATDDQSLQNAFSKYGDVIDSKIITDRETGRSRGFGFVTFAXDXAMXHXXXAMNXXXLXXRNITVNXASPAAXAVGGGXLXXEE

SEQ ID NO: 195414 - protein, 89 aa, Triticum aestivum
  unsure (1)..(89): unsure at all Xaa locations
  Clone ID: PAT_TA_89832.pep
MKGTKLAAILILQAVLVMGVLSHVNADFFPKCCNNCRSFSGVDVCDDAHPKCPKGCSACRVVSTSPEMWRCADMKXTVDGTCGGPCKXY

SEQ ID NO: 195415 - protein, 71 aa, Triticum aestivum
  unsure (1)..(71): unsure at all Xaa locations
  Clone ID: PAT_TA_89833.pep
LSSTSSPLIHGDGDLSLXRLNRXASSRKRAPRRTXXRTXGSXRQGXXXGXXYPLVRHXHVXHGQLPXRXPG

SEQ ID NO: 195416 - protein, 61 aa, Triticum aestivum
  Clone ID: PAT_TA_89834.pep
GKPPKGVKTNWIMHEYRLADVDRSAAARKKSNNALRVTTLPACPPPPSPLCQSALMLGCLV

SEQ ID NO: 195417 - protein, 63 aa, Triticum aestivum
  unsure (1)..(63): unsure at all Xaa locations
  Clone ID: PAT_TA_89835.pep
XQLKXNKNRAAXFSXRXKRXLCSKTLFIYFSFLYIYIYIYIYIYIYIYIYIIXXXXTLXLXXT

SEQ ID NO: 195418 - protein, 135 aa, Triticum aestivum
  unsure (1)..(135): unsure at all Xaa locations
  Clone ID: PAT_TA_89836.pep
MGKEKIHISIVVIGHVDSGKSTTTGHLIYKLGGIDKRVIERFEKEAAEMNKRSFKYAWVLDKLKAERERGITIDIALWKXETTKYXCTVIDAPGHRXFIKNMITGTPRLMCCAYIDSTRWFEVDLDGNRDTSAPG

SEQ ID NO: 195419 - protein, 139 aa, Triticum aestivum
  unsure (1)..(139): unsure at all Xaa locations
  Clone ID: PAT_TA_89837.pep
MAHLPPHSLFLLFLAVHVFXASHGXPLPPSSAYNDSVCSEXIKCGGVDIXYPFYLSNATQAXPXYXSXYACGXTDLKIFCQGXGATXIPILXLGQDXLHNYTVXXIIYDNHAIILRDTXASIXGGKCPTVSXNCHRQGW

SEQ ID NO: 195420 - protein, 76 aa, Triticum aestivum
  unsure (1)..(76): unsure at all Xaa locations
  Clone ID: PAT_TA_89838.pep
MSCCGGNCGCGSGCKCGNGCGGCKMYPEMDXGVNTASQTLIMGVAPSKGTPSFEAAAENGGCKCGPNCTCNPCTCK

SEQ ID NO: 195421 - protein, 95 aa, Triticum aestivum
  unsure (1)..(95): unsure at all Xaa locations
  Clone ID: PAT_TA_89839.pep
MDAAXLDDVIRRLLXARGGRTVRPAQLSDAEIRRLCXAAKDVFLSXXNLLXLXXPIKVCGDIHGXYSDXLRXXEYGGXPXVANXXFLGDYVDRGK

SEQ ID NO: 195422 - protein, 164 aa, Triticum aestivum
  unsure (1)..(164): unsure at all Xaa locations
  Clone ID: PAT_TA_89840.pep
PPTPILLNPPPPIRRDGPQQQQQXRRRRRTQPAPRRQQARPEHPQSNAAAASSAAAPPAAPPAAGIQHQQEPVPRHGPAAHRRHXSPPPPQHHHRPPPPLQQQHQQNPSPPPCASXVXXPXIXTPSXGPSVRNTTXXXLTXPAFMPXTXKXXLRGPLGXPVLMK

SEQ ID NO: 195423 - protein, 74 aa, Triticum aestivum
  unsure (1)..(74): unsure at all Xaa locations
  Clone ID: PAT_TA_89841.pep
FFFFFFFFFFFFFFFFXILKXQYYTXIAVTXXXDMFXRAXLXXPSPRKXXQXGTHNFKXREMENPVNXTHVXIT

SEQ ID NO: 195424 - protein, 60 aa, Triticum aestivum
  unsure (1)..(60): unsure at all Xaa locations
  Clone ID: PAT_TA_89842.pep
RLXMXGDXTRXXAVRRRVETLYQDHLTVXXAVXQDEAGRXRHGXXWHRXRRHACAEHLVX

SEQ ID NO: 195425 - protein, 61 aa, Triticum aestivum
  unsure (1)..(61): unsure at all Xaa locations
  Clone ID: PAT_TA_89843.pep
XXMXXXEEXGXXDAAXXSVPAXVAXXXGAGPGGXARRXPSYLYPHXETLEALPTRXEAGPV

SEQ ID NO: 195426 - protein, 101 aa, Triticum aestivum
  unsure (1)..(101): unsure at all Xaa locations
  Clone ID: PAT_TA_89844.pep
FKSYREGLMSPQTETKAGVGFKAGVKDYKLTYYTPEYETKDTDILAAFRXSPHLGSXXMKQGAAITXXILXWXMXXVWXXGXTSLXRXKGXXXKXXXLXGE

SEQ ID NO: 195427 - protein, 180 aa, Triticum aestivum
  unsure (1)..(180): unsure at all Xaa locations
  Clone ID: PAT_TA_89845.pep
RNGTNESPANLVSDRPQARRILLPRRLKMQIFVKTLTGKTITLEVESSDTIDNVKAKIQDKEGIPPDQQRLIFAGKQLEDGRTLADYNIQXKESTLHLVLRLRGGMQXLRQDLTGKTITXEVESSDTIDNVKPRSKDKEGIPPDXQRLIFAGXQLEDGRTXADYNIRRITSTFCVCGSIS

SEQ ID NO: 195428 - protein, 177 aa, Triticum aestivum
  unsure (1)..(177): unsure at all Xaa locations
  Clone ID: PAT_TA_89846.pep
PPGSHRRQQPDLRCRSRPTHRFTKQNGTRSNPALAPPHSPGSGLSVDHSPATVSGRCAAHDPDPAITFAVPTSDVQHLLLPCSFLRWPAPFRAKPWPMVRRHYPEQQPLPRFMVGSSPPHLLSPWISPPLRVVLHARSRTRATTVVSNAGDEPAETGAADPASISQGSSXDRLRXSX

SEQ ID NO: 195429 - protein, 174 aa, Triticum aestivum
  unsure (1)..(174): unsure at all Xaa locations
  Clone ID: PAT_TA_89847.pep
KSYREGLMSPQTETKAGVGFKAGVKDYKLTYYTPXYETKDTDILAAFRVXPQPGVPPEEAXAAVAAESSTGTWTTVWTDGLTSLDRYKGRCYHIEPVAGEDXQWIXXSLXITPXDXGSXXNMFTSXVXNYLXHSXTSLRLDDHNPLINFMSCTLKIHCVALLDSLSIPHDCIHW

SEQ ID NO: 195430 - protein, 120 aa, Triticum aestivum
  unsure (1)..(120): unsure at all Xaa locations
  Clone ID: PAT_TA_89848.pep
IHGDLGVDGKRHAPWPPPPAAASGSKERKEEAGASDPAAVGEEGEWKRWSGSLQRGTWSSATAGSTPPTPGAMAAXXAATAPGEAEAEAAAGERCCMWGDDGRIRAAARAWAETRGSRAR

SEQ ID NO: 195431 - protein, 70 aa, Triticum aestivum
  unsure (1)..(70): unsure at all Xaa locations
  Clone ID: PAT_TA_89849.pep
IFTFHYKGXXSXXDQMKXPRAVIXSNQXISSXTYQXXSXTHLTXXXKHCHVCLNTGYPXXXDLRSXXXVS

SEQ ID NO: 195432 - protein, 135 aa, Triticum aestivum
  unsure (1)..(135): unsure at all Xaa locations
  Clone ID: PAT_TA_89850.pep
ATPSSAILDIERKVTTLTRSGELPVDNFGVPLAGSLIPWIDKQLDNGQSREEWKGQAETNKILNTSSVIPVDGLCVRVGALRCHSQAFTIKLKKDVSIPTVGECXCAHPWAKVXPNDREITIVELTVPLPDADTP

SEQ ID NO: 195433 - protein, 85 aa, Triticum aestivum
  unsure (1)..(85): unsure at all Xaa locations
  Clone ID: PAT_TA_89851.pep
MAATTTMXLSSPAIKLAGASYALGGGGRITMRKAAPKASXSNSPWYXPXRVLYLXPLSGEXPXYXXVRVPGXDYXWXXAGVXXGX

SEQ ID NO: 195434 - protein, 159 aa, Triticum aestivum
  unsure (1)..(159): unsure at all Xaa locations
  Clone ID: PAT_TA_89852.pep
AAKAKPVSSGSPWYGSDRVLYLGPLSGDPPSYLTGEFPGDYGWDTAGLSVDPETFAKNRELEVIHCRWAMLGALXCVFPELLARNGVKFXEAVWFKAGSQIFNEGGLDYLGKPSSVHAQSILAIWACXVVLMGAVXGYGVXXGTLXKXVXRSNPGKFTP

SEQ ID NO: 195435 - protein, 77 aa, Triticum aestivum
  unsure (1)..(77): unsure at all Xaa locations
  Clone ID: PAT_TA_89853.pep
FFFFFFFFFFFFFFFFFFLXKNPNFISKLFDTXPIXITPTXQICXAXEXXPKXNFFXSLQNKSXVKSKXFXLRHXDK

SEQ ID NO: 195436 - protein, 180 aa, Triticum aestivum
  unsure (1)..(180): unsure at all Xaa locations
  Clone ID: PAT_TA_89854.pep
RGGPVGSCSIGCGHAGSLAVHTTVRLAGEQPQVKPKGFDTRGRAPTMTRAAEDGMQRHAAMPRRDSGXXGLGPPPRELGQAERASQHAVVRRQRRALLMTPRNVAXRCRAGNEXXXGXGPPTRGLXAASVVSNGVPXLGKLXKXQCLKXSTVRWWFRXXVKPXCXRSXPSXKQXSSXGIS

SEQ ID NO: 195437 - protein, 122 aa, Triticum aestivum
  unsure (1)..(122): unsure at all Xaa locations
  Clone ID: PAT_TA_89855.pep
MANPRVFFDMTVGGAPAGRIVMELYKDAVPRTVENFRALCTGEXKGVGKSGKPLHYKGSRFNRVSRXXVPXGGGXNKGXREPGGXHXTGKXXXAXKFVXKXXKARGFLPMXXGXPKXKXXIF

SEQ ID NO: 195438 - protein, 142 aa, Triticum aestivum
  unsure (1)..(142): unsure at all Xaa locations
  Clone ID: PAT_TA_89856.pep
MQIFVKTLTGKTITLEVESSDTIDNVKAKIQDKEGIPPDQXQRLIFAGKQLEDGRTLAXDYNIQXESTLQLVLKAXRXVMQIFVXDLNGXTSPRGLSPXDXIDNXKGKIQDKGXIPPGQXRLIXXGKQSRMHLGSSEGISAQ

SEQ ID NO: 195439 - protein, 107 aa, Triticum aestivum
  unsure (1)..(107): unsure at all Xaa locations
  Clone ID: PAT_TA_89857.pep
PXXXAXRDXXXTSXXLPLXTXRHXPQCSVVVPPSRXTPGVSXGLFSRVAPHLTAADDDALRRRPTAGHAEDDGPRRLSTTPPPAATAMDVRARVERNVIARSIWSSG

SEQ ID NO: 195440 - protein, 153 aa, Triticum aestivum
  unsure (1)..(153): unsure at all Xaa locations
  Clone ID: PAT_TA_89858.pep
MARGLKKHLKRLNAPSHWMLDKLGGAFAPKPSSGPHKAREXCLWILILRNRLKYALTYREVQSILMQRHIMVDGKGRTDKTYPAGFMDIISIPXTGEELQVLYDXQGPFRLHPVRXKDAKXKSAXQSVQFGKKXIPYSTLGWTTKPSSRQCTS

SEQ ID NO: 195441 - protein, 141 aa, Triticum aestivum
  unsure (1)..(141): unsure at all Xaa locations
  Clone ID: PAT_TA_89859.pep
MSDTDEHHFESKADSGASKTYPQQAGAIRKXGHIVIKARPCKXVEVSTSKTGKHGHAKCHFXVAIDXFNGKKLEDIVPSSHNCDSPMFDRQRXYKLIDIXDDGMSTFSLEXGNTKGDLXXPLDDVLLGQVQDGFADGXDCL

SEQ ID NO: 195442 - protein, 78 aa, Triticum aestivum
  unsure (1)..(78): unsure at all Xaa locations
  Clone ID: PAT_TA_89860.pep
NIXIGLNWDEYDYXXNYCMGKHTSPPNIYPPEXGWXKIQRIGSNPHXXXIXEGXCFPLLGETXLNPGFGXTPLDGKGD

SEQ ID NO: 195443 - protein, 65 aa, Triticum aestivum
  unsure (1)..(65): unsure at all Xaa locations
  Clone ID: PAT_TA_89861.pep
MAETEYRCFVGGLAWATDDNNLQQXAFSQYGEILDAKXXXDRETGXSRGXGFITFXSQDSMXQGH

SEQ ID NO: 195444 - protein, 73 aa, Triticum aestivum
  unsure (1)..(73): unsure at all Xaa locations
  Clone ID: PAT_TA_89862.pep
FFFFFFFFFYRKGXLISHITSRETCIMHIIESCGCSKTGLLNADQAAADQAKQDDTSLNFYSNLKGHPIQAKE

SEQ ID NO: 195445 - protein, 55 aa, Triticum aestivum
  unsure (1)..(55): unsure at all Xaa locations
  Clone ID: PAT_TA_89863.pep
IMPPENPNXQXFLKXFNTAGKQPVKLLSDRCRDLSEELQLEVGISPAKALLDKSK

SEQ ID NO: 195446 - protein, 134 aa, Triticum aestivum
  unsure (1)..(134): unsure at all Xaa locations
  Clone ID: PAT_TA_89864.pep
MSPQTETKAGVGFKAGVKDYKLTYYTPEYETKDTDILAAFRVSPQPGVPPEEARAAVAAESSTGTWTTVWXDGLTNXDPYKGRCYHIEPVAGENSQWICYXXYPLXQFXRSXYXXXYSNXRNVFXSKALXAXRL

SEQ ID NO: 195447 - protein, 114 aa, Triticum aestivum
  unsure (1)..(114): unsure at all Xaa locations
  Clone ID: PAT_TA_89865.pep
SADPLHSSASRRPDPASRVLPYARLMAADTAAARALLLFLAVAVAALLRTGEASVHEYSGLSFLNKGNAFILHAGSEGLYAPVSPANATADXEDDXXRRAAFIRFXKITFRXAD

SEQ ID NO: 195448 - protein, 50 aa, Triticum aestivum
  unsure (1)..(50): unsure at all Xaa locations
  Clone ID: PAT_TA_89866.pep
PXPNVVSLXPAPXIXAGXDXSSTSKSRGSVIFPVEKXPPXKXVWPKXQQM

SEQ ID NO: 195449 - protein, 90 aa, Triticum aestivum
  unsure (1)..(90): unsure at all Xaa locations
  Clone ID: PAT_TA_89867.pep
AKRLMELVHGIPCKINLISFNPHXGSXFKPTPDEXIIEFRNMLIQSGLTVMVRXSXRGDDQMAACGQLGAPGDYXLPLLRVPEXKFQXAL

SEQ ID NO: 195450 - protein, 124 aa, Triticum aestivum
  unsure (1)..(124): unsure at all Xaa locations
  Clone ID: PAT_TA_89868.pep
MVYIKNQKTRAYSKRFQVKFKRRRQGKTDYRARLRLTNQDKXNXYNTPKYRFVVRFTNKDVTAQIVYATIAGDXVMGAAYPMELPRYGLEGGLXTTYAAAYCTGLLLGRPCGQRPWRRSMKGRH

SEQ ID NO: 195451 - protein, 121 aa, Triticum aestivum
  Clone ID: PAT_TA_89869.pep
RHRGSRRRRRRRRLGGSAPRVQLVIIGQHPVTVRPAAPWPRMHAWRNGGDLSAKGSSIYTSSELKLNFSDGFRSIEKEKRNNGVVVGACKIIADRSKLVYSTLEWSPSYIYLQCMLSLVPS

SEQ ID NO: 195452 - protein, 174 aa, Triticum aestivum
  unsure (1)..(174): unsure at all Xaa locations
  Clone ID: PAT_TA_89870.pep
RFVYASLLRLLVLKFVLSMSASKDVLALASLEVDLSSIEPGSTVTVKWRGKPVFIRRRTDDDIKLANXXDVASLRHPEQDAERVKNQSXVXVIGVCXHLGCIPLPQSGRLGWWFCPCHGSHYDTLGRXAKGLXPFNXXVPPTXLXXYKXSIGKTTLRHISRKSDPGRNLFGDFC

SEQ ID NO: 195453 - protein, 89 aa, Triticum aestivum
  unsure (1)..(89): unsure at all Xaa locations
  Clone ID: PAT_TA_89871.pep
KNPTGRVKFNGPSLLPPGPCEEXGXXSLKTXIPQPFTHRRDLLRIDGIPSSWRMRAARVQATSLEDMATDSHRSRSAILGGDGSGGAGG

SEQ ID NO: 195454 - protein, 96 aa, Triticum aestivum
  unsure (1)..(96): unsure at all Xaa locations
  Clone ID: PAT_TA_89872.pep
MSPQTETKAGVGFKAGVKDYKLTYYTPEYETKXDTDILAAFRVXPQPGVPPEEXGAAVSCRSPTGTWTTVWTDGXLTXLDRSKGDAINPLLLGKQW

SEQ ID NO: 195455 - protein, 105 aa, Triticum aestivum
  unsure (1)..(105): unsure at all Xaa locations
  Clone ID: PAT_TA_89873.pep
YREGLMSPQTETKAGVGFKAGVKDYKLTYYTPEYETKDTDILAAFRVSPQPGVPPEEAGAAVAAESSTGTWTTVWXTDGLTILIVTKDRCYHIEPVAGKDSQWFC

SEQ ID NO: 195456 - protein, 112 aa, Triticum aestivum
  unsure (1)..(112): unsure at all Xaa locations
  Clone ID: PAT_TA_89874.pep
APEXRLSXXWIPTXSSCAXFPEDXIPSSDWESRLRTLPHACTNTYSIRPCIHKYILHPSQNSRRNKYIPSENTCRRNKYIVLLSWLCCLNTIIIWERESRITMKSCVRFSVS

SEQ ID NO: 195457 - protein, 117 aa, Triticum aestivum
  unsure (1)..(117): unsure at all Xaa locations
  Clone ID: PAT_TA_89875.pep
SRXNQPQISPDTRPPRPARRTPRPXASXPXXQPARDAPXNQASPAISRXRSSXVXDTGFPVRKSXTAXAGADXWVQRGXIGTKXXXVXXKXAWVPXAGSCXVRRXRKDPGLXXLHLA

SEQ ID NO: 195458 - protein, 141 aa, Triticum aestivum
  unsure (1)..(141): unsure at all Xaa locations
  Clone ID: PAT_TA_89876.pep
MARLNSKAVXGAAVVLAAVVLMMAGREGLGGAVRAGRWDSKLXAPCVAYXTGXGRXRLSKECCSXGVXGLNRHGRSTPDRKXIACKVPQRPRQPSIKXXNMGKXPGVPXXCGVSVPSHQXSTTANCQLVNIYLLRASWPCW

SEQ ID NO: 195459 - protein, 116 aa, Triticum aestivum
  unsure (1)..(116): unsure at all Xaa locations
  Clone ID: PAT_TA_89877.pep
FXLAXKVVLXKXXFIHLRXGCRDVPCWLXXGMGCYTGNRASRSKPLILCMHLSLQPRVFVGQFDNGRLSFLWCFICFRNFMPGSNMSQFINLHISWGYMTPFIMNQFSVPVNHPLV

SEQ ID NO: 195460 - protein, 161 aa, Triticum aestivum
  unsure (1)..(161): unsure at all Xaa locations
  Clone ID: PAT_TA_89878.pep
LGTQHVTVVSSIASSNKRSHQLIRSCVRFGPSPAMGFDKEASSSSSGLDAAALLPXHGGAGVGARLSSXXKTFANVFIAVVGSXVLXPPLHLLPHGLGGXAPXCXSXWXGSLXLDXXXRRLPXXPRRXXPRXVXRXLXXSCRXXAXXAXXHXVXSXKLLXW

SEQ ID NO: 195461 - protein, 63 aa, Triticum aestivum
  unsure (1)..(63): unsure at all Xaa locations
  Clone ID: PAT_TA_89879.pep
QDTTPTFSYPLLXPRSSSTMVXRRICXRRSSTLNSATKRRTLHQNSEGSKHGSLESARRVRRP

SEQ ID NO: 195462 - protein, 162 aa, Triticum aestivum
  unsure (1)..(162): unsure at all Xaa locations
  Clone ID: PAT_TA_89880.pep
HISPASNSSTPTYATTTPRLPSHPMLQRRLAMADRSMTLQLAFAAILLLILCGSTCSSLQFAYQEFERRPARPDFKLHPGAPPSPTAPCRSXRRRRHGHGPGKGHVRQGRPPSLGKKPSARRHLRSRRSSCQHRPQGTDGEKXGFSSTTTRPAXRXNGGXXG

SEQ ID NO: 195463 - protein, 155 aa, Triticum aestivum
  unsure (1)..(155): unsure at all Xaa locations
  Clone ID: PAT_TA_89881.pep
DTIDNVKAKIQDKEGIPPDQQRLIFAGKQLEDGRTLADYNIQKESTLHLVLRLRGGMQIFVKTLTGKTITLEVXESSDTIDNVKAKIQDKEGIPPXDQQRLIFXAGKQLEGWPHLADYTSRRXHLHWCQVVGGCRFRQELTGKTSPGGGLGHIDM

SEQ ID NO: 195464 - protein, 58 aa, Triticum aestivum
  Clone ID: PAT_TA_89882.pep
HFTRRARLLYGGRSTRSRRTCGFPAHGGSAPAACRCPRYPPVRRGVRRSQASAQTCRG

SEQ ID NO: 195465 - protein, 178 aa, Triticum aestivum
  unsure (1)..(178): unsure at all Xaa locations
  Clone ID: PAT_TA_89883.pep
QIFVKTLTGKTITLEVESSDTIDNVKAKIXDKEGIPPDQQRLIFAGKQVXRDGRTLADYNIQKESTLHLVLRLRGWVCKIFRQTXDGAKTIIWSXGVLXDTIRQRXRQRFKTRXGIPPGTKQRLTSAGKXSXDGRXXADYNTRRSHLHXGVRFVENLKPGAYRGGLGTKLKQGRRHPR

SEQ ID NO: 195466 - protein, 127 aa, Triticum aestivum
  unsure (1)..(127): unsure at all Xaa locations
  Clone ID: PAT_TA_89884.pep
MPASIAFGRFDDSFSLASFKAYIAEFISTLIFVFAGVGSAIAYSKXAXGAPLDPSGLIAVXAICHGSGLSXXSAVRXQHLPXGHVEPAVXFXLALGRQVTTSTGSTGFPSASSGLLVHSERRDPTVS

SEQ ID NO: 195467 - protein, 112 aa, Triticum aestivum
  unsure (1)..(112): unsure at all Xaa locations
  Clone ID: PAT_TA_89885.pep
KTTLHSMILIPEYLPCSHVITEFNIKSLETLYCLGXIHTKNSIQGLKVPQVWAAPPEIWVXSXQPFXXREQLIGPXTGNVVAGEHXXVTVELXTHFLVRXLCLXDYXXPHVG

SEQ ID NO: 195468 - protein, 159 aa, Triticum aestivum
  unsure (1)..(159): unsure at all Xaa locations
  Clone ID: PAT_TA_89886.pep
MQIFVKTLTGKTITLEVESSDTIDNVKAKIQDKEGIPPXDQQRLIFAGKQXEDGRHPRPTTTSRRXHLHWVSASAXGAKKRKKEDYTKPKEXEXQXKKVXSPPPXLQVXXRNGKVTVKKDXPXAMGPDFNTAYAVGHLSRGLSLLLDDHRSCFNTGELR

SEQ ID NO: 195469 - protein, 93 aa, Triticum aestivum
  unsure (1)..(93): unsure at all Xaa locations
  Clone ID: PAT_TA_89887.pep
LSXMLVGPNKTVSIDWSTILSKXVLNLPVATAXSVERXFSAMIYLKNKXLRNSMSDDLMNNCLVTFIERDVFLKVSEEDIVEDFMAKERRRVT

SEQ ID NO: 195470 - protein, 102 aa, Triticum aestivum
  unsure (1)..(102): unsure at all Xaa locations
  Clone ID: PAT_TA_89888.pep
IRLSRRPRRRGRWRAAVDPMTGGGGEDVPAPRRRPLTVLPLXALIFYXVXGAXVXESXDSVRAGRXXRXSCSSDSSILXGPLVAPWXPSSXXXLGXXVXXNR

SEQ ID NO: 195471 - protein, 56 aa, Triticum aestivum
  unsure (1)..(56): unsure at all Xaa locations
  Clone ID: PAT_TA_89889.pep
MLVYQDKLSGDELLSDSFPYRELENGVLWEVXDGHWVRSKEQFDVGHWEPSLLLSV

SEQ ID NO: 195472 - protein, 112 aa, Triticum aestivum
  unsure (1)..(112): unsure at all Xaa locations
  Clone ID: PAT_TA_89890.pep
ARALTTXNDAPXAPRRXXHAQXPAHDXXATALGGLPQXRLPAXRXPXXXRRQAEPFXAAXLPXLGXRDGVEYPVAVAVGRIFLGTGIGEXRHGTVPFLAPPLGVLVAFVRAR

SEQ ID NO: 195473 - protein, 120 aa, Triticum aestivum
  unsure (1)..(120): unsure at all Xaa locations
  Clone ID: PAT_TA_89891.pep
MATETETFAFQAEINQLLSLIINTFYSNKEIFLRELISNSSDALGQDQVESLTDKSKXDAQPELFIHIIPDKATSTLXLSTADWDDKSDFVNNSGTSQFGDKGWRIAGRKIGSSGGFPLL

SEQ ID NO: 195474 - protein, 161 aa, Triticum aestivum
  unsure (1)..(161): unsure at all Xaa locations
  Clone ID: PAT_TA_89892.pep
YRLNVGGEAVSPADDSGRFYRTWDTDVPYIFGAAVGVSFEKDSDVTIRYPPSVPPHIAXEGVYASARSMXPDXKINLNYXLTWDPTVGXAGFYYLLRFHFCEXIQYPITKVNQRSFFIYINNRRARSRWDVIDRRIGFRCNGLLVVTTGPARWSGCTGLRR

SEQ ID NO: 195475 - protein, 73 aa, Triticum aestivum
  Clone ID: PAT_TA_89893.pep
ADLSFADQLGKKEHRELAREAVRKSLVLLKNGNTPNQQFLPLPKKASKILVAGSHASNLGYQCGGMGQFNGGK

SEQ ID NO: 195476 - protein, 146 aa, Triticum aestivum
  unsure (1)..(146): unsure at all Xaa locations
  Clone ID: PAT_TA_89894.pep
QFRFLFAEMVNNTPVLFEYQSDTDAWQSSEAVLANGPAAPAGPDGDGTYLCAAHAGPDCVMVYSGPGVDRPVFFRPGFPHNPNAGGHGDRXHVYGDGXXVGGRSTVIDEPSRXPVKLGGGVDXYGSGRSPGDWXLGSTCRLTKVQP

SEQ ID NO: 195477 - protein, 100 aa, Triticum aestivum
  unsure (1)..(100): unsure at all Xaa locations
  Clone ID: PAT_TA_89895.pep
MREXISIHIGQAGIQVXNACWELYCLEHGIQPDGQTNGDXXIGGGDDAFNTFFXETGAXKXVPRAVFVDLXPTXXDEVRTNVYRQSSTXAVIXWKEDASK

SEQ ID NO: 195478 - protein, 95 aa, Triticum aestivum
  unsure (1)..(95): unsure at all Xaa locations
  Clone ID: PAT_TA_89896.pep
MXXIPALPEIXLGMILLLQFXXGLXGXPWGNAXXAXAXRXXXEXCXQARSEXXDLAREGNEIIRAXXKWSPELXAACXVWKAIKXEFXPVDPIDK

SEQ ID NO: 195479 - protein, 80 aa, Triticum aestivum
  unsure (1)..(80): unsure at all Xaa locations
  Clone ID: PAT_TA_89897.pep
HRXHSLXXAXWCPVEXRTKLHRRXXXRGLGXFRGRVAQAXGKLQPRHGGGGTGGEASEVAGDRXRAAGXGGGRSVHQRHA

SEQ ID NO: 195480 - protein, 143 aa, Triticum aestivum
  unsure (1)..(143): unsure at all Xaa locations
  Clone ID: PAT_TA_89898.pep
MSGRKKTREPKEENVTLGPAVREGEHVFGVAHIFASFNDTFIHVTDLSGRETLVRITGGMXVKADXRDESSPYAXAMLASXDVAVRCXELXITALHIKLRATXWKHDXNXGPXAQAALRXLAXSGXXIXRIEDLPGSTDRSRR

SEQ ID NO: 195481 - protein, 107 aa, Triticum aestivum
  unsure (1)..(107): unsure at all Xaa locations
  Clone ID: PAT_TA_89899.pep
LPLLLLLALLGTSSAAAAPGVIRLPRAGACATPADXAVYDRPVIGXXTHPGNXAAXRIDNXTSTSYIGASYVKXXEVXXXTXXHRSSTXRXDEXLLXKLSXSXGCLL

SEQ ID NO: 195482 - protein, 172 aa, Triticum aestivum
  unsure (1)..(172): unsure at all Xaa locations
  Clone ID: PAT_TA_89900.pep
IAKWSEAPRRAATQSKARRESVVLVPRRPVSRHGAQAEPEEGGAHLAAQACSAGRRRIAGPPSRPAARPRPRSAAFIACSHRFLIGPPEPAAAVGDTASVAXGHSGPLSSGQSRGGRPSTRTSSVAVADANRRRRRCTKPPVLGHCGPQVPXTSPRSPLXAGAWSHRRQNCV

SEQ ID NO: 195483 - protein, 129 aa, Triticum aestivum
  unsure (1)..(129): unsure at all Xaa locations
  Clone ID: PAT_TA_89901.pep
MYTARKKIQKDKGVEPSEFEDTVAQAFFDLENGNQELKSDLKDLYINTAIQMDVVGNRKAVVIHVPYRLRKPFRKIHVRLRQGAGEEFSGKDVALLQQEVVRHPRSSAVQRPRTKTXTVXDGXWEDCTS

SEQ ID NO: 195484 - protein, 69 aa, Triticum aestivum
  unsure (1)..(69): unsure at all Xaa locations
  Clone ID: PAT_TA_89902.pep
LATXSXXNNVPRKPKNPKKKRTXXASEDRKKRRDGIGTNPRSIPPSRIEXEHDRFDRGRGGEGREGALA

SEQ ID NO: 195485 - protein, 136 aa, Triticum aestivum
  unsure (1)..(136): unsure at all Xaa locations
  Clone ID: PAT_TA_89903.pep
MSPQTETKAGVGFKAGVKDYKLTYYTPEYETKDTDILAAFRVSPQPGVPPXEAGAAVXAESSTGTWTTVWTDGLTSLDRYKGRCYHIEPVAGEXDXXWICXVAYPLDLFEXGSVTNMFTSIXXNVFXFXXLTALRL

SEQ ID NO: 195486 - protein, 108 aa, Triticum aestivum
  unsure (1)..(108): unsure at all Xaa locations
  Clone ID: PAT_TA_89904.pep
PRLPHLPPVPSSPAPVSSLPIPAHATSQPXTPTRVAVIFQRAGLPASPRTDXARPQPTPPTXPGSLQPHRPGAXPALLPPEALQVSCSAPCDLVGWRCSTLRLRSIIG

SEQ ID NO: 195487 - protein, 68 aa, Triticum aestivum
  unsure (1)..(68): unsure at all Xaa locations
  Clone ID: PAT_TA_89905.pep
CNLLEAVSCFSCWYGRGQFAGKTRCSGKRTGERHHLQLHRGIIFAGXPPRIFATTVCDFCWXQPRFCY

SEQ ID NO: 195488 - protein, 152 aa, Triticum aestivum
  unsure (1)..(152): unsure at all Xaa locations
  Clone ID: PAT_TA_89906.pep
KSTPIQSPQKSPSQNPSPSDPGEMANPRVFFDMTVGGAPAGRIVMELYKDAVPRTVENXRALCTGEKGVGKSGKXLHYKGSPFHRVIPDFMCQGGDSPKGNGTGGXPSTARSRXREXVHXTPXRDLSMGNAGPTQRSSSSHLPCIGSTLARR

SEQ ID NO: 195489 - protein, 69 aa, Triticum aestivum
  unsure (1)..(69): unsure at all Xaa locations
  Clone ID: PAT_TA_89907.pep
GFLGSHNFNHTLTDWIYLPWIKCGSAKXSAPYQRLDPGQSWAPGXWDLKWVCGNAPNNVXQQFADLQQP

SEQ ID NO: 195490 - protein, 146 aa, Triticum aestivum
  unsure (1)..(146): unsure at all Xaa locations
  Clone ID: PAT_TA_89908.pep
VKQXXLEGCTNWVXIERAQAPALXPLNLLLIVVSXVHGSSRHLPGSSRLAPXXQHLGCSWQERGVVNSVVELGSSSVGLVVWNRREAPVMEIDGDGAVAVAGKTTRWRGCGGLQLEPKVVGDADEANGAAEHNLTGRGRLRPWERR

SEQ ID NO: 195491 - protein, 128 aa, Triticum aestivum
  unsure (1)..(128): unsure at all Xaa locations
  Clone ID: PAT_TA_89909.pep
MQIFVKTLTGKTITLEVESSDTIDNVKAKIQDKEGIPPDQQRLIFAXGKQLEDGRTLADYNIQKXXTSTFVLRLRGGMQFSXNLTGKTITXRFEXLTHRHVKASXRQXGSPGQXPXXXWLMGHADKHQ

SEQ ID NO: 195492 - protein, 169 aa, Triticum aestivum
  unsure (1)..(169): unsure at all Xaa locations
  Clone ID: PAT_TA_89910.pep
MQIFVKTLTGKTITLEVESSDTIDNVKAKIQDKEGIPPDQAASHLCWASSLRMAAPLLDYNIQEGXTSTWVLKVXVGGMQFFVXKTSTGQDHHLXVXPPALXDNVKXSXRQGXTLPDXTLIFGGXXSRMAXLAGYNTKKXTSTGCQVRGXMNFXKTQREDITWRISGQR

SEQ ID NO: 195493 - protein, 135 aa, Triticum aestivum
  unsure (1)..(135): unsure at all Xaa locations
  Clone ID: PAT_TA_89911.pep
MGKIKIGINGFGRIGRLVARVALQSDDVELVAVNDPFITTEYMTYMFKYDTVHGHWXKHSDIKLKDDKXLLFGREXXXFGVKEPEEXPWGEAGADYVVXPRVSSTGQGQAAAHFEGGAKKVALCPXXNPYFVWCQ

SEQ ID NO: 195494 - protein, 126 aa, Triticum aestivum
  unsure (1)..(126): unsure at all Xaa locations
  Clone ID: PAT_TA_89912.pep
MVSLKLHKRLASSVLKCGKGKVWLDPNEVNEISMANSRQNIRKLVKDGFIIRKPQKIHSRSRARRAHEAXQXGRHSGYGKRRGTRDARLPXKILXMRRMRXXXRLLRKYRXAKXIDKHMFHDITSQ

SEQ ID NO: 195495 - protein, 102 aa, Triticum aestivum
  unsure (1)..(102): unsure at all Xaa locations
  Clone ID: PAT_TA_89913.pep
PLHLLPQRRLPFGTPSSPPAAGEMXPKRGGKAPVPAKKKAAXKVVNPLFEKXPKQFGIXGALPPIXXLHRFXKWXKXVRIXRQRCILXQXLKVLXXLQYFTR

SEQ ID NO: 195496 - protein, 186 aa, Triticum aestivum
  unsure (1)..(186): unsure at all Xaa locations
  Clone ID: PAT_TA_89914.pep
ETTKYSCTVIDAPGHRDFIKNMITGTSQADCAVLIIDSTTGGFEAGISKDGQTREHALLAFTLGVKQMICCCNKMDATTPKYSEGRYEEXVKGISSYLKKXGYNLTRXPFVXTPXSEGDNMIXEAXNXXWXKGPXFLXALDKFNEPKSPRKXLLSPQRVXKLWIGMSGGFKIKSMVALGLTINRSP

SEQ ID NO: 195497 - protein, 153 aa, Triticum aestivum
  unsure (1)..(153): unsure at all Xaa locations
  Clone ID: PAT_TA_89915.pep
LSPLQRPVWLGQEDGTXVLLLSIRQSSSISRVXWDEAHQVGXLQHHSIRXNIIXISKGPXETSGYXIYTVLLRQQLLXGLXAXGSLPLGPXTRNYGXWCQXPNHNXXXLDXGNHXWNXEQXXAHHWXVXXWVXNPXKXFXADXXXQPGIXXFN

SEQ ID NO: 195498 - protein, 88 aa, Triticum aestivum
  unsure (1)..(88): unsure at all Xaa locations
  Clone ID: PAT_TA_89916.pep
CXGXNKQDISSTIVPRNXLRXSXSAYPALKGXCGRGRRSMWSGRRERSRRVADAEEGGVEGEGEQGGXRGRLLQIWISRSLYTAPTLA

SEQ ID NO: 195499 - protein, 95 aa, Triticum aestivum
  Clone ID: PAT_TA_89917.pep
MSCCGGNCGCGSGCKCGNGCGGCKMYPEMDEGVTTTSQTLIMGVAPSKGTPSFEAAAETGADNGGCKCGSNCTCNPCTCKIHPNQGQGDWMAWMA

SEQ ID NO: 195500 - protein, 35 aa, Triticum aestivum
  unsure (1)..(35): unsure at all Xaa locations
  Clone ID: PAT_TA_89918.pep
SSLTLILMVDYKAMXGFSXXXVILTSLVKDVRWIM

SEQ ID NO: 195501 - protein, 103 aa, Triticum aestivum
  unsure (1)..(103): unsure at all Xaa locations
  Clone ID: PAT_TA_89919.pep
MEHKETGCQSREGPILCVNNCGFFGXSAATMNMCSKCHKEMAMKQEQGKLAAXSFRQIVNGGDPRKETLLLAAVEFSRSEDAYYGLLISPSQRRGWPQRPRGT

SEQ ID NO: 195502 - protein, 162 aa, Triticum aestivum
  unsure (1)..(162): unsure at all Xaa locations
  Clone ID: PAT_TA_89920.pep
MARGLKKHLKRLNAPSHWMLDKLGGAFAPKPSSGPHKARECLPLILILRNRLKYALTYREVQSILMQRHTWLDGKGRTXDKTYPAGFMDIISIPKDWVKNYRFLYDTKVASAFILSRDEDANSXLQXRSVHSAKXXPYLKLXGRHRYQTIIRQCTSHWNRCD

SEQ ID NO: 195503 - protein, 70 aa, Triticum aestivum
  unsure (1)..(70): unsure at all Xaa locations
  Clone ID: PAT_TA_89921.pep
SFLMVAXESINMTLLQCTGTQLNSLXINSATHTKLNTTLGTEXVSXRXRTTVXDDQXRNSFXXATKSNXK

SEQ ID NO: 195504 - protein, 107 aa, Triticum aestivum
  unsure (1)..(107): unsure at all Xaa locations
  Clone ID: PAT_TA_89922.pep
MXDELDELIEFLSNGSPQVRGAAAXIVRGLTGDSDXLRSLAARADRALPALLRLLASVGAGCAGEAXDDSLVKLXQDXDLAXRLVVLGAVXVAMDVMVKRXXEXPNA

SEQ ID NO: 195505 - protein, 89 aa, Triticum aestivum
  Clone ID: PAT_TA_89923.pep
VSVHRLLVILTPSALLRRRRQSTEVGAACPSTNKNRRNGRLPTHRDQIHAAGEGPLIRNMYGKSSLNLLLKVIHKSWKAVVEQVLDQRV

SEQ ID NO: 195506 - protein, 137 aa, Triticum aestivum
  unsure (1)..(137): unsure at all Xaa locations
  Clone ID: PAT_TA_89924.pep
THLPXXLXXHEHELXKGSRSGDDGALQAXXRQRRRAARRPCXPLHAVLLSLPASAEVAXSTGRWCRRXAPSRASXSGRGKKRSVLVGIXYTNTXACELXGPIXXVKCMXYLLTXHFGXSNDCXSSHXXXRDXASSRQ

SEQ ID NO: 195507 - protein, 155 aa, Triticum aestivum
  unsure (1)..(155): unsure at all Xaa locations
  Clone ID: PAT_TA_89925.pep
XALPLTQLQEARXTIDLCTIYISILLEQAVKLLFTTGTXSGGGGSRALERTTEGSEHPQQPEHDALVQEPEEVDARQPAPPLPQRRGQRAHAQQRPAPGRRRHLLPYPLPLPPAGHRWRSIDLQVAGGIRGFSSSSASSVWMVTPLRMESFMLER

SEQ ID NO: 195508 - protein, 135 aa, Triticum aestivum
  unsure (1)..(135): unsure at all Xaa locations
  Clone ID: PAT_TA_89926.pep
MVSLKLQKRLAXSVLKCGKGXVWLDPNEVNEISMANSRQNIXKLVKDGFIIRKPQKIHSRSRAXRAHEAKHXGRHSGYGNRMGTMEAXLPTXILWMXTMXVLXRXLXKYXXAKKIDKHMXHDMYLKXXXXMFXXX

SEQ ID NO: 195509 - protein, 152 aa, Triticum aestivum
  unsure (1)..(152): unsure at all Xaa locations
  Clone ID: PAT_TA_89927.pep
MSAYCGKYKDELIQNAAYIGTPGKGILAADESTGTIGKRFASINVENVEDNRRALRELLFCTPGCXSKYLSGVILFXKETLYQEHQGWQAFVDILKAGNSSPDQGGQGYIDSLGQRETHQGLMTGKRCAKYTSWCRSQVGESGASIVSSTKR

SEQ ID NO: 195510 - protein, 160 aa, Triticum aestivum
  unsure (1)..(160): unsure at all Xaa locations
  Clone ID: PAT_TA_89928.pep
SMLIAQIIGTAIGCVISPLTFYVFYNAFDIGNQDSPWKAPYALIYRNIAILGVEGFSALPMHCLQLCCGFFAFALVANLMRDFLPQKYGKWVPLPMAMGFPFLVGASFAIDMCAGSLIVYIWXKIDRSKAAHMVQQLPPVKCGDGLGSPTSCLRWQVPTM

SEQ ID NO: 195511 - protein, 91 aa, Triticum aestivum
  unsure (1)..(91): unsure at all Xaa locations
  Clone ID: PAT_TA_89929.pep
KAVPAAAAAPSIXRXRPXTPSASHARXRPPXPCCLHPXRNLSXLGFEXNMXXLVSSSLVXXLXQXCXAPSXVTVSRPTFQQFMIYSSGIKX

SEQ ID NO: 195512 - protein, 59 aa, Triticum aestivum
  Clone ID: PAT_TA_89930.pep
ATFKIMHASASRISHHLVDHDDTVALPFNSDGNEIQSVLCAKKKKKKKKKKKKKKNSRL

SEQ ID NO: 195513 - protein, 116 aa, Triticum aestivum
  unsure (1)..(116): unsure at all Xaa locations
  Clone ID: PAT_TA_89931.pep
MLDKLWDDVVAGPRPETGLDKLRRAAATQPLAINTAAGEAIKQSPSMPTTPTTPVTRRRRTPPRGGSVWRSVFQPGEKLGHQNLXANFFDARNQLPTVYNWFKTTRQDKTRIRPTA

SEQ ID NO: 195514 - protein, 163 aa, Triticum aestivum
  unsure (1)..(163): unsure at all Xaa locations
  Clone ID: PAT_TA_89932.pep
SKRSQGSFVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKXKIQDKEGXPPDXQRLNFAGKQLKDGXXLADYNIXKGSSTWAKLRCG

SEQ ID NO: 195515 - protein, 186 aa, Triticum aestivum
  unsure (1)..(186): unsure at all Xaa locations
  Clone ID: PAT_TA_89933.pep
GCSAGLISLDLARNALRTRRNATALVVSTESIAPNWYPGTDKSMMLGNMLFRCGGSAVLLSNDPALRGRAKMELXCLVRSNIAANDDAHACAQQREDXDGRVXXNLSXALPKGAVKASTXNSGTLAPRILPXNELXRSPPAPAXEVSSSSASNXGKXRXKNLIRRNAGGGIKRERTWADKGLNRRP

SEQ ID NO: 195516 - protein, 159 aa, Triticum aestivum
  unsure (1)..(159): unsure at all Xaa locations
  Clone ID: PAT_TA_89934.pep
MQIFVKTLTGKTITLEVESSDTIDNVKAKIQDKEGIPPDQQRLIFAGKQLEDGRTLADYNIQXKESTLHLVLRLRGGMQIFVKTLNGKTITLEVDSSDTIXNVKAKIKDKGGNPPDXQRLIFASKQLEDGRNXXDYNIRRINLNWAPLVSNFKPHKIRV

SEQ ID NO: 195517 - protein, 157 aa, Triticum aestivum
  unsure (1)..(157): unsure at all Xaa locations
  Clone ID: PAT_TA_89935.pep
MATASLAVRSAFGVALAALIAARAVRRRSLDASGGAAGFAVMALHLACGYRYGALLLAFFXSPPSKVTKIGXDRKRRVXGRISKEGGXRNWXIPANSAITTVLGXLIGXMTGGKDXCLDSNGQKXXLGIISAIXGXYCXCNGTLGSNRLLMKTKSQP

SEQ ID NO: 195518 - protein, 123 aa, Triticum aestivum
  unsure (1)..(123): unsure at all Xaa locations
  Clone ID: PAT_TA_89936.pep
RTQHPPSACTNPSPGPGAAPPPSPPLVLLRCRSGKQPPAGSSRTAATSTPTAAALCTQPPXIFSATPQAVAGSTPRVVCPLPHPVAXSLPPPSLTAAAHCTAEPPVVAHCTAEPPVAAYCIDR

SEQ ID NO: 195519 - protein, 61 aa, Triticum aestivum
  Clone ID: PAT_TA_89937.pep
KVLITSQLGVSHTNNGLKVVQPKPTGSYVNSDQIQYTRLDKPGDQPCFEAQEFDLVRGIFI

SEQ ID NO: 195520 - protein, 99 aa, Triticum aestivum
  unsure (1)..(99): unsure at all Xaa locations
  Clone ID: PAT_TA_89938.pep
MKGTKLAAILILQAVLVMGLLSHVNADFFPKCCNNCRSFSGVDVCDDAHPKCPQGWSAFRVVSTSPEMWRCADMKSNVXXXCXGPARVLIRSSRHICSA

SEQ ID NO: 195521 - protein, 152 aa, Triticum aestivum
  unsure (1)..(152): unsure at all Xaa locations
  Clone ID: PAT_TA_89939.pep
XFXQVMLCKSELXERNWGFTGAFXHXKSGTTGKRKPHPQDATAPPGTGAXSPAAFARAGRPPRTGEQPSHAHRPRCPQPSTHRKGSTSMARGLRPGPRAQTSRPAPPQPLQQTCWRCQPESGWPSTSTEKRRTALGWLGGWRRRISCVGLVR

SEQ ID NO: 195522 - protein, 140 aa, Triticum aestivum
  unsure (1)..(140): unsure at all Xaa locations
  Clone ID: PAT_TA_89940.pep
RPXPFGSGVASAAXAXVSVGXGCRGGWAWRPRPRARXGQRLRVXGAPXXHAAXPXSAVHAEPHHGEXFRXFGLPRAGFGSDLEAGIDXVIYACRFMDFLAISGSLDGSVLCFSMAALCXXCLRGIHLXSXGXXXRMXLXP

SEQ ID NO: 195523 - protein, 190 aa, Triticum aestivum
  unsure (1)..(190): unsure at all Xaa locations
  Clone ID: PAT_TA_89941.pep
ELYCLEHGIQPDGQMPGDKTVGGGDDAFNTFFSETGAGKHVPRAVFXDLEPTVIDEVRTGAYRQLFHPEQLISGKEDAXANNFARGHYTIGQGDCXSLPRSYXELSDNCTGCKXILVFNAVGGGTGLXLGSLLLERXSVDYGKXSNLGQNLPXPKVSTXVVDHTHVCQPSSLTDSPSKRHHTLRPMTPNN

SEQ ID NO: 195524 - protein, 89 aa, Triticum aestivum; identical to SEQ ID NO: 117638
  Clone ID: PAT_TA_89942.pep

SEQ ID NO: 195525 - protein, 180 aa, Triticum aestivum
  unsure (1)..(180): unsure at all Xaa locations
  Clone ID: PAT_TA_89943.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSXTLGGFEAGISKDGXTRXXASXLQSLDEHMICSATNGAHSQISKGPYKKLQGIPPTRWTRSF

SEQ ID NO: 195526 - protein, 135 aa, Triticum aestivum
  unsure (1)..(135): unsure at all Xaa locations
  Clone ID: PAT_TA_89944.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNXSAKLEGDDLDFXKKNVESATKYFLTSSRTSXLVGXTS

SEQ ID NO: 195527 - protein, 59 aa, Triticum aestivum
  unsure (1)..(59): unsure at all Xaa locations
  Clone ID: PAT_TA_89945.pep
PMERLGGAAXPSLXXPGFXFHPTXEXLLXFYLKHHVTRXNKXQHLNRGTVRHXPHXAPV

SEQ ID NO: 195528 - protein, 158 aa, Triticum aestivum
  unsure (1)..(158): unsure at all Xaa locations
  Clone ID: PAT_TA_89946.pep
MAEQTFIMIKPDGVQRGLIGEVISRFEKKGFYLKGLKLQNVEKSFAEQHYSDLSSKPFFAGLVEYIVSGPVVAMVWEGKSVVATGRKIIGATNPLASEPGTXRGDFAVDIGKNVIHGSDSVESAKKEIALWVPEGMQSGGQPAHWMRLSVHDGLSEVQ

SEQ ID NO: 195529 - protein, 50 aa, Triticum aestivum
  unsure (1)..(50): unsure at all Xaa locations
  Clone ID: PAT_TA_89947.pep
SALVLMLSKAWSAAKGTDITKSDAKDIMFHLYMTAVANLQRQMPKXXKXX

SEQ ID NO: 195530 - protein, 102 aa, Triticum aestivum
  unsure (1)..(102): unsure at all Xaa locations
  Clone ID: PAT_TA_89948.pep
MKGTKLAAILILQAVLVMGVLSHVNADYFPKCCNNCRSFSGVXDVCDDAHPKCPKGCSASAWCRTTPEMLXCAXYESTVRRTCRGPXRTDVNANMYVPPKMK

SEQ ID NO: 195531 - protein, 91 aa, Triticum aestivum
  unsure (1)..(91): unsure at all Xaa locations
  Clone ID: PAT_TA_89949.pep
VDNSTMKGDGMAFFLACYPSKLSPNSRGGNLGLINSGDDGKNQAAFGDERFVXLEFDTSKTTWEPNWRTTLSTLTSFPVTTRVRDLRGHQR

SEQ ID NO: 195532 - protein, 130 aa, Triticum aestivum
  unsure (1)..(130): unsure at all Xaa locations
  Clone ID: PAT_TA_89950.pep
STASASSRLPSPPARRRSPTGLAGGLPSPWSFLERNKARWQWRRPSAYPPPPPFYRLYKDFXQDPSSAPEPPPPIRGSYHSFGATYTTDVVLPIWRIXGVRQLYPKGPNFXFKKDLXHSTKXXSQXFGLT

SEQ ID NO: 195533 - protein, 72 aa, Triticum aestivum
  unsure (1)..(72): unsure at all Xaa locations
  Clone ID: PAT_TA_89951.pep
LIEPMDDHXXLNRLDDHSXLTRLXIIVDLNLWTTHSGLELVXDHKVXFKLVGXXIVXFXPWSMXHACRLEDS

SEQ ID NO: 195534 - protein, 157 aa, Triticum aestivum
  unsure (1)..(157): unsure at all Xaa locations
  Clone ID: PAT_TA_89952.pep
SSCAKAPQTLTLVLAXLPSSRSSXSHGADQGRGAGHRHRPRHHLLXVRRRVAARPRRDHRQRPXGQPHHALXVRRLHRLXGASHPAMPPKNKVAMNPSTXSSDAKRLXSAEGCLIPXPKSDIXCXXYKVIPGPCKQMMWNSRVATFFNKILQRPHQK

SEQ ID NO: 195535 - protein, 140 aa, Triticum aestivum
  unsure (1)..(140): unsure at all Xaa locations
  Clone ID: PAT_TA_89953.pep
MANPRVFFDMTVGGAPAGRIVMELYKDAVPRTVENFRALCTGEKGVGKSGKPLHYKGSAFHRVIPDFMCQGGDLTRGQRTGGXSIYGENSPNRIPPTXHQXGISPMANAXPTQXSQFLIERPLIGQRTKPPRMTLSKGPQ

SEQ ID NO: 195536 - protein, 129 aa, Triticum aestivum
  Clone ID: PAT_TA_89954.pep
TILSSFRTHLSLLSPPPEATQTPSPSPNFPSLPRRRPQAHQLRPDERPPRVLQPLPVPPPPPGAPVQLPAPNPSHFAPRGIRPPVPLVLILLVLGEASPLGCGVGKYGPPWRRVLSGPLTQAPPGRKTY

SEQ ID NO: 195537 - protein, 140 aa, Triticum aestivum
  unsure (1)..(140): unsure at all Xaa locations
  Clone ID: PAT_TA_89955.pep
MPPLYILALGLLLLHTPRCSSSAPAGDTLTEGQVLAVGDKLVSTNGKFALGFFQPATTTISNLKNATSSSSSWYLGIWFNKIPVLTVRVGLLIPEGAXRHSNXNSTKXKFSKXXXTLSLSTNLAGNGPLFPSKLSHKQFH

SEQ ID NO: 195538 - protein, 118 aa, Triticum aestivum
  unsure (1)..(118): unsure at all Xaa locations
  Clone ID: PAT_TA_89956.pep
RRXSARRVLWRAARARMDITGSREIRMXLSAQAAGXPGVHAGHAPRRVLRGEMVRELGGGRQLEGVKVDMAETLDFHHRDEAPAPFAHRLQKLTISHAKCNLSTYESKNTSTQLIYCV

SEQ ID NO: 195539 - protein, 79 aa, Triticum aestivum
  unsure (1)..(79): unsure at all Xaa locations
  Clone ID: PAT_TA_89957.pep
SPQLRSSSGKVARLVGVLLPAQPRLDLLVLLFLVLGRSLQFGQVSTPKSSMNCCLSWXLVQSAAEXPXSLGSCVPLLTN

SEQ ID NO: 195540 - protein, 75 aa, Triticum aestivum; identical to SEQ ID NO: 106874
  Clone ID: PAT_TA_89958.pep

SEQ ID NO: 195541 - protein, 150 aa, Triticum aestivum
  unsure (1)..(150): unsure at all Xaa locations
  Clone ID: PAT_TA_89959.pep
RSPGSGSGQRPPPHHLPRRSPLARRSLDPVGAVPSSLPRLPPRSRSRPKATDATATAAPPGPRRSRLAGLVXLRPRRLHLLPAPRCLVPTSNDPESASDPQFDYGVDDSSFLLEQPDVGGKXPDATSTMTPTTLEVLLLLXPPTNXSXKR

SEQ ID NO: 195542 - protein, 153 aa, Triticum aestivum
  unsure (1)..(153): unsure at all Xaa locations
  Clone ID: PAT_TA_89960.pep
KHYMWPLLHYLLPLTPSTLGGLPFDRALYHSFLSANRAFADRLTEVLAPDDDFVWIQDYHLLALPTFLRKRFPRARVGFFLHSPFPSSEIFRTIPVRDDLLRALLNADLVGFHTFDYARHFLSXCSRLLGSTTVKARIIGIEYXGARQRQDSA

SEQ ID NO: 195543 - protein, 102 aa, Triticum aestivum
  Clone ID: PAT_TA_89961.pep
MGCTDMAWDAWLTIKDHFLDNLETRALHLDVSFRTFVQSDLSINNYCYKFKGMTNALRVLGEVVPDHALVLNPLKGLNKQFEHMKTFIGRTTSFPLFQAIRN

SEQ ID NO: 195544 - protein, 78 aa, Triticum aestivum
  unsure (1)..(78): unsure at all Xaa locations
  Clone ID: PAT_TA_89962.pep
LRIVERKEVXESTMNAXKADAXGYWTSALADLALTHPIRLGLALNFSGXYYETSNSPDQACNLAKQIEEDKEMVSRIV

SEQ ID NO: 195545 - protein, 107 aa, Triticum aestivum
  unsure (1)..(107): unsure at all Xaa locations
  Clone ID: PAT_TA_89963.pep
TTCCRRRAPXXSPPAPXPPXRXPRXRXPAXPGAKRPRRXRPGGGGGGRGRRGEGSGGAGRTGKCAPECGGAGGPPRRRGAGCARGRAPLFRPPEAEERRLRRGRFVS

SEQ ID NO: 195546 - protein, 94 aa, Triticum aestivum
  Clone ID: PAT_TA_89964.pep
MSCCGGNCGCGTACKCGNGCGGCNMYPEAEAAGATLLVSATATHKASSGGMEMAAENGGCGCTQCKCGTSCGCSCCSCIDHPYACNVPCCIIDS

SEQ ID NO: 195547 - protein, 156 aa, Triticum aestivum
  unsure (1)..(156): unsure at all Xaa locations
  Clone ID: PAT_TA_89965.pep
KTITLEVESSDTIDNVKAKIQDKEGIPPDQQRLIFAGKQLEDGRTLADYNIQKESTLHLXVLRLRGGMQIFVKTLTGKTITLXEVESSDTIDNVKAKIQDKEGIPPDQQRLIFAXGKQLEDGRTLPDYNIQKXPPPXGAQVRWWMQIFQDLTGRHT

SEQ ID NO: 195548 - protein, 163 aa, Triticum aestivum
  unsure (1)..(163): unsure at all Xaa locations
  Clone ID: PAT_TA_89966.pep
ALPAYFFFASAASDLAVFLNLPFLYPGLPSFRDMGDALVRCPGMPPIRAVDMLVTVQDKESDLTKVRLYQFKRIAESRGVLVNSFDWLEPTARKALADGVCVPDRPTPRIYCIGPLVNSGDASAXGEKRHECLAWLDAQPEKTSVLRFGTXARLGATEGDGPL

SEQ ID NO: 195549 - protein, 132 aa, Triticum aestivum
  unsure (1)..(132): unsure at all Xaa locations
  Clone ID: PAT_TA_89967.pep
SSVPSPTPSHHRSSPLLSPPPPPGSGTIAPCXPPPAPRADHPTMXGAAPHTDPTGPPPHRASRSPAXTPTSPSSPSSSSRPKLQASPTGRPXPGCLSRRRACLPAWRNRHRSNPPASEGGGYGTGAGASGVR

SEQ ID NO: 195550 - protein, 87 aa, Triticum aestivum
  unsure (1)..(87): unsure at all Xaa locations
  Clone ID: PAT_TA_89968.pep
MLYVHPGCLSKHIKYFLRCSNNPSIRTTEQFAFKTFSPXMXKTHCLVELKSREDNFHRMHKKYGETQRFAXCENNGNQSNIQXSPXF

SEQ ID NO: 195551 - protein, 79 aa, Triticum aestivum
  unsure (1)..(79): unsure at all Xaa locations
  Clone ID: PAT_TA_89969.pep
CETIGXTWARGXHGXTRGTAAMRLATTLTTXPWTXLKPRTTSSVSXCIIKYGLSAKLYVQYLNTMQLQTAVHDVYTDLF

SEQ ID NO: 195552 - protein, 156 aa, Triticum aestivum
  unsure (1)..(156): unsure at all Xaa locations
  Clone ID: PAT_TA_89970.pep
PAASPPTSSHLGSGQQPRLRPNSDAHSLHHLRTMPPHRVRPIPHHSSSLLPLLAAHPPSSLGFSREPPSSRASSLAASSACGSSSLLSRFLQGAGYPPGEASSILPPEKRRPPSHPKQAVVAAFAAVPDGRKATTRXPETLPERMTNGNVSDKTHK

SEQ ID NO: 195553 - protein, 151 aa, Triticum aestivum
  unsure (1)..(151): unsure at all Xaa locations
  Clone ID: PAT_TA_89971.pep
LPGVVPDPFCLLLPSPARPIAGPRRPIHRSREAATPSEPSVAEPSRPXPSSPVPPALPVASPPPSHLPTRPDLMSSPWSRAPPGDPAXIGTSRSPSMAADGPXPGPLPLPLLLPTAPSPSPPEDFAATWRPSRDSPGSTRPRHSMSRRGVD

SEQ ID NO: 195554 - protein, 154 aa, Triticum aestivum
  unsure (1)..(154): unsure at all Xaa locations
  Clone ID: PAT_TA_89972.pep
SSPAAPSTSPGPAAAMLRLRSSARLLRKLCEASRPLVRGEVQRVPPPLPTMTRRLSGAASAARSTSLLHPLPGSXLPALPPRQARPLPTASHAPNGFASLRRSPGPRRRLGCSWRSGRFTXPRINGATXCWRNWVQRNGEPEXIKXXKKXRQRG

SEQ ID NO: 195555 - protein, 68 aa, Triticum aestivum
  unsure (1)..(68): unsure at all Xaa locations
  Clone ID: PAT_TA_89973.pep
NKSVAAVGKAAGERWKSLSESEKAPYVAKANKLKGEYNKAIAAYNKGEXSAAAAAPKKAAAKEVEEER

SEQ ID NO: 195556 - protein, 83 aa, Triticum aestivum
  unsure (1)..(83): unsure at all Xaa locations
  Clone ID: PAT_TA_89974.pep
GGXSETXGGXXXVRXTXGXWPXPPCSCGRACAYPWRRXRPWWGRARVSRRRGEGGEPRRTMRRRPAGWLGRIIMDGRPVRPRD

SEQ ID NO: 195557 - protein, 154 aa, Triticum aestivum
  unsure (1)..(154): unsure at all Xaa locations
  Clone ID: PAT_TA_89975.pep
SATSVAPFQGLKSTAGLPVSRRSNGASLGSVSNGGRIRCMQVWPIEGIKKFETLSYLPPLSTEALLKQVDYLIRSKWVPCLEFSKLGSSSXEHNASPGYYDGRYWXTMWXLPXFGCTDXTQVIXRLEGVKEGYPDPKSDHRQMVSACVTSSPTT

SEQ ID NO: 195558 - protein, 148 aa, Triticum aestivum
  unsure (1)..(148): unsure at all Xaa locations
  Clone ID: PAT_TA_89976.pep
AAAASSCAKAPQTLTLAPSXLPSSRSSXSHGADQGRGAGHRHRPRHHLLVRRRVAARPGRDHRQRPGQPHHALVRRLHRLXGAPHRRCRQEPVAMNPSTXVFDAXVLSEEVLLIPCXQSDIKIXPYKVIPWPSKQILVQYKVKETILN

SEQ ID NO: 195559 - protein, 138 aa, Triticum aestivum
  unsure (1)..(138): unsure at all Xaa locations
  Clone ID: PAT_TA_89977.pep
MGKIKIGINGFGRIGRLVARVALQSDDVELXVAVNDPFITTEYMTYMFKXYDTVHGHWEXSDIKSKDDKTLLFWREAFTSFXRQEPEEFRWVXAWCRYLWXPTGSXTDKDKALHFXGXARRWHLCPNKXPYXVVGXXK

SEQ ID NO: 195560 - protein, 81 aa, Triticum aestivum
  unsure (1)..(81): unsure at all Xaa locations
  Clone ID: PAT_TA_89978.pep
PFLVXSHKXXXESXXSTLTXVRSQLIKEESPCCWVLXKATQANDSAFECHGFGLANSPSCLCGSSCPSXPGXFLIDTPSVP

SEQ ID NO: 195561 - protein, 135 aa, Triticum aestivum
  unsure (1)..(135): unsure at all Xaa locations
  Clone ID: PAT_TA_89979.pep
LEPWRRQRAKGPAIGIDLGTTYSCVGVWQHDRVEIIANDQGNRTTPSYVAFTDSERLIGDAAKNQVAMNPINTVFRCEASYRQKFADAPVQXSDIKMWAYKXIPXPADXPMIVMQYKGEDNIFLKNSPMASSNPE

SEQ ID NO: 195562 - protein, 95 aa, Triticum aestivum
  unsure (1)..(95): unsure at all Xaa locations
  Clone ID: PAT_TA_89980.pep
MKGTKLAAILILQAVLVMGLLSHVNADFFPKCCNNCRSFSGVDVCDDAHPKCPQGCSACRVVSTSPEMWRCAXDMKSTVDGTCGGPCKXTDRFPG

SEQ ID NO: 195563 - protein, 115 aa, Triticum aestivum
  unsure (1)..(115): unsure at all Xaa locations
  Clone ID: PAT_TA_89981.pep
FPLQDWVSMXGVIPVASGGXHXWHMPALXEIFGDDSVLQFGGGTLGHPWGNAPGAAANRVALEACVQARNEGRDLAREGNEIIRAACKWSPELAAACEVWKAIKXEFEPVDTIDK

SEQ ID NO: 195564 - protein, 142 aa, Triticum aestivum
  unsure (1)..(142): unsure at all Xaa locations
  Clone ID: PAT_TA_89982.pep
MSPQTETKAGVGFKAGVKDYKLTYYTPEYETKDTDILAAFRVSPQPGVPPEEAGAAVAAESSTXTWTTVXGTDGLTXSLDRYKGRCYHIEPVAGEXSQWICYVAYPLDLFXXGSVTNMLLPMVXTIWFKAYVPTFGDHESPY

SEQ ID NO: 195565 - protein, 139 aa, Triticum aestivum
  unsure (1)..(139): unsure at all Xaa locations
  Clone ID: PAT_TA_89983.pep
GRGPTPXTSXXTGRGARRHGGHSPSPPPPTPWRSRVAWGVQQLSLNLNLNPRNKSSELEGDTGWESIGCAELGFVTGVESVGAQRDGSPPHPRQSSTGGGERVDACRRGRAGGRRGGGRRRGGGGWVGVIRFGEEGPWL

SEQ ID NO: 195566 - protein, 152 aa, Triticum aestivum
  unsure (1)..(152): unsure at all Xaa locations
  Clone ID: PAT_TA_89984.pep
SYREGLMSPQTETKAGVGFKAGVKDYKLTYYTPEYETKDTDILAAFRVSPQPGVPPEEAGAAVAAESSTGTWTTVWTDGLTNPDRYKGRCYHIEPVAGERQQWILLXSYPIDLFEKGSLTNMFTPMXXXYWFKTLRAQRLXDXRIPPTYXKI

SEQ ID NO: 195567 - protein, 96 aa, Triticum aestivum
  unsure (1)..(96): unsure at all Xaa locations
  Clone ID: PAT_TA_89985.pep
GXXGXDDDVXSAXXXLRAKXGAPRYSSAGRLRIGRSGPGEKSPGKKTESIERGGVVASFLLCSMXATAARSVCVCVPALRRLVVVWIDRSMGLVVS

SEQ ID NO: 195568 - protein, 90 aa, Triticum aestivum
  unsure (1)..(90): unsure at all Xaa locations
  Clone ID: PAT_TA_89986.pep
MXTGRERXRHRAXRXXELGQARVXXPESRRTPRHCTSKPSGEXYXRRRHGRSTATAPAXFAXDGGAXGGNCCSVRFLSSDTXRLGFAPRP

SEQ ID NO: 195569 - protein, 134 aa, Triticum aestivum
  unsure (1)..(134): unsure at all Xaa locations
  Clone ID: PAT_TA_89987.pep
ASSCAKAPQTLTLVLAXLPSSRSSXSHGADQGRGAGHRHRPRHHLLVRRRVAXARPRRDHRQRPGQPHHALVRRLHRLXSVSSAMPPRTKVAMNPINTVXDAXVLSAESLXMPXSRVTFXMWPYXVIPPANPMN

SEQ ID NO: 195570 - protein, 154 aa, Triticum aestivum
  unsure (1)..(154): unsure at all Xaa locations
  Clone ID: PAT_TA_89988.pep
LVSARRLQEEVKFQPRGSSKSDLAPPSRRAGCRLCCCFLALMSALFMTMDDVPYPILGTMSTASAAKRKGSPGEHDDYPQAQGRKRSRYSVPDLPKVRNAKPAERRGGFPDTDIIASTLFHKFVETVSXAXCNCDNIILXLHLLLAQLTVNPAA

SEQ ID NO: 195571 - protein, 89 aa, Triticum aestivum
  unsure (1)..(89): unsure at all Xaa locations
  Clone ID: PAT_TA_89989.pep
MKGTKLAAILILQAVLVMGLLSHVNADFFPKCCNNCRSFSGVDVCDDAHPKCPQGCSACRVVSTSPEMWRCADMKSTVDGTCGGPCKXY

SEQ ID NO: 195572 - protein, 70 aa, Triticum aestivum
  Clone ID: PAT_TA_89990.pep
AGAAFGSGLRHAVQGMVLGLHGQPQLLLVDNVKTPKQNNGVSYVPRDFTTWNLNKLAKHGLHHLNRLLSF

SEQ ID NO: 195573 - protein, 124 aa, Triticum aestivum
  unsure (1)..(124): unsure at all Xaa locations
  Clone ID: PAT_TA_89991.pep
HLTSLSSLIHCHIDMFTILKCMIAANKPHYRQPNPLERTAKLTLCYVLEELYKKLPGAAAWARSMEISPAXHPMPXRLXLATXRGAXSXLTTNAEXMASGLKAAVXDNDPISWASTXLGXQXSX

SEQ ID NO: 195574 - protein, 80 aa, Triticum aestivum
  unsure (1)..(80): unsure at all Xaa locations
  Clone ID: PAT_TA_89992.pep
STRLPHGDVTAMLQIVMSRRMSTRLTHVPLYVHHYWESSRTPSAKEHSAXGQKPRQILAEKLHSGKTNRCTLFGETDFCX

SEQ ID NO: 195575 - protein, 156 aa, Triticum aestivum
  unsure (1)..(156): unsure at all Xaa locations
  Clone ID: PAT_TA_89993.pep
XRRDDAAXGGGAKKAPXTDRSRPSPILSARXEAVCCAAGVPPARTREXGXAPRSSDSSLDAPRRRRRRRTRTPCSASARPASAPPEACRRQPAAEALAALEGEAPHQSAGLSRQDELAVHGGEAVQEEQVQREPRKPKPNSGTAKRRETKRKEETE

SEQ ID NO: 195576 - protein, 111 aa, Triticum aestivum
  unsure (1)..(111): unsure at all Xaa locations
  Clone ID: PAT_TA_89994.pep
AGRGTSSSSAAALIHPSLTSSLYCPASLPPSRRRGRGASLPFLAPPEGDDRPRPEQTREARATGKALLSLEPYADAGGHSGADSARAAALLKPKWRLATGXRGRSATQIHT

SEQ ID NO: 195577 - protein, 89 aa, Triticum aestivum
  unsure (1)..(89): unsure at all Xaa locations
  Clone ID: PAT_TA_89995.pep
GADQFNPEXFAKGSRRAAKFPHALLAFSXIGRRACIGPEFAMLEAKSVMATVLQKFSFTLSPTYVHAPADFLTLQPKFGLPVVMKLLDV

SEQ ID NO: 195578 - protein, 97 aa, Triticum aestivum
  unsure (1)..(97): unsure at all Xaa locations
  Clone ID: PAT_TA_89996.pep
MSSTTXSAAVSAKCAAWAQERRPFTHPIEIPAASGAPDERRGRGRGGXGGEVEPPHVLMARRKAASSVCSGXGRTLKGRDLTRTRDSVLRMTGFIES

SEQ ID NO: 195579 - protein, 76 aa, Triticum aestivum
  unsure (1)..(76): unsure at all Xaa locations
  Clone ID: PAT_TA_89997.pep
PSNKSCNIGWLEQFQXNXYYLSLNNLREXYQVYILQGHYPCKXVRFRMAFXATEVTVQSRVVGRYLHGGTHKQHFK

SEQ ID NO: 195580 - protein, 136 aa, Triticum aestivum
  Clone ID: PAT_TA_89998.pep
MAPKAEKKPAAKKPVEEEPAAEKAEKTPAGKKPKAEKRLPAGKSSAAAKEGGKAKKKGKKSVETYKIYIFKVLKQVQPDIGISSKGMSIMNSFINDIFEKLAGEAAKLAKYNKKPHHVREIQTRRLVLPGSRKASP

SEQ ID NO: 195581 - protein, 78 aa, Triticum aestivum
  unsure (1)..(78): unsure at all Xaa locations
  Clone ID: PAT_TA_89999.pep
MSCCGGXCXCGSACKCGNGCGGCNMYPGGRAAGATLFVSATATHKASSGGMEMAAENGGCGCTQCKCGTSCGCSCCSC

SEQ ID NO: 195582 - protein, 155 aa, Triticum aestivum
  unsure (1)..(155): unsure at all Xaa locations
  Clone ID: PAT_TA_90000.pep
LPHPSFSTSGRCRGQPIVAARQQHPHHYLAPPAPLRRRTIHPPHYQQPPSTATTRVPDLTGVWSSVQLHSFSISLCCLSSLTSTATCCFASPSSTSADSPIFNLQFFYVLCPLLLSLSSSMAAISLSXIFAAAPVEPSTLLLLLLLLPKRXXLQL

SEQ ID NO: 195583 - protein, 142 aa, Triticum aestivum
  unsure (1)..(142): unsure at all Xaa locations
  Clone ID: PAT_TA_90001.pep
IXPERARXWLTGSTGVEEHRGSRSRRVHAGGXVEEGRRRHERRRERQGRRGQGLVPGRAAGRGGPPSISVKLALPKEKEPGLELADVSTLPDDEVVIGEDSDPKLRACVLRRTTVVWPACLRPACTYGEGERGGGGGGGGEG

SEQ ID NO: 195584 - protein, 126 aa, Triticum aestivum
  unsure (1)..(126): unsure at all Xaa locations
  Clone ID: PAT_TA_90002.pep
MGIDLVAGGRNKRTKRVAPKSDXVYLKLLVKLYRFLXVRRTKSKFNAVILKRLFMSKTNRPPLSMRRLSIRKGKRRXXNIAVVVXGTITDTFGFKXSNIKVTALKSTETXXARLXIWXEFLNFDNL

SEQ ID NO: 195585 - protein, 97 aa, Triticum aestivum
  unsure (1)..(97): unsure at all Xaa locations
  Clone ID: PAT_TA_90003.pep
KIILGAVEINLKFHLXTYKIFWTXYILXNWQIKYRXYPCISCNLSEGVLSISFXVSEGVLLICLKKVKPVFCQLHHFNPKLNKLTALTNTATETTNW

SEQ ID NO: 195586 - protein, 129 aa, Triticum aestivum
  unsure (1)..(129): unsure at all Xaa locations
  Clone ID: PAT_TA_90004.pep
MPSSTIRSISITVSDDDGAAAPRRTRAGRRKVVRSLGQRAVRLVARWWPILLLLPAVALLLFEASRLRASPSPAPPVSSNLGRLDPTTRLXVHGVREPFLXXLNPKSIENLXFKAPDLICGQEDYQNDI

SEQ ID NO: 195587 - protein, 91 aa, Triticum aestivum
  Clone ID: PAT_TA_90005.pep
IPSGPPSSARLPPSSSPSSGALPKKEYCPESKREFSAVEVDEEEAPPPPPPASARRPLMAGRGRAALLGFGFRGRARAWVLDLGELRGGEG

SEQ ID NO: 195588 - protein, 110 aa, Triticum aestivum
  unsure (1)..(110): unsure at all Xaa locations
  Clone ID: PAT_TA_90006.pep
MSRGGSAGGGQSSLGYLFGDGEPAKPAAAPAAKPAPAEKPAPAAADVAKQIPAGIPGSRANNYYRADGQEHGQLLTDRPSTKVNAAPGGGRPXGLLFGGNDVDACLMNER

SEQ ID NO: 195589 - protein, 111 aa, Triticum aestivum
  unsure (1)..(111): unsure at all Xaa locations
  Clone ID: PAT_TA_90007.pep
EAKQSNLCVSADVGTAKELLELAEKVGSEICMLKTHVXILSDFTPYFGTKLRSIAEKHNFLIFEXDRKFAXIGNTITIQYEGGIFXXLXRADIXXANXIXGPGIXNGXNLK

SEQ ID NO: 195590 - protein, 54 aa, Triticum aestivum
  Clone ID: PAT_TA_90008.pep
QLWWWLVGLVWRATPMTDALRGNPANKCSSGLLLQIIHVYGILYGIYSFCVQAS

SEQ ID NO: 195591 - protein, 95 aa, Triticum aestivum
  unsure (1)..(95): unsure at all Xaa locations
  Clone ID: PAT_TA_90009.pep
MKGTKLAAILILQAVLVMGVLSHVNADFFPKCCNNCRSFSGVDVCDDAHPKCPKGCXAFRVVSXRTPEMWRCXGYETTVDGTCGGPARTDRNAGI

SEQ ID NO: 195592 - protein, 73 aa, Triticum aestivum
  unsure (1)..(73): unsure at all Xaa locations
  Clone ID: PAT_TA_90010.pep
VLFWGRREYLGLVMVYATIVPKVELPAYMPPYLDAPTLTVNTASLSEFTEVPSREIATKFGRFXKYKCGQXEX

SEQ ID NO: 195593 - protein, 104 aa, Triticum aestivum
  unsure (1)..(104): unsure at all Xaa locations
  Clone ID: PAT_TA_90011.pep
MDSLPKRDAHHVPXSPVTFLPRAAAVYADRTSVVCGGTAFTXXQTQQRCVRLSAAXQALGVXXNDSSPCSRPTPRAIQMHFAVPXLGALXTPQPLETPPPFFAS

SEQ ID NO: 195594 - protein, 111 aa, Triticum aestivum
  unsure (1)..(111): unsure at all Xaa locations
  Clone ID: PAT_TA_90012.pep
PPAPPRRHAPATKLHPHPAPLFSLRLPCLSSPPPPXPPQPPPPFSPAPGFAAEEYLVSSCGLTHAQALKVSAKLSQLKSPAKPTPSSPSSPGSGSRRRRNGCKGPLLIWPG

SEQ ID NO: 195595 - protein, 122 aa, Triticum aestivum
  unsure (1)..(122): unsure at all Xaa locations
  Clone ID: PAT_TA_90013.pep
MARLNSKAVVAAVVLAAVVLMMAGREASAALSCGQVDSKLAPCVAYVTGRASSISKECCSGVXGLNGMARSNSDRKIXCKCLKXLANNIKSINMGKVSGVPRNSGSMVPXPINISTNCDTVN

SEQ ID NO: 195596 - protein, 106 aa, Triticum aestivum
  unsure (1)..(106): unsure at all Xaa locations
  Clone ID: PAT_TA_90014.pep
SDLRLHRXTQKSQQIKKITATTSTPRKHIVALAPRFLQNRKQQRKIARKRRRSKIPASIREKHRKRTEHLAGFLMAVRKFEKKNQESRDCKSLRRGGWIRSNWQIK

SEQ ID NO: 195597 - protein, 122 aa, Triticum aestivum
  unsure (1)..(122): unsure at all Xaa locations
  Clone ID: PAT_TA_90015.pep
KKFTKISLRGLIAQPNLCLPPSTSNTVAGVGDKHRTLNSRRSTIASLLCEPKKAPPQTAEHISMWSVXRGSTPCTLGPQIRCLHPTKLTKNTKICLPASPKPVPKQAISGKPSTTRXLASTX

SEQ ID NO: 195598 - protein, 149 aa, Triticum aestivum
  unsure (1)..(149): unsure at all Xaa locations
  Clone ID: PAT_TA_90016.pep
ERRSGEQRAWRARGTALRAACGARWGRPPTWRSWWAWTRWGWSTWSCRPPWRRAVTGTPACGSAQHVELVGGLLRELELAELMRREATSGPLEQSAARCGGSTPPSRRXKTANSADCFLGHTDGRTTPALRNTRTCSASSRLLVIRQTS

SEQ ID NO: 195599 - protein, 120 aa, Triticum aestivum
  unsure (1)..(120): unsure at all Xaa locations
  Clone ID: PAT_TA_90017.pep
MLDKLWDDVVAGPRPETGLDKLRRAAATQPLAINTAAGEAIKQSPSMPTTPTTPVTPFSXXPPRXXNFWRXXFNPGSNXAPKXLGQIFXRAANQXPXXLHWXYSEQTRTRSNTLSAQKGQ

SEQ ID NO: 195600 - protein, 115 aa, Triticum aestivum
  unsure (1)..(115): unsure at all Xaa locations
  Clone ID: PAT_TA_90018.pep
MLDKLWDDVVAGPRPETGLDKLRRAAATQPLAINTAAGEAIKQSPSMPTTPTTPXVTPSSSTPPRGGSVWRXRFSTPGKQPGPPKARRQLFDRPQPIPHVYDWFTARPQGATTLN

SEQ ID NO: 195601 - protein, 82 aa, Triticum aestivum
  unsure (1)..(82): unsure at all Xaa locations
  Clone ID: PAT_TA_90019.pep
XCAXWPGXWSSVELEGTMGCEGGGXRGEVKSVMADEMLRRSSTVVREAAMTAVAGGGTSYRSLAELVARCCDGSASNAPSEA

SEQ ID NO: 195602 - protein, 47 aa, Triticum aestivum
  Clone ID: PAT_TA_90020.pep
EGRSPAWASRRGRRRRGAPAWAPRAPSPPRRRRRSRRHPRRHPPPPR

SEQ ID NO: 195603 - protein, 145 aa, Triticum aestivum
  unsure (1)..(145): unsure at all Xaa locations
  Clone ID: PAT_TA_90021.pep
KRATKKVRCSFLPHLAFCILLFPPSLSASPLPPXENLPSIPTTRFPPESSPLNQPVDPISPCFFFNSIRPPSILLCSSSLTAAAAAVDLVAARVGXGAGTMAKPRSSPAAGSDAARVEVSGTGXTYKPAYRLXFXDNHGHXXGRX

SEQ ID NO: 195604 - protein, 142 aa, Triticum aestivum
  unsure (1)..(142): unsure at all Xaa locations
  Clone ID: PAT_TA_90022.pep
ATQARRPRAPASSRTPWSSPRETAASSPPPSRSSTPTPSSPSPLPSSTPILSPPPSSSTSACWPGRTTSTTXPGGKRRGDPGTRQEASPPLPSVPRQPSSPRGSPSRSPPXRRAPGNGVALAERALPPGRPRHGNAASSRLL

SEQ ID NO: 195605 - protein, 136 aa, Triticum aestivum
  unsure (1)..(136): unsure at all Xaa locations
  Clone ID: PAT_TA_90023.pep
MARLNSKAVAAAVVLAAVVLMMAGREASAALSCGQVDSKLAPCVAYVTGRASSISKECCSGVQGLNGLARSSPDRKIACKCLKSLATXSIKSINMGKVSXGVPGKCGVSVPSHQHVNNCNIQLQYIIPPKCIMDAR

SEQ ID NO: 195606 - protein, 95 aa, Triticum aestivum
  Clone ID: PAT_TA_90024.pep
DHDLGIRRIPQIQSPLPPDRRHRGSPPPPRRKGAVLAAARRLPPPPPQQLLRRPPTHQQSQPPSVAGSAANTAKAGGEAGKGRLQASPRCLGTES

SEQ ID NO: 195607 - protein, 89 aa, Triticum aestivum
  unsure (1)..(89): unsure at all Xaa locations
  Clone ID: PAT_TA_90025.pep
HIEPVAGEDSQWICYVAYPLDLFEEGSVTNMFTSIVGNVXGFKALRALRLEDLRIXPPTYSKTFQGPPHGXQVEKEISLKQVVVLNWGR

SEQ ID NO: 195608 - protein, 95 aa, Triticum aestivum
  unsure (1)..(95): unsure at all Xaa locations
  Clone ID: PAT_TA_90026.pep
VTAXNVXXAEXASXXKXTELXNPQVPFQRLCXIAQDFXTDLRXQSHAVLALXQEPAEAYXVGLFEDTNLCAIHAKRVTIMPKDIQLARRIRGERA

SEQ ID NO: 195609 - protein, 83 aa, Triticum aestivum
  unsure (1)..(83): unsure at all Xaa locations
  Clone ID: PAT_TA_90027.pep
GDLXXAPPDPGGLTCHLSVVILTWAVLVIRVPGFNRADEMSPXKVRGFEAHHQVKSRTGGAKQSXISSVPGPGSKTVTFSWKL

SEQ ID NO: 195610 - protein, 147 aa, Triticum aestivum
  unsure (1)..(147): unsure at all Xaa locations
  Clone ID: PAT_TA_90028.pep
MRECISIHIGQAGIQVGNACWELYCLEHGIQPDGQMPGDKTVGGGDDAFNTFFSETGXLGKHVPRAVFVDXEPTVIDXVRTGRLPPVFNLEQLIXGKEDAANXXARGHYTIGKELXLCLDVQGTXSNCTGLKGSWKAEVDWSGLGPS

SEQ ID NO: 195611 - protein, 133 aa, Triticum aestivum
  unsure (1)..(133): unsure at all Xaa locations
  Clone ID: PAT_TA_90029.pep
MQIFVKTLTGKTITLEVESSDTIDNVKAKIQDKEGIPPDQQRLIFAGKQLEDGRTLADYNIQKXPPFTWVLRLRGGXARSAKKKTYTKPRXKXKTRSELASLQVDDPPASKSRRMPQRGAGLHGNTRIRGRSL

SEQ ID NO: 195612 - protein, 145 aa, Triticum aestivum
  unsure (1)..(145): unsure at all Xaa locations
  Clone ID: PAT_TA_90030.pep
MARTKQTARKSTGGKAPRKQLATKAARKSAPTTGGVKKPHRYRPGTVALREIRKYQXKSTELLIRKLPFQXAWVREXAQGFKTDSRFQSHAVLXLQEAAEAYXVRLFXDTTVRIHPLTSSKNQLPAHPKRLSSLRHVDSPWNCPR

SEQ ID NO: 195613 - protein, 158 aa, Triticum aestivum
  unsure (1)..(158): unsure at all Xaa locations
  Clone ID: PAT_TA_90031.pep
RILLPRRLKMQIFVKTLTGKTITLEVESSDTIDNVKAKIQDKEGIPPDQQRLIFAGKQLEDGRTLADYNIQXKESTLHLVLRLPWEACRSSVKTLTGKDHHLEVESSDTIDNSKXKFQGQGGILRDKQRLIFAXGKQLEDGXPLLIQIQKXQPALSPP

SEQ ID NO: 195614 - protein, 125 aa, Triticum aestivum
  unsure (1)..(125): unsure at all Xaa locations
  Clone ID: PAT_TA_90032.pep
TXNPCGIGGGGLGAPSPHGMSRPWRWRSSPSLADGGRSGPGGPAVRDGEAAGDPAATNRPEQSAPRRSSNPAGRSQEEEAKKPGRRREGGAKRRGRWEEVVLGRPRRGGGGGRTTAERGGEGGSC

SEQ ID NO: 195615 - protein, 108 aa, Triticum aestivum
  unsure (1)..(108): unsure at all Xaa locations
  Clone ID: PAT_TA_90033.pep
MKGTKLAAILILQAVLVMGVLSHVNADYFPKCCNNCRSFSGVDVCDDAHPKCPKGCSACRVVSTXPEMWRCADMKSTVDGTCGGPARXLIGHPTKSPKMNKVRRMTSS

SEQ ID NO: 195616 - protein, 158 aa, Triticum aestivum
  unsure (1)..(158): unsure at all Xaa locations
  Clone ID: PAT_TA_90034.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVXXXLDLFXEGSVTNMFTSIVXNYXFKALRALRLEDLRIPLLQKLPRPASWYQLTEIE

SEQ ID NO: 195617 - protein, 110 aa, Triticum aestivum
  unsure (1)..(110): unsure at all Xaa locations
  Clone ID: PAT_TA_90035.pep
NERKIPNQSRRRSTLGSSNPPPRRLKMQIFVKTLTGKTITLEVESSDTIDNVKAKIQDKEGIPPDQQRLIFAGKQLEDGRTLXADYNIQEGXTLHLVLRLRGGMQFSSRR

SEQ ID NO: 195618 - protein, 49 aa, Triticum aestivum
  Clone ID: PAT_TA_90036.pep
SCQRYSGYPVKDETGTSVHNFKRVMEEFLEASRHVVSSDDNLRPIEKKR

SEQ ID NO: 195619 - protein, 112 aa, Triticum aestivum
  unsure (1)..(112): unsure at all Xaa locations
  Clone ID: PAT_TA_90037.pep
WLLCPLGLLPPLAHLGTSGSSSTRLGLGAASEESPRERXRPLPLSCSFHLQASVPRDWGTSNIANYYRXKGRRGKXFSLSFXKLQCXXGWAGXXLDSPXRXPVCQSINHPPF

SEQ ID NO: 195620 - protein, 166 aa, Triticum aestivum
  Clone ID: PAT_TA_90038.pep
SRPGAPGALWHQQARRPVVHRRLGQQQQERQQLRDAYAMPGSGAPGKRALENRKGIPNLGAGEEGQDGGSTGNPAAPGRAGRISRARTEHPPGMDRAGRKDFTSRERSRTWRIKRQAGGKDRGELRFRGAKSAAGGARIGSRGSGGTGLLLMVAVFGGWRCWFLEG

SEQ ID NO: 195621 - protein, 157 aa, Triticum aestivum
  unsure (1)..(157): unsure at all Xaa locations
  Clone ID: PAT_TA_90039.pep
AAGKTTILYKLKLGEIVTTIPTIGFNVETVEYKNISFTVWDVGGQDKIRPLWRHYFQXNTQGLIFVVDXSNDRDRVVEARDXLHRMLNEDXYVDAVLLXFANXKFPNAMNAAEITGXLGLHPFANDTXYIQXTFAXTGEGLFEAWTVSNNIATTLSS

SEQ ID NO: 195622 - protein, 166 aa, Triticum aestivum
  unsure (1)..(166): unsure at all Xaa locations
  Clone ID: PAT_TA_90040.pep
YQSRLSARRGARPAAXAARPXRXRGELEEAXEGSSVXTVSSLPISAXAFFFGRRGGRGRRRPAXQKRARXSARRSSSWLVGIEATVQGSLRRGRPCQHAMGDGAGGKIPEISTEARIWGERGVVVVGWGGVGWKRPAAAVFRAKIWGRSIYPLSGSRLMGEEEAEA

SEQ ID NO: 195623 - protein, 95 aa, Triticum aestivum
  unsure (1)..(95): unsure at all Xaa locations
  Clone ID: PAT_TA_90041.pep
NEQSPPAAPTLEYGASIQDPAVHIQFPIWATYGNLVLYLQLNGKTYRIPINLTXXTVWLCMHNCLMXXRDFXDKMTXLPXNXXQKSRHVKPXPXP

SEQ ID NO: 195624 - protein, 160 aa, Triticum aestivum
  unsure (1)..(160): unsure at all Xaa locations
  Clone ID: PAT_TA_90042.pep
SSTQFGPPGERPSXXESFPSXVRTASPTCRSRASGATSTVPLLALVAPGQGXQRRRTATETGXGGGVAGGWRARRIPAPHDDPRRGGRPRGRRXIGGPGAGAAAAGRGWRSGGRARTGRRRGMARRWGSERGRRRRRPSAAETEGDQARERPRRRNCGCE

SEQ ID NO: 195625 - protein, 160 aa, Triticum aestivum
  unsure (1)..(160): unsure at all Xaa locations
  Clone ID: PAT_TA_90043.pep
VMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXMWKLPMFXGCXDATQXINEVEEVKXGYXDPIPTVTSSCSHRLKQRLQG

SEQ ID NO: 195626 - protein, 147 aa, Triticum aestivum
  unsure (1)..(147): unsure at all Xaa locations
  Clone ID: PAT_TA_90044.pep
PPPPSPPXAPADQPEQEAPPPRXPAPPPPPSPPRPPPXSPPFPPPPPPPSXRPPPASEPRXGPPXAGRLLDLPRHPRAPQVVXGAAPXAPDSANPLRPXGPPAAPSVGSTSSASQVLRAGPLIRPGVGGGGNCQRKAPGGRKEPGGE

SEQ ID NO: 195627 - protein, 58 aa, Triticum aestivum
  unsure (1)..(58): unsure at all Xaa locations
  Clone ID: PAT_TA_90045.pep
ICXDXLFKNRPRIIVVSYLIPYPTVRRSRCQKPLTGSLXKMDPGVGSIKNYPNXSSXF

SEQ ID NO: 195628 - protein, 143 aa, Triticum aestivum
  unsure (1)..(143): unsure at all Xaa locations
  Clone ID: PAT_TA_90046.pep
YLSTTSLLMSWEVGTEPVYLWTLPMFHCNGWTFTWGMAARGGVNVCIRENRPAEVYRAIARYGVTHMCCAPVVFXISSKVGDAPRGREAVNFLTGGPXAGRPSGRXQXIGLTLXXPXGVXQGXXXPLASKWPLGKLAWTPPKP

SEQ ID NO: 195629 - protein, 160 aa, Triticum aestivum
  unsure (1)..(160): unsure at all Xaa locations
  Clone ID: PAT_TA_90047.pep
HNLVFRFLDRQDQINQKMMQATVALSAVLTVAVRGRXGRXXKSRHRGRRRQKDAGRCRSCIGRRGAGRRTTAPASRCSPWKACDLVXGEACDAQMYRRWRXNYYPTNNQKRFPDXAXHFRRXFCQGPYKQQLLIKNYYNYICKTLISXKASXXKLITKHL

SEQ ID NO: 195630 - protein, 91 aa, Triticum aestivum
  unsure (1)..(91): unsure at all Xaa locations
  Clone ID: PAT_TA_90048.pep
FSLIKSVENTXIXIRLLXXEILAXIPXEAQPAXERGEXGAWPGXRARRGLWIRWRREEFRHTPAVATGGGGGAGVLTRRDLACREGGAGGG

SEQ ID NO: 195631 - protein, 174 aa, Triticum aestivum
  unsure (1)..(174): unsure at all Xaa locations
  Clone ID: PAT_TA_90049.pep
RKRPPNAPPPNQQQQHKRSSKRARGSPLLTLSSHIHLRWDDRSRRALPADDQIGIPWRTSAPFRXSPAPRPPRPRPRPRRRRPRPQAGFSPWGDIPLLGGVLSYEVWERLPERXATGSSLPKFFXAVRSXEQCAFLKRGKITLLXPLXLXLXCXSTXSKAILKXXTIXXIQGXI

SEQ ID NO: 195632 - protein, 83 aa, Triticum aestivum
  unsure (1)..(83): unsure at all Xaa locations
  Clone ID: PAT_TA_90050.pep
XQPKDLERILETCWXQRRAQLXPPQQXXYGLXDPGVLSANSSCQDDQPVEATGFSHRIDWSLLGQAYETRDEDXQWCRGHCRL

SEQ ID NO: 195633 - protein, 111 aa, Triticum aestivum
  unsure (1)..(111): unsure at all Xaa locations
  Clone ID: PAT_TA_90051.pep
STWDPSLLSCQFLPSQPARGHKALPRQRSIRVDESIRFSTVCLAPGLPPPPLLPSVSRRHQRCLIGPLGPHNSLVYIRGMSRFIASESLEGKARXPLIGYQXLRFQPRVPG

SEQ ID NO: 195634 - protein, 129 aa, Triticum aestivum
  unsure (1)..(129): unsure at all Xaa locations
  Clone ID: PAT_TA_90052.pep
RIRCMQVWPIEGIKKFETLSYLPPLSTEALLKQVDYLIRSKWVPCLEFSKVGFIFREHNASPGYYDGRYWXTMWKLPMFGXAPTPHNVXKLEEVKKEYXPIPHIRIXNMRXCMRQFIAFXPPGSKIRQG

SEQ ID NO: 195635 - protein, 68 aa, Triticum aestivum
  unsure (1)..(68): unsure at all Xaa locations
  Clone ID: PAT_TA_90053.pep
FDPKIYNNAKQTSRQIILLLGQXGEKFIQQTLFXKIXNLNAFFLXXPFFQNXDHQYKXITXXILKKIT

SEQ ID NO: 195636 - protein, 156 aa, Triticum aestivum
  unsure (1)..(156): unsure at all Xaa locations
  Clone ID: PAT_TA_90054.pep
HGSVKWKPRSRHDDASSFGSHPPASPCAHARLVVAGRPGPAPPNGRHPCVPALEEPGQSFLARASEAGCDAAHLEGGGAPKGQAAGRRGSRRRPAGRLRHIHRDFPAQGVSGVLDITPAIWAQCAPCDACRTPSFRPPSNVLSKFLRKPTXXLLXT

SEQ ID NO: 195637 - protein, 140 aa, Triticum aestivum
  unsure (1)..(140): unsure at all Xaa locations
  Clone ID: PAT_TA_90055.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESXNTKDDLNXTDDVLLGKLXWADGTDPSYSQW

SEQ ID NO: 195638 - protein, 75 aa, Triticum aestivum
  unsure (1)..(75): unsure at all Xaa locations
  Clone ID: PAT_TA_90056.pep
HKCXQCWDNVITSIQVGFRSERDAVGKXSTLLRGDXPCASACLMVSFDYRSSKSLHXWASFTKAKAARCTLLHEN

SEQ ID NO: 195639 - protein, 152 aa, Triticum aestivum
  unsure (1)..(152): unsure at all Xaa locations
  Clone ID: PAT_TA_90057.pep
QYQREPHISLLCSIRHWRPPPPWRSPPPSSPEPTPXRGGGRITMRKAAPKASASNSPWYXPERVLYLXPLSGEPPRYLSXEFPGXYWWDTXGLSVXPXTFAXXRELHVXHCRWAMLXXLXCVXPKLLARXGVXXGXESGXKXGSKXFXEXXS

SEQ ID NO: 195640 - protein, 85 aa, Triticum aestivum
  unsure (1)..(85): unsure at all Xaa locations
  Clone ID: PAT_TA_90058.pep
GPSFLRVTPGRXLPRLSMAGRRERQTLCRGGGAARGDGSSWMGLPWRPXSGAVPEDWLARARAAAVAVEGRGLARGGGVRLGGGA

SEQ ID NO: 195641 - protein, 99 aa, Triticum aestivum
  unsure (1)..(99): unsure at all Xaa locations
  Clone ID: PAT_TA_90059.pep
MKGTKLAAILILQAVLVMGLLSHVNADXFPKCCNNCRSFSGVDVCDDAHPKCPQGCSACRVVSTSPEMWRCADXKSNVDGNCVDLQEYCWLMPDICSNK

SEQ ID NO: 195642 - protein, 128 aa, Triticum aestivum
  unsure (1)..(128): unsure at all Xaa locations
  Clone ID: PAT_TA_90060.pep
FFFFTSTDLFRDLKLNLVXSIRLQLETSSTIVPRGWSHGEAADVTEDGRVDIGERGAGEHRAVAPGAGRLQRAAAGVAAAHAEEGPDDVVRAALRHHPRRCLRAAAAANGGRRLRDLCRGGGRRRGRC

SEQ ID NO: 195643 - protein, 137 aa, Triticum aestivum
  unsure (1)..(137): unsure at all Xaa locations
  Clone ID: PAT_TA_90061.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFXEGSVTNMFTSXVGNVLVQSLRALRLEDH

SEQ ID NO: 195644 - protein, 136 aa, Triticum aestivum
  unsure (1)..(136): unsure at all Xaa locations
  Clone ID: PAT_TA_90062.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDNIDNVXAKIKTRXASSGQQGLIFAXKQLXDGATXVIIKK

SEQ ID NO: 195645 - protein, 59 aa, Triticum aestivum
  unsure (1)..(59): unsure at all Xaa locations
  Clone ID: PAT_TA_90063.pep
GRGERQPRPHPLHLRAAPAGPRLHAGPPRXXPHARLRLAXPGRAQCLLPHLXXXEXGRT

SEQ ID NO: 195646 - protein, 130 aa, Triticum aestivum
  unsure (1)..(130): unsure at all Xaa locations
  Clone ID: PAT_TA_90064.pep
AAAAAKQPAPSTHHRPAKIKTILAXETIDIPEEVTXKXSAKMISVTGPRGTLTRNFKHLNLXFQLXEGGRRLKVDAWXGTRKTMAAIRTAISHVQXLITGVTKGFRXKMRFVXAHFPXNASXTPPTAASY

SEQ ID NO: 195647 - protein, 137 aa, Triticum aestivum
  unsure (1)..(137): unsure at all Xaa locations
  Clone ID: PAT_TA_90065.pep
ATISVGATKTLFILVATFLLDRVGRRPLLLTSAGGMLVSLVTLASTLHVIAQRASPADGATALSGVSIASVLTFVASFSIGMGPIAWVYSSEIFPLRLRAXGCALGTAXNRXMSGAINMSFHSLSTRRSRELQLYAT

SEQ ID NO: 195648 - protein, 121 aa, Triticum aestivum
  unsure (1)..(121): unsure at all Xaa locations
  Clone ID: PAT_TA_90066.pep
MSMATATATAWPSTSSSVLAPRRHHATRPRALRSGFLXRALTLAXPTDRPSPVSVSVRAAWEXPLSXARLIMHGRXVKLTEKLKEHIEDXVGXTVHNHSQLVRXVDXRXXARGGXSQXPKX

SEQ ID NO: 195649 - protein, 153 aa, Triticum aestivum
  unsure (1)..(153): unsure at all Xaa locations
  Clone ID: PAT_TA_90067.pep
MAEQTFIMIKPDGVQRGLIGEVISRFEKKGFYLKGLKLQNVEKXSFAEQHYAHLSSKPSSAWLVEYIVSRPVRRYVWEGQERPLQLDAKIIGATQPPGPXPXTSVGDFAFNFGXXVLQXXDQFXMXEGIAXWXLXDFQWRRTKLYKKIVIFQN

SEQ ID NO: 195650 - protein, 84 aa, Triticum aestivum
  unsure (1)..(84): unsure at all Xaa locations
  Clone ID: PAT_TA_90068.pep
THPNRRKAKFSQINETTSTPNLGERIACTSLGHRLRERIVCSXAVCKDLHAKSLKFPSLGKGXVQQPPEMIPCTLILGTCQLYP

SEQ ID NO: 195651 - protein, 140 aa, Triticum aestivum
  unsure (1)..(140): unsure at all Xaa locations
  Clone ID: PAT_TA_90069.pep
QLTGPFASGRPKYILSQLFSIQLVRRILRLYFKPLVIAYAQSSSASSSRCLHDPKYGNGRRSPGPAVTSKGESARSSQDARSXTTLPAALNRKSSVAPCWAXLXHFFQXASAAGQLLRLRXKCPRTRXQGSFGAGXXRAP

SEQ ID NO: 195652 - protein, 86 aa, Triticum aestivum
  unsure (1)..(86): unsure at all Xaa locations
  Clone ID: PAT_TA_90070.pep
PVGDGALLLRPGRPTTAADSCRSSLPFVLTAAPFPLFPTEENSSNLVLCVPIELQDYHTCTLHCSMEDLXEELLXSFSKGXPRQVI

SEQ ID NO: 195653 - protein, 62 aa, Triticum aestivum
  unsure (1)..(62): unsure at all Xaa locations
  Clone ID: PAT_TA_90071.pep
RRSPAPSLSPPPPXWPSPPTPRPWPRPPAPPXPAPPPPPSRPSAPCSGQRALLLLPAISPAD

SEQ ID NO: 195654 - protein, 89 aa, Triticum aestivum
  unsure (1)..(89): unsure at all Xaa locations
  Clone ID: PAT_TA_90072.pep
IPATLFYXSLRRLKHLLKFHXYSLXFKLDAAXGKLPNYVVIXQRYFTAKEXPAKDXQPSQEVAXGQRLXKEVYXXLRAXPXWXETSSSL

SEQ ID NO: 195655 - protein, 139 aa, Triticum aestivum
  unsure (1)..(139): unsure at all Xaa locations
  Clone ID: PAT_TA_90073.pep
MAPTVMASSATSVAPFQGLKSTAGLPVSRRSNGASLGSVSNGGRIRCMQVWPIRGHQEFETLSYLPPLNTEXLLKQVDYLIRSKWVXCLQFNKVGFXFPXXKAXPGYYNGXVLAMLXLPKFGXLTHKVXNEVEXVKKDT

SEQ ID NO: 195656 - protein, 140 aa, Triticum aestivum
  unsure (1)..(140): unsure at all Xaa locations
  Clone ID: PAT_TA_90074.pep
QIFVKTLTGKTITLEVESSDTIDNVKAKIQDKEGIPPDQQRLIFAGKQLEDGRTLADYNIQKESTLHSVLRLRRGHHPXSLXGLARKXNQEKMILPKCYAKLHPKDVNCRKXXXGKTTNFRPRRSLRTKLKLSPFRGNQT

SEQ ID NO: 195657 - protein, 140 aa, Triticum aestivum
  unsure (1)..(140): unsure at all Xaa locations
  Clone ID: PAT_TA_90075.pep
DLLFPPTFSGSGAGEPTADRAIPPIRRGEPGGRDSPGRRGDWGLTFTKLFSRLFAKKEMRILMVGLDAAGKTTILYKLKLGEXVTNIPNIGFNVXTXEYXNINFTVWNXGVKXXXKAXXGIIKKSTFWDVCLSKDSDLMR

SEQ ID NO: 195658 - protein, 99 aa, Triticum aestivum
  unsure (1)..(99): unsure at all Xaa locations
  Clone ID: PAT_TA_90076.pep
MKGTKLAAILILQAVLVMGVLSHVNADYFPKCCNNCRPLXGVDVCDDAHPKCPKGLXPLPRCVXXSPXMLRFAXDLNPTFNGPXGXPGKISSHIFPKRI

SEQ ID NO: 195659 - protein, 85 aa, Triticum aestivum
  Clone ID: PAT_TA_90077.pep
LRQPTLWKLHIRPISTSSSCGERIHRGERPNACSRWQGDEPRRNAICLPRKNDDVPLPHLSPPPPAAPSLALPGRRRRPAPRRIC

SEQ ID NO: 195660 - protein, 88 aa, Triticum aestivum
  Clone ID: PAT_TA_90078.pep
WHCLGFCPSTKQHKIAHFYPGAHAGSLEVLCEIYTIGDRIWRQIGSLRGAPIDRGIHVNGSVYYLTRFRYISSSRINCLNLQSEKLTS

SEQ ID NO: 195661 - protein, 160 aa, Triticum aestivum
  unsure (1)..(160): unsure at all Xaa locations
  Clone ID: PAT_TA_90079.pep
GDACLELIPLSLPNPQSPLSPSAPIDPVGRGATLVRRVVGAVDQEASVCPSATSECLSRVPQSRGGRRGGGWQQPGRRRHQLRSACGSCSGKSTVVSLIERSMSRLGSVLLDMHDIKGPRRQVAARAVRVVNKETGCSQQHPGEISTERASYTDELTPXK

SEQ ID NO: 195662 - protein, 67 aa, Triticum aestivum
  unsure (1)..(67): unsure at all Xaa locations
  Clone ID: PAT_TA_90080.pep
SMVTAXXTXVXXADXDRSSPPNRGLFCSSRRPSLSQPRVLGWELWGFACKRFVCVCVCEKWIWAEQA

SEQ ID NO: 195663 - protein, 133 aa, Triticum aestivum
  unsure (1)..(133): unsure at all Xaa locations
  Clone ID: PAT_TA_90081.pep
EHPWGIRLRPPRQHHLFHKPPGPPYQHSTGIFKEQIHGGVQSVPYVVGLFNAMLWVFYALVKTGEGSSSTSNAAGASSKTSTSSCTRLXPTKAKFHSKXSSXSXRQLGXLSXLXASREXALSSLIXRFXFGSP

SEQ ID NO: 195664 - protein, 86 aa, Triticum aestivum
  Clone ID: PAT_TA_90082.pep
KNLTALKKLRLEMCKGMGTLPGWLGQLTSLEEILISICPNLTCLPESIRSLSALKLLRIVECPGLIASCQGEDAGKICHIPTVEYS

SEQ ID NO: 195665 - protein, 161 aa, Triticum aestivum
  unsure (1)..(161): unsure at all Xaa locations
  Clone ID: PAT_TA_90083.pep
LAAAATSRSNLTPPPPPDPITAQSNQTRSPRAFPPLPAPDPTDRPTAPRDRRESMGSGGRTDLTXXAPWAPLDHLRDSAPAVHRLATXRRSHGRDQQTASPRRLRXDXGIXXPAPPNSPAHSFNGSTXRTXRXXGSSRWRXDNNWRDLAXRRYXSAGRHIS

SEQ ID NO: 195666 - protein, 105 aa, Triticum aestivum
  unsure (1)..(105): unsure at all Xaa locations
  Clone ID: PAT_TA_90084.pep
MXXTMXSMTGLSQGVRLPGPAGRRASRFTVRASSAEAEAAGRRAVLGLMAXXIVGSAFXQVVHPGTVAVIKVGXPPXLSGGLXGXXNXARQXFDXPLXXRFXLQP

SEQ ID NO: 195667 - protein, 178 aa, Triticum aestivum
  unsure (1)..(178): unsure at all Xaa locations
  Clone ID: PAT_TA_90085.pep
YKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPXXRLGNGYAPXLDCHTSHIAVXFAELVTKIDXRSGKDWRPAKXSKNXDPGXVKIIPTNHGVETLLPLWAFAYRKCGGHKQR

SEQ ID NO: 195668 - protein, 142 aa, Triticum aestivum
  unsure (1)..(142): unsure at all Xaa locations
  Clone ID: PAT_TA_90086.pep
SDSSVCDSCRFCNAALLSHPRNVDSSSGPAAPSPGRSNHANDAGNAPDLCVCMLYAKKELSKRFVRSKFYRSGTRVWPPWWFAXSSXXXPGMQSPETLPEAIHSASGRCVRILRAFFPRPGRESRLMGAWVADGLIAAWFDE

SEQ ID NO: 195669 - protein, 67 aa, Triticum aestivum
  unsure (1)..(67): unsure at all Xaa locations
  Clone ID: PAT_TA_90087.pep
LEPYRRHSPRSQXSXSPSFAYCLGGLWSARGWXEEXPTPLVAPVRGTYTGSWSXQWTCMHCSTACHE

SEQ ID NO: 195670 - protein, 126 aa, Triticum aestivum
  unsure (1)..(126): unsure at all Xaa locations
  Clone ID: PAT_TA_90088.pep
MAPGRLRWSAAALVLLFLAAGAAAEAARREVVTSPRGAVAADDERCSKIGRDALRCGGTAVDAAXATSLCLGVVSPASSGIGGGAFMLVRSPDGTAVVTIPKRAAGGTKECAMTPESKGRLSRVKL

SEQ ID NO: 195671 - protein, 100 aa, Triticum aestivum
  unsure (1)..(100): unsure at all Xaa locations
  Clone ID: PAT_TA_90089.pep
MKGTKLAAILILQAVLVMGLLSHVNADFFPKCCNNCRSFSGVXDVCDDAHPKCPQGLLRRAAWVSNXPEMWRCAGYETTVRRTCXGPARXLRSCPHDISA

SEQ ID NO: 195672 - protein, 169 aa, Triticum aestivum
  unsure (1)..(169): unsure at all Xaa locations
  Clone ID: PAT_TA_90090.pep
FDLQVEESTLGTSTGRAVVQRVSVPLPHYYGLRCRGERGRCDPARRERRRAHPKDHSGGGDGTPEQAGVRAPRAPPVHHRRRAARLPQDAEVEPAAHGSWARRYAEAHDLGQRLPDLERRPQFFRGTRHADSSXESISDRSHSPLPLVIYPPSLPLXWLSPRQAGNXGT

SEQ ID NO: 195673 - protein, 138 aa, Triticum aestivum
  Clone ID: PAT_TA_90091.pep
RPACPVLHWTSLSQILYINGQIHHCYPISHLKCVSKSIWQLSLQKHKVKKMQELLPVLSGKAISNSFMYTMVFTHLWKSILKSQSWLGYGYLCCFHGSSLSGRCSPLVLWPPRDYCDMIPHSDQVPPDLYCRREPANR

SEQ ID NO: 195674 - protein, 102 aa, Triticum aestivum
  unsure (1)..(102): unsure at all Xaa locations
  Clone ID: PAT_TA_90092.pep
RLFFCKKHPASTEPLVAXVDTTQARQGMRXGGRERRXSPRMGRXAXTXVVQRGVXSXXAGVEXAVDRXSRRXTRQLXLASSLGGRXLXTGGTWREPXKSGTE

SEQ ID NO: 195675 - protein, 79 aa, Triticum aestivum
  unsure (1)..(79): unsure at all Xaa locations
  Clone ID: PAT_TA_90093.pep
MSCCGGSCGCGSACKCGNGCGGCNMYPEVEAAGATLLVSATATHKASSGGMEMAAENGGCGCTQCKCGTXSCGCSCCSC

SEQ ID NO: 195676 - protein, 155 aa, Triticum aestivum
  unsure (1)..(155): unsure at all Xaa locations
  Clone ID: PAT_TA_90094.pep
VASLPRPPLRARSCSPPPLRAGNSNSSGFSGGPASAGGRDSSRLDVSPYAPPNYPLNPRRQQQLAPYRLKCDREPLNNKLGPPDFYPQTPNCPEETLTKEYVQSGYKETVEGIXEAREXVLSHISYFCKPDIVXKCKEALKKWXKANNESRAQKX

SEQ ID NO: 195677 - protein, 155 aa, Triticum aestivum
  unsure (1)..(155): unsure at all Xaa locations
  Clone ID: PAT_TA_90095.pep
AFHHLEDVLDDLVVSLCKFTTLLNTSLVEEPVTAFGDDLKARLATETLFTIANKYGHYIRTGWRNVLDCILRLHKLGLLPARVASDAADDSEVSAETVQGKPVPSSISTSHIPVMGTLGKSSGLKGRLINYSPLDXXEQRXQPTEQQLAATKGPS

SEQ ID NO: 195678 - protein, 117 aa, Triticum aestivum
  unsure (1)..(117): unsure at all Xaa locations
  Clone ID: PAT_TA_90096.pep
LWAGPACTVRCDFLQPSDPALIPTRSCLLPSYVFLTRPTSPLHLRSSKTAYAVSISQQPNDAISASAIVGYSSHRQPALTLGRPRSPSPVAPPEDEEDIATLRWSXQQGXPLVXKFW

SEQ ID NO: 195679 - protein, 69 aa, Triticum aestivum
  Clone ID: PAT_TA_90097.pep
DKIRPIPNGSNEHTCHLIASALSCSVGRKAMASPSMARVSSSSMKHLVANLTMCLAPVALMWSACTCAT

SEQ ID NO: 195680 - protein, 81 aa, Triticum aestivum
  Clone ID: PAT_TA_90098.pep
PLATAAGVRDSATTSSSATAGAGRASASGTVVVEADAWSGAGSAAAALVLIGGSAGRASPAGVEVISGAVNCGRWLGAGEE

SEQ ID NO: 195681 - protein, 65 aa, Triticum aestivum
  unsure (1)..(65): unsure at all Xaa locations
  Clone ID: PAT_TA_90099.pep
XLRRLPDLMLPPXAPRIDSVSRRVFFXFLSTFHXPLFSNYFSFXNYYPXDSVQKIEYSXXTQKCS

SEQ ID NO: 195682 - protein, 111 aa, Triticum aestivum
  unsure (1)..(111): unsure at all Xaa locations
  Clone ID: PAT_TA_90100.pep
FSYSMTGELGDDFESMEGYEEESQFVADRERGREDVEDQEGMLPVPNVQLGFNFMRDRRKYRYDVFAARVNLQCLSLYQKRRLSATEAXDCWTIALSLGLGHAGIAEXLLR

SEQ ID NO: 195683 - protein, 55 aa, Triticum aestivum
  unsure (1)..(55): unsure at all Xaa locations
  Clone ID: PAT_TA_90101.pep
MFRXFIHIHTVVLCLYAYGLPTLDHICVHVRMELAIASFIGKTTLSDVNDNLLLY

SEQ ID NO: 195684 - protein, 67 aa, Triticum aestivum
  unsure (1)..(67): unsure at all Xaa locations
  Clone ID: PAT_TA_90102.pep
MKSSTLVVILVLQAVLXMGILSQANARVPKXCCDTSXFFSGAVXVCXNAGPICXKGGLXCXFFXXGP

SEQ ID NO: 195685 - protein, 83 aa, Triticum aestivum
  Clone ID: PAT_TA_90103.pep
KNKRVLMESIQKSKAEKAREKTLSDQFEAKRAKSKASRERKHARREERLAQGPRDHAPAPAAAAPAPAPAAAAPKKARPRSEV

SEQ ID NO: 195686 - protein, 107 aa, Triticum aestivum
  unsure (1)..(107): unsure at all Xaa locations
  Clone ID: PAT_TA_90104.pep
RGVSSFFFFFFFFFFFFFFFFKEKHGHIHHAMLSIALISMLKQRTLGMIRSPAISSQRSIILTRDPSIAYPWSIIGYETISGFGHSRPWNKIFPSASLILPSLQSXP

SEQ ID NO: 195687 - protein, 41 aa, Triticum aestivum
  unsure (1)..(41): unsure at all Xaa locations
  Clone ID: PAT_TA_90105.pep
GKKDXDHKEKKDKKKKKDXKHCEGXXDYXGHXSSXSXSYSD

SEQ ID NO: 195688 - protein, 87 aa, Triticum aestivum
  unsure (1)..(87): unsure at all Xaa locations
  Clone ID: PAT_TA_90106.pep
PPAFQKTKLMTRLTYTLDEMEGPLEVGADGTLXFEXKDXIXYXAXXVXLPGXEXVXFLXTXKXLVXXGXPXXLXGXXLVQKRGXSFS

SEQ ID NO: 195689 - protein, 51 aa, Triticum aestivum
  unsure (1)..(51): unsure at all Xaa locations
  Clone ID: PAT_TA_90107.pep
PRSSLEFXFXFFRXVSXVFRXIXNCPHKCXLQXNQXNYXXGXVISXXRCLT

SEQ ID NO: 195690 - protein, 50 aa, Triticum aestivum
  unsure (1)..(50): unsure at all Xaa locations
  Clone ID: PAT_TA_90108.pep
XCWXGNVMVXRXVHFYXXKXQIMVLXGXCQXNXLXXVLFLKVNDXLDNSN

SEQ ID NO: 195691 - protein, 129 aa, Triticum aestivum
  unsure (1)..(129): unsure at all Xaa locations
  Clone ID: PAT_TA_90109.pep
MKGTKLAAILILQAVLVMGLLSHVNADFFPKCCNNCRSFSGVDVCDDAHPKCPQGCSACRVVXTSPENVALPDMNPPSXDCGGPCXXYDRLCRDISAINKAECVAKLFLAYHCLFSPKLGCCGPVTKGP

SEQ ID NO: 195692 - protein, 61 aa, Triticum aestivum
  unsure (1)..(61): unsure at all Xaa locations
  Clone ID: PAT_TA_90110.pep
CRXXLLVXVYSSFRVSSXXHISHXTXAXLSLXLSTTHXSISXMXYPPFXVIXIVXIVHIFT

SEQ ID NO: 195693 - protein, 94 aa, Triticum aestivum
  unsure (1)..(94): unsure at all Xaa locations
  Clone ID: PAT_TA_90111.pep
MKGTKLAAILILQAVLVMGLLSHVNADFFPKCCNNCRSFSGVDVCDDAHPKCPQGCSACRVVSTXPEMWRCADMKPRQGTAVDLQYDRLCRMPK

SEQ ID NO: 195694 - protein, 59 aa, Triticum aestivum
  unsure (1)..(59): unsure at all Xaa locations
  Clone ID: PAT_TA_90112.pep
MVKAVAVLTGSEGVKGTIFFTQEGDGPTTVXTGXVTGTQXKAQXFNVXXLXDTTXXCMS

SEQ ID NO: 195695 - protein, 52 aa, Triticum aestivum
  Clone ID: PAT_TA_90113.pep
MLRHKFFLASQGLQFFVGESMHDDGGVVFAYYKEGLLTNFLYFAHGLKEVKC

SEQ ID NO: 195696 - protein, 81 aa, Triticum aestivum
  unsure (1)..(81): unsure at all Xaa locations
  Clone ID: PAT_TA_90114.pep
RGLEFFFFFFFFFFFFFFFFFFFFFFFFFFXLXFKXFNPCKYQTQFKNILGVKPQKFKFLQGPEGKKWRPSKRLPICPTCK

SEQ ID NO: 195697 - protein, 126 aa, Triticum aestivum
  unsure (1)..(126): unsure at all Xaa locations
  Clone ID: PAT_TA_90115.pep
HYHXXTDQEPLCSTSXTAXGRFTPGSVWRAESHNQTXILGTWQQPSGGHCIRDFQNRTGXPLRAASSQRRFXSHGNAXPHLWSMNKEKRLGNHPRRAPXTYRGQAPHQGVGARVTMPSHERASVSA

SEQ ID NO: 195698 - protein, 123 aa, Triticum aestivum
  unsure (1)..(123): unsure at all Xaa locations
  Clone ID: PAT_TA_90116.pep
SWTILLPXVXQIHLSXSKSNTQRQRRVIASKLVHXKSQPCQXFSKLYTELLVLLLXSNLPFNSFKHTPSPLVEGNPTCHYLPAYACSSLHLISQFDLMCHKSQLRAEEGKNSLGMPPLWTPKP

SEQ ID NO: 195699 - protein, 61 aa, Triticum aestivum
  unsure (1)..(61): unsure at all Xaa locations
  Clone ID: PAT_TA_90117.pep
RGEDEKXDTEXGKVXEIDEEKEEKEKXQKXIKEVSHEWNLINXQKPIWMRKPXEITXEEYA

SEQ ID NO: 195700 - protein, 180 aa, Triticum aestivum
  unsure (1)..(180): unsure at all Xaa locations
  Clone ID: PAT_TA_90118.pep
GPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYQTSHQGNDTIKLDLETTRLLTXQFTWXVVMVTXGRKLAVGKTGEHRNLRHHVRCKASHRLGSLH

SEQ ID NO: 195701 - protein, 101 aa, Triticum aestivum
  unsure (1)..(101): unsure at all Xaa locations
  Clone ID: PAT_TA_90119.pep
MVAHRFHQYQVVGRALPTPGDEXPKIYRMKLWATNEVRAKSKFWYFLRXXKKVKKANGQMLAINEIFXKXPTTIKNYGIWXRYKAGXYKTFQEYRXXTLXX

SEQ ID NO: 195702 - protein, 94 aa, Triticum aestivum
  unsure (1)..(94): unsure at all Xaa locations
  Clone ID: PAT_TA_90120.pep
YKGDTKCGVRINKSFEGQRNRNDRLHINLFNKLHRSQVQVARPSPRPSSHSVASLHARFSCLSVCXLYAXGDGALGTRXDLVEXVLVXWXXLXP

SEQ ID NO: 195703 - protein, 46 aa, Triticum aestivum
  unsure (1)..(46): unsure at all Xaa locations
  Clone ID: PAT_TA_90121.pep
HLHILGVTTRIVTSHVLARQRNHKYCIKYITSHESVESFRXLLLTS

SEQ ID NO: 195704 - protein, 55 aa, Triticum aestivum
  unsure (1)..(55): unsure at all Xaa locations
  Clone ID: PAT_TA_90122.pep
QGCXCLXVWFTCXLSAYALPLVSLCVCVCTCPCNCFIYLHYGWSXEYXRXNXLPN

SEQ ID NO: 195705 - protein, 54 aa, Triticum aestivum
  unsure (1)..(54): unsure at all Xaa locations
  Clone ID: PAT_TA_90123.pep
EVXSRVFFFFFFXYXTMLYNDYXXEMXVCXLHIDVIDTSXYQILTLKXXTCXHP

SEQ ID NO: 195706 - protein, 52 aa, Triticum aestivum
  Clone ID: PAT_TA_90124.pep
QLHLFISLQLKAPVRAILPDTSSLNHYSFRTSSKGSTNSNTNVIFLNTYLGV

SEQ ID NO: 195707 - protein, 61 aa, Triticum aestivum
  unsure (1)..(61): unsure at all Xaa locations
  Clone ID: PAT_TA_90125.pep
GCCLVNMMQALFGYSVIYSKMQNRCVLYICQQCTTLWSXYCTTSQKKKKKKKKKNSRLHLG

SEQ ID NO: 195708 - protein, 41 aa, Triticum aestivum
  unsure (1)..(41): unsure at all Xaa locations
  Clone ID: PAT_TA_90126.pep
ILQPVNRNPNFPPFQPQXEKKWEILXXLTXXRFKXEPIQEN

SEQ ID NO: 195709 - protein, 137 aa, Triticum aestivum
  unsure (1)..(137): unsure at all Xaa locations
  Clone ID: PAT_TA_90127.pep
IIXELPQARPYLSPSLFVRSAFSPTAVFFTIDCGQXGESVLEEIXQGHLASVVTAVXQIWLDTCXVGTXXMXEGEREIMVXXDRTXRSKSIXVDXLTAXLXKMFGPDVSGRXIAXNRKGPLGYKPSIDKESFTQAQC

SEQ ID NO: 195710 - protein, 34 aa, Triticum aestivum
  unsure (1)..(34): unsure at all Xaa locations
  Clone ID: PAT_TA_90128.pep
YSGXSSXSLFTATKXXXLCLHPIXNANIPKLNXS

SEQ ID NO: 195711 - protein, 82 aa, Triticum aestivum
  unsure (1)..(82): unsure at all Xaa locations
  Clone ID: PAT_TA_90129.pep
ERGLGELSLEVDXLDILLDLXTLLGVLCSGLPTGSGRRRFMSSRSSLLCWXTLQSIWCCHVLFVALRGTKAPRAALNRSSSM

SEQ ID NO: 195712 - protein, 170 aa, Triticum aestivum
  unsure (1)..(170): unsure at all Xaa locations
  Clone ID: PAT_TA_90130.pep
MSDTDEHHFESKADSGASKTYPQHAGAIRKGGHIVIKARPCKVVEVSTSKTGKHGHAKCHFVAIDIFNGKKLEDIVPSSHNCDVPHVDRQDYQLIDITDDGYVSLLTXESGNTKDDLKLPTDDVLLGQIKTGLXDGKDLIXSVMSAXGEXQICAVXEVVEINCSWLLTAI

SEQ ID NO: 195713 - protein, 32 aa, Triticum aestivum
  unsure (1)..(32): unsure at all Xaa locations
  Clone ID: PAT_TA_90131.pep
RELVSSFFFFFFFFFFFFFFFFLXWTTKFVLG

SEQ ID NO: 195714 - protein, 149 aa, Triticum aestivum
  unsure (1)..(149): unsure at all Xaa locations
  Clone ID: PAT_TA_90132.pep
MAAAFSSTVGAPAXTPTNFLGKKLKKQVTSAVNYHGKSSXANRFTVMAAENLDEKRNTDKWKGLAYXISDDQXDITRXKGIVDSLFQAPTGXGTHEAVLSSYDYVSXGLKKYDFDXTWELHIAPAFMDKLLSTLNSPANISIWYWERSI

SEQ ID NO: 195715 - protein, 62 aa, Triticum aestivum
  unsure (1)..(62): unsure at all Xaa locations
  Clone ID: PAT_TA_90133.pep
PDVFKKNVESATKYLXXKLKDLQFFVGESMHDDGGVVFAYYKEGXADPTFLYFAHGLKEVKC

SEQ ID NO: 195716 - protein, 91 aa, Triticum aestivum
  unsure (1)..(91): unsure at all Xaa locations
  Clone ID: PAT_TA_90134.pep
ALAXXQXISXXMRRYIKNPXLPSLXXIDXDVFKXNXEXCHXXYLLASXKDLQFFVGEXMHDDGGVVFXYYKEGAADPTFLYFAHGLKEVKC

SEQ ID NO: 195717 - protein, 98 aa, Triticum aestivum
  unsure (1)..(98): unsure at all Xaa locations
  Clone ID: PAT_TA_90135.pep
MRGTKLAAILILQAVLVMGVLSHVNADFFPKCCNNCRSFSGVDVCDDAHPKCPKGCSACRVVSXXPXXWRCXDMKSTVXXTLRVDPPRSTDRMLADFR

SEQ ID NO: 195718 - protein, 68 aa, Triticum aestivum
  unsure (1)..(68): unsure at all Xaa locations
  Clone ID: PAT_TA_90136.pep
EVKLVRRMWDLYTXTGDHVWLPRFWQEAFEAAYEELAGDDTPASDAAVSEIARMAIHRPELEQAGNNN

SEQ ID NO: 195719 - protein, 58 aa, Triticum aestivum
  unsure (1)..(58): unsure at all Xaa locations
  Clone ID: PAT_TA_90137.pep
HTXFLSFIQNIMWVSRMVDIQSIICVNPSVCWCLCNVLDMMWNNGVXXVWEKKKKTRD

SEQ ID NO: 195720 - protein, 101 aa, Triticum aestivum
  unsure (1)..(101): unsure at all Xaa locations
  Clone ID: PAT_TA_90138.pep
KVPQLLLPPSSGELLLPGSLSXMRRYIRNXXCXXXEGDDXDVXKKNVXSXTKYXLSKLKDLQFFXGESMHDDGGVVFAYYKEGAADPTFLYFAHGLKEVKC

SEQ ID NO: 195721 - protein, 86 aa, Triticum aestivum
  unsure (1)..(86): unsure at all Xaa locations
  Clone ID: PAT_TA_90139.pep
KNKRVLMESXIXXSXAXXAREKTLSDQFEAKRAKSKASRERKHARREERLAXGPXDHAPAPXAASSISGSSGTTLRPPISELRSML

SEQ ID NO: 195722 - protein, 74 aa, Triticum aestivum
  unsure (1)..(74): unsure at all Xaa locations
  Clone ID: PAT_TA_90140.pep
KNKRVLMESIHXSKAEKAREKTLSDQFEAKRAKSKASRERKHAXREERLAQGPRDHAPAPAAAAPAPAPAAXVP

SEQ ID NO: 195723 - protein, 55 aa, Triticum aestivum
  unsure (1)..(55): unsure at all Xaa locations
  Clone ID: PAT_TA_90141.pep
RGQVCLAYXNXWRXGTXKNXNEXLXXMMNYNPTREVLNXLLDXHXXDXLLEDXAX

SEQ ID NO: 195724 - protein, 103 aa, Triticum aestivum
  unsure (1)..(103): unsure at all Xaa locations
  Clone ID: PAT_TA_90142.pep
NSLVISVVAAEVFFFFFFFFFFFFFFSNFTKIFXNFXFIFKPXXANAAXTLFRMGLFPXFXSIGVGKVLKISLNHFFVXXAFXSXFHFSLFFIFPFFLXFSNF

SEQ ID NO: 195725 - protein, 91 aa, Triticum aestivum
  unsure (1)..(91): unsure at all Xaa locations
  Clone ID: PAT_TA_90143.pep
STXKGTKLAAILILQAVLVMGVLSHVNADYFPKCCNNCRSFSGVDVCDDAHPKCXXGXXXCRVVXTSPEMXRCADMKSTVXXXGGGPCKXY

SEQ ID NO: 195726 - protein, 52 aa, Triticum aestivum
  unsure (1)..(52): unsure at all Xaa locations
  Clone ID: PAT_TA_90144.pep
XYXXFQFSLTXXFLIXYLXLXIXSTLXTXIXNFNITTTPHSTSTKNTHXNTX

SEQ ID NO: 195727 - protein, 85 aa, Triticum aestivum
  unsure (1)..(85): unsure at all Xaa locations
  Clone ID: PAT_TA_90145.pep
XDXNDVKTXGKMXEDXGFXDXVVEXXXDXFLRXLERELGEXEKNKEAFXGXLXQEEYXXMVNGWXAKVXXRXXXEQKWGXLIXXK

SEQ ID NO: 195728 - protein, 138 aa, Triticum aestivum
  unsure (1)..(138): unsure at all Xaa locations
  Clone ID: PAT_TA_90146.pep
NSLVISSGRPGRSRYEEIVKEVSSYLKKVGYNPDKVPFVPISGFEGDNMIERSTNLDWYKGPTLLEALDQINEPKRPSXDKPLRLPLQDVYKIGWALGTVPVGPVFETGVIKXLGMVVTFWSPLVLTTEVQVPXEMHQ

SEQ ID NO: 195729 - protein, 45 aa, Triticum aestivum
  Clone ID: PAT_TA_90147.pep
LYIGGLLINQSSSSIHAHGQESEEKESRTKTKIISNMDPQTNHLV

SEQ ID NO: 195730 - protein, 54 aa, Triticum aestivum
  Clone ID: PAT_TA_90148.pep
FKPFYRYECSISDKFYISYFPFKFGTNTNIVVERVPLFAWTSSSLTCRAAARNH

SEQ ID NO: 195731 - protein, 44 aa, Triticum aestivum
  Clone ID: PAT_TA_90149.pep
LKNIVLPCTAYRSTTSTNAKGFSYINHHRQLLTSAATTLITSEF

SEQ ID NO: 195732 - protein, 118 aa, Triticum aestivum
  Clone ID: PAT_TA_90150.pep
EKRERVVAKTNGWNQAKPKPGSSTDSLPPWPNCSLAMRTNGTLVADGHGEGAHLVPAYKTTSTAPLLADRRTTRTSASSCVLLRDRQLATHLFRGRRAVYLEVGHGRESTQGRNCCGG

SEQ ID NO: 195733 - protein, 156 aa, Triticum aestivum
  unsure (1)..(156): unsure at all Xaa locations
  Clone ID: PAT_TA_90151.pep
NSLVISVVAAEVFFFFLGQHTIAFFSSTFSRTQTSCTQAAVAPSFRRSNRLGTDRFVAPACIITLPRSTAKLRHRPSAALKQGWPPATVVLQAPGGRLRNPNPAGRHGRPGEHATFGAQFRPNKWSXVITIQLGPSVFNKRPLELGEKPLGRLPQL

SEQ ID NO: 195734 - protein, 137 aa, Triticum aestivum
  unsure (1)..(137): unsure at all Xaa locations
  Clone ID: PAT_TA_90152.pep
LLGXESRGTSGQGYRCIRGWLNQHLTLKLWMHSHGRTRAMGGCARMGTXPSFLLGSGXEGRTNQRLGKNRCLGGMDGNMLPVCLVPNSAANLIISKYCMFLGNKKDGAQCERYVCFVWGVMYMDELVMMDLFGLDYV

SEQ ID NO: 195735 - protein, 54 aa, Triticum aestivum
  Clone ID: PAT_TA_90153.pep
FRAPPGQVCLVPGQSSWTTESPPGPDFRQMANCLTPKQRDKSKRHGDDDVMDIW

SEQ ID NO: 195736 - protein, 175 aa, Triticum aestivum
  unsure (1)..(175): unsure at all Xaa locations
  Clone ID: PAT_TA_90154.pep
RGRGRGAAFSSTVGAPASTPTNFLGKKLKKQVTSAVNYHGKSSKANRFTVMAAENLDEKRNTDKWKGLAYDISDDRQDITRGKGIVDSLFQAPTGDGTHEAVLSSYEYVSQGLKKYDFXDNTMGGFXYIAPAFMXDKLVVXLLPKNSMTLAQTSKIQLILGLSWGKQRVKGKTSN

SEQ ID NO: 195737 - protein, 90 aa, Triticum aestivum
  unsure (1)..(90): unsure at all Xaa locations
  Clone ID: PAT_TA_90155.pep
FXFXELACSPXKWAXRLCSXVLXXXFGMIXVVSAXPWYSSXLLYWYXVLGCMRLHIXVFXXFLXXXXPXGAFIWPRRXYXVGYLFLXRNX

SEQ ID NO: 195738 - protein, 45 aa, Triticum aestivum
  unsure (1)..(45): unsure at all Xaa locations
  Clone ID: PAT_TA_90156.pep
XXXGXGXFCRPXAFLTLEXXXFINIXLXLXIQSIXSLIQSIIKNN

SEQ ID NO: 195739 - protein, 47 aa, Triticum aestivum
  unsure (1)..(47): unsure at all Xaa locations
  Clone ID: PAT_TA_90157.pep
PXPXXRLMYXKXKFLDLXKXXXNCINXHXPXIXLXFVXEIXXFKVXK

SEQ ID NO: 195740 - protein, 182 aa, Triticum aestivum
  unsure (1)..(182): unsure at all Xaa locations
  Clone ID: PAT_TA_90158.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEXVKKEYXDAYXRIIGFTTSQXQCVSXSPSNGLQESGQTATHTGIYKC

SEQ ID NO: 195741 - protein, 129 aa, Triticum aestivum
  Clone ID: PAT_TA_90159.pep
REHLMKGEEDFPISLLLFLMMNQLMRRSFLFNPISSIRSSEKKVEPTHNVKKKNERRRSKGRKVSLPNDVAPTTHCDDDCYTIGAIHTINDESDYAYDMKRPKLREAMLDENDIFETCPGGRSNHLVNS

SEQ ID NO: 195742 - protein, 130 aa, Triticum aestivum
  unsure (1)..(130): unsure at all Xaa locations
  Clone ID: PAT_TA_90160.pep
AVGGSSPNNGXDPAXAGRRNXTKWIXXRXXRGXVKNFLRSPKQGXHRSKCXTTPMLYFQSPTSPFQLSXKPCQVFXRKKQQLGXTNXQSXQKTSQVSGXTMPXPXKKDGVDTKCGFRWVXXPXXTSXKAQ

SEQ ID NO: 195743 - protein, 39 aa, Triticum aestivum
  unsure (1)..(39): unsure at all Xaa locations
  Clone ID: PAT_TA_90161.pep
LVFEILXDLXXXEIVCYLXCYFXXHXNXKKKKXXXPXPR

SEQ ID NO: 195744 - protein, 77 aa, Triticum aestivum
  unsure (1)..(77): unsure at all Xaa locations
  Clone ID: PAT_TA_90162.pep
GGEFTKXLTWARPXGPQFFFFFWXQECFISHRGGKWGHTGGSIYXGXAXRXNQXXQXPNXGXTQKXXPQMXKXKXGX

SEQ ID NO: 195745 - protein, 44 aa, Triticum aestivum
  unsure (1)..(44): unsure at all Xaa locations
  Clone ID: PAT_TA_90163.pep
KLRRTLRARTHRFNSTLVEISAXPPLPGRTHYWEEPPPTAVWMX

SEQ ID NO: 195746 - protein, 111 aa, Triticum aestivum
  unsure (1)..(111): unsure at all Xaa locations
  Clone ID: PAT_TA_90164.pep
MKLIAAYLLAYLGGNSSPSAADVKNILDSIGAEADEKXLEFLXAELKXKDITXVIASGREKFCRLCLQGGGGXIAVGSSXLPASWVXXANXLLPEFKXKREXGXXXEREEL

SEQ ID NO: 195747 - protein, 83 aa, Triticum aestivum
  unsure (1)..(83): unsure at all Xaa locations
  Clone ID: PAT_TA_90165.pep
LQASLANLWEPPATCVGPRRRTAGSDRTSLCQQQLSLXGTNDKLLRSRSGPALXSFSLPPPLXRSRAXPSYLRPGGPTLNPLS

SEQ ID NO: 195748 - protein, 100 aa, Triticum aestivum
  unsure (1)..(100): unsure at all Xaa locations
  Clone ID: PAT_TA_90166.pep
ISFSGNHGQAQISLTTNAFKVSNWKCLYKVLTGATGKRPLKPPXRPXQRXNXXIPXAGPANGXGRGKAMPNRPGPQISAPXXGEVRIYKFQLGPVRFLTT

SEQ ID NO: 195749 - protein, 61 aa, Triticum aestivum
  unsure (1)..(61): unsure at all Xaa locations
  Clone ID: PAT_TA_90167.pep
NXTKTGXFHXXSAXXAVXIFRKXSFTXFRLNXNKVKXXCKKKKKNSRLDLPGRPLESLSDS

SEQ ID NO: 195750 - protein, 60 aa, Triticum aestivum
  unsure (1)..(60): unsure at all Xaa locations
  Clone ID: PAT_TA_90168.pep
TLIRNNQSYXIQTRWGSSPNNGPTCXGGPPNSXXIKRGPRAEGVPIQILXLSFVHFLKKK

SEQ ID NO: 195751 - protein, 68 aa, Triticum aestivum
  unsure (1)..(68): unsure at all Xaa locations
  Clone ID: PAT_TA_90169.pep
DTIRNTQGYASKRGWGKLLPIMGPNLQGRAGEXQLSDFXXGAPRGKVLSPPKFFFFFFFFFFFFFFFF

SEQ ID NO: 195752 - protein, 77 aa, Triticum aestivum
  unsure (1)..(77): unsure at all Xaa locations
  Clone ID: PAT_TA_90170.pep
SRXFFFFFFFFFFFFGAXKHYFHYKKYLQVXLPXTKARXLTNLGIPXSXXVLXWXPESNDXIXWQTTTKXXTTAXLX

SEQ ID NO: 195753 - protein, 65 aa, Triticum aestivum
  unsure (1)..(65): unsure at all Xaa locations
  Clone ID: PAT_TA_90171.pep
EDVMNLGMHCHXYIPSXFWXLAIFXLKKKKKKNSXPARGGAXXXIPXGAIEGGEXANDRPXSPXK

SEQ ID NO: 195754 - protein, 70 aa, Triticum aestivum
  unsure (1)..(70): unsure at all Xaa locations
  Clone ID: PAT_TA_90172.pep
LAWSRPRVFFFFFFFFFFFFFFFFFFLXXIXXXPPAVVPXCSIRSLSSXXSRXDHEQPXXPWSXXPXTPL

SEQ ID NO: 195755 - protein, 58 aa, Triticum aestivum
  unsure (1)..(58): unsure at all Xaa locations
  Clone ID: PAT_TA_90173.pep
MINVVXAEVXTXXXGGRPTATXXVKHQRHLXTPGXKNDVLXXGPXXXCGAEYSPPPRF

SEQ ID NO: 195756 - protein, 52 aa, Triticum aestivum
  unsure (1)..(52): unsure at all Xaa locations
  Clone ID: PAT_TA_90174.pep
LIKILKAYASKRVXEAPPIRGPTWXGXGPXNSTKWIKRWVRGPGWKLSPPRF

SEQ ID NO: 195757 - protein, 55 aa, Triticum aestivum
  unsure (1)..(55): unsure at all Xaa locations
  Clone ID: PAT_TA_90175.pep
XLTWSRXRSTLEXFFFFYXLSMNTXMGMXLHNTERQELXIRNAXCVLIXXTILXF

SEQ ID NO: 195758 - protein, 96 aa, Triticum aestivum
  unsure (1)..(96): unsure at all Xaa locations
  Clone ID: PAT_TA_90176.pep
EFXXGLAWXQPRSRXPSFFFXXFSFXFFFXFFGALNHXLFXTGIIXRQRSFHETFSXRFCXNHXTSXXXXHXXXGTRGKPIKKXXSVTFWXGYVHT

SEQ ID NO: 195759 - protein, 52 aa, Triticum aestivum
  unsure (1)..(52): unsure at all Xaa locations
  Clone ID: PAT_TA_90177.pep
FSCLFCFXNNAXHXFSLFPXCELAIKQXXEHSKXNVHRTQDLAXXTXITXEX

SEQ ID NO: 195760 - protein, 60 aa, Triticum aestivum
  Clone ID: PAT_TA_90178.pep
LSVVAAEVFFFFFYNQSISGQSSTNLINRPTNNKLRVSGPLHNHPLAGRSIHRHVTCPGG

SEQ ID NO: 195761 - protein, 114 aa, Triticum aestivum
  unsure (1)..(114): unsure at all Xaa locations
  Clone ID: PAT_TA_90179.pep
PELSYIQRRRVLHPTPFDVGSCNRARLELQLATGGAARGEXIFANVFSFCRTQFCFCWXRCIFLLEPRFFLLQRLQSSQMLMSFLLEPKFDCVGRIFGFASTDHRTLIRGEDFC

SEQ ID NO: 195762 - protein, 91 aa, Triticum aestivum
  unsure (1)..(91): unsure at all Xaa locations
  Clone ID: PAT_TA_90180.pep
GXXFXXAPGQXXSFFFXFFFFFFFFFFFFFFFFLIIIPXTISIFRCDSSSICNLFLIINTEAPNTHNPHFQHLLTKHTYLGRDHXNHLVNS

SEQ ID NO: 195763 - protein, 78 aa, Triticum aestivum
  unsure (1)..(78): unsure at all Xaa locations
  Clone ID: PAT_TA_90181.pep
PARAGMTFLSRAFENXIVLSRQCYYQYQKNCIPLXIVSSSXLYQXQAFALHXVSWCRKKKKKLEIXYLGRGHXNXXVX

SEQ ID NO: 195764 - protein, 84 aa, Triticum aestivum
  unsure (1)..(84): unsure at all Xaa locations
  Clone ID: PAT_TA_90182.pep
LPXXFKXPFXXXLFPRPKKXKRXXKKXKKXKKKKKKKXKXGPWGLHLPGXPXGNHLXNXRPALPVRXYWETSPTRLDAIALXIL

SEQ ID NO: 195765 - protein, 59 aa, Triticum aestivum
  Clone ID: PAT_TA_90183.pep
FERPPGQVIILHRRHVFKLLVKLHAVVIKLNKLASQFSLQNRYEELKCTTLYCGICSFH

SEQ ID NO: 195766 - protein, 43 aa, Triticum aestivum
  unsure (1)..(43): unsure at all Xaa locations
  Clone ID: PAT_TA_90184.pep
ARAGRELVWSFNXMYAIAYFSRTHIIAVLADDVXIPXLYIILA

SEQ ID NO: 195767 - protein, 80 aa, Triticum aestivum
  unsure (1)..(80): unsure at all Xaa locations
  Clone ID: PAT_TA_90185.pep
GXXRXMXXLXFAIGAPXCSXRLFGXXYXEKKXGGXPXPFFYPIAGFDXPCVLKKGEIFLALRXKKKGNXIKXSFSPILFS

SEQ ID NO: 195768 - protein, 55 aa, Triticum aestivum
  unsure (1)..(55): unsure at all Xaa locations
  Clone ID: PAT_TA_90186.pep
MIKRGPXRXSXPPSFLRDLPXRPQSSRXMGAPHRFPQPPTSPDSXGAKXXXRSXY

SEQ ID NO: 195769 - protein, 89 aa, Triticum aestivum; identical to SEQ ID NO: 117638
  Clone ID: PAT_TA_90187.pep

SEQ ID NO: 195770 - protein, 70 aa, Triticum aestivum
  unsure (1)..(70): unsure at all Xaa locations
  Clone ID: PAT_TA_90188.pep
RXARQVRDXGLNXILYXGTMHASYVMYVTVSTKISXSXCTNXFSXXNXRXYNYLHXXKXGAVXCLAXKKK

SEQ ID NO: 195771 - protein, 132 aa, Triticum aestivum
  unsure (1)..(132): unsure at all Xaa locations
  Clone ID: PAT_TA_90189.pep
NSLIRGRRRYHRTSDDELCAESSSSNLLKGTKLAXILIPPRAVLVMGVLSHVNAXFFPKCCNNCRSFSGVDVCDDAHPKVXPKGCSGAAWCTNPKCPLRAIWKIQPVRGNAGGTAKEGTIGFMAGHNDVSLK

SEQ ID NO: 195772 - protein, 94 aa, Triticum aestivum
  unsure (1)..(94): unsure at all Xaa locations
  Clone ID: PAT_TA_90190.pep
RGRGRGQXRLIFAGKQLEDGRTLADYNIQKESTLHLVLRLXGGMQIFVKTLTGKTITLEVESSDTIDNVKAKXIXDKEXIPPDQXRSSXPXKAT

SEQ ID NO: 195773 - protein, 57 aa, Triticum aestivum
  unsure (1)..(57): unsure at all Xaa locations
  Clone ID: PAT_TA_90191.pep
RTACQTLQTLALYRIANTQARACLPHQIYALIISVSRSPSIVSSXRRLLRGCRSFRL

SEQ ID NO: 195774 - protein, 119 aa, Triticum aestivum
  unsure (1)..(119): unsure at all Xaa locations
  Clone ID: PAT_TA_90192.pep
LVFXCFXCSWXPRRLIAXIXYPYXKNPXCWGTLDXGGRGVXTXRXWSGRXWRASSXRRSGQLMEGCGYXLRXXXFTXIITRVGXXESXICARPRLXFASLTRRRRGRXSXXTTLIISEF

SEQ ID NO: 195775 - protein, 73 aa, Triticum aestivum
  unsure (1)..(73): unsure at all Xaa locations
  Clone ID: PAT_TA_90193.pep
IHXMIXVVAAEVFFFXXTGTFIXSSXXTTXKRVLVFATPLQIHXXCGKQKXNSCPTNIKQSXXWRXHPNLFFX

SEQ ID NO: 195776 - protein, 95 aa, Triticum aestivum
  unsure (1)..(95): unsure at all Xaa locations
  Clone ID: PAT_TA_90194.pep
MSXGGSAGGGQSSLGYLFGXGEPAKPAAAPAAKPAPAEKPAPAAADVPKQDSSWAFQVXRXNNYYRADXQNTGNFLTGRPSTKSCWPLPVAPPLG

SEQ ID NO: 195777 - protein, 43 aa, Triticum aestivum
  unsure (1)..(43): unsure at all Xaa locations
  Clone ID: PAT_TA_90195.pep
MXETNPIRKKKKRXYYSXRPRFRPGSLDXNPKIKSETXNITTX

SEQ ID NO: 195778 - protein, 152 aa, Triticum aestivum
  unsure (1)..(152): unsure at all Xaa locations
  Clone ID: PAT_TA_90196.pep
RSKTKIYVNAWAIGRDPVSWPDDPEEFNPDRFEANEIDFKGEHPELMPFGTGRRICPGMSMXVATIRSLHSANLLFNFXWTLPXGQRRDDVNMEEEGRLIFHRKTPLVLVSQTNTTKCLEIKKRSGHNLNKVQFVLHTLRKGWVPKDKKFLI

SEQ ID NO: 195779 - protein, 96 aa, Triticum aestivum
  unsure (1)..(96): unsure at all Xaa locations
  Clone ID: PAT_TA_90197.pep
MKGTKLAAXLILXAVLVMGVLSHVNADFFPKCCNNCRSFSGVDVCDDAHPKCPKGCSACRVVSTXSPEMWRCADMKSXVXGNCGGPCKKYSVQAGI

SEQ ID NO: 195780 - protein, 132 aa, Triticum aestivum
  unsure (1)..(132): unsure at all Xaa locations
  Clone ID: PAT_TA_90198.pep
SRXFFFFFFFFFFFFFFFFXIQRGKCRXMXTXXVIKVGCPPRKQDRKRISXXMRGCXSAKVXLPNFTSGSCXXXXLIHCIPEXHXFLDDEATAMXPPXXSPTSPKGPSHNGHANQTNXFGFXFKEPFQXXSF

SEQ ID NO: 195781 - protein, 93 aa, Triticum aestivum
  unsure (1)..(93): unsure at all Xaa locations
  Clone ID: PAT_TA_90199.pep
HXGGVXLTXRINLXLXQXYIISDGIPRNAFVSGGRMGACCTAXXVIXGLGQPRPGGXNNXVKLWXATQPAGVVRGLXRANPPPGGXGNKQRXX

SEQ ID NO: 195782 - protein, 67 aa, Triticum aestivum
  unsure (1)..(67): unsure at all Xaa locations
  Clone ID: PAT_TA_90200.pep
XRXQEEKDDAFSDQRAXHWXSKXRHGKAXXLXSXXNXCFXXSQXPLDXFFGXHSXLXEXLCVSXAQI

SEQ ID NO: 195783 - protein, 66 aa, Triticum aestivum
  unsure (1)..(66): unsure at all Xaa locations
  Clone ID: PAT_TA_90201.pep
RXTARLLFPXPXRXXXPAXQEXRPQRRGVTTGXPFTPFXHANLISDVXXFVPKYRIASKRLLGMFX

SEQ ID NO: 195784 - protein, 52 aa, Triticum aestivum
  Clone ID: PAT_TA_90202.pep
RPGRWPPCEPCPWTSFPVLPHNLAEEVYPFYQNLFYCVELRFQVPVVLCYFV

SEQ ID NO: 195785 - protein, 92 aa, Triticum aestivum
  Clone ID: PAT_TA_90203.pep
NSLVISSGRPGRFFFCPRSYHSSFDKIYHPSLRSEVNFVSLFTSSTSNDKSEYNITSTIPQTCHYKHRVSTCCHLFSESSLTVRQKAVYCFP

SEQ ID NO: 195786 - protein, 75 aa, Triticum aestivum
  unsure (1)..(75): unsure at all Xaa locations
  Clone ID: PAT_TA_90204.pep
ICGVXNHCSPAXAASMKVXIDVASGXPPSPVSPMPAAGPGASNSXPPAPPSNAATSVGATAGFGLVALLAAGLMA

SEQ ID NO: 195787 - protein, 112 aa, Triticum aestivum
  unsure (1)..(112): unsure at all Xaa locations
  Clone ID: PAT_TA_90205.pep
MGKEKIHISIVVIGHVDSGKSTTTGHLIYKLGGIDKRVIERFEKEAAEMNKRSFKYAWVLDKLXXERERGITIDIALWKFETTKYXXTVIDAPXHRXFIKNMITGTSXXDCA

SEQ ID NO: 195788 - protein, 72 aa, Triticum aestivum
  unsure (1)..(72): unsure at all Xaa locations
  Clone ID: PAT_TA_90206.pep
XPILRVKTPRKLKKKKKTRDLPGRPAWSXPRFSLEFFFFFSRHATVPVLXGVQVASIYTRWYHCIRSCMAVE

SEQ ID NO: 195789 - protein, 151 aa, Triticum aestivum
  unsure (1)..(151): unsure at all Xaa locations
  Clone ID: PAT_TA_90207.pep
MINRGRGXSXFLXRIKKXYERNGXLANLLIDPEXFAQEXMDRQXAWRRVXCLXINNGVSTPGMSREVWPTXDSYPEGTSFPAXLVQGPRXTTLGGAHLRKGVDNARXPFHTGSGNKDPNSKDWLGSYQKKGHQFRPSLGILLAAKSMSFSL

SEQ ID NO: 195790 - protein, 50 aa, Triticum aestivum
  Clone ID: PAT_TA_90208.pep
LAWSRPRSTLLLPLLQQLTMMIYIAKSFRVRRCCAPVRSTRKNYVLKLIL

SEQ ID NO: 195791 - protein, 166 aa, Triticum aestivum
  unsure (1)..(166): unsure at all Xaa locations
  Clone ID: PAT_TA_90209.pep
QAKAAASTVAKQGRPKXHPKXGGXLLLQRRCPRASTPDQTSXGKESSKKPGDLGPVNYHGQRSSKGPNRFTSHGXAGKTSHEERGNNGXKLGKGSFAVXISPGXTKQGHHQEGKGASVXLRSFPRRPQRGXRATPTKGGSSNSLTEVRQAQGELQRXLPTSXNXQL

SEQ ID NO: 195792 - protein, 60 aa, Triticum aestivum
  Clone ID: PAT_TA_90210.pep
AQAGCGCTQCKCGTSCGCSCCSCDHRPYACTVPCVHHRSYRSTTTIPCNRNLIEGLYLCT

SEQ ID NO: 195793 - protein, 57 aa, Triticum aestivum
  unsure (1)..(57): unsure at all Xaa locations
  Clone ID: PAT_TA_90211.pep
HXICCXTIFFLPXXHVHCXVRRRFXAXKVXGXQXLQXWXVQLVVDXXGXPLESXSEX

SEQ ID NO: 195794 - protein, 67 aa, Triticum aestivum
  unsure (1)..(67): unsure at all Xaa locations
  Clone ID: PAT_TA_90212.pep
KKKXXPRAGXLYVXVVHAQQQLLLLSXSLSFSXSSEKTCFFLRIEKXVVASVNKHIVSIYAYXLKSX

SEQ ID NO: 195795 - protein, 136 aa, Triticum aestivum
  unsure (1)..(136): unsure at all Xaa locations
  Clone ID: PAT_TA_90213.pep
NSLSDRGGRGIASRPHPKVSSRAVLRSSNGSQSCCCQXANAKGXAAKVAKAVKVXGSIKKTAKKIRTSVTFHRPKTLSKGRXTPKYPXXSTPGRKKLDXYQILKVPRLTLKSAMKKXEDNKTLVFIRTLKGPTKKE

SEQ ID NO: 195796 - protein, 61 aa, Triticum aestivum
  unsure (1)..(61): unsure at all Xaa locations
  Clone ID: PAT_TA_90214.pep
HLXKFXRXKXGAGRCSXXIXIXQLMGVFCTXVVLYGRYKITRSTQVVAXRPFYXKTKLCFX

SEQ ID NO: 195797 - protein, 109 aa, Triticum aestivum
  unsure (1)..(109): unsure at all Xaa locations
  Clone ID: PAT_TA_90215.pep
RRIQXVIPSGPPRGKXAANXRAGGGXNVQGATXSPTTKRWXQHPPGQGPPAPTCGFGIFYRAKQGRALCSWVCRHPLGNEPMNDXAHGSWDMQNEAXRASSVXHRPVPI

SEQ ID NO: 195798 - protein, 116 aa, Triticum aestivum
  unsure (1)..(116): unsure at all Xaa locations
  Clone ID: PAT_TA_90216.pep
AXXDACLNXXXELFNFNFKXGXIXXXGIDPNQLXXLQGXXXQGSXXXGWNFNXXXASPXKFWGVCWXTNXGXAGSSPFGQFGLGVLRRRRPRRKDXQLXHHFGKLVGRFRCERTSP

SEQ ID NO: 195799 - protein, 100 aa, Triticum aestivum
  unsure (1)..(100): unsure at all Xaa locations
  Clone ID: PAT_TA_90217.pep
RIXVWVXXXGFFPSXXTFXKXTAPLXXLLXTSXXRXKFGPRTFAXXPARHWRPAGKFXXGAARPGPGQGFDHGLRKGGPVSAFXILQSNSTIRCPSPGFF

SEQ ID NO: 195800 - protein, 97 aa, Triticum aestivum
  unsure (1)..(97): unsure at all Xaa locations
  Clone ID: PAT_TA_90218.pep
GRCAXGGLWAAXXXLHRPRXVGALLXGASLTSSPFPFFPSCRMLXLPTXXSNGRYQRNLNNTPILAVLCPTYQCIHWSKIPALLLCKIYSLGMCYRX

SEQ ID NO: 195801 - protein, 149 aa, Triticum aestivum
  unsure (1)..(149): unsure at all Xaa locations
  Clone ID: PAT_TA_90219.pep
MSPQTETKAGVGFKAGVKDYKLTYYTPEYETKDTDILAAFRVSPQPGVPPEEAGAAVXAESSTGTWTTVWTDGLTNLDRYKGRCYHIXPVAGEDSQWXCYXTYPLDLXFEEGSVTNMFXSXVGTYFGFKALRCLRLGGLPXPPXYSKTF

SEQ ID NO: 195802 - protein, 117 aa, Triticum aestivum
  unsure (1)..(117): unsure at all Xaa locations
  Clone ID: PAT_TA_90220.pep
TXGXPSRWKGAXAAKTGCXPTLEXXXGPFLCFXKQXXNXGXAVLIXPGSFEVRXXXLXGCRFXXAKESLRDGVLXXRRARRXXPSXXFFLXXCXSWFPFHRALRARRGGSREVEAPT

SEQ ID NO: 195803 - protein, 107 aa, Triticum aestivum
  unsure (1)..(107): unsure at all Xaa locations
  Clone ID: PAT_TA_90221.pep
LAWSRPRWXFFFFFFFFFFFFFFFFWXMXXCXIYXVXXKKSFXFXQXIPXSCPXWXVQLKXTTGPRLNNQMQRGLXPDGXPXQLAQVQVXPXRRRRXVRXGAPIXFP

SEQ ID NO: 195804 - protein, 127 aa, Triticum aestivum
  unsure (1)..(127): unsure at all Xaa locations
  Clone ID: PAT_TA_90222.pep
GKGCAAALKQAGARVXVTKIDPICALXALMEGIQXLTLEDVVSEADIFVTTTGNKDIIMVHHMRKMKNXNAIVCKIGHFXDNEIRHETGFRPNPGCXSAINIXAPKTDRWVLPXNKEESIVSCRVVN

SEQ ID NO: 195805 - protein, 139 aa, Triticum aestivum
  unsure (1)..(139): unsure at all Xaa locations
  Clone ID: PAT_TA_90223.pep
MAPKVAVAKKGDAKAQAAKVAKAVKSGSIKKTAKKIRTSVTFHRPKTLSKARDPKYPRISTPGRNKLDQYQILKYPAXTLKSAMKKXEXKKTLVFIVXLKGDKKKIKGAVKKMXDIQGKKGXNLIKPDGXKKXYXKLTT

SEQ ID NO: 195806 - protein, 90 aa, Triticum aestivum
  unsure (1)..(90): unsure at all Xaa locations
  Clone ID: PAT_TA_90224.pep
AFFXWEGGPQTXXWGLKXLEXGXFXEXPPGTLRKXAWFFCQGNFXLXGGFWSXFDXFXXFCXWIPPXXTWPKAHGCWRXVERATHXGXIS

SEQ ID NO: 195807 - protein, 133 aa, Triticum aestivum
  unsure (1)..(133): unsure at all Xaa locations
  Clone ID: PAT_TA_90225.pep
QHAGSLRRQRMQDHXPLRFSPXQRRIVLIVMKASWSYGRCMSIMWSFERTPXFLSVVWLNECVIVEYFVLNCMYCSWIEIITNKPYVLYNYQLMLFSLIWAQLMSTHFRIKKKKKKNSRLYLGRDHANHLVNS

SEQ ID NO: 195808 - protein, 88 aa, Triticum aestivum
  unsure (1)..(88): unsure at all Xaa locations
  Clone ID: PAT_TA_90226.pep
MKXTKLAXILILQAXLXMGXLSHVNXDYFPXXCNKCXSFSXVXSXNETXPSDPKGWXGGRXKSKFPPPPAGREISGPNSSKVSFTNSP

SEQ ID NO: 195809 - protein, 46 aa, Triticum aestivum
  Clone ID: PAT_TA_90227.pep
VCHKKIRFFFLIFDFTVHTGSICLLSVERYFRFKKKKKKKPRPRPR

SEQ ID NO: 195810 - protein, 73 aa, Triticum aestivum
  unsure (1)..(73): unsure at all Xaa locations
  Clone ID: PAT_TA_90228.pep
KTQSMXPXRWGAPPIRAEPAXRGANSTXGFPKRXPGKVFFFFFRXXKXCXXTXDTXTKKSXPSQNXGXXTMXL

SEQ ID NO: 195811 - protein, 99 aa, Triticum aestivum
  unsure (1)..(99): unsure at all Xaa locations
  Clone ID: PAT_TA_90229.pep
NSLVINVVAXEVFFFDQNITTPISRLPLQSKSHNYQESFQDTQHLIVTDTTLESRLTTIEQSKNTDDRIDFSIQVRLALDLFQAHVQSTGKLGXAAPSL

SEQ ID NO: 195812 - protein, 70 aa, Triticum aestivum
  Clone ID: PAT_TA_90230.pep
KESSLTKELLSTSQAKIFSPKRLYFLVIWASTSLKEHCICLNNLQKQQEAKLTNWPILSKRASSVQMDFS

SEQ ID NO: 195813 - protein, 58 aa, Triticum aestivum
  unsure (1)..(58): unsure at all Xaa locations
  Clone ID: PAT_TA_90231.pep
XQYYSRVKKCIXFXERECDSYYVXSTSICNXQAFXSFFLMILRXXFFKKXXXXXHVNH

SEQ ID NO: 195814 - protein, 81 aa, Triticum aestivum
  unsure (1)..(81): unsure at all Xaa locations
  Clone ID: PAT_TA_90232.pep
KRTXXVXFXIXTXXLGGNLGPXXXAFXPGPPLGRPXXNFGLALVRGXEXLVSGFFFFFFHKLXLLLTQLYSFRGAPKGAIT

SEQ ID NO: 195815 - protein, 89 aa, Triticum aestivum
  unsure (1)..(89): unsure at all Xaa locations
  Clone ID: PAT_TA_90233.pep
MKGTKLAAXLILXAVLVMGLLSHVNADFFPKCCNNCRSFSGVDVCDDAQPKCPQGCXACRVVSXXPEMWRCADMKSNVDGTCGXXCKXY

SEQ ID NO: 195816 - protein, 73 aa, Triticum aestivum
  unsure (1)..(73): unsure at all Xaa locations
  Clone ID: PAT_TA_90234.pep
XXSRXXRXALTVKRKATPSPXGEXHGDARVFDPFLXLXLEXPVGPDXERXFHXXKGXXXTVXELVXWKXGXYX

SEQ ID NO: 195817 - protein, 58 aa, Triticum aestivum
  unsure (1)..(58): unsure at all Xaa locations
  Clone ID: PAT_TA_90235.pep
SRXFFXFFXFXVIKRLQISLKYKIATLSDEVSPTQPNDTMTTVISSSNTDLGRDHANH

SEQ ID NO: 195818 - protein, 69 aa, Triticum aestivum
  unsure (1)..(69): unsure at all Xaa locations
  Clone ID: PAT_TA_90236.pep
ELXXKXLSTNNEXDXXRGDSHPPRXSWAMGVLXHVKRPTXFPNXGKKREXAXPGXXXCEXKPPPNSXXG

SEQ ID NO: 195819 - protein, 96 aa, Triticum aestivum
  unsure (1)..(96): unsure at all Xaa locations
  Clone ID: PAT_TA_90237.pep
IGMLKRCKGSSRRHSSPLGXSSWXSGRCILAGTSKVTCCAPLPPPMQQRDXWVVYGRMFLXVKXEPILXXXPGLXXNPXXGLAQXLGXQXKXCXKP

SEQ ID NO: 195820 - protein, 120 aa, Triticum aestivum
  unsure (1)..(120): unsure at all Xaa locations
  Clone ID: PAT_TA_90238.pep
MVAHRFHXYQXVGRALPTPGDEQPKXYRMXLWATXEVRAKSKFWYFLRXLKKVKXXNXXMLXIXXXFXKNPTTIKNXXIWXLRYXNKTGXHNMLKEPWHEPSGGGAVQGWGRNMRCPLHS

SEQ ID NO: 195821 - protein, 74 aa, Triticum aestivum
  unsure (1)..(74): unsure at all Xaa locations
  Clone ID: PAT_TA_90239.pep
FLVXHXWXCSLFPQLRVEEXRKLFGXTPYIXVRLKXHXRNYQGRLFCCGRSRLFPHXPKQKRRRRXSQKGCSIL

SEQ ID NO: 195822 - protein, 102 aa, Triticum aestivum
  unsure (1)..(102): unsure at all Xaa locations
  Clone ID: PAT_TA_90240.pep
MKGNKLAXXLILXAVLVMGVLSHVNADYFPKCCNNCRSFSGVDVCEDAQPKXXPKGCSACRVVSTNPEMWRCADMKSNVDGTCGGPCKEITDVKRYVPPKMK

SEQ ID NO: 195823 - protein, 79 aa, Triticum aestivum
  unsure (1)..(79): unsure at all Xaa locations
  Clone ID: PAT_TA_90241.pep
XLSREQRPPNGKFLSNYPCFPFYYLTCCLFRAEDLLLWLCFEPXEXWERRRLLLPRNNGIIIGLKKLARAAARNHLVNS

SEQ ID NO: 195824 - protein, 124 aa, Triticum aestivum
  unsure (1)..(124): unsure at all Xaa locations
  Clone ID: PAT_TA_90242.pep
AETYSFPGIXPXPVLXLQGSHPQXXLXTVGFXIPRKRQQFXGASXDHPRRPPXEPAPWGTLWGWGVVRQTFDPPEKGPCKLFASXFGKKIGRFNVVEEDSPLTRTALEESRIPAELCCPSLFSY

SEQ ID NO: 195825 - protein, 110 aa, Triticum aestivum
  unsure (1)..(110): unsure at all Xaa locations
  Clone ID: PAT_TA_90243.pep
TWTXFETXHGLFIPSRXXNKLAYPXXWEPPPXVXTQXADAVSXSXLLCHNXSYXDNXNFEVPVGSPLIFSXASLMVRXDQLRPLRXGTXAWFAHVGKEIGQTPGVLCXFM

SEQ ID NO: 195826 - protein, 86 aa, Triticum aestivum
  unsure (1)..(86): unsure at all Xaa locations
  Clone ID: PAT_TA_90244.pep
PPXXGCXLLXLVLILKPTGQXGXLXXLLQLXEXXFXXXFLQFVKXNFVPLILINXWCGEYQLXDHFQVKKKKKKNXXXGXXHVXHW

SEQ ID NO: 195827 - protein, 100 aa, Triticum aestivum
  unsure (1)..(100): unsure at all Xaa locations
  Clone ID: PAT_TA_90245.pep
MKGTKLAXXLILXAVLVMGXLSHVNADYFPKCCNNCRSFSGVDVCDDAQPKCPXGCSAXRVVSTSPEMWRCADMKSNVDDNWGGPCKKVLGLKPTMICFA

SEQ ID NO: 195828 - protein, 88 aa, Triticum aestivum
  unsure (1)..(88): unsure at all Xaa locations
  Clone ID: PAT_TA_90246.pep
XXGQXNSXYWEPXXIITAVYSRGIFRIAEXQATPIFSRXRKHXDQEXTYXYKHXWXHTHPXXTMXLPXXSELLFNFRXDXIXCRDXTD

SEQ ID NO: 195829 - protein, 89 aa, Triticum aestivum
  unsure (1)..(89): unsure at all Xaa locations
  Clone ID: PAT_TA_90247.pep
ANPXETPSNNGMGXFRKNXPFPLCSSKLFCXSTPAVLNERAPFGNGSPPKGXMVGALEPKRXNXLNPAWVAPXTRRCGSFNKWPTSVQP

SEQ ID NO: 195830 - protein, 70 aa, Triticum aestivum
  unsure (1)..(70): unsure at all Xaa locations
  Clone ID: PAT_TA_90248.pep
LLSSNNSIKTQNASIQPSIXDXXISSLKSESDPVNEYXSQPHSKNGNLAGRAPEIRNPRRPPRGGGNKAN

SEQ ID NO: 195831 - protein, 144 aa, Triticum aestivum
  unsure (1)..(144): unsure at all Xaa locations
  Clone ID: PAT_TA_90249.pep
MQIFVKTLTGKTITLEVESSDTIDNVKAKIQDKEGIPPDQQRLXFAGKQLEDGRTLADYNIQKESTLQLVLRLRGGMQIFVKNLTGKNINLEXLRSSDTNXNVXGKIQDKXRGXPPXTXQXLXFCWXTXLXDGRSLADXNXQKG

SEQ ID NO: 195832 - protein, 113 aa, Triticum aestivum
  unsure (1)..(113): unsure at all Xaa locations
  Clone ID: PAT_TA_90250.pep
QFGQRGTKVWESQKXLRIPXHXILXLGSVFKFFETVTXFGLKXNHRXXVSPGLLXPXLLXWRRXXXPXXPPGHQFTFXLXXRDQFXLPQXLSSPNXRXXCXXPGRPXESLVNX

SEQ ID NO: 195833 - protein, 101 aa, Triticum aestivum
  unsure (1)..(101): unsure at all Xaa locations
  Clone ID: PAT_TA_90251.pep
MIPAAREVQQLLTNEEILXNXMFALVXSHDTXSILMTCMVXQLXNDSXNLXAMVQXHEKIARXKXEGKGLNWEKLXKRXKFTWESLQKEXLRIEPPIFGQL

SEQ ID NO: 195834 - protein, 64 aa, Triticum aestivum
  unsure (1)..(64): unsure at all Xaa locations
  Clone ID: PAT_TA_90252.pep
KSSPSAGKNKGGKGNCIXINLAIILPPLGVFLKFXCGHEFWIWLLVNFLGXIPGXIYAIYANNK

SEQ ID NO: 195835 - protein, 157 aa, Triticum aestivum
  unsure (1)..(157): unsure at all Xaa locations
  Clone ID: PAT_TA_90253.pep
TAPRSPKXSXTQALLLFMWKFLIRLLLXLLNKIHPFESYLLVARGSLVCLYIGWSLVQGPLCFVYLLQLXLESDVISQLKDAPLILAIFSLILTNQFSRALFVFFEKAFFRDQTKFAFXXELRIRDXXFCWLKKKKKKLRXIXXXPARRPHGLIPFS

SEQ ID NO: 195836 - protein, 69 aa, Triticum aestivum
  unsure (1)..(69): unsure at all Xaa locations
  Clone ID: PAT_TA_90254.pep
LTXAIHKTXVGNVNGGIRKXKKKXXYEMGXSTPXVXPXKWXRTKFNQXLLKXXKXNXTXRAGGXXKNRL

SEQ ID NO: 195837 - protein, 55 aa, Triticum aestivum
  unsure (1)..(55): unsure at all Xaa locations
  Clone ID: PAT_TA_90255.pep
ALYIVNXCCSHYPRVNTCILFWSGNLIVTCIYPRLYLISSPSCLLYXPFWAFXFF

SEQ ID NO: 195838 - protein, 61 aa, Triticum aestivum
  unsure (1)..(61): unsure at all Xaa locations
  Clone ID: PAT_TA_90256.pep
FXGGQLIXNNSKAYGXPNAVWGRSPQXXVRTLQGXGPPKFQLNXFKRGXPXGXEGENLNPP

SEQ ID NO: 195839 - protein, 70 aa, Triticum aestivum
  unsure (1)..(70): unsure at all Xaa locations
  Clone ID: PAT_TA_90257.pep
NSLMINVXXGEXXSXVFFFFFFIKAXQPTSXLFVVKHQLRNHFQTPXTKSVXNXQWXTFQRLXRNTCPGG

SEQ ID NO: 195840 - protein, 113 aa, Triticum aestivum
  unsure (1)..(113): unsure at all Xaa locations
  Clone ID: PAT_TA_90258.pep
SFXXPLVHXNGGLGRXDPXXCLSLFLGTASHHPXRLXGDPRXFVWALDIALFEXGIXEAAFIILSCYVGGSFVXXQGFFFIYLXXXIXFXHLILXKKKKKTXDWPSPXPTLXX

SEQ ID NO: 195841 - protein, 121 aa, Triticum aestivum
  unsure (1)..(121): unsure at all Xaa locations
  Clone ID: PAT_TA_90259.pep
GVVXPPLKLELELEXKLVLLSXTRNSFVVVVIRRCLYSIXLLPLAAGIXCVLTRFWKKKRPXXPFSSQLSCRFVFGXSVGIWRLDGGXXFNXLXPFXLXVIAFLALSGDXPGXPLXIISXX

SEQ ID NO: 195842 - protein, 40 aa, Triticum aestivum
  unsure (1)..(40): unsure at all Xaa locations
  Clone ID: PAT_TA_90260.pep
FNKLFHAPFNXXQFQREGKXHRGFLKLXDXNXGPGPXYSF

SEQ ID NO: 195843 - protein, 96 aa, Triticum aestivum
  unsure (1)..(96): unsure at all Xaa locations
  Clone ID: PAT_TA_90261.pep
PRXRFXXXXFFXXXPIXSFXGXXNCLTDXRIGXXGAHXSLXXKXEGCSXGKSKLRPVAAPSPRRGIGHYVVCHRPGQVXGALLTCPGRPLEITSEF

SEQ ID NO: 195844 - protein, 89 aa, Triticum aestivum
  unsure (1)..(89): unsure at all Xaa locations
  Clone ID: PAT_TA_90262.pep
MKGTKLAAILILQAVLVMGVLSHVNADYFPKCCNNCRSFSGVDVCDDAHPKCPKGCSACRVVSTSPEMWRCADMKSTVDGTCXGPCKKY

SEQ ID NO: 195845 - protein, 176 aa, Triticum aestivum
  unsure (1)..(176): unsure at all Xaa locations
  Clone ID: PAT_TA_90263.pep
TLLGRXQTPFGSEHYHFKLARIXSHTHPCQLTXPFLALGQSLXSPFSQQRGKVSPNSALXRGFSRQGFLAHCRESXXVCPXIGRGRPFPHDPHLLTHPAAGGXLWKRAQSKPLFALASILHFTVSFFLXSHPESPLGACGGGLLGXHLFPPXFFRVSGXPXRXDXRAADPRLIHLV

SEQ ID NO: 195846 - protein, 55 aa, Triticum aestivum
  unsure (1)..(55): unsure at all Xaa locations
  Clone ID: PAT_TA_90264.pep
PXWXLXSXSGVIXNCFGXKXXRTAXVXTTHAEKKKKNWGISXXAXAPAXKSLVNS

SEQ ID NO: 195847 - protein, 64 aa, Triticum aestivum
  unsure (1)..(64): unsure at all Xaa locations
  Clone ID: PAT_TA_90265.pep
XDPRETFXTLQXQGGXGGXEANXLGASXLECGXLWXXKXWWLNAWXYXXPXFRCNXTXFVXTXF

SEQ ID NO: 195848 - protein, 103 aa, Triticum aestivum
  unsure (1)..(103): unsure at all Xaa locations
  Clone ID: PAT_TA_90266.pep
MKGTKLAAILILQAVLVMGVLSHVNADYFPKCCNNCRSFSGVDVCDDAHPKCPKGCSACXRVVSXXPEMWRCAGYXIPPVDGTCGGPQEVLIGSCQHDMFRLK

SEQ ID NO: 195849 - protein, 49 aa, Triticum aestivum
  unsure (1)..(49): unsure at all Xaa locations
  Clone ID: PAT_TA_90267.pep
FXXXADIELFTWDSTXXTTQLFPPSGRYLXKEWXXSRPYFXSXYIXVXR

SEQ ID NO: 195850 - protein, 76 aa, Triticum aestivum
  unsure (1)..(76): unsure at all Xaa locations
  Clone ID: PAT_TA_90268.pep
MXKAVAVLTGSEXVXGTIFFTQEGDGPTTVTGSVTXLKEGLHGFHVDALGDTTXGCMSXGPHFNPAGSWCMGAPRR

SEQ ID NO: 195851 - protein, 153 aa, Triticum aestivum
  unsure (1)..(153): unsure at all Xaa locations
  Clone ID: PAT_TA_90269.pep
ALXGITQGYGFQXRWGSSSQYGRTLQGGRXIQXSELSXGRXPEVKTIQRVLXXXLPNRXKSWXGAXXCXXANXAKYXCFPEQRXVPAAAGLRRCXGAHPQSSNSSRLXWPGXXXKSSXKPAGPPLGETGDPSSWXCLXHWEMGALAFLCXRGD

SEQ ID NO: 195852 - protein, 114 aa, Triticum aestivum
  unsure (1)..(114): unsure at all Xaa locations
  Clone ID: PAT_TA_90270.pep
KKKKKKXKXKKXSXPXRAXXPKSXSRXRNSGXATMXXSGXNSPXTRFXLXIXLAXXLXASPXWGKXWRXXNLIXXAVKSPXSXXCAXXXNXARXPIGPSQXFXXPXXLXMVEPL

SEQ ID NO: 195853 - protein, 38 aa, Triticum aestivum
  unsure (1)..(38): unsure at all Xaa locations
  Clone ID: PAT_TA_90271.pep
FXRPPGQVXXCFXPXPLKIANTAXLXMCCNTGNSLKSC

SEQ ID NO: 195854 - protein, 123 aa, Triticum aestivum
  unsure (1)..(123): unsure at all Xaa locations
  Clone ID: PAT_TA_90272.pep
RQEVARFPXXLLPEWXLVGXSPXXAXLRRPPXXAHXAXPPGIQLXGXSXTXYPGQTVTVPALXAPXHPVRCGKLGIRLPHXGLFSXLITPHKHPLPXQMXGLHPXWMLSSXXSSTSYLPRTXC

SEQ ID NO: 195855 - protein, 153 aa, Triticum aestivum
  unsure (1)..(153): unsure at all Xaa locations
  Clone ID: PAT_TA_90273.pep
AWSRPRSXSDLQALLCGVLQVIVPKLSNSDAEPIITQNADQLMFLFLRVFACHGSTVHEEAMLAXIGVLADAIGPDFVKYMPXEFFKYLEAGLQNHEEYQXVCSISVGVXGDICRTLEDKXCLPFCDXIMTVLLKDLSNPMLNRVLSXPPFSH

SEQ ID NO: 195856 - protein, 98 aa, Triticum aestivum
  Clone ID: PAT_TA_90274.pep
MKQLQGHMHTHIHTRTPWAEHGRASKQTTRHTHTHPCSTPSDQTLVIHVYSHTNTRTYECMQLNSCRGCTCSCRRSCSPRRTARRPPRNLPGRPLEIT

SEQ ID NO: 195857 - protein, 117 aa, Triticum aestivum
  unsure (1)..(117): unsure at all Xaa locations
  Clone ID: PAT_TA_90275.pep
CXIAHHTREGPHPTLLVRXSLLNFGFCSPFPTSCLHVSFPENLARKKVVRCTHLFHLWRLSLRGRNPGALSGXRXXXKETLGPAXPPLNXXSEIRRPALARFGPIWGXPPQTAVWMP

SEQ ID NO: 195858 - protein, 87 aa, Triticum aestivum
  unsure (1)..(87): unsure at all Xaa locations
  Clone ID: PAT_TA_90276.pep
ISSGRPXRSKSXILAKXFPIFGXKMGYXLXXCTTLIENAXHDGYLKDNFFGFHXLMVFKNHPLQDIXSCXACDKLLQLXKMKNTPLK

SEQ ID NO: 195859 - protein, 53 aa, Triticum aestivum
  unsure (1)..(53): unsure at all Xaa locations
  Clone ID: PAT_TA_90277.pep
XXPAALRLTXGGILRXDGEPXPXXXELNFXEHVXXNQRLGRPXPXGRSNHXVX

SEQ ID NO: 195860 - protein, 115 aa, Triticum aestivum
  unsure (1)..(115): unsure at all Xaa locations
  Clone ID: PAT_TA_90278.pep
MAXAFSSTVGAPASTPTNFLGKKLKKRVTSAVNYHGKSSKANRFTSHGKRKTSTRKXNXXKWEGSCVXISXXTSKXITXRGKGIVDSXLSKRPRAXGTXEGVLSSYXIRSAKGQN

SEQ ID NO: 195861 - protein, 55 aa, Triticum aestivum
  unsure (1)..(55): unsure at all Xaa locations
  Clone ID: PAT_TA_90279.pep
RLXPDXXAKKXDPTGEEXRREXXXTPFKHXNLISDVXSFVXKYRIAXXXLLGMFC

SEQ ID NO: 195862 - protein, 51 aa, Triticum aestivum
  unsure (1)..(51): unsure at all Xaa locations
  Clone ID: PAT_TA_90280.pep
XPXFLLEXRQEIXVIHSIFKFXLSKXCTMXRXTPPFSNFKFEIRLINFXXF

SEQ ID NO: 195863 - protein, 105 aa, Triticum aestivum
  unsure (1)..(105): unsure at all Xaa locations
  Clone ID: PAT_TA_90281.pep
MSRGGSAGGGQSSLGYLFGDGEPAKPAAAPAAKPAPAEKPAPAAADVAKQIPAGIPGSRANNYYRADGQXNTGNFLTXRPSXKVHAAPGGGXSXLGYXFGGKGDC

SEQ ID NO: 195864 - protein, 83 aa, Triticum aestivum
  unsure (1)..(83): unsure at all Xaa locations
  Clone ID: PAT_TA_90282.pep
KGGGNLXKDXSGRPGKGDKISSXKXKXPXXFLKXSTXTTYYGISITIPAXXWXATPXNIXKKXNTFXIMPMXDXVVDNLFXGR

SEQ ID NO: 195865 - protein, 68 aa, Triticum aestivum
  unsure (1)..(68): unsure at all Xaa locations
  Clone ID: PAT_TA_90283.pep
SXXXLVNYSQQMHCXCERXXKPXSQESKVXXGLKIXRLXVLSSSFVKLDSFYHAMYLEKKWCGPSCGG

SEQ ID NO: 195866 - protein, 135 aa, Triticum aestivum
  unsure (1)..(135): unsure at all Xaa locations
  Clone ID: PAT_TA_90284.pep
MMSSSPLFANAPPEKKGVKNFAIDFLMGGVSAAVSKTAAXAPIERVKLLIQNQDEMIKAGRLSEPYKGIGDCFGRTIXDEGFGSLWRGNTANVIRYFPTQXALXFXIQXDYFKRMFKLQRRDKGWTGSGGGHPLL

SEQ ID NO: 195867 - protein, 89 aa, Triticum aestivum
  unsure (1)..(89): unsure at all Xaa locations
  Clone ID: PAT_TA_90285.pep
NIKXGLLPXXRIKNIXIXQPKGVSCNFLXAPPLINFQXXLRKTYLNKWKXKINRILFFFFFKSKKFLFFIHRSSIRHWLKKDRVPPFFF

SEQ ID NO: 195868 - protein, 90 aa, Triticum aestivum
  unsure (1)..(90): unsure at all Xaa locations
  Clone ID: PAT_TA_90286.pep
MKGTKLAAILILQAVLVMGVLSHVNADYFPKCCNNCRSFSGVDVCDDAHPKCPKGCSACRVVSXSPEMWRCADMKSTVDGTCGXGPCKKY

SEQ ID NO: 195869 - protein, 88 aa, Triticum aestivum
  unsure (1)..(88): unsure at all Xaa locations
  Clone ID: PAT_TA_90287.pep
RPAHGGRXNSISLVGGPRFSSFFFFSLVHHLYIDVSMHYNSSDKVHEVPSGVQDHSSRGNNCATTYDRSSSSSKTNLFIRETVELVKQ

SEQ ID NO: 195870 - protein, 74 aa, Triticum aestivum
  unsure (1)..(74): unsure at all Xaa locations
  Clone ID: PAT_TA_90288.pep
IXRXRMRRXRLRRTEXXKXKXXKKXKKKXKMKXKKKKKXKKKKKKKKKKKKXXXKKKKKKKKKISLDLGRHANH

SEQ ID NO: 195871 - protein, 110 aa, Triticum aestivum
  unsure (1)..(110): unsure at all Xaa locations
  Clone ID: PAT_TA_90289.pep
NSLXDXAWXRPXVFFFTSISRHATSPSFIRVEVASIYTXMXSLYKVRAWXGXGNLVMIRYXHYIRRACIXCPHIVYXVLGRRSVTIKPDRSFANCFLERXXGLRQRGCQI

SEQ ID NO: 195872 - protein, 109 aa, Triticum aestivum
  unsure (1)..(109): unsure at all Xaa locations
  Clone ID: PAT_TA_90290.pep
XSSFFFFFFFFFFFFFFFFFTKXPXVGYIFKLXVXTDMHGPNXFLXLXXPLTXDSXXQXPXLTESGXAQIGEXXXHNVYXQGQXXKXRKIXMALEVGXKPXTXFGWISX

SEQ ID NO: 195873 - protein, 99 aa, Triticum aestivum
  unsure (1)..(99): unsure at all Xaa locations
  Clone ID: PAT_TA_90291.pep
MKGTKLAXILILQAVLVMGVLSHVNADYFPKCCNNCRSFSGVDVCDDAHPKCPKGCSSCRVVVDEXPKCGXCAXDMKSTVDGTCGXGPCKKVLIGSCQA

SEQ ID NO: 195874 - protein, 58 aa, Triticum aestivum
  unsure (1)..(58): unsure at all Xaa locations
  Clone ID: PAT_TA_90292.pep
TNLXFFFFFSKNXQXFXDLIYGXIRRTSXXNRPSLFLPVRNFFXSSVFLRVKLTTARG

SEQ ID NO: 195875 - protein, 88 aa, Triticum aestivum
  unsure (1)..(88): unsure at all Xaa locations
  Clone ID: PAT_TA_90293.pep
STPCPRRCENXCPLQTXXAKLPAMLPQLRINAQDIXPSKXKTGMSXDEIGSNVQMQLVSKATKEHTGHRKGIQXXNCKQXRFLLVAXV

SEQ ID NO: 195876 - protein, 144 aa, Triticum aestivum
  unsure (1)..(144): unsure at all Xaa locations
  Clone ID: PAT_TA_90294.pep
XSXIQGGGFQVKCHNVXGPCSXXNVCGXFYAAWXQRPVKGASLXKHXTLXGWRXXXNRXTIRQXFLXSMARXRGXXPKIFXXXKRFXSVPPXKQSXRGXXGLQXFPSLNPSFRXFSMGGGXRXFXPXLRGLGFLPLXFXPVWXS

SEQ ID NO: 195877 - protein, 38 aa, Triticum aestivum
  Clone ID: PAT_TA_90295.pep
LAFHNKSVSGAQEFSRRRNRNTVIKRQTDHCSPRPRPR

SEQ ID NO: 195878 - protein, 127 aa, Triticum aestivum
  unsure (1)..(127): unsure at all Xaa locations
  Clone ID: PAT_TA_90296.pep
ASNXSXALFCACKCKEKSLDVLERKRKWVWHTIGDVTVLCPYVENSNSCQTXXLLVRSVVTPCHEHTLSTQPGWGWQXEALSEASSXKISRQPEPCNGNFSEDXREKKKKITSLQLGSHLGRDHANH

SEQ ID NO: 195879 - protein, 60 aa, Triticum aestivum
  unsure (1)..(60): unsure at all Xaa locations
  Clone ID: PAT_TA_90297.pep
EXXNDXRGXGXXLARXLRFNGPXTRRGDXGVSLTQRPRXSXXRRASXLFFKDXGWLXHHQ

SEQ ID NO: 195880 - protein, 116 aa, Triticum aestivum
  unsure (1)..(116): unsure at all Xaa locations
  Clone ID: PAT_TA_90298.pep
RGRGRGXFFFFFFFFFFFFFFFFFFFRTMDXCXIXLXHDKKSFXFXQXIPKSCPXXXVQLKXTTGPRFKNQMXRGLEPDGXPIKLAHVXXXPGRRRRXARGGRSKSNSRGRQXXAG

SEQ ID NO: 195881 - protein, 134 aa, Triticum aestivum
  unsure (1)..(134): unsure at all Xaa locations
  Clone ID: PAT_TA_90299.pep
FPAAARAGRHRNCRRTIFSSRFRQLTKLRKLVIYKLNIKNEGKLFDELRFSIEDLCXYSLQTLVIDDGSAGFLXSXGXLSSPPXFLNALELSCKLQEKWLIPQKWILGTKSWTHSNRMLSLKMLWYPLMQKQGS

SEQ ID NO: 195882 - protein, 118 aa, Triticum aestivum
  unsure (1)..(118): unsure at all Xaa locations
  Clone ID: PAT_TA_90300.pep
MKGTKLAAILILQAVLVMGLLSHVNADFFPKXCNNCRSFSGVDVCDDAHPKCPQXCSACRVVSTXSPEMWRCAXDMKSTVDGTWGGKMLCVLGPRPTLIEFPRPPWGGGEFNVRGQIP

SEQ ID NO: 195883 - protein, 126 aa, Triticum aestivum
  unsure (1)..(126): unsure at all Xaa locations
  Clone ID: PAT_TA_90301.pep
NSXNFXRXVPFRQHSLNHXLXXPNNXPREXXPXXEPXLXLCLKNGXVKEVXPLXLPHXPRXLVFSPXLLGIPXGXCLDNISSLPLLVSQQVRASQLVLQRALQXHHXQTGNPENFDXHQHSXHDSS

SEQ ID NO: 195884 - protein, 193 aa, Triticum aestivum
  unsure (1)..(193): unsure at all Xaa locations
  Clone ID: PAT_TA_90302.pep
FRAGPAXQGVLPVFFFFFLGTDXNILXFIQLPXHXTNNLXGXGXLXNXXQDCQTPGNGWGDKIFXFNXKQXIIGFLKKXRXGQIFXEXASXXXGGAXLKXAPQSKXSLGKXXXPXGPKGGXKWXRGXMXGGXKXGXPXPWQNKKNLGERFPPWXAGPPEKGANLXXXLPRKLXKGXEXNGWXVXKPTLGKKRG

SEQ ID NO: 195885 - protein, 65 aa, Triticum aestivum
  unsure (1)..(65): unsure at all Xaa locations
  Clone ID: PAT_TA_90303.pep
VXFTLGXXFFRKXKKXKKXSEXVXXTLARAHVNHLLNSPAXPCQXAXIGGPPQPPLDXITFELFX

SEQ ID NO: 195886 - protein, 175 aa, Triticum aestivum
  unsure (1)..(175): unsure at all Xaa locations
  Clone ID: PAT_TA_90304.pep
XLDRKLXTGGAKKARXAXQFDXAFVAKFPXNPXELAPRXEFSPGDLAPLQAXLRFEXPRLVCWELLGKDGRTQREPEAKEGFXHHPXPSPSTPGGCIVXQDQRNLPPGLLPNRKRTVDQEAEYIVEPPQPDCLERLKKSSLKRXPKGNVLAPSTRSLEGNLRLARAPAGNHLXNS

SEQ ID NO: 195887 - protein, 114 aa, Triticum aestivum
  unsure (1)..(114): unsure at all Xaa locations
  Clone ID: PAT_TA_90305.pep
MQXFVKTLTXKTITLEVEXSDNIDNVKXKIQDKEXIPPXXXRLXFAGKXLEDGRTLXXYNIQXKESNLHLVLRLRGGMQIFVKXTLTXKNITPGLESSDINVKAKIQEGPRKQL

SEQ ID NO: 195888 - protein, 65 aa, Triticum aestivum
  unsure (1)..(65): unsure at all Xaa locations
  Clone ID: PAT_TA_90306.pep
YLSSLIXVSGILXYTHXQEDKRIGSLLKNKIWEIXIKKXKTRDXXCPGGRSGRPGXVAGXAXKGP

SEQ ID NO: 195889 - protein, 68 aa, Triticum aestivum
  unsure (1)..(68): unsure at all Xaa locations
  Clone ID: PAT_TA_90307.pep
FRAAARAGELVPRFFFFFFFFFFFFFFFFFFFFFFKXNLPXFXFSFTXLXKTSNLAFQTSKGGSHGRA

SEQ ID NO: 195890 - protein, 107 aa, Triticum aestivum
  unsure (1)..(107): unsure at all Xaa locations
  Clone ID: PAT_TA_90308.pep
KGNRIVDKSSRWCRCSDSGSGQPLVVLXHTXTGRPQACTDPQLGMLNVVKTGDLVSLVSLAPSLPKVGGAANLLXEGAWGEKGTPSXSXLXKWAFSVPKNSKAXANN

SEQ ID NO: 195891 - protein, 74 aa, Triticum aestivum
  Clone ID: PAT_TA_90309.pep
SSPLVPLVGHARDHCVRCCPALASFLAPNAPQRPSETCVLYLGCMQPSRRGNLPESDAKVFTCPGGRSKSLVNS

SEQ ID NO: 195892 - protein, 119 aa, Triticum aestivum
  unsure (1)..(119): unsure at all Xaa locations
  Clone ID: PAT_TA_90310.pep
XGGPRXEGKXNPPGFFFFLRGNKLXPXQMGNGLXNRGKKDXLGDTXXQTGNTNFLXTGEXTXXXXKXXXXXFQXPPGNKKXQKLGRGGAXXKXKXPAGRQWGGXGEAXXTSGAXXPPNR

SEQ ID NO: 195893 - protein, 113 aa, Triticum aestivum
  unsure (1)..(113): unsure at all Xaa locations
  Clone ID: PAT_TA_90311.pep
VQRIKHQDIKLACLKGVKAAAVVTPRRWGRSSWXVWSVHPAGTRQSXLLCPFTSSYATKRWWVCMENVLXVERXXSSXASWVATPXSWPGSSRGQXXCTRLTLXWLLGRXMWP

SEQ ID NO: 195894 - protein, 77 aa, Triticum aestivum
  unsure (1)..(77): unsure at all Xaa locations
  Clone ID: PAT_TA_90312.pep
LXXGTPXVPXRXFFAXRXXVFXXGTGRAAPXKXGXKLWQAXPSGRSAAXSPSALXRIGXPQPIDWXSGAGQAQXLKR

SEQ ID NO: 195895 - protein, 74 aa, Triticum aestivum
  unsure (1)..(74): unsure at all Xaa locations
  Clone ID: PAT_TA_90313.pep
GHRFLPLFFARFDFFGKFPFFFQFFFCKKKKKKKKKKKKKKKKKKKKKKXXRNXFSRERERERERERERERERD

SEQ ID NO: 195896 - protein, 57 aa, Triticum aestivum
  unsure (1)..(57): unsure at all Xaa locations
  Clone ID: PAT_TA_90314.pep
CXXPRPSMPPAGNLIRPPXRAXVGXDPXFNFFCXRSDSFIFFKQGXXFFSLVPXTXX

SEQ ID NO: 195897 - protein, 88 aa, Triticum aestivum
  unsure (1)..(88): unsure at all Xaa locations
  Clone ID: PAT_TA_90315.pep
TYIHVYRSXKTSIXXPPSPKCXXRPNXLTXCXXXKKXXLCXNCLTKFNVKXRXGFFXNQTDVPLXLXLKDELXRKEIKTRXIICCCXQ

SEQ ID NO: 195898 - protein, 134 aa, Triticum aestivum
  unsure (1)..(134): unsure at all Xaa locations
  Clone ID: PAT_TA_90316.pep
LNVVAXEXXXHLRLXQNLCPQXLPPQTXAIPXDXNXSVGQGGENGDDGPXGRKGKXXXCXXAXWGLSXXRPXRKVSSGPSSKXSAXCLXTKLELLPEGVHXDMGEKHXAPXRGWXAXISTCFGPXNKIKIXXLT

SEQ ID NO: 195899 - protein, 165 aa, Triticum aestivum
  unsure (1)..(165): unsure at all Xaa locations
  Clone ID: PAT_TA_90317.pep
NSLXISSXRPGXSAXXLHLRPXTCTPXPGQSRXHQSSPSTXGPSSTKFVKSMVKMGXXNVLTGNQXSNXLGXVPAQXRPXXXRGXAALVCRXGRPKAXCLXLMGFNRFXXXCLVPSXNGFGLXDVXXIXCVNLSXNXNXIXGLXLSXSKKXXCAXFGKKKKKKKK

SEQ ID NO: 195900 - protein, 56 aa, Triticum aestivum
  unsure (1)..(56): unsure at all Xaa locations
  Clone ID: PAT_TA_90318.pep
SFFVNIFVLGTKNYKLSVRAFFXFFALFXFCVVFFVYLEFXCEHFCFRYKKLQTFY

SEQ ID NO: 195901 - protein, 207 aa, Triticum aestivum
  unsure (1)..(207): unsure at all Xaa locations
  Clone ID: PAT_TA_90319.pep
RXWXTHFSLXSRXLXXYSLXXNWXWSXXPVXLPXGSXAKQPHFKTLSSTFWGDLNQEPXXXLFVFXVISTPLNHLKWXTQIQQLXRNFPRNXPIQHQIREFXRNCPVFSXLLLXTGRQDSSPHLLXINHIVPRXWIVALPLVARPFKFGHFLEEAHEVLRVWXHXIXXPGAHAYLXIXFRRXPXRXGPXLXGLPPPXVGCITFGFFF

SEQ ID NO: 195902 - protein, 83 aa, Triticum aestivum
  unsure (1)..(83): unsure at all Xaa locations
  Clone ID: PAT_TA_90320.pep
LFGLCXVLKLFVXXMLWXGGFKXAXXPXFFVXYLWXWPXXTCXMXWPXNWXNXDCTSVGSKFXEKKKKLXXCPGXRSKSLVNS

SEQ ID NO: 195903 - protein, 118 aa, Triticum aestivum
  unsure (1)..(118): unsure at all Xaa locations
  Clone ID: PAT_TA_90321.pep
STVITXNNPTCKARTNYXYLKERKXDDXGNIKIPELIXRRVWXPRRXXTWKXMARESSXAXLVXTPSLVKGPPQXSXGGKSCPSRGRXTRXSRKAXPKEPSXSXSGIXPLPGXTKGCQ

SEQ ID NO: 195904 - protein, 58 aa, Triticum aestivum
  unsure (1)..(58): unsure at all Xaa locations
  Clone ID: PAT_TA_90322.pep
LGXWRSXLLXKGNENNKGFGVPXLHKNSLXLANWKQYIXEXVMLWHMPGXPXEITSEF

SEQ ID NO: 195905 - protein, 56 aa, Triticum aestivum
  unsure (1)..(56): unsure at all Xaa locations
  Clone ID: PAT_TA_90323.pep
NGXXDQFQPXXFWDCPRRMVCSLVGIKLGKPXXXYAFXXDXXXHPRXXPRXSFVNS

SEQ ID NO: 195906 - protein, 77 aa, Triticum aestivum
  unsure (1)..(77): unsure at all Xaa locations
  Clone ID: PAT_TA_90324.pep
YIHXMVSLYXVXHXGRVTCXDTLHTLHRRXASMPHIXYASXPPFRYINRSILALFWKXXXAHGCNXXWXPAGGTLKT

SEQ ID NO: 195907 - protein, 128 aa, Triticum aestivum
  unsure (1)..(128): unsure at all Xaa locations
  Clone ID: PAT_TA_90325.pep
PPPTPIXXXTSLSDAIQTXLQASSYXRDTSXSXVTPMALTQGMMTPXVXFGKVXVAXTPLGXSPLXXKIIVAWTVKGLDPVIXKLXSLQIIELRMKNFGQWNXPEXGGWXGXXAXKXXNPPNSGXKGK

SEQ ID NO: 195908 - protein, 134 aa, Triticum aestivum
  unsure (1)..(134): unsure at all Xaa locations
  Clone ID: PAT_TA_90326.pep
ISKPPEVQPTHWSSERHWDWECXQKLSIRKANNXVXKPAMGREGXXXSKSSKGQWPVXGXSVXPPXXGMWAPCKMGVPTFRGWXDXXPGPGAPXLAXANXXFLXXPXXGSSPXWNFEGATFFPKGGSVGHQPXX

SEQ ID NO: 195909 - protein, 73 aa, Triticum aestivum
  Clone ID: PAT_TA_90327.pep
FRAGRPGRLDDQPDEKACNFEYRLALLSSAYSVFLQMNYYSPFVAATLSALVCKQRMMISSVIIKKKKKKLED

SEQ ID NO: 195910 - protein, 75 aa, Triticum aestivum
  unsure (1)..(75): unsure at all Xaa locations
  Clone ID: PAT_TA_90328.pep
TPSLGYXVXRYLTLWKXPXMLGCTDXXQLINGVEEVKKEYPDAYARIIGFDNMRQVQCVSFIAFKPPXCEESGKA

SEQ ID NO: 195911 - protein, 52 aa, Triticum aestivum
  unsure (1)..(52): unsure at all Xaa locations
  Clone ID: PAT_TA_90329.pep
RXXSPGXHXXXREFDLEXPPXQVXKCXICKNXQCLHVGXNNXSXXIFVGXLV

SEQ ID NO: 195912 - protein, 161 aa, Triticum aestivum
  unsure (1)..(161): unsure at all Xaa locations
  Clone ID: PAT_TA_90330.pep
LAWSRPRSTISPGNLRSERSESLVLLLKMQIFVKTLTGKTITLEVESSDTIDNVKAKIQDKEXIPPDQQRLIFXGKQLEDGRTLADYNIQXKESTLHLVLRLXGGMQXFXKTXTGKTITXXXGSXXTIHNLXXKIQXKXGIPPGXXXAHLSPKETKGWVLL

SEQ ID NO: 195913 - protein, 87 aa, Triticum aestivum
  unsure (1)..(87): unsure at all Xaa locations
  Clone ID: PAT_TA_90331.pep
GRLXLHPMQXRNXXRLLLLQLLDRXXXICMXRAVRASSIISIYYYHTMXPQPDRGPLSMHLTCISSQVPCHDCKQGPLNKISPDLPR

SEQ ID NO: 195914 - protein, 123 aa, Triticum aestivum
  unsure (1)..(123): unsure at all Xaa locations
  Clone ID: PAT_TA_90332.pep
LTGSXPVPMGSKRXLKELKDLQRDXPTSCSAGPVXGDMFHWXGXIMGPXESPXAGGXILGXNXXPPKYQSKPTKGCILKKXVFTQILKTXGXXCSXYSXXEQWXPGNFQKGGPLNLPQKGKPW

SEQ ID NO: 195915 - protein, 68 aa, Triticum aestivum
  unsure (1)..(68): unsure at all Xaa locations
  Clone ID: PAT_TA_90333.pep
NLRAXEQRLNRNSPRGRQWXGRGSNXNVPGPNXALXVXXVXKIHWAVXFXNVRGPGXNPGRLPXLKSP

SEQ ID NO: 195916 - protein, 105 aa, Triticum aestivum
  unsure (1)..(105): unsure at all Xaa locations
  Clone ID: PAT_TA_90334.pep
SKKRXPNXGLEXGSNKVDVXIDLXKPLLKRTVYGFLXXXAVCACXVVXXDAFXCIHXGDISXRXLXKKLXKMXKEGAYWGAVAGVYXGMEYXVERAPXDRXWKNS

SEQ ID NO: 195917 - protein, 90 aa, Triticum aestivum
  unsure (1)..(90): unsure at all Xaa locations
  Clone ID: PAT_TA_90335.pep
MKXXKLAGXLILXAVLVMGVLSXVNADYFPKXCWNNWRSFSGXDVXXEAQPKCPKGCSXCPRGVXTXPEMWRCAGXKSNVDXNCGGACKK

SEQ ID NO: 195918 - protein, 89 aa, Triticum aestivum
  Clone ID: PAT_TA_90336.pep
MKGTKLAAILILQAVLVMGLLSHVNADFFPKCCNNCRSFSGVDVCDDAHPKCPQGCSACRVVSTSPEMWRCADMKSTVDGNCGGPCKKC

SEQ ID NO: 195919 - protein, 69 aa, Triticum aestivum
  unsure (1)..(69): unsure at all Xaa locations
  Clone ID: PAT_TA_90337.pep
KTKXCNQPGGXSPXRGDLQGGRNLPMINVGXXEGPIFFFFFTKVKHEYXVPXKXXTTNPKAMEATPALN

SEQ ID NO: 195920 - protein, 102 aa, Triticum aestivum
  unsure (1)..(102): unsure at all Xaa locations
  Clone ID: PAT_TA_90338.pep
LXDIVDXSRLQEXXLFDXKQFISHMKXYIKTLXXKLEGDDXDAFKKNVESXTKYLLSKLKDLQFFVGESMHDDGGVVFAYYKEGAADPTFLYFAHGLKEVKC

SEQ ID NO: 195921 - protein, 96 aa, Triticum aestivum
  unsure (1)..(96): unsure at all Xaa locations
  Clone ID: PAT_TA_90339.pep
XNFSPNSMLXGXDAXNHLXLIVYSXSNSLAXXFTSNQTTKDKQSEQIPXTEHSTTNXSQKNKPSSXXSSAXHXXRXGKLAFLDXRXLGRRTXLNXF

SEQ ID NO: 195922 - protein, 51 aa, Triticum aestivum
  unsure (1)..(51): unsure at all Xaa locations
  Clone ID: PAT_TA_90340.pep
XEKTNXEFFFFLNQXKXXFKXPXKEFXIHVSHFLQXSXFXRXQNPHSKXXL

SEQ ID NO: 195923 - protein, 89 aa, Triticum aestivum
  unsure (1)..(89): unsure at all Xaa locations
  Clone ID: PAT_TA_90341.pep
NSXKISXXRXGKLXDXTDXXXCNFEXKLAXLSKGYXVFLXMNYYSPXVAATLSALGCXQKXMISTVIIKKKKKKLXXKPRAANXLIXFP

SEQ ID NO: 195924 - protein, 107 aa, Triticum aestivum
  unsure (1)..(107): unsure at all Xaa locations
  Clone ID: PAT_TA_90342.pep
MTXPTELSREENVXMXKLXXQAERYXEMVEXMEXVGXTVXSEEITVXERNLLSVCXKKVIXARRALKGQQSPPFAKRRRSPWPRTRSLNKGVPWRRLKLKICDGNPN

SEQ ID NO: 195925 - protein, 99 aa, Triticum aestivum
  unsure (1)..(99): unsure at all Xaa locations
  Clone ID: PAT_TA_90343.pep
NQXLRXKFSVQAVDEARMXCYXYLXWSLMANGXGDXEDDGDXQSGDDELDLQVLXTKPSAGARALXPEIQGKGLGLVNPXQQSXXXGPXDSXNLVXGFP

SEQ ID NO: 195926 - protein, 165 aa, Triticum aestivum
  unsure (1)..(165): unsure at all Xaa locations
  Clone ID: PAT_TA_90344.pep
NSLINVVAAEVPPSDAGKSLRKRSEGSLVLLLXMRXFVKTLTGXTITLEVESSDTIDNVKAKIQDKEXIPPDXXRLIFAGKXLEDGRTLAGYNIXKESTLHLVLXLRGGMXIFVKTLTGKXITLEVXSSNTNDNVKXKIXDXXGIPPXDXQRLIFSXSNLRNGRT

SEQ ID NO: 195927 - protein, 66 aa, Triticum aestivum
  unsure (1)..(66): unsure at all Xaa locations
  Clone ID: PAT_TA_90345.pep
KNITVLLLLAVNYPLLGKVPLHVTADEYVTIDEKSNQRLTRXLPLLVLVYSPXAREAGDGPXPRPR

SEQ ID NO: 195928 - protein, 76 aa, Triticum aestivum
  unsure (1)..(76): unsure at all Xaa locations
  Clone ID: PAT_TA_90346.pep
WFQLWQKRKPGKXXCGTRTFLKLXXXPXXRIFTXXQGIPKVLGGMGITXXXLLGGXMTXXEXRLNRIGXEVFCXIW

SEQ ID NO: 195929 - protein, 70 aa, Triticum aestivum
  unsure (1)..(70): unsure at all Xaa locations
  Clone ID: PAT_TA_90347.pep
XTXFAALDLFFFXRRXPLNIYXVIIXVXGFLNFXHKKEVGXXALYLKKGFGXXFGKKKPSXXPPLXISEX

SEQ ID NO: 195930 - protein, 102 aa, Triticum aestivum
  unsure (1)..(102): unsure at all Xaa locations
  Clone ID: PAT_TA_90348.pep
NXLMINVVXXEVKNXGLAKMXMXTARXIHPCMVVSKSPRTPPXXFLLHTNKPLTTALSSSFHXTLHSVDVSXDDKPLDAXLETKQXDATAAAAXDLVTPLPG

SEQ ID NO: 195931 - protein, 92 aa, Triticum aestivum
  unsure (1)..(92): unsure at all Xaa locations
  Clone ID: PAT_TA_90349.pep
XKXNAXXIEFDPTFRGXGPDLLCSPPXLAARGXGIWTAPPARXIFFFFFXXXXDXELVKSFIYLXXTERKGXVXLXIXSIWCVXPSHMSFWK

SEQ ID NO: 195932 - protein, 55 aa, Triticum aestivum
  Clone ID: PAT_TA_90350.pep
FKFTVPKGVYPTVIFGMCKCPDGSEAYIYTSTFSKKKKNSRLDLPGGRSKSLVNS

SEQ ID NO: 195933 - protein, 84 aa, Triticum aestivum
  unsure (1)..(84): unsure at all Xaa locations
  Clone ID: PAT_TA_90351.pep
HMSFVXQNHVTNXPAHPSTIIFLSLTDQPTWAKRILSSRFKSTTNQALPPRVIQNRGGXKGXKGGXXAVPCSCWXXGXSTXXXX

SEQ ID NO: 195934 - protein, 155 aa, Triticum aestivum
  unsure (1)..(155): unsure at all Xaa locations
  Clone ID: PAT_TA_90352.pep
XNXPAPHGGXGNXISXVAXEFSXFFFFFFATNAQIIXYSRRIFRIFEQQATPIFLERENTATKTRAYWYTYLLPTHTRIGTMTLLISSELLFHFRRNISCWHEPISTSCRAHRRCRRRWISYPRSATFRGXWTPRGTPSSPWGTWGGRRRRRRPR

SEQ ID NO: 195935 - protein, 107 aa, Triticum aestivum
  unsure (1)..(107): unsure at all Xaa locations
  Clone ID: PAT_TA_90353.pep
CISHYIKATNLVDLLDLGASTAARKPXRPRPCLRACQAPVPWYILAMMGLQEGLQAPSSLSLKLXQPQPKLGWXQATGXAGXKXGSLDSSFLSSSKGSFGGXFFXPW

SEQ ID NO: 195936 - protein, 155 aa, Triticum aestivum
  unsure (1)..(155): unsure at all Xaa locations
  Clone ID: PAT_TA_90354.pep
NSLSDSSGRPGRWHSVLELANMNSLRGTLRIIGLDGVGSKEEAEQALLGNKSSVKVLKLEWGAPSLRQLEEEPAAGCNPAVAVLEGLKPHKPSPSPTYHQGTLGKKSPTWLSEPEKMQKLTRLYLKNCRKLXDFRPWGGLPCLGSGLSRELNNRP

SEQ ID NO: 195937 - protein, 52 aa, Triticum aestivum
  unsure (1)..(52): unsure at all Xaa locations
  Clone ID: PAT_TA_90355.pep
MYXRGLTLVKCTXYNDNDHAXRKHHKYMYDSLVIILYGADXSIRHLPPARAA

SEQ ID NO: 195938 - protein, 100 aa, Triticum aestivum
  unsure (1)..(100): unsure at all Xaa locations
  Clone ID: PAT_TA_90356.pep
XXLPXFLFXFXFSLFFPFLXFSSFLFFPXFLXLQFFXIFQNXPXIKKCSIFENCSVSSNFXXXFKKMFXFLXKWXXXQXXVHVXKQXXAELKKRGGXSXF

SEQ ID NO: 195939 - protein, 101 aa, Triticum aestivum
  unsure (1)..(101): unsure at all Xaa locations
  Clone ID: PAT_TA_90357.pep
MVKAVAVLTGSEGVKGTIFFTQEGYGPTTVTGSVTGLKEGLHGFHVHALGDTTNGCMSTGPHFNPXGHVHGAPEDEIRHAGDLXXNVTSWERDGVAXINVY

SEQ ID NO: 195940 - protein, 111 aa, Triticum aestivum
  unsure (1)..(111): unsure at all Xaa locations
  Clone ID: PAT_TA_90358.pep
MLVYXDKLSGDELLSDSFPYRELENGVLWEVDGHWVVQGAVDVDIGANPSAEGGGDEKGXLTKAVKGXDIVXNXRLQXANLLFXKETIXSLTLKRYNQKNLSXQSFERGMT

SEQ ID NO: 195941 - protein, 46 aa, Triticum aestivum
  Clone ID: PAT_TA_90359.pep
FPRTDFAFIRVSHYIRSSHVAIFKRHGWIQSRRTCRAAARNHLVNS

SEQ ID NO: 195942 - protein, 81 aa, Triticum aestivum
  unsure (1)..(81): unsure at all Xaa locations
  Clone ID: PAT_TA_90360.pep
DVLTFFLNQMYNKHISXRMWXXLXYQKHLIFXXKKKKXXXQNTQKKKKPXTXTCXGXRSKXNSXGRXXGXGXXKFXPNSPX

SEQ ID NO: 195943 - protein, 79 aa, Triticum aestivum
  unsure (1)..(79): unsure at all Xaa locations
  Clone ID: PAT_TA_90361.pep
LWVTKXGNXXRXQKAXXXKKTQXXCSLSXMXRWXNPIXVLVRGXLQXIIKXTRXCMHKXTGGRGXXHXSKXKSKLLLAK

SEQ ID NO: 195944 - protein, 165 aa, Triticum aestivum
  unsure (1)..(165): unsure at all Xaa locations
  Clone ID: PAT_TA_90362.pep
LLAVFGKGXPXGGPLREPGPGGRSIXLXGLXGIGFLLGAFLVXFXRSNLVXPFSQGGFXGXPGFGLFCFPXPVGTTRFXSHPGXGGGPGRTAYSPRXSIRSWXAXIXXXPSQPIIFXSXEPXXALLFALVLYXPLFLPXGXRIVKLXVFFXAQKKTFAGXXVNHX

SEQ ID NO: 195945 - protein, 63 aa, Triticum aestivum
  unsure (1)..(63): unsure at all Xaa locations
  Clone ID: PAT_TA_90363.pep
NXLMINVXXXEGXIXSFFFFFLAREXSFISAXXLWXHXNMTYXKRXRIQRXEVASMGNTKHAR

SEQ ID NO: 195946 - protein, 44 aa, Triticum aestivum
  unsure (1)..(44): unsure at all Xaa locations
  Clone ID: PAT_TA_90364.pep
YRSAVFRXGIXTXPHFMFKLILKQXFLXLKKKKKLXDLDLPGAR

SEQ ID NO: 195947 - protein, 79 aa, Triticum aestivum
  unsure (1)..(79): unsure at all Xaa locations
  Clone ID: PAT_TA_90365.pep
APXSGSGNIGMVVVXRYXRCCTRGACXIDXQXSSXCSRSXRXLXPHLXWVXPXPXFSXXISXPXEXDXPGXPLESXVNS

SEQ ID NO: 195948 - protein, 82 aa, Triticum aestivum
  unsure (1)..(82): unsure at all Xaa locations
  Clone ID: PAT_TA_90366.pep
YFGRPWHGTHAYXRXAHXGQXXTXTLLFPLQALAPXVVGLXLXXGPXGXAPLXXDPVAPGEXLGEVXPVNHRDFXXPLRPEG

SEQ ID NO: 195949 - protein, 104 aa, Triticum aestivum
  unsure (1)..(104): unsure at all Xaa locations
  Clone ID: PAT_TA_90367.pep
PTVEEYRDNSLANSLLCLTXEEFEGILLIXXATTSPVPXCKTFFDTXIVSKNVLYYGTGGVIFMTLILIHRPRHVWVQVLWXYFRFTYYHPSRETSFNNISDIS

SEQ ID NO: 195950 - protein, 89 aa, Triticum aestivum
  unsure (1)..(89): unsure at all Xaa locations
  Clone ID: PAT_TA_90368.pep
QEFLVTXGXXLRPXIWNSRTIPXLDEDGDGEPEEPDDGEXAAVKAEVEXEFFPARXSTXKSTVFCSPPCPHPFSRLLSLXPXPLVXSPX

SEQ ID NO: 195951 - protein, 86 aa, Triticum aestivum
  unsure (1)..(86): unsure at all Xaa locations
  Clone ID: PAT_TA_90369.pep
XRPGELVXSFFFFFYIKRLEXLQVXXXTXXXQVTXTILALKRIHVFTRDNNYSLVXXNLKAXXCXXQXINXWVQPLRPAAXRXGPR

SEQ ID NO: 195952 - protein, 93 aa, Triticum aestivum
  unsure (1)..(93): unsure at all Xaa locations
  Clone ID: PAT_TA_90370.pep
XTKGXVPGFKKRGVQSTGQXXFSRXNITFXTSGRRPXLIXFPXXRXRGGGGSKPXXXGQNXPXXGXRXXKSXGAGXLXTXWTGGKNPGXVTXT

SEQ ID NO: 195953 - protein, 98 aa, Triticum aestivum
  unsure (1)..(98): unsure at all Xaa locations
  Clone ID: PAT_TA_90371.pep
CVXXNAKRENSSRHFPPKXEYANQXSSXWLKSKSXEAXPCPXXKAXIQGKPXGNKLSNQVTYTGAKWGFKXSKKAASXISFLSTFKRGKWTXTLGMGG

SEQ ID NO: 195954 - protein, 90 aa, Triticum aestivum
  unsure (1)..(90): unsure at all Xaa locations
  Clone ID: PAT_TA_90372.pep
SFSFXVXLRVXLILEHXKFXTXXXAISXXXQXXRXLKXXIVFVLLDVSEXXXQSFLKLFKKKKKKKKKKKKKKKKKKKKKXPLGRDHANH

SEQ ID NO: 195955 - protein, 92 aa, Triticum aestivum
  unsure (1)..(92): unsure at all Xaa locations
  Clone ID: PAT_TA_90373.pep
MASIAGSAVSFAKPVKAINXNSLSFSGARRXNAFLXLQPVPMRFAVCCSPKQDTVEKVCEIVXKXLAVPEXXEXCGTTXFSDLGADSLGHRL

SEQ ID NO: 195956 - protein, 112 aa, Triticum aestivum
  unsure (1)..(112): unsure at all Xaa locations
  Clone ID: PAT_TA_90374.pep
XLTWSRPRSSRNXEIQGSRSRSRPGSNGRDGDCXCXRRCHRXRCSRXSWXSXSRPPAXSXSLGMWGPFFQAYHLIXXQGRXPQQGHQXFPEGFHYKVYNPQRXSFAFSXPRA

SEQ ID NO: 195957 - protein, 163 aa, Triticum aestivum
  unsure (1)..(163): unsure at all Xaa locations
  Clone ID: PAT_TA_90375.pep
RGRGRGPICALXALMEGIQILTLEDVVSEADIFVTTTGNKDIIMVDHMRKMKNNAIVCNIGHFDNEIDMNGLETXPGVKRINIKPQTDRWXVFPKTKTGIIVLAEGRLMNLGMCXLGHPNFVMSCSITKQGYCSTLSCGEERPPGKVKKVRSPQSLQRLHLGQ

SEQ ID NO: 195958 - protein, 36 aa, Triticum aestivum
  unsure (1)..(36): unsure at all Xaa locations
  Clone ID: PAT_TA_90376.pep
SRFFFFFFFFFFFFFFFFFFFKFPKKSLXIILILRP

SEQ ID NO: 195959 - protein, 92 aa, Triticum aestivum
  unsure (1)..(92): unsure at all Xaa locations
  Clone ID: PAT_TA_90377.pep
MLVYQDKLSGDELLSDSFPYRELENGVLWEVDGHWVVQGAVDVDIGANPSAEGGGDDEGGDDQAVKXVDIVDTFRLQXEQPAFDKETXYLPK

SEQ ID NO: 195960 - protein, 66 aa, Triticum aestivum
  Clone ID: PAT_TA_90378.pep
VINVVAAEVGNVHCGRCEILLMHPFGAPAVKCSLCLFVTEIGERNVRPRISVEQVTPHQQELANQV

SEQ ID NO: 195961 - protein, 64 aa, Triticum aestivum
  unsure (1)..(64): unsure at all Xaa locations
  Clone ID: PAT_TA_90379.pep
FQATNWTVSSFIIXIHFPPGLXILYKESLRARQPRDQQKNSXHNXQXNLVTNIYLGSLTNKSRE

SEQ ID NO: 195962 - protein, 126 aa, Triticum aestivum
  unsure (1)..(126): unsure at all Xaa locations
  Clone ID: PAT_TA_90380.pep
MKGTKLAXXLILXAVLVMGVLSHVNADYFPKCCNNCRSFSGVDVCDDAQPKCPQGCSACRVVSTSPXMWGLRGYXNPTVDGNLRVGPAXXLLDRFNAGDMFPPKKKIKTSKGRLGQCLIAVCWANA

SEQ ID NO: 195963 - protein, 92 aa, Triticum aestivum
  unsure (1)..(92): unsure at all Xaa locations
  Clone ID: PAT_TA_90381.pep
GPVISNVXPFIDSVVXTLKQPFNGARKGWIXGKXNNLPGAGPPXNSKFXAXPANGRARXSXGERXGAPXSAPYKWXPXXNKFHLXRRFLTTV

SEQ ID NO: 195964 - protein, 124 aa, Triticum aestivum
  unsure (1)..(124): unsure at all Xaa locations
  Clone ID: PAT_TA_90382.pep
MVKAVAVLTGSEGVKGTIFFTQEGEGPTTVTGSVTGLKEGLHGFHVHALGDTTNXCMSTGPHFNPAGSCAXGAPEDEIRHAGXIFGNVTAGVDGCXLSINITDCQYPPLLXPNSNCLGRCLSFQ

SEQ ID NO: 195965 - protein, 93 aa, Triticum aestivum
  unsure (1)..(93): unsure at all Xaa locations
  Clone ID: PAT_TA_90383.pep
FERGQCXVAGKAWIARRQAXSMEISLFSFFFTRVXKGEDDSIAAIQDRLFVPRIQTPGQAXTXPKTSGPGCRRAPXRRPXKSVLXPXWXWRVG

SEQ ID NO: 195966 - protein, 121 aa, Triticum aestivum
  unsure (1)..(121): unsure at all Xaa locations
  Clone ID: PAT_TA_90384.pep
IXXKNDTKNKGXLTQGAGHTPAPXSKVSGRNQAVKSQKKIKXCSRGGWGXTXVNQKRSXPGXXFPLPXXGXTFXXMPXNXXNPGPGVXNXKFXPGXXIGGXGXXLRXIRXXKXALXXEGGI

SEQ ID NO: 195967 - protein, 120 aa, Triticum aestivum
  unsure (1)..(120): unsure at all Xaa locations
  Clone ID: PAT_TA_90385.pep
MVKAVAVLTGSEGVKXTIFFTQEGDGPTTVTGSVTGLKEGAPPASMXHALGDTTNGCMSTGPHFKPXGSCAWGTRKDXNPXHAGRSLXNXTNWXXGLVLLXINXTDCNIPPXLXPKLVGP

SEQ ID NO: 195968 - protein, 137 aa, Triticum aestivum
  unsure (1)..(137): unsure at all Xaa locations
  Clone ID: PAT_TA_90386.pep
MSAYCGKYKDEXLIKNAAYIGTPGKGILAADESTGTIGKRFAXSINVENVEDNRRALRELLFCTPGALQYLXSGVILFEETCTKXTKGGKPFVDILKAGNXLPGKSWDKGHPSLAGNTGETNNPRAFLTLKPLAPNY

SEQ ID NO: 195969 - protein, 92 aa, Triticum aestivum
  unsure (1)..(92): unsure at all Xaa locations
  Clone ID: PAT_TA_90387.pep
MKGTKLAAILILXXVLVMXVLSHVNXAXYFPKCCNXXRSFSGVDXXHDXXPKCPXGCSACRVVSXXSPEMWRCAGXKSTVRGTCGGAPARKY

SEQ ID NO: 195970 - protein, 47 aa, Triticum aestivum
  unsure (1)..(47): unsure at all Xaa locations
  Clone ID: PAT_TA_90388.pep
QAQRPLQFFVGESMHXDDGGVVFAYYKEGAADPTFLYFAHGLKEVKC

SEQ ID NO: 195971 - protein, 111 aa, Triticum aestivum
  unsure (1)..(111): unsure at all Xaa locations
  Clone ID: PAT_TA_90389.pep
NSLNDSSGRPGXPARAASXATXASATPATVXLHALVRTCVGVRVYXNNXRLIXWSPTXVRVRVRVVCLLALPXSAHGVLVCMCVCXCPCNCFIYPHYGWSDEYXRMKDFPN

SEQ ID NO: 195972 - protein, 87 aa, Triticum aestivum
  unsure (1)..(87): unsure at all Xaa locations
  Clone ID: PAT_TA_90390.pep
XXVEXFFFFFFFATSAQSXLXHXGNSGXXEXXXLPCFFSREKTHLLRHXILVYXIXWPHTXAXVXSSCSPXHDTFISFYSGXYQCWW

SEQ ID NO: 195973 - protein, 82 aa, Triticum aestivum
  unsure (1)..(82): unsure at all Xaa locations
  Clone ID: PAT_TA_90391.pep
GPPSSLVTKXNXLTXXGPGTWPGGGAAPKIEXPRGPXMXGAGKQCESPGPKXALKGXSEXKXXRGRSVLXTSVDXGKXPGXX

SEQ ID NO: 195974 - protein, 123 aa, Triticum aestivum
  unsure (1)..(123): unsure at all Xaa locations
  Clone ID: PAT_TA_90392.pep
PTLMLAXCTXKPXIFSLFLAVLSCPIXXWSFYXLSXFXNFSFLXIXXVSFLFPFFDFFKIVQFXYFKKTKFFFLNFXKQVNFANSXPNFMKFLQTXDFFLLLLTXLVXLFPNFLNCFSSLQHV

SEQ ID NO: 195975 - protein, 135 aa, Triticum aestivum
  unsure (1)..(135): unsure at all Xaa locations
  Clone ID: PAT_TA_90393.pep
RVPXTXTQXXQRGXGEVKEGVPLTGYCPHSSGFDNLRPXAVRQXHRLSTPRVGRSPASLKQLTXDRPYIKXHCSFVNFDIALGXPSPFIFSXLVXKNLCMXMFMXELGSEKACSFVIAIXGFXFARTHXFIXFVX

SEQ ID NO: 195976 - protein, 120 aa, Triticum aestivum
  unsure (1)..(120): unsure at all Xaa locations
  Clone ID: PAT_TA_90394.pep
PPXXPXXXPLRXXKNTLENFXXXLTLTSPXQGRVXXTXTTXEKXDXAGIARGXEXSXXVLXVVXVPGALXXRRGNXDXXEGSRXGHPGPPCXGSXRVLQXGLACRXXFWMLXXXRLTMXK

SEQ ID NO: 195977 - protein, 160 aa, Triticum aestivum
  unsure (1)..(160): unsure at all Xaa locations
  Clone ID: PAT_TA_90395.pep
FPAAARAGLXXTVPAYLXKNLFPNILXEEKFWAHPXRXITXAYXKTXKXILSXXPXLGQXGSXAXTAXLIXGSXLWXXNVGDXPAVLLXRGGGIXMXIXHXXNAERGAIXKKGXFVSKMPXXVPTNCGXXXVSXXFXGXESKNTFINLMLIHAEPILSRF

SEQ ID NO: 195978 - protein, 94 aa, Triticum aestivum
  unsure (1)..(94): unsure at all Xaa locations
  Clone ID: PAT_TA_90396.pep
DLXXQNLSFPSXXVERRGPKFCQVNXAXFLXYHCFFIEVAEKXXLAGPFFXEPTXFXSHXXXLSEXCQXFGXFXXEIRNFWTQXXXARXPAWNL

SEQ ID NO: 195979 - protein, 141 aa, Triticum aestivum
  unsure (1)..(141): unsure at all Xaa locations
  Clone ID: PAT_TA_90397.pep
KSXGGCXNXXPLLFLGXEDXKFCMIRXGXNRXPKDXLXPXCSSCXCXIIPSXSGSXLCCSLPTMESFDSGXPHKYSVTXWYPQIXQDTCFCXXXTNFVGIXFNGNNVSSPPKKKKKKKKKKKKXXDLVHLGRXHVNHLVNS

SEQ ID NO: 195980 - protein, 65 aa, Triticum aestivum
  unsure (1)..(65): unsure at all Xaa locations
  Clone ID: PAT_TA_90398.pep
NSLVISSGRPGRSSPEVFFFFFFFFFFFFFFFFFWEQXXTLLIHSNXIPXGSXPIIXPNNKYXRX

SEQ ID NO: 195981 - protein, 75 aa, Triticum aestivum
  unsure (1)..(75): unsure at all Xaa locations
  Clone ID: PAT_TA_90399.pep
LKIEIYXNFFFFSSNPKNFSFFIHRFVDSALVKKGAGCPXFFXVNSSNHFIDMSVLYQINFTLAISRLNSVLILI

SEQ ID NO: 195982 - protein, 95 aa, Triticum aestivum
  unsure (1)..(95): unsure at all Xaa locations
  Clone ID: PAT_TA_90400.pep
FXNPGGSAGGXQSSLGYLFGDGEPAKPAAAPTAKPAPAEKXTPAAADVSKXIPAGIPCSRANKYYRADXQNXGNFLXDRPSTKXHAAPGGGSSLG

SEQ ID NO: 195983 - protein, 127 aa, Triticum aestivum
  unsure (1)..(127): unsure at all Xaa locations
  Clone ID: PAT_TA_90401.pep
MGGXLTDXQXAXFKEGFXLXHKDGDGXIXXKELGTVXRSLXXKPTEGGLQEXIXQGXXXRGKGTTNFPSXLKLXGRXIXDTDSXEELXXGFPXVXXKDKKGFXSXGCANNEPNLPGNAKGGGAIFEG

SEQ ID NO: 195984 - protein, 117 aa, Triticum aestivum
  unsure (1)..(117): unsure at all Xaa locations
  Clone ID: PAT_TA_90402.pep
PGCPXXXFFWXWXPGXIXNSPXXPXDPXAHDPXFXWXLLXRALTPLVFPXPALLTLTRFVRAAXFYXXYCPPGRCPALFTPVRGLXLPKQCKDRSFYVTERRXRRIXYXRHQCMPLM

SEQ ID NO: 195985 - protein, 66 aa, Triticum aestivum
  unsure (1)..(66): unsure at all Xaa locations
  Clone ID: PAT_TA_90403.pep
MRVASILTLSEKLRRHIASRVLTLPWCHKSSLFPKLLKSTDLLCCPDGTHQKRLLSVRTTPRPXPR

SEQ ID NO: 195986 - protein, 61 aa, Triticum aestivum
  Clone ID: PAT_TA_90404.pep
VFFLNHVLVVFSLLRVYYVRSVLIMISEAMLTSCIIVFLKIDPPNSCSLITDPVKSSLDFK

SEQ ID NO: 195987 - protein, 86 aa, Triticum aestivum
  unsure (1)..(86): unsure at all Xaa locations
  Clone ID: PAT_TA_90405.pep
LGXIFRXEHNGIPXGXYDGRXTWTMWKLPMFGCTDATQVINEVEEVKKEYPDAYVRIIGXXNMRQVQCVSXFIAFKPPGCEESGKA

SEQ ID NO: 195988 - protein, 90 aa, Triticum aestivum
  unsure (1)..(90): unsure at all Xaa locations
  Clone ID: PAT_TA_90406.pep
NSLVISVVXXEVLQVVXXMGXLSHVXADFFPKXCXKCRSFSGVDVCDDAHPKCPQCCSVCRVVSTSPEMWRCADMKSTXDGTCXGXCXKY

SEQ ID NO: 195989 - protein, 126 aa, Triticum aestivum
  unsure (1)..(126): unsure at all Xaa locations
  Clone ID: PAT_TA_90407.pep
NSLXIXVVAAEVRERTSLEFFFFFFFLQSIIATVIYKVVSLILNIIELELLSNEQSCNSYISRYKSTREKTGILQYKKTGRDXINLDRSVLLDRSTWXTSSSGAQDTFKLPLPSHPVPSLFNPMAG

SEQ ID NO: 195990 - protein, 80 aa, Triticum aestivum
  unsure (1)..(80): unsure at all Xaa locations
  Clone ID: PAT_TA_90408.pep
MAAGGNWIGPPRAGRRXLXLDNTFWNGSVVFPADAPLXKYIRXYXDFVXELNKAFAADQXXEXCQLPXVXDGITXCRRAK

SEQ ID NO: 195991 - protein, 159 aa, Triticum aestivum
  unsure (1)..(159): unsure at all Xaa locations
  Clone ID: PAT_TA_90409.pep
NXLXIXAGARAXXRXDMNGLETYPGCQAHHHQAPRPDRWGLPPRPXLGIIVLAEGVRLDETLXCANWATPNLWSCPXLNSTKPKVIASNLGSLWGTXXXAKWAKVXNKRKGWLRFLPXKXPXNGRKGSAGXPPNFGAKASXRPKALXQSLNQKVPKVXD

SEQ ID NO: 195992 - protein, 111 aa, Triticum aestivum
  unsure (1)..(111): unsure at all Xaa locations
  Clone ID: PAT_TA_90410.pep
MSAYCGKYKDELIKNAAYIGTPGKGILAADESTGTIGKRFASINVENVEDNRRALRELLFCTPGALQYLSGVILFEETLYQKXTKGGKPFVDILXXGNVLPGNQGTVTIEL

SEQ ID NO: 195993 - protein, 54 aa, Triticum aestivum
  unsure (1)..(54): unsure at all Xaa locations
  Clone ID: PAT_TA_90411.pep
PQSIFFSQASRFSFFVGESMHDDGGVXVFAYYKEGAXAXPTFLYFAHGLKEVKC

SEQ ID NO: 195994 - protein, 52 aa, Triticum aestivum
  Clone ID: PAT_TA_90412.pep
NSLVISVVAAEVDPFASAAAAADDDDLYKLNPFAFVDVVLRYAVHGRTMFLS

SEQ ID NO: 195995 - protein, 62 aa, Triticum aestivum; identical to SEQ ID NO: 106970
  Clone ID: PAT_TA_90413.pep

SEQ ID NO: 195996 - protein, 74 aa, Triticum aestivum
  Clone ID: PAT_TA_90414.pep
GYQRWGRHELILLLATNCYGDCRNWNNLIISTALPSCLREIIRSAKFICFNRRIVVTAKKKNSRLDLGRDHANH

SEQ ID NO: 195997 - protein, 111 aa, Triticum aestivum
  unsure (1)..(111): unsure at all Xaa locations
  Clone ID: PAT_TA_90415.pep
IFFXLLHLXKXCKVQNPWNRLLGGTVXVSRXLVDVXXGFSXEXXGFFXFYYXTVXEASPFHXXGFIXXGLQEKXXIHGTPXVQKKKKKKKKKKKKKKKKKKKXLGRDHANH

SEQ ID NO: 195998 - protein, 91 aa, Triticum aestivum
  unsure (1)..(91): unsure at all Xaa locations
  Clone ID: PAT_TA_90416.pep
LXXXPGNQTEVGGGQRRSTLTXYVRHHXDXDNMRQVPVRQLHRLQATGLRGVRQGLNSFTHDRPYIKCHCSFVNSDIALGFPSPFIFLICS

SEQ ID NO: 195999 - protein, 140 aa, Triticum aestivum
  unsure (1)..(140): unsure at all Xaa locations
  Clone ID: PAT_TA_90417.pep
ERXXELXSSFFFFFLQLKQDILXLSKRQPXTHRPXHGWIYXLTMQQLRITHTHTXTHXXQQFIQCINXXMXLKQXTHXCXXTWPSIXTXXYNXHTHFFMHMHTICYITXRGRFKFXXXAXLGNSWEXXXGSXGXXKFXTX

SEQ ID NO: 196000 - protein, 101 aa, Triticum aestivum
  unsure (1)..(101): unsure at all Xaa locations
  Clone ID: PAT_TA_90418.pep
XGVWGTXRGPDAPXXDKEFRLFKLQGTPISTXNSQFQFQGWLNNSSTLMNGPVCLFVSXQLSTYPTTWIKQYHLRFRLRSTNSTFIYFVFHPTSTTMNWLF

SEQ ID NO: 196001 - protein, 80 aa, Triticum aestivum
  unsure (1)..(80): unsure at all Xaa locations
  Clone ID: PAT_TA_90419.pep
FXXGXRAKXQXFFLFFXKXXTXXGXTXFAXXXGKTTPPTKAXLXWXGIPFXKXNKXFHATXWGTSLXGGEXVSNYKLKXR

SEQ ID NO: 196002 - protein, 101 aa, Triticum aestivum
  unsure (1)..(101): unsure at all Xaa locations
  Clone ID: PAT_TA_90420.pep
MKGTKLAAILILQAVLVMGVLSHVNADFFPKCCXNCRSFSGVDVCDDAHPKCPKGCSAFRVGVDXSPEMWGCAGYENXPSTGTCGGTLQRSTDWFNARQNE

SEQ ID NO: 196003 - protein, 48 aa, Triticum aestivum
  unsure (1)..(48): unsure at all Xaa locations
  Clone ID: PAT_TA_90421.pep
LAXSRPRFXLEYRQEILVIHSIFKFYLSKPCTMHRXTPPFSNFKFEIL

SEQ ID NO: 196004 - protein, 34 aa, Triticum aestivum
  Clone ID: PAT_TA_90422.pep
LGTILENILHRFKWEGAYLDLSSVISSHNNIKVD

SEQ ID NO: 196005 - protein, 95 aa, Triticum aestivum
  unsure (1)..(95): unsure at all Xaa locations
  Clone ID: PAT_TA_90423.pep
KRXGGPLFFLVNSSNHFIXMXVLYQXNFXLXISRLNSVXKXKXLXKXXXFLPGLQASLXLTGLXGXXILGLXKNKVXLPMSXRKXARXGXPKXNS

SEQ ID NO: 196006 - protein, 57 aa, Triticum aestivum
  Clone ID: PAT_TA_90424.pep
FFLMKLKLLKRANKNKETTLLTMIYFYLGGRSPLNIYPKSYIGFGILKYKHKNEDRG

SEQ ID NO: 196007 - protein, 70 aa, Triticum aestivum
  unsure (1)..(70): unsure at all Xaa locations
  Clone ID: PAT_TA_90425.pep
LXWXPAGGIXCIIMGXKVAAMKXVWCMEXNPMGLXFLKKLVXGKXXLIGPNKRLLXFLNNDXKIGGFFFH

SEQ ID NO: 196008 - protein, 52 aa, Triticum aestivum
  unsure (1)..(52): unsure at all Xaa locations
  Clone ID: PAT_TA_90426.pep
HVFVMLIGSSLSYSLHKLFPCSLMDRPVAPRNTVLLNLKKKKXKKKKKKTRD

SEQ ID NO: 196009 - protein, 33 aa, Triticum aestivum
  unsure (1)..(33): unsure at all Xaa locations
  Clone ID: PAT_TA_90427.pep
RTSLEXFFFFFFFFFFFFFFFFFFFFLNPKSVH

SEQ ID NO: 196010 - protein, 38 aa, Triticum aestivum; identical to SEQ ID NO: 195877
  Clone ID: PAT_TA_90428.pep

SEQ ID NO: 196011 - protein, 133 aa, Triticum aestivum
  unsure (1)..(133): unsure at all Xaa locations
  Clone ID: PAT_TA_90429.pep
EFTNGLTVVPXXVRRHRXLLRXXGPXSLPPXAGAIPGDDSGXXGQGGENGDDGPXGRXGKXQRVLPLRGGXSXTRPLLGKVSSWDHPSKKGSRTXXPRGTXPGXLFPXKGRSQXTXXXGXXXAXGAPLXXXGX

SEQ ID NO: 196012 - protein, 95 aa, Triticum aestivum
  unsure (1)..(95): unsure at all Xaa locations
  Clone ID: PAT_TA_90430.pep
NSXALGGDRXKQLQGXTWHXTXLHXXGTXMXQSIGRAXQANXXRTRHXXPCSTPSDQTXVIHVYSHTNTRTYECMQLNSCRGCTCSCRRSCSPRR

SEQ ID NO: 196013 - protein, 91 aa, Triticum aestivum
  unsure (1)..(91): unsure at all Xaa locations
  Clone ID: PAT_TA_90431.pep
MSDTDEHHFESKAXSGASKTYPQQAGAIRKGGHIVIKARPCKVVEVSTSXDWGRHGHPKCHFVAIDIXNGKXLEDIXXFIXTXCXRPPCTA

SEQ ID NO: 196014 - protein, 78 aa, Triticum aestivum
  unsure (1)..(78): unsure at all Xaa locations
  Clone ID: PAT_TA_90432.pep
VIXKRAARGKSXGRXGXGVPNKRXXAVRKAXGSXXSXPRAAFKVAQXQXLRXXAXGXSLXXXCPEPSTLQXFKXWPFX

SEQ ID NO: 196015 - protein, 53 aa, Triticum aestivum
  unsure (1)..(53): unsure at all Xaa locations
  Clone ID: PAT_TA_90433.pep
MKGXKLAEILIXQAVLXKGXHSHVXADFFPXCCNNCRSFSGVXXCDDAXXKCP

SEQ ID NO: 196016 - protein, 73 aa, Triticum aestivum
  unsure (1)..(73): unsure at all Xaa locations
  Clone ID: PAT_TA_90434.pep
GCCLVNLMQAXFGYXVIFSKXQNRCVLYICXQXTTXWSXYCTTXQKKKKKKKKKKKKKKKNSRLHLGRDHANH

SEQ ID NO: 196017 - protein, 68 aa, Triticum aestivum
  unsure (1)..(68): unsure at all Xaa locations
  Clone ID: PAT_TA_90435.pep
SRVFFFFFFFFFKNXHLRXXSLKXHTKYDHQXPKDFKXXXXTXIKXXXEXNTTXLXPIIMXLFLGKSK

SEQ ID NO: 196018 - protein, 68 aa, Triticum aestivum
  unsure (1)..(68): unsure at all Xaa locations
  Clone ID: PAT_TA_90436.pep
MXHXFITXLXSLALNXWSFGFXSFXFPLVGGRAXLLXEEGAEQGGVHVVDHLSXSSLLLLRCRRRRTS

SEQ ID NO: 196019 - protein, 44 aa, Triticum aestivum
  Clone ID: PAT_TA_90437.pep
MPRSRVNGNFIDKTSSIVANILLRIIPTTSGEKKAFTYYRDGAI

SEQ ID NO: 196020 - protein, 94 aa, Triticum aestivum
  unsure (1)..(94): unsure at all Xaa locations
  Clone ID: PAT_TA_90438.pep
MKGTKLXAILILQAVLVMGLLSHVNADFFPKCCNNCRSFSGVDVCXDAXPKCPXGCXAXPPWCRPKCGRWLKSTRLTGVGPRKLIGLPGMFPPK

SEQ ID NO: 196021 - protein, 59 aa, Triticum aestivum
  unsure (1)..(59): unsure at all Xaa locations
  Clone ID: PAT_TA_90439.pep
SVVAAEVSSFFFFFFFXFFXATNXQSLXIHGGYSGYLNNKHHQFFSXSEKXQRXXHGNX

SEQ ID NO: 196022 - protein, 114 aa, Triticum aestivum
  unsure (1)..(114): unsure at all Xaa locations
  Clone ID: PAT_TA_90440.pep
XVXVLRKSMXAQLYIMFLPXFXVXAKXVPLSXCNGDXRSFXLGXLRVLFVGCXRHCRFWVGVLLXTGRCMFXXXDGANSRXLFVGIXXXKNXATWGFXWFXXWRXEXFNGNNXN

SEQ ID NO: 196023 - protein, 63 aa, Triticum aestivum
  Clone ID: PAT_TA_90441.pep
DYFPKCCNNCRSFSGVDVCDDAHPKCPKGCSACRVVSTSPEMWRCADMKSTVDGTCGGPCKKY

SEQ ID NO: 196024 - protein, 74 aa, Triticum aestivum
  unsure (1)..(74): unsure at all Xaa locations
  Clone ID: PAT_TA_90442.pep
LGVLRLPGIWTXWKLPXFGCTXDATQVINXEVEEVKKEYPDAYVRIIGFDNMRQVQCVSFIAFKPPGCEESGKA

SEQ ID NO: 196025 - protein, 97 aa, Triticum aestivum
  unsure (1)..(97): unsure at all Xaa locations
  Clone ID: PAT_TA_90443.pep
WNLVXEXGQRVXXXTQXGQXXLGXKQLYTIYNTEITNRSXLRLLTSHYFPXWGXSTEXAGXRXSFFFFFFLQTKMQAQQVSNYPSASISSLSFQYNN

SEQ ID NO: 196026 - protein, 106 aa, Triticum aestivum
  unsure (1)..(106): unsure at all Xaa locations
  Clone ID: PAT_TA_90444.pep
MKGTKLAAILILQAVLVMGVLSHVNADYFPKCCNNCRSFSGVDVCDDAHPKCPKGCSACRVVXTKPPKCWRXADIKTNXVKGTCGGPWKEVMSMATMISRPELKKT

SEQ ID NO: 196027 - protein, 73 aa, Triticum aestivum
  unsure (1)..(73): unsure at all Xaa locations
  Clone ID: PAT_TA_90445.pep
LWVAREGDDLGGQXAVRSKKTHRVCSLSPMEXWXSPVHVLVRRRLXSIIKKTRACMHRSTXXMRXXXLKHVXV

SEQ ID NO: 196028 - protein, 90 aa, Triticum aestivum
  unsure (1)..(90): unsure at all Xaa locations
  Clone ID: PAT_TA_90446.pep
THLMLSXLXGTARXXPSXLAGXXRXXVWGXDIALFEKEXXEAAFVXXSCYXGGSXVAGQGXXLXYIIQDNNSSHVILRKQKKKKPARXAA

SEQ ID NO: 196029 - protein, 78 aa, Triticum aestivum
  unsure (1)..(78): unsure at all Xaa locations
  Clone ID: PAT_TA_90447.pep
TXFXXPGRLLRTSFIXXGWDDLPGRXXPXPGRSXIVXDXRFFXMRNRSXXLPTXFFFSFLFRVLLFSFSXFSXSXXGF

SEQ ID NO: 196030 - protein, 107 aa, Triticum aestivum
  unsure (1)..(107): unsure at all Xaa locations
  Clone ID: PAT_TA_90448.pep
ERPPGQVQSSPLRSKRSQGSFVLLLKMXIFVKTLTGKTITLEVESSDTIDNVKAKIQDKEGIPPDQQXRLIFAXKQLEDGRXLADYXIXXXSTLHLCSSVVACKFQP

SEQ ID NO: 196031 - protein, 144 aa, Triticum aestivum
  unsure (1)..(144): unsure at all Xaa locations
  Clone ID: PAT_TA_90449.pep
AWSRPRWSTNLDWYKGPTLLEALDQINEPKRPSDKPLRLPLQDVYKIGGIGTVPVGRVETGVIKPGMVVTFGPTGLTTEVKSVEMQHESLLEGASXGDNVGFNVKNVGRQRSQSVXYVASNSKGRTLPKGVNRPSSIMKPLGQD

SEQ ID NO: 196032 - protein, 47 aa, Triticum aestivum
  unsure (1)..(47): unsure at all Xaa locations
  Clone ID: PAT_TA_90450.pep
RGRGRGLEFFFFFFFFFFFFFFFFFFFFFFFLXXKXGFNQKNMSQVG

SEQ ID NO: 196033 - protein, 58 aa, Triticum aestivum
  Clone ID: PAT_TA_90451.pep
RNMHKNDAWLLSHNYYVSYMIMQSNDNECSSHQKEAVEVAWQYILEWPWKSHLGRDHA

SEQ ID NO: 196034 - protein, 53 aa, Triticum aestivum
  Clone ID: PAT_TA_90452.pep
KSHYNILSYALVFFCFLFLCVFIFPFFALLVIFCFCGFLAECNFGAKLCAICF

SEQ ID NO: 196035 - protein, 119 aa, Triticum aestivum
  unsure (1)..(119): unsure at all Xaa locations
  Clone ID: PAT_TA_90453.pep
RAAARAGGRGYLLVLLYGKLDLDFFCCLSFFWHSLCFLVEECGLFSQEFERKEGTQYFLRGQWRNHAFLHLGTGRTARTSLTPRSSRVHGRTKKQXFTPIQTXQDIXNPDPXRXSPLKP

SEQ ID NO: 196036 - protein, 65 aa, Triticum aestivum
  unsure (1)..(65): unsure at all Xaa locations
  Clone ID: PAT_TA_90454.pep
ARAGEMYXSPCLXFVXKRNHXXVIXXVSVYLEXSHXMNHHLXDQKKKKKKKKKKKKKKTSAATTP

SEQ ID NO: 196037 - protein, 123 aa, Triticum aestivum
  unsure (1)..(123): unsure at all Xaa locations
  Clone ID: PAT_TA_90455.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRXIVRATKKGSAVQRPRNXTLTAVQ

SEQ ID NO: 196038 - protein, 63 aa, Triticum aestivum; identical to SEQ ID NO: 196023
  Clone ID: PAT_TA_90456.pep

SEQ ID NO: 196039 - protein, 87 aa, Triticum aestivum
  unsure (1)..(87): unsure at all Xaa locations
  Clone ID: PAT_TA_90457.pep
GPPMXGPREFRFRAWSAAXGNLLTKNLNXNNFXVLKNENMHIFLNLQTIVLKREHLLIHEQFLKNEHFLNXCPKFEXXXSFQKLNIF

SEQ ID NO: 196040 - protein, 60 aa, Triticum aestivum
  unsure (1)..(60): unsure at all Xaa locations
  Clone ID: PAT_TA_90458.pep
SSGRPGRSAGKXGXKRPQXXXFAFXTXSEVDXLXDGYXWXNYXQKXVXNSXFXRXYYRCT

SEQ ID NO: 196041 - protein, 123 aa, Triticum aestivum
  unsure (1)..(123): unsure at all Xaa locations
  Clone ID: PAT_TA_90459.pep
MASIAGSAVSFAKPVKAINTNSLSFSGARRGNAFLRLQPVPMRFAVCCSAKQDTVEKVCEIVKKQLAVPEGTEXVCGXNXFSXLGADSTGTRXENVMGPXXEEVSRLSVGGRAQRKFANWEWT

SEQ ID NO: 196042 - protein, 41 aa, Triticum aestivum
  unsure (1)..(41): unsure at all Xaa locations
  Clone ID: PAT_TA_90460.pep
KXNEXQYFFSXVLSYSFXKXIRTGFGESXNNFIGKIXVXKL

SEQ ID NO: 196043 - protein, 80 aa, Triticum aestivum
  unsure (1)..(80): unsure at all Xaa locations
  Clone ID: PAT_TA_90461.pep
RARFFFFFYRXGSQIXIKNXXESQIXGAXNSPYLXXXGLXAIXXXTKDTXIFHXTLLVXIHTRGPKDGWPKEATPRPRPR

SEQ ID NO: 196044 - protein, 45 aa, Triticum aestivum
  unsure (1)..(45): unsure at all Xaa locations
  Clone ID: PAT_TA_90462.pep
KIXYQLLNXXSXLKKKKKKKKKKKKKKKKKKKKLETSSPAWAAAR

SEQ ID NO: 196045 - protein, 75 aa, Triticum aestivum; identical to SEQ ID NO: 117166
  Clone ID: PAT_TA_90463.pep

SEQ ID NO: 196046 - protein, 74 aa, Triticum aestivum
  unsure (1)..(74): unsure at all Xaa locations
  Clone ID: PAT_TA_90464.pep
ERXPGQVSSFFFFFLFKXRICVHXHXEYRXXTHSTXGDDNIIXGXLWENRKSXXFSRXTRLLXEILXDRFXPSM

SEQ ID NO: 196047 - protein, 112 aa, Triticum aestivum
  unsure (1)..(112): unsure at all Xaa locations
  Clone ID: PAT_TA_90465.pep
MKGTKLAAILILQGXSWVMGVLSHVNADYFPKCCNNCRSFSGVDVCEDAQPKCPXGCSAXRVVSNNPEMXWRCRXLKSTXXGTGXGPXKNYNANIFSPKMKLKAKTGKRPLM

SEQ ID NO: 196048 - protein, 101 aa, Triticum aestivum
  unsure (1)..(101): unsure at all Xaa locations
  Clone ID: PAT_TA_90466.pep
MKGTKLAAILILQAVLVMGVLSHVNADFFPKCCNNCRSFSGVDVCDDAHPKCPRAAPACRVGVDXTPEMWRCADMKSXTVDXXCXGPCKNTDRMPDMICSA

SEQ ID NO: 196049 - protein, 122 aa, Triticum aestivum
  unsure (1)..(122): unsure at all Xaa locations
  Clone ID: PAT_TA_90467.pep
SVVAAEVKAERERGITIDIALWKFETTKYYCTVIDAPGHRDFIKNMITGTSQADCAVLIIDSTTGGFEAGISKDGQDXVKHALLAFTLGVKQXMICCCNKDGRQQLPKLLKRARLRKNEVSS

SEQ ID NO: 196050 - protein, 45 aa, Triticum aestivum
  unsure (1)..(45): unsure at all Xaa locations
  Clone ID: PAT_TA_90468.pep
EVLXDQIXXXPDLPRVXWYIYVXERXGIXFIKKKVLXVXAETXAT

SEQ ID NO: 196051 - protein, 68 aa, Triticum aestivum
  unsure (1)..(68): unsure at all Xaa locations
  Clone ID: PAT_TA_90469.pep
GWXXGXSXETLLFETLANSRPVCCSPQRRNSEGAGGGSGGARACMRRDGEEGCGGDGGGCCRPRPRPR

SEQ ID NO: 196052 - protein, 47 aa, Triticum aestivum
  Clone ID: PAT_TA_90470.pep
RAWSRPRFFFFFFFFFFFFFFFFFFFFFFFNRKNANLKPGKKLLRSF

SEQ ID NO: 196053 - protein, 130 aa, Triticum aestivum
  unsure (1)..(130): unsure at all Xaa locations
  Clone ID: PAT_TA_90471.pep
MEGKEEDVRLGANRYSEHQPIGTAAQGGGADXKDYKEPPPAPFFEGGELXSWSFYRAGIAEFLXXFLFLXISVLXVMGVVGNPSGFKCGXVGTQXIXWSFRXMVFXAXLMEPPGFPGGXLNPAXNXGVVL

SEQ ID NO: 196054 - protein, 83 aa, Triticum aestivum
  Clone ID: PAT_TA_90472.pep
ATNAQSLLIHGGYSGYLNNKQHQLFLERENTATKTRHTGIHICWPHTRIGTMTLLISSELLFHFRRNISCWHESISNLPGRPL

SEQ ID NO: 196055 - protein, 49 aa, Triticum aestivum
  Clone ID: PAT_TA_90473.pep
FKFTVPKGVYPTVIFGMCKCPDGSEAYIYTSTFSKKKKNSRLDLPGGRS

SEQ ID NO: 196056 - protein, 101 aa, Triticum aestivum
  Clone ID: PAT_TA_90474.pep
AWSRPRSAVIGVFYEIGAHDAFLHKLEPYLEMIADRKDREEKMGMMDPRGARGKASVYYRYVGSLNNPPLLGKVSSWQSVKGGPATVVRGNQAWEPPGKAQ

SEQ ID NO: 196057 - protein, 109 aa, Triticum aestivum
  unsure (1)..(109): unsure at all Xaa locations
  Clone ID: PAT_TA_90475.pep
MQIFVKTLTGKTITLEVESSDTIDNVKAKIQXDKEGIPPDQAAPDLCWASKLEDGRTLAXDYNXQKESNLXLXVLRPXVGGMQXFGEDPQXGKTNQLWEGEAPDNLTNG

SEQ ID NO: 196058 - protein, 81 aa, Triticum aestivum
  unsure (1)..(81): unsure at all Xaa locations
  Clone ID: PAT_TA_90476.pep
RGRGRGFFFFFFFRITGQNLLIQPKHNHTNFTITITKXIPQLSEXFQRHSTSDKLLDNKHWXKSAWTTNKIKSKNTWXNKN

SEQ ID NO: 196059 - protein, 157 aa, Triticum aestivum
  unsure (1)..(157): unsure at all Xaa locations
  Clone ID: PAT_TA_90477.pep
SVVAAEVNPHPISSPIDSRARRILLPHRLKMQIFVKTLTGKTITLEVESSDTIDNVKAKIQDKEGIPPDQQRLIFAGKQLEDGRTLADYNIQKESNLHLVLRLRGXGCXIFVKNLNGKDNTLXVEKXLTPIDXVKXKDSXXKEGESPGTQAAWILGW

SEQ ID NO: 196060 - protein, 138 aa, Triticum aestivum
  unsure (1)..(138): unsure at all Xaa locations
  Clone ID: PAT_TA_90478.pep
AWSRPRWSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDXKRGYVPSNSKGRTFQGRVANFNGQVHQ

SEQ ID NO: 196061 - protein, 105 aa, Triticum aestivum
  Clone ID: PAT_TA_90479.pep
MKGTKLAAILILQAVLVMGVLSHVNADYFPKCCNNCRSFSGVDVCDDAHPKCPKGCSACRVVSTSPEMWRCADIKSNVHGHLAWGPGKEITSCQMIFFRLKLNKS

SEQ ID NO: 196062 - protein, 46 aa, Triticum aestivum
  unsure (1)..(46): unsure at all Xaa locations
  Clone ID: PAT_TA_90480.pep
ERPPGQVSFFFFFFFFFFFFFFFFFFFFFXIKKXFFXERKKAYLLH

SEQ ID NO: 196063 - protein, 49 aa, Triticum aestivum
  Clone ID: PAT_TA_90481.pep
SRVFFFFLQFNLCLFIITSTTNKTQSWNYLLIELDIVLQNSHSFDGDTP

SEQ ID NO: 196064 - protein, 110 aa, Triticum aestivum
  unsure (1)..(110): unsure at all Xaa locations
  Clone ID: PAT_TA_90482.pep
XXLPFXGXWXRRXIXPAPPWXPRXIRLXWSRPRFFXKPWKEREYNPQIFXCSFXTQLVYVCSNSKKKNRTSFLFLXXNRSFXFGIXPFYQYXAFFTHSXHNIPYSIHNQE

SEQ ID NO: 196065 - protein, 43 aa, Triticum aestivum
  unsure (1)..(43): unsure at all Xaa locations
  Clone ID: PAT_TA_90483.pep
RAAARGGFFFFXFXNPXITHXILIAILSDXGFXSTXEHYYXPQ

SEQ ID NO: 196066 - protein, 138 aa, Triticum aestivum
  unsure (1)..(138): unsure at all Xaa locations
  Clone ID: PAT_TA_90484.pep
MANQLTDDQIAEFKEAFSLFDKDGDGCITTKELGTVMRSLGQNPTEVELQXDMINEVDLMATGTIDFPKVPKPGWARKDERTTGLKKGRELKGRAQVVLTKGTKKRFNLCWLEAPANVNERKPPGKKAPTGRWQSVES

SEQ ID NO: 196067 - protein, 154 aa, Triticum aestivum
  unsure (1)..(154): unsure at all Xaa locations
  Clone ID: PAT_TA_90485.pep
RGRGRGTNPNPNQAGGKRDVGPEDADGRRLRGLSPHPIVPGGQGAGGGGVGRQGHQGQGGGGVVDPQGGVRLQEEGGGGRRRGHRQGQGQRPRRKRRHLSPXSRARXRXTRTXDXXMGRCLFYGQESRXXQPPPFLKXXRXXFPTFKFXGLTTL

SEQ ID NO: 196068 - protein, 87 aa, Triticum aestivum
  unsure (1)..(87): unsure at all Xaa locations
  Clone ID: PAT_TA_90486.pep
SVVAAEVLQAVLVMGLLSHVNADFFPKCCNNCRSFSGVDVCDDAHPKCPQGCSACRVVSTSPEMWRCADMKSTXVDGTCGGXPCKKY

SEQ ID NO: 196069 - protein, 68 aa, Triticum aestivum
  unsure (1)..(68): unsure at all Xaa locations
  Clone ID: PAT_TA_90487.pep
STRXPGQVXSPVFFFFLQXNPXXFXXTXTTNKTQSWGXLXXCITYXITKXSXFWWGDPXNIXSANXVP

SEQ ID NO: 196070 - protein, 35 aa, Triticum aestivum
  Clone ID: PAT_TA_90488.pep
RAWSRPRFFFFFFFFFFFFFFFFFFFFFFFNKALL

SEQ ID NO: 196071 - protein, 102 aa, Triticum aestivum
  Clone ID: PAT_TA_90489.pep
PKHNHTNFTITITKQIPQLSESFQDTQHLIVTDTTLESRLTTIEQSKNTDDRIDFKHTVRLALDLFQPMCKVQESWISKLPPCSKANNTPPSSMHALRQTKN

SEQ ID NO: 196072 - protein, 70 aa, Triticum aestivum
  unsure (1)..(70): unsure at all Xaa locations
  Clone ID: PAT_TA_90490.pep
TEWRIVHHLSHEFVALRFQITKFLRKKKKKKKKKKKKKKKKKKKKTXGPAXGAXXQIPXAXMGXXXMQXR

SEQ ID NO: 196073 - protein, 39 aa, Triticum aestivum
  unsure (1)..(39): unsure at all Xaa locations
  Clone ID: PAT_TA_90491.pep
EVLNSXXXFKLXPVLXXITNIAVLACFHGLLXIDHXXRX

SEQ ID NO: 196074 - protein, 75 aa, Triticum aestivum
  Clone ID: PAT_TA_90492.pep
DIGIQKHLEQEQKRGVEKPEVSFRLVAEQRQIRPNTYTKNQRSRQSIACRCVRSYHFQPDEFVGDVHLIRITTNT

SEQ ID NO: 196075 - protein, 95 aa, Triticum aestivum
  Clone ID: PAT_TA_90493.pep
SVVAAEVSDVPGIVKLLCLESAWKTPVPGNRLVLGKTTKLRQRWQCEHKRVSRMKRLGYLRYRKRLYRDNYMHQGSLFPTVSGSCGKDHPIAVTH

SEQ ID NO: 196076 - protein, 57 aa, Triticum aestivum
  Clone ID: PAT_TA_90494.pep
AWSRPRFFFCHQLVALSNPLLIFQAYLCLTRYYSSAQGFLGNQFQSQPRTTPNLPGR

SEQ ID NO: 196077 - protein, 106 aa, Triticum aestivum
  unsure (1)..(106): unsure at all Xaa locations
  Clone ID: PAT_TA_90495.pep
DXFQGGMLXPPTXVSFFRQAQRTPSSXFXLAGSHALMMAGVGVXPXYKGGELPDPNFPCTFAHGAERGQVLIALVCLKXMLSSVFLLLSMVVSXTLPMLVSVTVRC

SEQ ID NO: 196078 - protein, 47 aa, Triticum aestivum
  Clone ID: PAT_TA_90496.pep
RFAMVARRSTCCCRFGCICNLFQPGRIECCSIINKKEIAQVIIVYKE

SEQ ID NO: 196079 - protein, 144 aa, Triticum aestivum
  unsure (1)..(144): unsure at all Xaa locations
  Clone ID: PAT_TA_90497.pep
MMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALXFXFKDYFKRVFNFKXGQRLVTGKWFGGNPASGWGLPPGSFRG

SEQ ID NO: 196080 - protein, 160 aa, Triticum aestivum
  unsure (1)..(160): unsure at all Xaa locations
  Clone ID: PAT_TA_90498.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNXSPGYYDGRYWTMWKLPMFGCTDATQVINEVEESRRIPDAYVRIIGFTTSSVSRQLMP

SEQ ID NO: 196081 - protein, 97 aa, Triticum aestivum
  unsure (1)..(97): unsure at all Xaa locations
  Clone ID: PAT_TA_90499.pep
PRCLEFFFFFFFFFFPLVTIKTYIVDILYNIMRPFIYIATDSILIRACFLEPCWYMNMDIHIFLGTNKKDKWXRKTQSNVRVDKTAMALYIWPVVRP

SEQ ID NO: 196082 - protein, 55 aa, Triticum aestivum
  unsure (1)..(55): unsure at all Xaa locations
  Clone ID: PAT_TA_90500.pep
MLVXQDKLSGDELLSDSFPYRELENGVXCEVDGXWVXQGXXGVDIXXNPSADGGG

SEQ ID NO: 196083 - protein, 101 aa, Triticum aestivum
  unsure (1)..(101): unsure at all Xaa locations
  Clone ID: PAT_TA_90501.pep
TXLEFFFFFFFFFFFLKNSQXPXTSQHXILXIKXXASSXYSFXLNHTXGCSSXQPYIRETAHHXRTFXVAXGITDERLFPWXAYXSLPXXGXXSSHMLRXR

SEQ ID NO: 196084 - protein, 175 aa, Triticum aestivum
  unsure (1)..(175): unsure at all Xaa locations
  Clone ID: PAT_TA_90502.pep
RFRIIKGIATGLLYLREKWEKIIIHRDIKASNVLLDGEMNGRLGDFGLARLYDHGTDAQTTHMVGTKGYLAPELLRTGKASPLTDVFAFGMFLLEVACGQKPVKINAEGNEVFLVDWVLEHWNNEALIKTVDXRLQCDFSIDEAXLVLKLGLCASPFQVKAKMRKLAYSRTCTAD

SEQ ID NO: 196085 - protein, 103 aa, Triticum aestivum
  Clone ID: PAT_TA_90503.pep
LRKKQRKPKKIKKKKEETKKIDAKLLLNMSLTGPTHNRRAGPTPEMWPCGRYVCEAESNPREHFSNPHDIHLFVNSYLVELMVLLMPEIKHNATAVCPRAPQC

SEQ ID NO: 196086 - protein, 124 aa, Triticum aestivum
  unsure (1)..(124): unsure at all Xaa locations
  Clone ID: PAT_TA_90504.pep
MVKAVAVLTGSEGVKGTIFFTQEGDGPTTVTGXVTGLKEGLHGFHXXAXGXIXXGCMSTXXHFNPAXHVHXAPRXXIRHAGDLGKCXKLXXDXVAXINVXDWHIXLTGVTCWSVSTTMIVVAFQ

SEQ ID NO: 196087 - protein, 47 aa, Triticum aestivum
  Clone ID: PAT_TA_90505.pep
IKLLRRREAHIFASAPPESPIHPRHQLQFINDIGYHLLPRFHIKKKK

SEQ ID NO: 196088 - protein, 42 aa, Triticum aestivum
  unsure (1)..(42): unsure at all Xaa locations
  Clone ID: PAT_TA_90506.pep
IFYKEVQAGILXTKFHVIDQPWXGKTTLLICRDFXIXKFYIA

SEQ ID NO: 196089 - protein, 95 aa, Triticum aestivum
  Clone ID: PAT_TA_90507.pep
MKGTKLAAILILQAVLVMGVLSHVNADYFPKCCNNCRSFSGVDVCDDAHPKCPKGCSACRVVSTSPEMWRCADMKSTVDGTCGGPARSTDRLMPA

SEQ ID NO: 196090 - protein, 156 aa, Triticum aestivum
  unsure (1)..(156): unsure at all Xaa locations
  Clone ID: PAT_TA_90508.pep
MAAKEPMRVLVTGAAGQIGYALVPMIARGVMLGADQPVILHMLDIEFAAEALKGVKMELIDAAFPLLKGVVATTDVVEACTGVNVAVMVGGFPXKEGMERKDVMTKNVXIYKAQASAPEVISPNSRFGCCNHKHNAHLKELLIILRKHSVPLTQHR

SEQ ID NO: 196091 - protein, 158 aa, Triticum aestivum
  unsure (1)..(158): unsure at all Xaa locations
  Clone ID: PAT_TA_90509.pep
NLIQSCRTLVTSYNNYKPILPTTGTDICSLLVKQNKHLQLQLHGHEKYIIQCGMQIKRPLPPNCASSRMHHKYSQVHFILCTIFCCMASIQLKKATRQILHKNNAPNHTRNQIHSSNHRVVQQSVSVHGDILAHPSVGTXNYCAYLRGTQIQICLDHG

SEQ ID NO: 196092 - protein, 140 aa, Triticum aestivum
  unsure (1)..(140): unsure at all Xaa locations
  Clone ID: PAT_TA_90510.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKARSGQGGIPRTTXLXLPXTLEMPTLKHLTGAWGKRVV

SEQ ID NO: 196093 - protein, 40 aa, Triticum aestivum
  Clone ID: PAT_TA_90511.pep
VLGYFAIHMILSCTVCHRKKPERRFAARRPKAHLKRSYTM

SEQ ID NO: 196094 - protein, 152 aa, Triticum aestivum
  unsure (1)..(152): unsure at all Xaa locations
  Clone ID: PAT_TA_90512.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINXWRSQXEYLTRIRIIXFENPQ

SEQ ID NO: 196095 - protein, 39 aa, Triticum aestivum
  unsure (1)..(39): unsure at all Xaa locations
  Clone ID: PAT_TA_90513.pep
VCGSXYTANXMYNXIXVXWSMCFIXXERLVXLVLVHLPP

SEQ ID NO: 196096 - protein, 129 aa, Triticum aestivum
  unsure (1)..(129): unsure at all Xaa locations
  Clone ID: PAT_TA_90514.pep
QGQFALVVDPXVGGYKFTKVLMDGGSSINILYYETFRRMGLTDKDLRPSNTVFHGVVPGKSAYHVGKIALEVAFGDEHDSRSETLTFEVVKIWSXYHALFGRPAYAKFMARPCYIYLQLKMPGHKGTTS

SEQ ID NO: 196097 - protein, 71 aa, Triticum aestivum
  unsure (1)..(71): unsure at all Xaa locations
  Clone ID: PAT_TA_90515.pep
MKLIAAYLLAYLGGNSSPSAADVRNILDSVGAEADEEKLEFLLAELKGKDITEVIASGREXFAAVLQGGVQ

SEQ ID NO: 196098 - protein, 49 aa, Triticum aestivum
  Clone ID: PAT_TA_90516.pep
SLEFFFFFFFFFFFFFFFFFFFFWTISWRRSPRYESEPKVGYMSTISEY

SEQ ID NO: 196099 - protein, 59 aa, Triticum aestivum
  unsure (1)..(59): unsure at all Xaa locations
  Clone ID: PAT_TA_90517.pep
PRFFFFFFFFFFFFFFFFFFFFFLXTXIPNFQKIVLKKMPCLGCNCLNRLWIMCMYAGR

SEQ ID NO: 196100 - protein, 86 aa, Triticum aestivum
  unsure (1)..(86): unsure at all Xaa locations
  Clone ID: PAT_TA_90518.pep
FFFFLTTAFCIQPXYFTSCMVVVQTKPSCMHACMRTLDRVRTYVHGRFPDITQHLAAYLPGTKLVAKAQALLLTGSARWSARFSPR

SEQ ID NO: 196101 - protein, 93 aa, Triticum aestivum
  unsure (1)..(93): unsure at all Xaa locations
  Clone ID: PAT_TA_90519.pep
YPLQWCLLEFSKXGFIFRXHNDSWYYDXQXWTMWKLXMFGCADATQVINEVEEVKKEYPDAYVRIIGFDNMRQVQCVSFIAFKPPGCEESGKA

SEQ ID NO: 196102 - protein, 110 aa, Triticum aestivum
  unsure (1)..(110): unsure at all Xaa locations
  Clone ID: PAT_TA_90520.pep
MSSSEVACTLAALILHDDGIPITSEKIATVVKAAGIKVEAYWPALFAKLLEKRSVDDLILSVGSGGGGAPAAAAAAPAAGGAAAXEEKKEEKKEEAKEESDDDMGFSLFD

SEQ ID NO: 196103 - protein, 57 aa, Triticum aestivum
  unsure (1)..(57): unsure at all Xaa locations
  Clone ID: PAT_TA_90521.pep
RGKGNKXCXMXXPXXTKXMQFXGDXXQWFIXCXXDQVXEMIMXCYXSLDIYVRXLCS

SEQ ID NO: 196104 - protein, 97 aa, Triticum aestivum
  unsure (1)..(97): unsure at all Xaa locations
  Clone ID: PAT_TA_90522.pep
PRSRVFFFFFFXLRKNXQDFKNLTLIXXNXXXXLXSTPXFXAXNXNETCVXSVTXTXIKYTXDXRTIMKVLQHQTKMXEXQTPXXVRPXXXCXKTPX

SEQ ID NO: 196105 - protein, 148 aa, Triticum aestivum
  unsure (1)..(148): unsure at all Xaa locations
  Clone ID: PAT_TA_90523.pep
MLVYQDKLSGDELLSDSFPYRELENGVLWEVDGHWVVQGAVDVDIGANPSAEGGGDDEGVDDQXAVKVVDIVGTFRLQEQPAFDKKQFISHMKRYIKNXSAKLEXDDLNAFKKNVESATKYLPSKLKDFSSCWQSIMICGCSLHKEEL

SEQ ID NO: 196106 - protein, 132 aa, Triticum aestivum
  unsure (1)..(132): unsure at all Xaa locations
  Clone ID: PAT_TA_90524.pep
AQTCLPLSWLVLKPSPSPXXERAKLRGLXPXARPSLXVXAXNKAKNVQTAQPYWPGGGVEFKEGXXASGRVAXGNGVYQFADXYRAXVXGYSPXXTPXEEWSPXSGXVYXGXKTGLFLRAXTXAXIWAVACS

SEQ ID NO: 196107 - protein, 87 aa, Triticum aestivum
  unsure (1)..(87): unsure at all Xaa locations
  Clone ID: PAT_TA_90525.pep
TVSSQTLKRDLQLGPSCSGLTKRANRSXFQGXVQXCCXXSGPKXXNRGGXXKKRXRGIXEXTXGGKITXARVXPXKXXXGVQKPXVT

SEQ ID NO: 196108 - protein, 105 aa, Triticum aestivum
  unsure (1)..(105): unsure at all Xaa locations
  Clone ID: PAT_TA_90526.pep
MLVYQDKLSGDELLSDSFPYRELENGVLWEVDGHWVVQGAVDVDIGANPSAEGGGDDGGVDDQAVKVVDIVDTFRLQEQPAFDKKXFISHMNATSRTLCQLEGDD

SEQ ID NO: 196109 - protein, 81 aa, Triticum aestivum
  Clone ID: PAT_TA_90527.pep
RGFFLQLRHFRVPIGRQPFRGFLRDRFTLRRLTERRKPSTGRRSCFSQDFSLLMSAFSLLISPGLVTKNLPRLTERPATDT

SEQ ID NO: 196110 - protein, 76 aa, Triticum aestivum
  Clone ID: PAT_TA_90528.pep
LRMTNQVQYVQHTRRQQRKLKQWNYSFHLFPLDQLILQNSSIKKYILLTLTDVNYCLVVAATPRFIGFLRFVRTVP

SEQ ID NO: 196111 - protein, 60 aa, Triticum aestivum
  unsure (1)..(60): unsure at all Xaa locations
  Clone ID: PAT_TA_90529.pep
PRFFFFFFFFFFFFFFFFXXXFFFFLIQNDYYTXFKXGKGLXCXXXFPXPXIXIMWXTXX

SEQ ID NO: 196112 - protein, 114 aa, Triticum aestivum
  unsure (1)..(114): unsure at all Xaa locations
  Clone ID: PAT_TA_90530.pep
MVKAVAVLTGSEGVKGTIFFTQEGDGPTTVTGSVTGLKEGLHGFHVHALGDTTNGCMSTGPHFNPAGHVHGAPEDEIRHAGDLXNVTAGADGVAXINVTDAXPYQINGFKGFLG

SEQ ID NO: 196113 - protein, 86 aa, Triticum aestivum
  unsure (1)..(86): unsure at all Xaa locations
  Clone ID: PAT_TA_90531.pep
IRFNDNQRRWRSINSDTTMDFNRSIKLTGGTLLXDLLLGAXXACCYXLXLXXSTPXVQXHXESAXXXMGVTIGXEPFXXXGLXXGR

SEQ ID NO: 196114 - protein, 90 aa, Triticum aestivum
  unsure (1)..(90): unsure at all Xaa locations
  Clone ID: PAT_TA_90532.pep
DXXXAHLAXPXNRNFVLDVTXGRVTFETVRSFLEFVLWKLHDGARKSGDTAFDSGLRAMRYMSDKSMVLATXCITLCLHVLNGTRFLVTA

SEQ ID NO: 196115 - protein, 88 aa, Triticum aestivum
  unsure (1)..(88): unsure at all Xaa locations
  Clone ID: PAT_TA_90533.pep
PGASFLLTLRXYIRNXSXKLEGDGPXMLXXRIVGPATKYLXSKLKDLQFXVXGESMHDDGGVVFAYYKEGAADPTFLYFAHGLKEVKC

SEQ ID NO: 196116 - protein, 80 aa, Triticum aestivum
  unsure (1)..(80): unsure at all Xaa locations
  Clone ID: PAT_TA_90534.pep
GGIRQAGSDSSQAIIALPSSCSPTRHSPCDMPALLDRCRRHYGKGNSLIPSCIYSIYLLPSNWINNNGVFPNFGSXSQSV

SEQ ID NO: 196117 - protein, 36 aa, Triticum aestivum
  Clone ID: PAT_TA_90535.pep
EGSRSCVKKKKKNSRRERERERERERERERERERER

SEQ ID NO: 196118 - protein, 164 aa, Triticum aestivum
  unsure (1)..(164): unsure at all Xaa locations
  Clone ID: PAT_TA_90536.pep
QAKYPALAEAVYGFLXASRKLKQYFQGHXITVVSSAPLGDIIPEPGKRLAGFPKWAIELGPHGLKYVPQTAVKSQALVDFINDWIEMQAPEEKPDHTYWTIHFDGSRQLEGSGAGVVLISPXGDKFCYVLRLMFPCTNNAAEYEALLHGLRMAKEMNLSRVKTS

SEQ ID NO: 196119 - protein, 64 aa, Triticum aestivum
  unsure (1)..(64): unsure at all Xaa locations
  Clone ID: PAT_TA_90537.pep
VISXRSPXXVFFFFFFFFXDXXKGPFNYLXNKTXXTRYRANILLSIIIXVLVXXNXVVXLXRAR

SEQ ID NO: 196120 - protein, 54 aa, Triticum aestivum
  Clone ID: PAT_TA_90538.pep
RLQPGLKAVGATNHDYRGSEICFLFFYLFFVFNFCLNCLYLLGYLTSLSDSFLH

SEQ ID NO: 196121 - protein, 137 aa, Triticum aestivum
  unsure (1)..(137): unsure at all Xaa locations
  Clone ID: PAT_TA_90539.pep
VGMIWIEPRIHHTTFGFPXFSALGCRWMETSFXLLAGRSGYDPQIRFLIXYRTYNMSSLHLVHGNMFXVRXXRLWTRXSSHXSQVLXFRDAXQFFSRQXVKRXTTDXLKFPXXLTRKSLAXRHQXAQYKXXYXXGAX

SEQ ID NO: 196122 - protein, 127 aa, Triticum aestivum
  unsure (1)..(127): unsure at all Xaa locations
  Clone ID: PAT_TA_90540.pep
LSHPYAEVVVDDEXVDDQAXVKVXDXVDXFRLQEQPAXFDKKQFISHMKXYIQDLSCQXFEGDDLDAFKKNVESATKYLLSKLKDLQFFVGESMHDDGGVVFAYYKEGAAXDPTFLYFAHGLKEVKC

SEQ ID NO: 196123 - protein, 86 aa, Triticum aestivum
  unsure (1)..(86): unsure at all Xaa locations
  Clone ID: PAT_TA_90541.pep
MGKRKAAAKPPPRKRMDKLDTVFSCPFCNHGSSVECRIDLKNLIGEANCQICQESFSTTANDTSEWIXECERVNTVEDDDGCMSML

SEQ ID NO: 196124 - protein, 86 aa, Triticum aestivum
  unsure (1)..(86): unsure at all Xaa locations
  Clone ID: PAT_TA_90542.pep
KLDXTEKGXXFSLXIPQALHHRGQXQRCSXAAPXRTYXXWXLDFQHFGLXLXYFHDXSXXLSIXDXSIGHXVYTXFXNVIRKKHRX

SEQ ID NO: 196125 - protein, 91 aa, Triticum aestivum
  unsure (1)..(91): unsure at all Xaa locations
  Clone ID: PAT_TA_90543.pep
REXXRRXQVVAAXPXVMRKRNEELVAITLYLSNVGIMSXLAERPXTFMXYPLVXLSLYHXCXHVCTXLCLEPKKKKKLEXAGRPLEITSEF

SEQ ID NO: 196126 - protein, 53 aa, Triticum aestivum
  unsure (1)..(53): unsure at all Xaa locations
  Clone ID: PAT_TA_90544.pep
PGQAAAAPSASAAPXAXAPAAXXRSIIDHMHAPCRXCIIDHIDLLLPYHVTAT

SEQ ID NO: 196127 - protein, 114 aa, Triticum aestivum
  unsure (1)..(114): unsure at all Xaa locations
  Clone ID: PAT_TA_90545.pep
MKFIAAYLLAYLSGNASPSAEDLTSILESVGCEIDNEKMELMLSQVKGKDITELLAAGREXFAAVPSGGGGVAVSAAAPAAXGGAAAPAAESKKEEKXLEKEESDDDMGFNLFD

SEQ ID NO: 196128 - protein, 50 aa, Triticum aestivum
  unsure (1)..(50): unsure at all Xaa locations
  Clone ID: PAT_TA_90546.pep
SISCNTHHISLXYXSRXVMAAGACSASPSPPXRXCPIRRLPGGPESGWAK

SEQ ID NO: 196129 - protein, 111 aa, Triticum aestivum
  unsure (1)..(111): unsure at all Xaa locations
  Clone ID: PAT_TA_90547.pep
TFNCTEYIRKNNYILLXYVFXRLINCAXVQRYLQPSLQXPSVPXXGXXXYPLXGACXAACFXEYXCFDVFXLXLXXGXKIGHTEXQGYTLQGWEEIVXIXSEXXVPXGQFI

SEQ ID NO: 196130 - protein, 96 aa, Triticum aestivum
  unsure (1)..(96): unsure at all Xaa locations
  Clone ID: PAT_TA_90548.pep
PSXXRGTXPLKEXKXFLNFXFFQGXSLKIXQXRQIEPIFGNMIXSLGXXXMXXVLXXVWXXXSVXVVKKKKKXRKXTKKKKKKKKKKNLGRDHANH

SEQ ID NO: 196131 - protein, 95 aa, Triticum aestivum
  unsure (1)..(95): unsure at all Xaa locations
  Clone ID: PAT_TA_90549.pep
LAWSRPRCFFFFFFFFFFFFFXFFLTMDTCTIXXVHDRKSFLFLQXIPKSCPXWQVQLKETTGPRLNNXMXRGLEPDGQPIQLXHAXLRPGRRRR

SEQ ID NO: 196132 - protein, 88 aa, Triticum aestivum
  unsure (1)..(88): unsure at all Xaa locations
  Clone ID: PAT_TA_90550.pep
FAAARGLILQAVLXMGILSHVNADYFPKCXNSCXSFSGVDXXXDAHPQCPKGCSACRVVTPSPHKTFRCADMKSTXSTATCXGPCXKH

SEQ ID NO: 196133 - protein, 65 aa, Triticum aestivum
  unsure (1)..(65): unsure at all Xaa locations
  Clone ID: PAT_TA_90551.pep
LIXNFFFFPLTCTINQXIYIHTGSHXXPXRXATSPXTCLRLRVLLPXVKTKGCXGTNXQLGPRTS

SEQ ID NO: 196134 - protein, 125 aa, Triticum aestivum
  unsure (1)..(125): unsure at all Xaa locations
  Clone ID: PAT_TA_90552.pep
MSDTDERHFXSKXDSGASKTYPQXAXAIRKXGHIVIKARPCKVVXVSTSXTGKHGHAKCHFVAIDIFNGKXLXXIVPSSHXCXXPHVDRXDYQLIDXNXXDXMXALLTESGKHKRMDLKSRFLPW

SEQ ID NO: 196135 - protein, 84 aa, Triticum aestivum
  unsure (1)..(84): unsure at all Xaa locations
  Clone ID: PAT_TA_90553.pep
NSPSDXTWAPXXVFFFFRKEICINNTKLDARQPLGADGCPFKARNNPXKNSLXTSNKLXLKRSKSKGTMTLRLCCYKNSSKFQS

SEQ ID NO: 196136 - protein, 78 aa, Triticum aestivum
  unsure (1)..(78): unsure at all Xaa locations
  Clone ID: PAT_TA_90554.pep
RXPLXWPNPREKEXXCRMVKPRLALXGGXLFKANGQGVPIITQPXKERKXREHNTDMTEXRATRVETSPATTLIISEF

SEQ ID NO: 196137 - protein, 60 aa, Triticum aestivum
  unsure (1)..(60): unsure at all Xaa locations
  Clone ID: PAT_TA_90555.pep
NKKEXGNIRSFTPKKKXLLKKKLSKIERSFFFFQFKWLINPXSKISLKNXIQFFNQXGVR

SEQ ID NO: 196138 - protein, 125 aa, Triticum aestivum
  unsure (1)..(125): unsure at all Xaa locations
  Clone ID: PAT_TA_90556.pep
EFTSDFRPPGXVPPLSTEALLKQVDYLIRSKWVPCLEFXSKVGFVFREHNSSPGYYDGRYWXTMWKLPMFGCTDATQVLNEVEEVKKEYPDAYVRVIXGFDNMRQVQCVSFNCLQANKLRESGKG

SEQ ID NO: 196139 - protein, 103 aa, Triticum aestivum
  unsure (1)..(103): unsure at all Xaa locations
  Clone ID: PAT_TA_90557.pep
MKGTKLAAILILQAVLVMGVLSHVNADYFPXSCCNNCXSFSGVDVCDDAXPKCPKGCSALRVVSNXPRNVGAARDMKXSTVDGTCGXGPCKXVDWAHANDMFP

SEQ ID NO: 196140 - protein, 186 aa, Triticum aestivum
  unsure (1)..(186): unsure at all Xaa locations
  Clone ID: PAT_TA_90558.pep
NSLXDXSXRPGKCXPXFFFFFNWDEKKQIQNXSMFPKGGVLNFMTISTXITLSSSPREFQEITGKTKMTKRLPDVELLGQHFXTXPXXKTXXWXLLXHVVKRXASSLLARFQWMQPSTIXTKQXSPXGXGSNGXIFLXTKPSGPXEGAPRLKFWPAXPNLAKLXWXXKWPKMXXPPPRGXKGXKNX

SEQ ID NO: 196141 - protein, 104 aa, Triticum aestivum
  unsure (1)..(104): unsure at all Xaa locations
  Clone ID: PAT_TA_90559.pep
LXWSRPRCLXVFFFFFFFFFFFPLXTIKTYIVDILYNIMRPFIYIATDSILIRACFLEPCWYMNMDIHIFLGTNKKDKWGRKTQSNVRVDKTAMALYIWPVVRP

SEQ ID NO: 196142 - protein, 91 aa, Triticum aestivum
  unsure (1)..(91): unsure at all Xaa locations
  Clone ID: PAT_TA_90560.pep
RASFAGXGXSFPIVNXSXXXAFGGVXGXTFXAFXQSXLLXTGRGGEPRGKRSQXLFPXXXGGGEKXXDCFIFXGRRXDFXPRXGPRLXIVN

SEQ ID NO: 196143 - protein, 86 aa, Triticum aestivum
  unsure (1)..(86): unsure at all Xaa locations
  Clone ID: PAT_TA_90561.pep
TSPVQXSHSGSAQEXXKFLVGILHFCTRRPPVLVMKSWETCSWTXRLHLWFXRTSRLFEFVTRGKRDRYFGYIFHIXGECSEQTYS

SEQ ID NO: 196144 - protein, 56 aa, Triticum aestivum
  unsure (1)..(56): unsure at all Xaa locations
  Clone ID: PAT_TA_90562.pep
FPTMKXDCNLTSXPXWAGKXSPNSLTSXKXXTQXVVKXMKKKXLXFLFAXTXXXKG

SEQ ID NO: 196145 - protein, 124 aa, Triticum aestivum
  unsure (1)..(124): unsure at all Xaa locations
  Clone ID: PAT_TA_90563.pep
EILKGYGXPKRRWGRLXPXXGRTCKGGPANFTNGLXGPAPGXVXETNXEVFFFFGEEDGXXYNSGDPLXIGGDYMXKIKQKYXEIYQSHKDSINQRKMRGRERFSPRNNPWTKKLSXWGFICPS

SEQ ID NO: 196146 - protein, 94 aa, Triticum aestivum
  unsure (1)..(94): unsure at all Xaa locations
  Clone ID: PAT_TA_90564.pep
PGKPARLVKGPSNWGLXNGSQDWGTWWKPXSXLGARXLPKSGRGRRTXLRPKLLWGKKSXNLXFSXTCQXGPPSXSXKLKSLRQINPGFGGMKP

SEQ ID NO: 196147 - protein, 64 aa, Triticum aestivum
  unsure (1)..(64): unsure at all Xaa locations
  Clone ID: PAT_TA_90565.pep
XPNXSPLYLDPKFKFVWPVACLFVPLVDXLMILGKGXDHELEQGAPWXRLVAPCCVAESSGXQG

SEQ ID NO: 196148 - protein, 53 aa, Triticum aestivum
  unsure (1)..(53): unsure at all Xaa locations
  Clone ID: PAT_TA_90566.pep
XLIXILKAYASNAXGRLLPIWVXPAXRAAEIQLNDXXWAXAGXGGPLPFRVXC

SEQ ID NO: 196149 - protein, 144 aa, Triticum aestivum
  unsure (1)..(144): unsure at all Xaa locations
  Clone ID: PAT_TA_90567.pep
RGRGAFSSNVGGPASTPXTNFLGKKLXKXVTSAVNYHGKSSKANRFTVMGAENLXEKRNTDKWKGLCVRYLRRPSRTSPRGKGIVDSLFXAPTGDGXTHEXVLXSYEXVKPXGLKKYDXXNNNGEGFYIAPAXMGQCCPISSEL

SEQ ID NO: 196150 - protein, 78 aa, Triticum aestivum
  unsure (1)..(78): unsure at all Xaa locations
  Clone ID: PAT_TA_90568.pep
RGPXRXGTQXLRHLLIGXRRSLVHFVAGRVLXSLPVXYACXGDXRXAPXXRXXKDFXPVIRXQXLXHXLKLXXCRYGI

SEQ ID NO: 196151 - protein, 104 aa, Triticum aestivum
  unsure (1)..(104): unsure at all Xaa locations
  Clone ID: PAT_TA_90569.pep
FIVLALQLLTEXLLGTIXVLQFGGGXTLGHPXWGNALGAAANRXVALEACVQAXRNEGRXDLAREGNEIXRAACKWSPELPAACEVWKAXKFEFXPGRYLLISR

SEQ ID NO: 196152 - protein, 61 aa, Triticum aestivum
  unsure (1)..(61): unsure at all Xaa locations
  Clone ID: PAT_TA_90570.pep
IIKXSKXCIQSGGEXFQNGPTAXXGANXXMIKRGPRXRXPKANLXFFXFFFFFFFFFFFFH

SEQ ID NO: 196153 - protein, 74 aa, Triticum aestivum
  unsure (1)..(74): unsure at all Xaa locations
  Clone ID: PAT_TA_90571.pep
DDAQEKXRIAQLVEQRTENPRVTSSNLGPGXRKKKKTRPRAANTLIEIPAGRQWAXRGXMRXPGPXFAPIXEVV

SEQ ID NO: 196154 - protein, 93 aa, Triticum aestivum
  unsure (1)..(93): unsure at all Xaa locations
  Clone ID: PAT_TA_90572.pep
HPXLTVEKXLXEXXHXFVQEQXDNVRXVQFXDPYLSXQAALVVXNQDAMKXXSFXGKGXXQXXFXVPAGCTDQXPXNXDPTXGXXDGSXLXXF

SEQ ID NO: 196155 - protein, 108 aa, Triticum aestivum
  unsure (1)..(108): unsure at all Xaa locations
  Clone ID: PAT_TA_90573.pep
PXEFFXXASXIRGXXGPXNVXIAPPAXPIGGPPGXFRIXALVRRPGGSPVLVQGKVWTFXPNQTXYKXFXLRIXLKGXDFHXITLSLVFVSSIEEYPXLKXILXQXLI

SEQ ID NO: 196156 - protein, 143 aa, Triticum aestivum
  unsure (1)..(143): unsure at all Xaa locations
  Clone ID: PAT_TA_90574.pep
DVQXPPXFLLDGVPLVYYSNQKXRXLRKRLGDLXKDYLXPPWPKIPRTEEXLEXFXAPPRPNSKGSWFFACVDHPSPYTNSLREGPSVRPGRKNWFPESMXRLNFCLYTITYPIXXPLLGGYPRLPXXPSRLGILRKRIGYSS

SEQ ID NO: 196157 - protein, 103 aa, Triticum aestivum
  unsure (1)..(103): unsure at all Xaa locations
  Clone ID: PAT_TA_90575.pep
XVIPLRDCXPGRISCCNLXLXLXTXLXVSAGASHRASSSSXFVALLPPLSSTVRTGGGPRSHFXSLSPRSEASXXSFELRNDQPQKVGGLTLENCKSLDARLE

SEQ ID NO: 196158 - protein, 138 aa, Triticum aestivum
  unsure (1)..(138): unsure at all Xaa locations
  Clone ID: PAT_TA_90576.pep
ARNSTNGLXVGXXRXSWAGXFVSFYPKXLVCGLGVDRVKLSRMQVHGCCGLGAGKVPXXKKQXWGELILCAVRTNVRVYVTCRALSYKLSSVKKKKKKNSEELXLPRGRXARKIEXXAXPPWAGRGKQWRTSGPKXAL

SEQ ID NO: 196159 - protein, 140 aa, Triticum aestivum
  unsure (1)..(140): unsure at all Xaa locations
  Clone ID: PAT_TA_90577.pep
GXAEXTXGLTVGXGRRXPXAPNGCQXXEKXGLVPQNRGIIRPKRPXRSLLXSVCPWAATGVIEFSTLLLPGFFPVSPPRAXNVVRSKNGXSTIAPNSKAKLNFCRGVAFGQCYFFXCKVGILXRQLRWXASPPTGPCXIK

SEQ ID NO: 196160 - protein, 112 aa, Triticum aestivum
  unsure (1)..(112): unsure at all Xaa locations
  Clone ID: PAT_TA_90578.pep
RPFGKFVXPLKFCKGPXWDTRQKRXLNFXHWGLSRLTFEPSGLGXLXQPQIVRXWGPTNIRAQGELSQNPKARNLKELLVFHVFPQKQFFIVHXYVIDGNVKLDIVNNLMFY

SEQ ID NO: 196161 - protein, 138 aa, Triticum aestivum
  unsure (1)..(138): unsure at all Xaa locations
  Clone ID: PAT_TA_90579.pep
NSLIAARAGQXFVKTLTGKNITLEVXSSDTIDNVKGKIXDKEGIPPXXSKRLIFAGKQLEDXRTLADYNIXKESTLHLVLRLRGGMQIFVKNLTGKNITLEVESSXDTIDNVKGKDQXTKEXIPPDQASXXSFAGKQL

SEQ ID NO: 196162 - protein, 121 aa, Triticum aestivum
  unsure (1)..(121): unsure at all Xaa locations
  Clone ID: PAT_TA_90580.pep
SCLVLSPXFHXXKSSRRLXRFWVKGKVXTLIPTQTNSKGLIYEFXKXLDFHIYLXLVLCQYENIPSLNLFYPKPYLIIXLRFFPKILXCYFRNYXYYSRKXIESKXDLQKLGFLLMPLNNI

SEQ ID NO: 196163 - protein, 100 aa, Triticum aestivum
  unsure (1)..(100): unsure at all Xaa locations
  Clone ID: PAT_TA_90581.pep
MKGTKLAXXLILXAVLVMGVLSHVNADYFPKCCNNXRSFSGVXVCDDAHPKCPXGCSACRVVSTSPXMWRCADXKSNVDGTCGGXCKEVLIGSHDMFRLK

SEQ ID NO: 196164 - protein, 160 aa, Triticum aestivum
  unsure (1)..(160): unsure at all Xaa locations
  Clone ID: PAT_TA_90582.pep
NSLVISVVAAEVILLRSNKYTLLTLVSEAICHLIYPIRWQHVYIPIIFSSGVDYIDAPTPYMMGLHSGVDTSTVTMDGVVVVDLEYNRITTTXDIPPIPESEHSFLRGEILKLLQPNVVGIDYMKINLGSMGDYSLRTATKSWGQDHDFQXLRLIFLENL

SEQ ID NO: 196165 - protein, 130 aa, Triticum aestivum
  unsure (1)..(130): unsure at all Xaa locations
  Clone ID: PAT_TA_90583.pep
LXLQXFPIIFPXXWTILXSILAYXCVWFFEXLSTHXXRSSYSPHXSXPNXSVFSKKKQQXRCFPXKNNXPLIFKEKQXYFYFXEXXKKNCXRLRXKXRETGXGTXPASXNKXYGAQQINSHPPKKKKKKA

SEQ ID NO: 196166 - protein, 80 aa, Triticum aestivum
  unsure (1)..(80): unsure at all Xaa locations
  Clone ID: PAT_TA_90584.pep
FXSNQXXTHVGXEFLFXHXXCFXYTNKPWVXXPXSFILCTHVCXDXCGEFINPRIGIVCEILFYXQKKKKPARAXAGNHX

SEQ ID NO: 196167 - protein, 121 aa, Triticum aestivum
  unsure (1)..(121): unsure at all Xaa locations
  Clone ID: PAT_TA_90585.pep
IQYLREAKIAPFGTKXGTTRXPKANXIKLXEPXWQFPKGMSLKVPSNKIGNTXIRPXKXFRXRGWXYGQNNGITNLEANRVINNXGKGXTKSXEVEKXKPAKXXIFFQIKINRRKXNQXKX

SEQ ID NO: 196168 - protein, 144 aa, Triticum aestivum
  unsure (1)..(144): unsure at all Xaa locations
  Clone ID: PAT_TA_90586.pep
NSLXINVVAXEVXXFXFFFFFXSFXFXKGFKFLNYFXLXSXXXTPHQXXIXPLISNXPSTFQIIXXPDGXPSSHXXXLSKLKFWXKIPPVSKXAPVVFLXIXTMSNLYLXGXXAXIDSPRTTRGGXXNTXSGPTSPKKWGRXKN

SEQ ID NO: 196169 - protein, 122 aa, Triticum aestivum
  unsure (1)..(122): unsure at all Xaa locations
  Clone ID: PAT_TA_90587.pep
MAAAFSSTVGAPASTPTNFLGKKLKKQVTSAVNYHGKSSKANRFTVMAAENIDEKRNTDKWXGLAYDISDDQQDITRGKGIVDSLFQAXTGDGNPRGRPXAPTXYXSQGLKKYXXQQTIGRL

SEQ ID NO: 196170 - protein, 147 aa, Triticum aestivum
  unsure (1)..(147): unsure at all Xaa locations
  Clone ID: PAT_TA_90588.pep
PWVRXPEGEEXAKXWNSLLHQQHATSRXTNIAPQQPNNQQLLWAVLQGAKFKSYMFSSPGTTPLGNLXHPVSGPRQWWEXLRRALAHFAPMGNPPNXQPXGQRIIQTKXDGDKVXFXTGXNDXXHEQAETGXKYGSRFXKWPMLWLV

SEQ ID NO: 196171 - protein, 110 aa, Triticum aestivum
  unsure (1)..(110): unsure at all Xaa locations
  Clone ID: PAT_TA_90589.pep
MVLKTELCXFXGQXIYPGXGIKFNRSDSQVFLXANSXKCKRYFTNRLKXAKLXWAANVXGKXQXKKGIHAEGAKKXXAXPTKXPVTSPAFWCLPSYPKRGGGNPESPLLA

SEQ ID NO: 196172 - protein, 68 aa, Triticum aestivum
  unsure (1)..(68): unsure at all Xaa locations
  Clone ID: PAT_TA_90590.pep
QKLXTPFVNLGXINXKNFXXXSFXKNFFXFXGPGFXXFLTPXPGXXPLXIINLXPPXQVGPFWXEFPT

SEQ ID NO: 196173 - protein, 114 aa, Triticum aestivum
  unsure (1)..(114): unsure at all Xaa locations
  Clone ID: PAT_TA_90591.pep
EPNWXKXSMVPWFYPKINGXLNWRTPNNKXHQASXXIWXLXXNKXXAXKLVXXLXNXTXXFNXTILPRFQXPFPIWQGFHLNPKGGXXGFPXXXKPKXGGGGGXXFXPRGANXF

SEQ ID NO: 196174 - protein, 102 aa, Triticum aestivum
  unsure (1)..(102): unsure at all Xaa locations
  Clone ID: PAT_TA_90592.pep
MKGTKLAXXLILQAVLGHGXLSHVNADYFPKCCNNCKSFSGVDVCDDAXPKXPQRAAXACRVVXNQAPEMWRCAXDMKITVDXNCXGPWRKYDASMKMFPPK

SEQ ID NO: 196175 - protein, 61 aa, Triticum aestivum
  unsure (1)..(61): unsure at all Xaa locations
  Clone ID: PAT_TA_90593.pep
KKKKKKNFGGXSFFSPSARXTHGXFHLVDFAAXPLPGXXQLLEELPXAXGCIALIIXISVT

SEQ ID NO: 196176 - protein, 70 aa, Triticum aestivum
  unsure (1)..(70): unsure at all Xaa locations
  Clone ID: PAT_TA_90594.pep
EFTNDXSGXPGXWRRKKRTXPRVFFFFFLXFNIFFKTLSVFSPEKLKKXSQFQTXFFNSGGEQRXIEXPA

SEQ ID NO: 196177 - protein, 68 aa, Triticum aestivum
  unsure (1)..(68): unsure at all Xaa locations
  Clone ID: PAT_TA_90595.pep
FGWGIQGEGREXXXIGLNXVGXSCLAPRIEIPEKDCCPPEFGNYWKKLPNILRVDPYIXIQLGFWLKX

SEQ ID NO: 196178 - protein, 99 aa, Triticum aestivum
  unsure (1)..(99): unsure at all Xaa locations
  Clone ID: PAT_TA_90596.pep
MVKGVAVLTGSEGVXGNIFFIQEGDGPTTVXXNVTGLKGKGSNXFHVARSLVTPNGLHVKLGQHQTLLGHVWGQKRNPPCVIGKYKPSGGLTNCLLDWQ

SEQ ID NO: 196179 - protein, 56 aa, Triticum aestivum
  unsure (1)..(56): unsure at all Xaa locations
  Clone ID: PAT_TA_90597.pep
XNMXLQRALPPYKGRTSRKFINFLXENNVDXTNVNKCFRXTTTNTHPXKKELKRAY

SEQ ID NO: 196180 - protein, 60 aa, Triticum aestivum
  unsure (1)..(60): unsure at all Xaa locations
  Clone ID: PAT_TA_90598.pep
NRXQDNINDGLFTXYNQXLTYITHPHMIHFPRKXXPNNLFFLKNXPNAXICSXKLTGXGC

SEQ ID NO: 196181 - protein, 71 aa, Triticum aestivum
  unsure (1)..(71): unsure at all Xaa locations
  Clone ID: PAT_TA_90599.pep
TIYLHNTKGPTVMXSSGNSVAPFQGVKXXAGLPXXRRSNGANLGXXXSNGGRXKCMQVWPNQGNKKFQXLS

SEQ ID NO: 196182 - protein, 153 aa, Triticum aestivum
  unsure (1)..(153): unsure at all Xaa locations
  Clone ID: PAT_TA_90600.pep
AKGFPXNSLVASLXLPGQXSLIFFXRAXRTSLGFRRLRTRPXAQSGRGGNPNGLGCRNXEEIVSXPPIFLIEDRALPGSPALXXPQGLXAGFTLISALRASLPQAXSRCGLGAYRILPTYPXGLFVTSSSFPTXCPLFEXFLXIVIGXVTNKX

SEQ ID NO: 196183 - protein, 204 aa, Triticum aestivum
  unsure (1)..(204): unsure at all Xaa locations
  Clone ID: PAT_TA_90601.pep
RIRXXIDXFLXLVLSFLFXFLXRKQXSLLXLXXNPXISLPGPXPQVAVGXLDXITRAAPTFSGVCWNTNGGQRXEQPLLGXLLGLGRSFARTFDPREKGXSSCLQATWEISRAFQRVEEDSPLTQGTAFGRMRNXPAELLFXPFIGSLDXIFSLQKFFXFNSLRLRDPSGPGTNVKXIIKFAGXPCKFGXYWEEFPKRVWMHKL

SEQ ID NO: 196184 - protein, 125 aa, Triticum aestivum
  unsure (1)..(125): unsure at all Xaa locations
  Clone ID: PAT_TA_90602.pep
AKLXXXSSGPPRARFFFFFFWSAKREEGGRFNYXTXTNWLTIRVGFIKITHVXNCQTKRVWXPXRNNXTILRPGPXPQVQAPXEGKSRNDSNQEXNFSXPIWGQXEKXGNFWXFKPPXNGPWAXP

SEQ ID NO: 196185 - protein, 115 aa, Triticum aestivum
  unsure (1)..(115): unsure at all Xaa locations
  Clone ID: PAT_TA_90603.pep
VXXPRKKIXLXVXYLFXPXWNPSLFYFVQQRXQEIXSIXTTNFXXNHFLTQKRSFIXXEQSVXWCASDVGXAFNKNFKLHGKTLYGIYLLXXPFIIGFFXLPTFXPRPTLIISEL

SEQ ID NO: 196186 - protein, 92 aa, Triticum aestivum
  unsure (1)..(92): unsure at all Xaa locations
  Clone ID: PAT_TA_90604.pep
XPYLIHFAFIIPXFKHPPLPVYXRGXVPVLSFTXGRFKKPSXXXLHLGRGKKKGFVGIXHTRQAIFSLVLKKKLGISFSPXPXDHVIXLVNS

SEQ ID NO: 196187 - protein, 67 aa, Triticum aestivum
  unsure (1)..(67): unsure at all Xaa locations
  Clone ID: PAT_TA_90605.pep
XXXIRDXFXSXRSFXKNLQKXPHNFLRIEPTSRLRAVQSNQKISVPKTVHGXVSSQYGLXPFRSINK

SEQ ID NO: 196188 - protein, 170 aa, Triticum aestivum
  unsure (1)..(170): unsure at all Xaa locations
  Clone ID: PAT_TA_90606.pep
WVELARRAGEIQLMIKRGPGPKVSRSFFFFFPLSSLLLIKHPSNLCPPSSILLLLLNFIVKKISFSSGPSRSNKEDGGKLDKNSRVAFLTXILGWRGLPQRXSNPGSSLEGRATIXGTPAEAAPQDVSTKWTGEREPTGPEDSPXRNXLRXSXGAXGWXERXNPPPGEXR

SEQ ID NO: 196189 - protein, 119 aa, Triticum aestivum
  unsure (1)..(119): unsure at all Xaa locations
  Clone ID: PAT_TA_90607.pep
FEKTFFTFXLPXAXKIFYHTLLFGPIEMCRAGRCFCPPQNKRVQFGAKXQFLLLXWRIDTCEPPRRVSXKVNPLQHPLQIKHHCSGGTQVRSLGQPLLPQLLNELKRRACFSEKYIFPH

SEQ ID NO: 196190 - protein, 96 aa, Triticum aestivum
  unsure (1)..(96): unsure at all Xaa locations
  Clone ID: PAT_TA_90608.pep
RLGXAQXFXPSQRTVCKNGPXXVEXLIPTSTXXGRKFGPRKVXHCFPGXXIGRPXGXFXFSXGSRPEVEPSIILSKSRIXHCKLXSYXFCNLSDAH

SEQ ID NO: 196191 - protein, 150 aa, Triticum aestivum
  unsure (1)..(150): unsure at all Xaa locations
  Clone ID: PAT_TA_90609.pep
VLKKKXKXFPLNLXLFFIPFFXDPHPKVGLGGQVHFQFXXFKVLIXXFWPFPLFSFFVKVPRGXGQFXSKEKFXTFNPNQPITRGFILRXFLXGLGFPHILCPLYLCXVLRNILXLXYLXQTLFDHLTLGFSPXILVAYPGITLIFPXPX

SEQ ID NO: 196192 - protein, 63 aa, Triticum aestivum
  unsure (1)..(63): unsure at all Xaa locations
  Clone ID: PAT_TA_90610.pep
RPGRRAXNSLXDYPAARGKVRGKVXIPEFFFLIQLFIYPLSKNFLENXNFIFSFXXGLDDXSS

SEQ ID NO: 196193 - protein, 47 aa, Triticum aestivum
  unsure (1)..(47): unsure at all Xaa locations
  Clone ID: PAT_TA_90611.pep
MIERPGQVFFVXESMHDDGGVVFAYXKEGAADPTFLYFAHGLKXXKC

SEQ ID NO: 196194 - protein, 57 aa, Triticum aestivum
  unsure (1)..(57): unsure at all Xaa locations
  Clone ID: PAT_TA_90612.pep
VVSLXXFGXXFXPTQXLSGFLGSKYILVQTXLRGPEGNFLLLFLQTPSXRGPTLIIS

SEQ ID NO: 196195 - protein, 196 aa, Triticum aestivum
  unsure (1)..(196): unsure at all Xaa locations
  Clone ID: PAT_TA_90613.pep
QFWXXGVGXLKXKXGXNPFFXEKKXXXXGFPPLFLXPLXNXEKXWFXXKKKXLPXPPXXVKXGXXXSKXGIFXFFXKNXXLFNLVQXXNXSIXFSXEXWHXXPRXGLWNLKQGLPHSGXAPPLGIFGFVPRXPIPLFVFVAALSXFYFXPSRLLXXGFXVPRTXLXFRRRPRINRRLGXVRPNRVHRCXGRPXENH

SEQ ID NO: 196196 - protein, 89 aa, Triticum aestivum
  unsure (1)..(89): unsure at all Xaa locations
  Clone ID: PAT_TA_90614.pep
GGXLKAXXVKTPIXLNLIXXDXPIFALLVFYNTSRELLKLIFGKIQIXLNFPRPXGAQKTXVPFLDSXFDQFIPAAIVIIAVFYXVFRI

SEQ ID NO: 196197 - protein, 112 aa, Triticum aestivum
  unsure (1)..(112): unsure at all Xaa locations
  Clone ID: PAT_TA_90615.pep
DQPNLGHLFLLLKPLXNMFPHYLESYFDISCIKXRDYRIVFIGTLVXILRGIRSKIFFXHIKHCFXGXKHCFIQNTXIGLVFFGDTPHFXFSXHIXXXXLAXPXXGPTLINX

SEQ ID NO: 196198 - protein, 134 aa, Triticum aestivum
  unsure (1)..(134): unsure at all Xaa locations
  Clone ID: PAT_TA_90616.pep
SKLMAIPNAVWGKAPPQXXAEPGXGXAAEIQXXXIKPWGXRXRRFFFFFWXNLKAXXKCSKGXGEQYNESREPXXILDXGEKXPKNSLIYPNXKRPPPTXXWEPWGKXAKWKLSISXDELKXKNGXGQLXAXKF

SEQ ID NO: 196199 - protein, 97 aa, Triticum aestivum
  unsure (1)..(97): unsure at all Xaa locations
  Clone ID: PAT_TA_90617.pep
RXFGXFXPEPPAXIXSKLXXRGDFXPFXFPXPXPLXLXTXRXDXLXPLPLLXTRXGXXXPAHLXSPVAPCGXXPLXYXIRFPFGSFPXGAPSSCNXX

SEQ ID NO: 196200 - protein, 53 aa, Triticum aestivum
  unsure (1)..(53): unsure at all Xaa locations
  Clone ID: PAT_TA_90618.pep
SKSNIKYLXQMDXFHNKSSWIRELRDSRFNPDGIPXSFYTSRXPNSXPGFFKN

SEQ ID NO: 196201 - protein, 63 aa, Triticum aestivum
  unsure (1)..(63): unsure at all Xaa locations
  Clone ID: PAT_TA_90619.pep
LMLFPXPAVDDINFVNRVHPLLFGKAPTFGRGPPFNXLVNSAXRPCQVRTHYWEELPQRRLDA

SEQ ID NO: 196202 - protein, 87 aa, Triticum aestivum
  unsure (1)..(87): unsure at all Xaa locations
  Clone ID: PAT_TA_90620.pep
HPNSLPVVWLAFASSSLLYPIIAXXLXLKXPGVRFGYYSPARKPPGNTSGGPVLVRFFRGHLKIVRDRVLRMATTVGMPCALLGFCF

SEQ ID NO: 196203 - protein, 69 aa, Triticum aestivum
  unsure (1)..(69): unsure at all Xaa locations
  Clone ID: PAT_TA_90621.pep
APDCPVLNXSYFVKAFXFFCCGGPSFLFFVPXQKKKKKTRXLVFXPCXGAXRLGNPLVISRPXLASSPL

SEQ ID NO: 196204 - protein, 86 aa, Triticum aestivum
  unsure (1)..(86): unsure at all Xaa locations
  Clone ID: PAT_TA_90622.pep
KTHMGTANSKXFHTRKIKKGGQNASNGLPNLPTXXXLXLFPQXNNSWDXXXHXXNRGGQSVSXTSTPQXWGQKXSXPQYPXNWXXI

SEQ ID NO: 196205 - protein, 96 aa, Triticum aestivum
  unsure (1)..(96): unsure at all Xaa locations
  Clone ID: PAT_TA_90623.pep
RXFQLEIGLNVLEQGQWTETXLPGXCLCIFSXAWLVXSRHXXSEALTPXIXGVCFAKIRTTCCFXHFSSTQLVXHIAFFLXXKKNXSAXXPPXNSX

SEQ ID NO: 196206 - protein, 75 aa, Triticum aestivum
  unsure (1)..(75): unsure at all Xaa locations
  Clone ID: PAT_TA_90624.pep
WGTLPXXPNLEXXAAKXNKWINVXXXRRPQVFFFKNKLNLLREXKESSKFLPQPQPEKSKYNLXHXFTXXXRIIX

SEQ ID NO: 196207 - protein, 140 aa, Triticum aestivum
  unsure (1)..(140): unsure at all Xaa locations
  Clone ID: PAT_TA_90625.pep
PIPGVXFRAXXPVFXVNFPTKVSGKPGFFTTSGTNSNGWGRAFWFHLVTRPGERPARXPXWLTXAPXLXGRXSPVRVXFKXCFGQGXXXVREEXPIGSFKXPRLHSPKNRPRKEESRXPPXGXCSLLRLLRVLVRRTCCL

SEQ ID NO: 196208 - protein, 96 aa, Triticum aestivum
  unsure (1)..(96): unsure at all Xaa locations
  Clone ID: PAT_TA_90626.pep
RLXMXGGPTLIVGVVXDXLXXEALLEFXGXPIDEXRGHHHQQXREXPVFTSSHXHRLXXXCHXEFXPFFXXXVGCLILCSXKVWFXVXCSIGXWLX

SEQ ID NO: 196209 - protein, 170 aa, Triticum aestivum
  unsure (1)..(170): unsure at all Xaa locations
  Clone ID: PAT_TA_90627.pep
SGLXXLRLSQERKSQTGXGGVPQXRFEXFLWLCFKRPGXAGIQFGSPSPXLRTLKERTGFRTYRKRLCFXPSHFLAPSFLXVXFFLSPSXXRLIGSKSFASAFLQAGXXFXLXLAXWRSQXIXXARLASXFPFLQRLSLXLIAPAXFSMTIVXSLLLTITITSXXDXXNH

SEQ ID NO: 196210 - protein, 87 aa, Triticum aestivum
  unsure (1)..(87): unsure at all Xaa locations
  Clone ID: PAT_TA_90628.pep
TNRNTQSYATNRGGEPPNNGXTRXGGAKSLNGLTVGXXRKXGNXKPHKLKKADGVFPLXKKFXXWQVMDKVERDXXLVPRSGLIQLF

SEQ ID NO: 196211 - protein, 72 aa, Triticum aestivum
  unsure (1)..(72): unsure at all Xaa locations
  Clone ID: PAT_TA_90629.pep
KNGIKSPQSXDSEPTNNQVYKPTAPNTELLEGTKGGDSDLPXKFXLPALKPQGNNXESRSLPFVNSPINFPS

SEQ ID NO: 196212 - protein, 176 aa, Triticum aestivum
  unsure (1)..(176): unsure at all Xaa locations
  Clone ID: PAT_TA_90630.pep
FXXGARAXFFFFFFFNSXSKESFLQLXQQTNNKQSLRWSANKTDQPQTQQKSKVSTNYPCLPLPTNPLQKIGSPLKPSTSSSWVLVVEAAVGRPPPPGSSAGPLVHGPTRRGLQQRAXQPPFGASSSVSPPFLGPVWVSRPSQLQKPXLXGAPSNFLLLLXSPXLVRQACPLXPTG

SEQ ID NO: 196213 - protein, 43 aa, Triticum aestivum
  unsure (1)..(43): unsure at all Xaa locations
  Clone ID: PAT_TA_90631.pep
PGYXHLRPGXTFXPLVEFGGXPCRXDXYWESFPNAFGCIALII

SEQ ID NO: 196214 - protein, 127 aa, Triticum aestivum
  unsure (1)..(127): unsure at all Xaa locations
  Clone ID: PAT_TA_90632.pep
VNQGGLQKTPKSKXXNLLXGITKNAKRNSVXYNAXFWXLXRMDXGSTPAGEQXLIQXPRGPANGGGREAMXKXGPQXPPXXVRSLIXKFXWGXRFXKRPGLGKNPWXVTXXLXRXXKXNPPXSPXWG

SEQ ID NO: 196215 - protein, 96 aa, Triticum aestivum
  unsure (1)..(96): unsure at all Xaa locations
  Clone ID: PAT_TA_90633.pep
GGIGAXTLXCSPARHWXPAGEFRFXSGPPRGKVLVLEFFFFFFLTRDNFIDKAPHVTIDTNVVRTHNNISSPTFAXAXWNXPAPRPQHPLNLHADN

SEQ ID NO: 196216 - protein, 153 aa, Triticum aestivum
  unsure (1)..(153): unsure at all Xaa locations
  Clone ID: PAT_TA_90634.pep
SFLRQGGVENTGFLPVFXPFTKSSIPHCLPKVVSPTGLKNLSLHKPTESLLQKLRATRLSTLYFDFFYLSKFASRGQGPSPAAKKQRTINFPSSPKRATSLSSSFFFAGGTSGPRPRLIHLVNSRPALQVRPXXGRASQTRLDALAFEYFYSV

SEQ ID NO: 196217 - protein, 126 aa, Triticum aestivum
  unsure (1)..(126): unsure at all Xaa locations
  Clone ID: PAT_TA_90635.pep
RGXXPRGKHQDNKSSSEFXTDGGPTSKSXSRPKFNLFVKAXVRRHWDGRWHTIDNQVLSMASTCFLKXFGXLLFINXXSFXALVPACLPGNQKPCRGTNFYKLRHGSPNKFCQSSSXNVFKKNLGP

SEQ ID NO: 196218 - protein, 89 aa, Triticum aestivum
  unsure (1)..(89): unsure at all Xaa locations
  Clone ID: PAT_TA_90636.pep
KITNFXRFFLKSILIYSFTKRDKXLGXGXTRKPXFIRKNWKVKNWXVKXLQISFXNXEXYXSNMXRGNPLPPPTSXFINVXRGIWGPXX

SEQ ID NO: 196219 - protein, 112 aa, Triticum aestivum
  unsure (1)..(112): unsure at all Xaa locations
  Clone ID: PAT_TA_90637.pep
MAPTVMASSXTSVAPFQGLKSTAXLPVXSRRSNGASLGSVSNGGRIRCMQVWAIXGIKKFETLSXLPXLNXEGLLKQVDYPDPLQSGWPFPLSLNKRSGFQSFRAKNAVSPG

SEQ ID NO: 196220 - protein, 74 aa, Triticum aestivum
  unsure (1)..(74): unsure at all Xaa locations
  Clone ID: PAT_TA_90638.pep
YDVVLIRKPLXXHCYRVXIECWFPYDILPLVYSNAXMIITXTICLXSKKKKKKKKKKKKKXLETRPARAAARNH

SEQ ID NO: 196221 - protein, 105 aa, Triticum aestivum
  Clone ID: PAT_TA_90639.pep
FRAAARAGLILQAVLVMGILSHVNADYFPKCCNSCRSFSGVDVCDDAHPQCPKGCSACRVVTPNPHKTFRCADMKSTVDGTCGGAMQKALIRSRLQAQTKCARLK

SEQ ID NO: 196222 - protein, 62 aa, Triticum aestivum
  unsure (1)..(62): unsure at all Xaa locations
  Clone ID: PAT_TA_90640.pep
AAARAFFFFFFFFFFFFFFFFFFFFFFFFKXKXXXFIXXRSVFNILRGGPVYTQLFKRGDCG

SEQ ID NO: 196223 - protein, 57 aa, Triticum aestivum
  unsure (1)..(57): unsure at all Xaa locations
  Clone ID: PAT_TA_90641.pep
TVNSLLYSSPSRCVRXMCLTYLFRQLMNSNCFPKKKKKKKKPRDLVLSPARAAARNH

SEQ ID NO: 196224 - protein, 79 aa, Triticum aestivum
  unsure (1)..(79): unsure at all Xaa locations
  Clone ID: PAT_TA_90642.pep
NFLXXSLRLGPFXLLKXXISPRRALFCIKIWFXXQDKIWTVFXFXSXXQXTIXNXDXXXSXXNPRTEHXEXCXFFXGXF

SEQ ID NO: 196225 - protein, 56 aa, Triticum aestivum
  Clone ID: PAT_TA_90643.pep
SLSMCCNDLLDNSSQRVQANLHVKYQTIGPHDFGLLVKKKKKKNSRHLPGRPLEIT

SEQ ID NO: 196226 - protein, 106 aa, Triticum aestivum
  unsure (1)..(106): unsure at all Xaa locations
  Clone ID: PAT_TA_90644.pep
MEHKETGCQSREXPILCVNNCGFFGSAGTMNMCSKCHKEMXMKXEXAKLGASSFDSIVNGGDAAKEHLAANVGVAHVEGTLINAGDIAGPQGNQTQKGQAGNKGRG

SEQ ID NO: 196227 - protein, 112 aa, Triticum aestivum
  unsure (1)..(112): unsure at all Xaa locations
  Clone ID: PAT_TA_90645.pep
LLSNPKMTVGEXXRYXHMLVQEQDNVKRVQLXADTLLEPRQLLGDANQDAMKTCFLLRLEHSPYTPTISCLHRXGKGAQQGTLPVPAGCTDQTAKNFDPTARSDDGSCLYTF

SEQ ID NO: 196228 - protein, 99 aa, Triticum aestivum
  unsure (1)..(99): unsure at all Xaa locations
  Clone ID: PAT_TA_90646.pep
PPTXFFFFSQXSXGPFSFFCWXEPLXVDGRLVXPLQXXGGCXPNFPVLSTWXERGQVXIAXFXKXFAVXQYFCSXXWLPXGLPNVGVSNCQMLSVXKTX

SEQ ID NO: 196229 - protein, 79 aa, Triticum aestivum
  unsure (1)..(79): unsure at all Xaa locations
  Clone ID: PAT_TA_90647.pep
MGXGNAXKSKMARERNLXKLKGGKGSQLEANKKXMNIQCKXICMQTFICTTSEAKCKEHAQGKASEERSSSKCFPHLKQ

SEQ ID NO: 196230 - protein, 142 aa, Triticum aestivum
  unsure (1)..(142): unsure at all Xaa locations
  Clone ID: PAT_TA_90648.pep
LWSRPRSPLQSPNPSHLLSPQPSSSARFPGASGAGXAMASETETFAFQAEXNQXLLSLIINTFYSNKEXFLRELISKAXSDALDKXRFEXSLTDXXKLGAXPEXLFIHIIPDKXTKXLXLIDSGIGXGXSQNLRENWEQQAW

SEQ ID NO: 196231 - protein, 74 aa, Triticum aestivum
  unsure (1)..(74): unsure at all Xaa locations
  Clone ID: PAT_TA_90649.pep
GRLPLLXGETVVSHQCIHXCLMYKKDLADXHVXLDIEGKSCVVNSSLAAMXXPSDXGLLXAXHQLQQQWRICVL

SEQ ID NO: 196232 - protein, 93 aa, Triticum aestivum
  unsure (1)..(93): unsure at all Xaa locations
  Clone ID: PAT_TA_90650.pep
EFFFFFLVDXLYNXXRPCIYXATDSIHIRACFLXPCWYMNMXIHIFLGTNKKDKWGRXTQSNVRVDKTAMXLYIWPVLSXLFKPCRXPXNPVX

SEQ ID NO: 196233 - protein, 70 aa, Triticum aestivum
  unsure (1)..(70): unsure at all Xaa locations
  Clone ID: PAT_TA_90651.pep
XIHYXLXWXRXRXFFFCGTXHFXTISIDDXTRRDQXHPGGKGKHTLHTPVCLXPLLPPXNXRRXKRSXAP

SEQ ID NO: 196234 - protein, 68 aa, Triticum aestivum
  unsure (1)..(68): unsure at all Xaa locations
  Clone ID: PAT_TA_90652.pep
NSLMINVVXAEGFFFFFFFFFFFXKXXMXXNTTSLKPIIMPLFXXKXKXXLSQPSXXSKHNHNNKSXA

SEQ ID NO: 196235 - protein, 116 aa, Triticum aestivum
  unsure (1)..(116): unsure at all Xaa locations
  Clone ID: PAT_TA_90653.pep
RLSEERERETRECQXXRXRGTNKVCXLDACDRTEDCQRARKRERERERNQQGLCVDPCDRTXDCQRERETETERERDRDRGRGTNKVCMLDACDRTEDYQRERERQRETSAATTLI

SEQ ID NO: 196236 - protein, 113 aa, Triticum aestivum
  unsure (1)..(113): unsure at all Xaa locations
  Clone ID: PAT_TA_90654.pep
MXAAFSSTVGAPASTPXNFLGKKLKKXVTSAVNYHGKXSSKXNRFTVMGAXETXTEKRNTRQSWKGLAYDISXDHQDITKRGRXSXGSLLPXRPTGRTXNHXRFLPNETVCQG

SEQ ID NO: 196237 - protein, 34 aa, Triticum aestivum
  Clone ID: PAT_TA_90655.pep
ELVPRFFFFFFFFFFFFFFFFFFFFFFGIVCKPI

SEQ ID NO: 196238 - protein, 129 aa, Triticum aestivum
  unsure (1)..(129): unsure at all Xaa locations
  Clone ID: PAT_TA_90656.pep
ERYEEMVEFMEKVAKTADVGELTVEGRNLLSVAYXNVIGARRASWRIISSIEXKEESRGNEAYVASIKEYRTRIETELSKICDGILKLLDSHLVPSATAXKSKVFYLKNEGXTYHRYLAGVQXXVPEKE

SEQ ID NO: 196239 - protein, 100 aa, Triticum aestivum
  unsure (1)..(100): unsure at all Xaa locations
  Clone ID: PAT_TA_90657.pep
PFFXPFGXRFEXXPFXKXKXRPXSPGGVEXKXGFEXPXQVFFFXSGXIYPPXRGDPPPQXXFPXFFLPFKXGDXGXAQPNLXVFLXGXTXXGTRLIIXXF

SEQ ID NO: 196240 - protein, 72 aa, Triticum aestivum
  unsure (1)..(72): unsure at all Xaa locations
  Clone ID: PAT_TA_90658.pep
MEHKETGCXSREGPILCVNNCGFFGKXATMNMXSKCHKEMAMKQEQAXLXASSFXXIINXGDKKNLAANAVV

SEQ ID NO: 196241 - protein, 74 aa, Triticum aestivum
  unsure (1)..(74): unsure at all Xaa locations
  Clone ID: PAT_TA_90659.pep
KIKNFSIFSYSFYLXFQKEIRIGLVXRKQFYRKIEVKIEGKIAISFLREXTQQXAWVIXSSPLPXYYVXGDLGP

SEQ ID NO: 196242 - protein, 177 aa, Triticum aestivum
  unsure (1)..(177): unsure at all Xaa locations
  Clone ID: PAT_TA_90660.pep
SITFXXXGPXPXVPSKLQRLXAKXNPWFWLKLEAKGPIEQKAWGVGPRWXNXPKGFQFQXGPPSSXRKQXXPQFLWXFGGEDPKPVQFLGAXDXLIAALNHPRVGXSKGXXHXRIXIXXKVTQCLQTMGVVSXIFPXCGXTHDDVLCFPVVVTKMSASETTSSQGEDHLPGRPLEIT

SEQ ID NO: 196243 - protein, 106 aa, Triticum aestivum
  unsure (1)..(106): unsure at all Xaa locations
  Clone ID: PAT_TA_90661.pep
MLVYQNKLSGDELLSDSFPYRELENGVLWEVDGHWVVQGAXVDVDIGANPSXAEGGGDXXGVDXDXTVKVVENVDTLXLQXSXPAFXKKQVYLNNASATKKPPLPK

SEQ ID NO: 196244 - protein, 73 aa, Triticum aestivum
  unsure (1)..(73): unsure at all Xaa locations
  Clone ID: PAT_TA_90662.pep
FQPAXRXIXXXXYLGEIXATXXPTKVKYTXPKQSHYNXDKXPEXVIKILXFLVPXXIXGLAVPVXIYTKAESV

SEQ ID NO: 196245 - protein, 132 aa, Triticum aestivum
  unsure (1)..(132): unsure at all Xaa locations
  Clone ID: PAT_TA_90663.pep
RGPGRRFXXRFTNXDVTAQIVXATNAGXIVMAAAXSHELXPHGLEVGLTNXAAXAYCTGLLLXXPVLKNRDLDEEYXAMLIGXGEDFSVEXSEXXRXFRAPLDVGXIRTTTGKPCVWCPLKGSFLGGKFPTN

SEQ ID NO: 196246 - protein, 95 aa, Triticum aestivum
  unsure (1)..(95): unsure at all Xaa locations
  Clone ID: PAT_TA_90664.pep
MISSGRPGRTTKRRRRRRQRKKEERPAMVHVNFYXNYGNTFKKXRRPYEKXRLDAEXKLVGEYGXXCKXXELWRVQYALHCLQDTCSTFKPLPSF

SEQ ID NO: 196247 - protein, 52 aa, Triticum aestivum
  unsure (1)..(52): unsure at all Xaa locations
  Clone ID: PAT_TA_90665.pep
ILFPXIRSCXCSXRISMXGXKRKXNLAECHIXIGXNINCCXLTFVXKKTSAR

SEQ ID NO: 196248 - protein, 143 aa, Triticum aestivum
  unsure (1)..(143): unsure at all Xaa locations
  Clone ID: PAT_TA_90666.pep
PSPLPPALVERAFKELVPGPWLRXTETFXFQAEINQLLSLNNQNLXFQTREIFLRXRSISXXPDALGKXXGFESLTGQKXSWVLXXXLFIQINPDKGXEQXQLLIXSGXLGMKKSXDLVXNXGTNARXGTKGFYGTGLPGAEC

SEQ ID NO: 196249 - protein, 124 aa, Triticum aestivum
  unsure (1)..(124): unsure at all Xaa locations
  Clone ID: PAT_TA_90667.pep
QATCCRLXPVLXRIGXQXXFFCNKDYVAITTXXXAXRTCLFFAKMFLQXRFCCKKKTATLXLLHXFCNXIIVGKMSLQQXLRCKGERNXRVVNGXXDSXRXLRGXGXFKKXSARADRVNKXPLK

SEQ ID NO: 196250 - protein, 90 aa, Triticum aestivum
  unsure (1)..(90): unsure at all Xaa locations
  Clone ID: PAT_TA_90668.pep
MKGTKLAXILILXAVLVMGVLSHVNADYFPKCCNNCRSFSGVDVCDDAQPKCPKGXCPGCRXVSXXPXMWRCAXXKSNVXGTCGGACXXY

SEQ ID NO: 196251 - protein, 97 aa, Triticum aestivum
  unsure (1)..(97): unsure at all Xaa locations
  Clone ID: PAT_TA_90669.pep
QDKPXEFVIKDPXXCLVPPXDTGLXRXRTDXPQGGVCXXTXVLXQSVSQSFGSAQELNKFXWGFAFCTSVTVXXMKCGNCSRXXVAFXXVRRPXLKS

SEQ ID NO: 196252 - protein, 85 aa, Triticum aestivum
  unsure (1)..(85): unsure at all Xaa locations
  Clone ID: PAT_TA_90670.pep
XXGRXWGXXKPRPFFPXHPXRNGLGXNXPXXPFRPLERVCPKVRLGXRSRTPFQXAWWERIKWWEPGXFPLLAWPHPGFNLXAXT

SEQ ID NO: 196253 - protein, 52 aa, Triticum aestivum
  unsure (1)..(52): unsure at all Xaa locations
  Clone ID: PAT_TA_90671.pep
HXFXXIPFSXFLDERXLYRINPSXLLMEGXXFPEXIIRSXXXEKKKKKSRPA

SEQ ID NO: 196254 - protein, 77 aa, Triticum aestivum
  unsure (1)..(77): unsure at all Xaa locations
  Clone ID: PAT_TA_90672.pep
QXXXGIHWRPQGRXQSEVKSXKKAKEKRMXLXTSXRFYKKKMXFLFXENINXQLEILCXXXVICNMXPLTFQKKKXK

SEQ ID NO: 196255 - protein, 79 aa, Triticum aestivum
  unsure (1)..(79): unsure at all Xaa locations
  Clone ID: PAT_TA_90673.pep
FFFXFFFXPXXNWFGLSXTPSCTKXTFAKAQILPVSXPLSXXQNXXLKLLTKKGGGSNSXWEEPXATFXPGFDFLXISC

SEQ ID NO: 196256 - protein, 77 aa, Triticum aestivum
  unsure (1)..(77): unsure at all Xaa locations
  Clone ID: PAT_TA_90674.pep
MAXLAXXKXLGXRVNFXGSSKYATEGPTAXXXKIXSLFXRFXKKPAXKAEARPPWGTXSGXXPRXSSXXGXDLDKFF

SEQ ID NO: 196257 - protein, 34 aa, Triticum aestivum
  Clone ID: PAT_TA_90675.pep
PSTITYIASHQTSHGSFNKRYFMISSELWTRQHY

SEQ ID NO: 196258 - protein, 120 aa, Triticum aestivum
  unsure (1)..(120): unsure at all Xaa locations
  Clone ID: PAT_TA_90676.pep
LPSRDALXVRXDAENLTEAHPVAAPFEEAGXVPXARPTCKRATXTGGXLVPRIGNPVRALGRXSRELLRXPNPKXXQSSSVEAXPQSSGQPXMNFKXPPRPFPXNWWXTGXTVSXPRPIP

SEQ ID NO: 196259 - protein, 46 aa, Triticum aestivum
  unsure (1)..(46): unsure at all Xaa locations
  Clone ID: PAT_TA_90677.pep
LAWSRPRLEFFFFFFFFFFFFFFFFFFFFFXKTTLSRKYAFQFSAA

SEQ ID NO: 196260 - protein, 150 aa, Triticum aestivum
  unsure (1)..(150): unsure at all Xaa locations
  Clone ID: PAT_TA_90678.pep
SCTLGXSKSXNKXTQVLYKXLKVQRGKQANLRPNKSNIKPISSXSILLSAFWGEXXGRXLVGXXHHYSGXHGTRVLPSKSPYSTNTPERNKEWLASXXAGXXRFPPGLPNPXXNXTNPVNSIRXXPFNSXXXFPXIPPAXNPSDNPIXWX

SEQ ID NO: 196261 - protein, 76 aa, Triticum aestivum
  Clone ID: PAT_TA_90679.pep
RGRGRGLNPATSGEAGGGGGVREGLFSSQAPIACGRESLIRRSNSFSTSGVRLNFPPLVMTPTWALRDFSEIVRWA

SEQ ID NO: 196262 - protein, 89 aa, Triticum aestivum
  unsure (1)..(89): unsure at all Xaa locations
  Clone ID: PAT_TA_90680.pep
FXHVXPXFLDRXSTXLPNXCKPCXXLXLXPWXFTXXXHXLLELLPQGXWSXVETGAPDGGGEGSSHLGAXWXTXASNGRCAXXLVTSPA

SEQ ID NO: 196263 - protein, 57 aa, Triticum aestivum
  unsure (1)..(57): unsure at all Xaa locations
  Clone ID: PAT_TA_90681.pep
CXSMLALXNLSLLGNXDCMAXXASXAXPXXEXXPXWLCCVSFXLXKXKKXLRDLPGA

SEQ ID NO: 196264 - protein, 89 aa, Triticum aestivum
  unsure (1)..(89): unsure at all Xaa locations
  Clone ID: PAT_TA_90682.pep
EFTSDXXGRGRGFFFFXPIIMPLFLGKSKRXPLPTLTXGQXITIXXXPPPXETXXMIIEGKQDRLXXSSRLGAXGSRLKASRPSXXXML

SEQ ID NO: 196265 - protein, 144 aa, Triticum aestivum
  unsure (1)..(144): unsure at all Xaa locations
  Clone ID: PAT_TA_90683.pep
NSLVIXKRPARAGLXLQAVLVXGDPLTXEAPTISPKCLQXVVGPSPGGRRLRTTPTPKCPXGCSXCARWXRPXPSQRRFRVRPTIXXSTGRXGILGGXGHGKKRXLDXVXGXFQGLXXXGXCSXLKIKHPSXXYQCKQVHCGXP

SEQ ID NO: 196266 - protein, 92 aa, Triticum aestivum
  unsure (1)..(92): unsure at all Xaa locations
  Clone ID: PAT_TA_90684.pep
AYSVRKVKRNVLIFKLXFLXRSAXTPXSEIPRGPPMGXPGXPLTTFXAXISXPXTXXRSVXXNFXWGPVGFXQNXRCXWGXKXPCGVLHLKL

SEQ ID NO: 196267 - protein, 88 aa, Triticum aestivum
  unsure (1)..(88): unsure at all Xaa locations
  Clone ID: PAT_TA_90685.pep
FRSGPPGQGVFFFFLFVSXKDIGRXLLLLILFPIEMYRDPMCPTYNXILVQWXXTKKCAKKPLIWPSANSNGVAFPFLPNLRARRTNG

SEQ ID NO: 196268 - protein, 106 aa, Triticum aestivum
  unsure (1)..(106): unsure at all Xaa locations
  Clone ID: PAT_TA_90686.pep
IKRPPGQVKNGIKFGEAVWFKAGAQIFSEGGLDYLGXPQXCVHAQSILAIWXAVQVVLMGFIXGLPVLGGGAPSGEGPRIIYPRGALRPTLVLAERTPHPARFLKG

SEQ ID NO: 196269 - protein, 52 aa, Triticum aestivum
  unsure (1)..(52): unsure at all Xaa locations
  Clone ID: PAT_TA_90687.pep
EIHXXIXCXRPGXXXQVFFFFLQXKKXHLSKPGVXWSXPHTIHIXXTSXSFT

SEQ ID NO: 196270 - protein, 144 aa, Triticum aestivum
  unsure (1)..(144): unsure at all Xaa locations
  Clone ID: PAT_TA_90688.pep
RGRGRGAAFSSTVGAPASTPTNFLGKKLKKQVTSAVNYHGKSSKANRFTVMAAENLDEKRNTDKWKGLAYDISDDQQDITXRGKGIVDSLFQAPTGDGTHEXVLSSYEXYVSXGLKKYDFDNTMGXXXIAPAFMDKXVVHLSKK

SEQ ID NO: 196271 - protein, 87 aa, Triticum aestivum
  unsure (1)..(87): unsure at all Xaa locations
  Clone ID: PAT_TA_90689.pep
RGRGRGIDIALWKFETTKYYCTVIDAPGHRDFIKNMITGXTSXADCAVLIIDSTTGGFEAGISKDGQTREHALLXFTLXVXQMXCCW

SEQ ID NO: 196272 - protein, 82 aa, Triticum aestivum
  unsure (1)..(82): unsure at all Xaa locations
  Clone ID: PAT_TA_90690.pep
NKKNVITNIYVHSRVQELTIYXTCSVLKGXVLYLPSMVFXPRQGLRHSTAXPXKIFEKKAPRSFLPXXXFXLVKTNXGXAPX

SEQ ID NO: 196273 - protein, 95 aa, Triticum aestivum
  unsure (1)..(95): unsure at all Xaa locations
  Clone ID: PAT_TA_90691.pep
MVKAVAVLTGSEGVKGTIFFIQEGDGPTTVTGSVTGLKEGLHGFHVHALGDTTNGCMSTGPHFNPAGXVHGXTKDEIRHAGXILGNVTTGADGVC

SEQ ID NO: 196274 - protein, 73 aa, Triticum aestivum
  unsure (1)..(73): unsure at all Xaa locations
  Clone ID: PAT_TA_90692.pep
ARIXLMINVGPXRXVQXXWTKLPXKVGXTRNXXPASFRSGTGSPTKRGTKASTKPRPLXIHRQTRXGTXLMGW

SEQ ID NO: 196275 - protein, 94 aa, Triticum aestivum
  unsure (1)..(94): unsure at all Xaa locations
  Clone ID: PAT_TA_90693.pep
MKGTKLAAILILQAVLVMGVLSHVNADYFPKCCNNCRSFSGVDVCDDAHPKCPKGCSACRVVSTNPEMWRCADMKSTVDGTXCGGPCKKVLISC

SEQ ID NO: 196276 - protein, 79 aa, Triticum aestivum
  unsure (1)..(79): unsure at all Xaa locations
  Clone ID: PAT_TA_90694.pep
CFPAPAGFISPPGRFXFFFFFFFFFFFFFFFFFFFFFFFFFFHSTTVRVGQVHLVQQNEETEENSGMVLRHLGRDHANH

SEQ ID NO: 196277 - protein, 100 aa, Triticum aestivum
  unsure (1)..(100): unsure at all Xaa locations
  Clone ID: PAT_TA_90695.pep
PPYLLVACCSSTYIYLSLXTSLNSLDREGARLLESLWLHRLLLHQMQGLMIPLQETRMSSSGSSTGTLNVTMFPFPMISSGAQLGVNGTVVDLGRDHANH

SEQ ID NO: 196278 - protein, 88 aa, Triticum aestivum
  unsure (1)..(88): unsure at all Xaa locations
  Clone ID: PAT_TA_90696.pep
XFLXXIXPRXXNHQXXFNRXGXTLVLXGPAPRGPKIXXHTXKLKMGAPPXPXPTWQXRFXTXXKNFNQQPXTXLXXXTQHXSVFFGRG

SEQ ID NO: 196279 - protein, 58 aa, Triticum aestivum
  unsure (1)..(58): unsure at all Xaa locations
  Clone ID: PAT_TA_90697.pep
TTITRRPAXDSGETSPXKXXLVQKNLXTHIALQCVQTGXXKQLKXTPAPXGRXKSXVN

SEQ ID NO: 196280 - protein, 47 aa, Triticum aestivum
  unsure (1)..(47): unsure at all Xaa locations
  Clone ID: PAT_TA_90698.pep
LCVVAAEVRELVSEFFFFFFFFRXILNNFITASVAHLCGAAYTLVER

SEQ ID NO: 196281 - protein, 106 aa, Triticum aestivum
  unsure (1)..(106): unsure at all Xaa locations
  Clone ID: PAT_TA_90699.pep
MAAKEPXRVLVTGAAGQIGYALVPMIARGVMLGAXQPVILXMLXDIEFAAEALKGVXMELIDAAFPLLKGVVATTXXVXACTGXVMLRLLVGGFPXPRNGNGDGPK

SEQ ID NO: 196282 - protein, 62 aa, Triticum aestivum
  unsure (1)..(62): unsure at all Xaa locations
  Clone ID: PAT_TA_90700.pep
MTHHFESXKAXSXAXXTYPQQAGAIRMGGXIVIKARPCKXVEVSTSKHWEMGQRTVVNLTFG

SEQ ID NO: 196283 - protein, 60 aa, Triticum aestivum
  unsure (1)..(60): unsure at all Xaa locations
  Clone ID: PAT_TA_90701.pep
MESRSVGFEXTTSGFGDPRSTELELRALSIHSKRKSFSIPNVSHVXIVSHKFKLYPLYFN

SEQ ID NO: 196284 - protein, 63 aa, Triticum aestivum
  unsure (1)..(63): unsure at all Xaa locations
  Clone ID: PAT_TA_90702.pep
MEHKXTGCQSREGPILXVXNCGFFGSAXTMNMCSXCHXXMXMXKXXCKSWPASSFDSIXTXGG

SEQ ID NO: 196285 - protein, 166 aa, Triticum aestivum
  unsure (1)..(166): unsure at all Xaa locations
  Clone ID: PAT_TA_90703.pep
DFTSDFXAAARAGVXSFFFFFFKXQXVCIHMIKYSNWTPYXXNKXLARTIYKXGVHXRRTRSCHHPLWLXQDXXFISXXMAMXLEXXACLPGXPKXXNTXYLGHXPKXEXXGRPXXLQPTXPXNXTFXSQLAXQXGGLTSTSXXXGKPPXLHXQQIXDSKWXPAXV

SEQ ID NO: 196286 - protein, 51 aa, Triticum aestivum
  unsure (1)..(51): unsure at all Xaa locations
  Clone ID: PAT_TA_90704.pep
LKXXIKDTXTKGIAARLHIXNSXDIFXKXTYXTSXHLNXITCWHYSTWQXK

SEQ ID NO: 196287 - protein, 103 aa, Triticum aestivum
  unsure (1)..(103): unsure at all Xaa locations
  Clone ID: PAT_TA_90705.pep
PXPQXFLXLXKXQGXLXCSFFWRXXFXDDGGXVFXLLQGGSLLXPNFPXLXHMGXKEXKCLIALYAKIXCCLQYFCXLSMVVQSTPPMLVXGNXQMLSVXKTF

SEQ ID NO: 196288 - protein, 57 aa, Triticum aestivum
  unsure (1)..(57): unsure at all Xaa locations
  Clone ID: PAT_TA_90706.pep
XAYPXAXFLVXTFQXTETYXXTXXXLRGXFRLDKNISWSAXLFLXFYVALXXKLQFX

SEQ ID NO: 196289 - protein, 93 aa, Triticum aestivum
  unsure (1)..(93): unsure at all Xaa locations
  Clone ID: PAT_TA_90707.pep
LSRNLNREEADVRFXXMXDPLISIKWFXLFXWEKKRGPPCPFFXXXRNRXXLCIKKRNFLXLKKKKKEFYXIXIXHFFXLVFLSEIEVIKXGK

SEQ ID NO: 196290 - protein, 97 aa, Triticum aestivum
  unsure (1)..(97): unsure at all Xaa locations
  Clone ID: PAT_TA_90708.pep
XGQXLSKAXGGXXILKPXVGKTAPWGRNXVCPGGGGHXFNDLXSFKGHCFPRIXEGRELXRQDLXEGFKREVVAXLDHFGGQXVELLVXVVSFPPKS

SEQ ID NO: 196291 - protein, 95 aa, Triticum aestivum
  unsure (1)..(95): unsure at all Xaa locations
  Clone ID: PAT_TA_90709.pep
XFTTDXRPPGQXSSFFFFXSXFXIFXLSNEPXLXLXFYVYISXXXNXHKTXLNIKRTLPPMIKIYHGXXKLFLXFYXPSLIISISLRKTNXINGK

SEQ ID NO: 196292 - protein, 72 aa, Triticum aestivum
  unsure (1)..(72): unsure at all Xaa locations
  Clone ID: PAT_TA_90710.pep
TFLKLLYPLTPXFQNFDKYIRTLSTTCSNPGNPDEYHLIDRLIRLVLTLSVSTATTERAFSAMKLVKTRLRT

SEQ ID NO: 196293 - protein, 107 aa, Triticum aestivum
  unsure (1)..(107): unsure at all Xaa locations
  Clone ID: PAT_TA_90711.pep
TIXNQXYAXKRVGGXXKGXTGRXXQIXKWXXGGPXXGKQXXREQXQXGVRGLKTTXKXGKDXPWLXPIRXWVPQXWXXAGXTPGSRKTRDKXSNGWGXGLNRPFNNN

SEQ ID NO: 196294 - protein, 90 aa, Triticum aestivum
  unsure (1)..(90): unsure at all Xaa locations
  Clone ID: PAT_TA_90712.pep
WVIVSPPGGSGVIXSCEFGNIPWVXIGAHXCQRLSKYNXFLXSLGEKKKPXXRRPXPKSEFPAXSPIGGPGEAMXXSGPKFXPLXXGXXN

SEQ ID NO: 196295 - protein, 109 aa, Triticum aestivum
  unsure (1)..(109): unsure at all Xaa locations
  Clone ID: PAT_TA_90713.pep
NSXSDFERXPGQVSLEFFFFFLGWTTSLXAVXAFFFFFLAGXELICWASXYXXFXXGXVPRPXPSXXPWVXXSXSFFFXXLKNKXXLFFFINQRXVVFPWETPGLXFFF

SEQ ID NO: 196296 - protein, 85 aa, Triticum aestivum
  unsure (1)..(85): unsure at all Xaa locations
  Clone ID: PAT_TA_90714.pep
XVAQPPSRXXPRSPFPTFNCPVLLLPGGRNQXHHSPRTFXGTRAXLINPAALLILDWLKLTHXGLGADXXXQLPRTPLYISSSGT

SEQ ID NO: 196297 - protein, 132 aa, Triticum aestivum
  unsure (1)..(132): unsure at all Xaa locations
  Clone ID: PAT_TA_90715.pep
MXAAFSSTVGAPASTPTNFLGKKLKKQVTSAVNYHGKSSKANRFTVMXAXNIXEKRNTDKWKGLAYDISDXDQQDITXGKXIVDSLFQAPTGDGTHEXVLXSYEYVXQGLKKYDFHNTMGRXLIAPXFMGEC

SEQ ID NO: 196298 - protein, 108 aa, Triticum aestivum
  unsure (1)..(108): unsure at all Xaa locations
  Clone ID: PAT_TA_90716.pep
ANTKLGSXEQDLIQRQXXVGRKXRXLNNFTXAXTLKKPGTXFPMGVFTXEGPHNLXNSSSXGXKXNLTXNWXFWWIXFXXQXKRLAQKKXXMERXXFNWDXTGXFXPX

SEQ ID NO: 196299 - protein, 77 aa, Triticum aestivum
  unsure (1)..(77): unsure at all Xaa locations
  Clone ID: PAT_TA_90717.pep
KGXLEKKGPPTRAXQRXPKGFPIQEENXGXYFLARRXFGXMVHLXXCLXARLLYPPGGAXXPVLSFNYXISYXXASG

SEQ ID NO: 196300 - protein, 130 aa, Triticum aestivum
  unsure (1)..(130): unsure at all Xaa locations
  Clone ID: PAT_TA_90718.pep
MAPTVMXSSATSVAPFQGLKSTAGLPVSRRSNXASLGSVSNGGRIRCMQVWPIEGIKKFETLSYLPPLSTEALLKQVDYLIRSKWVPCLEFNXVGFIFREQKRXPXGYYDGRYWXMLKLLMFGCTXRHAR

SEQ ID NO: 196301 - protein, 97 aa, Triticum aestivum
  unsure (1)..(97): unsure at all Xaa locations
  Clone ID: PAT_TA_90719.pep
NSLVIXVXAXEXFFFLFFFGXXQXLGAXTGXIIESXYMDFGKPKPNLLXFFPKXXXKEPKXTLNPPAPXWAQTXXPLILXQTPFLCXXISXLSSSGY

SEQ ID NO: 196302 - protein, 155 aa, Triticum aestivum
  unsure (1)..(155): unsure at all Xaa locations
  Clone ID: PAT_TA_90720.pep
NSLVIKRGRGRGVSSFFFFFFFFFFFFFFFWXFXTIIMTVRWPVXXXPVQXXXXXSLLFXXIXXTPTVKGEVLKRKXNXXNXCHLQSSNPXSQXWIXVYIICTSKFSRTVPEKKKQSGWLQXGKXXCFXGLVGKXXGWXPLPDXNQRGXXARXTF

SEQ ID NO: 196303 - protein, 51 aa, Triticum aestivum
  unsure (1)..(51): unsure at all Xaa locations
  Clone ID: PAT_TA_90721.pep
GGXCCTPVQVXXQLXLALAAAARSLIXDHACTAXAASIIXIYYLPXHVTAT

SEQ ID NO: 196304 - protein, 84 aa, Triticum aestivum
  unsure (1)..(84): unsure at all Xaa locations
  Clone ID: PAT_TA_90722.pep
MASGAHMNMVAVGXMMXAIMFIAXPNAXXAPAETCIXTKTGKVXLAXDCICXKXCACGXKCIXXGXXDXDIQKXFVECXLKNEC

SEQ ID NO: 196305 - protein, 102 aa, Triticum aestivum
  unsure (1)..(102): unsure at all Xaa locations
  Clone ID: PAT_TA_90723.pep
GLFASSFEFVGTXGGPIGXXLRKKGXYXFSPQSHXGRRXSAAXSHFGQSFGRPGLTKASPKFPQVLTYHLAIPNLRVPLQALRALPGISVSQHDLAGLGFEP

SEQ ID NO: 196306 - protein, 82 aa, Triticum aestivum
  unsure (1)..(82): unsure at all Xaa locations
  Clone ID: PAT_TA_90724.pep
ALNGRXPLVGXLCLGALFXPXTHXKKGLKGHXVYFCFSLAXAAAXEAACLSRASAACLSRTSXAXFSIVDLPGRPLEIISEF

SEQ ID NO: 196307 - protein, 137 aa, Triticum aestivum
  unsure (1)..(137): unsure at all Xaa locations
  Clone ID: PAT_TA_90725.pep
GELGPRTFALLPRPAMAXRGEFGFSGPPRARSPSTSPGHPTVCLARSTKPATRDWLLXFLPSXRRVPPGFLXPTQISFGEEXSKKARLTXRXGDPPFNHLVEIRRPAFARFXPIIGRSFPNAFGCNSFWLFLISCXP

SEQ ID NO: 196308 - protein, 63 aa, Triticum aestivum
  unsure (1)..(63): unsure at all Xaa locations
  Clone ID: PAT_TA_90726.pep
NLSDIEHSYRQNXLNYLLEKKRGHLPFFNQCRXRXPMYKKRENFFGFXEKKKXXPLIFHFPFI

SEQ ID NO: 196309 - protein, 131 aa, Triticum aestivum
  unsure (1)..(131): unsure at all Xaa locations
  Clone ID: PAT_TA_90727.pep
MAAAFSSTVGAPASTPTNFLGKKLKKQVTSAVXYHGKSSKANRFTVMAAGNIDEKRNTXDKWXGLAYDISDDQAGHHQEGRASWXSLFQAXTGRTXPTRXSSSSYEYVKQGLKKXYDFXXHHGEGSKSLLL

SEQ ID NO: 196310 - protein, 125 aa, Triticum aestivum
  unsure (1)..(125): unsure at all Xaa locations
  Clone ID: PAT_TA_90728.pep
MAPTVMASSATSVAPFQGLKSTAGLPVSRRSNGASLGSVSNGGRIRCMQVWPIEGIKKFETLSYLPPLXTEGLLKQVDYLIRSXKWVPCLXFNKVGFIFREXNASPGXYDGRVGNVGKLNVSGGT

SEQ ID NO: 196311 - protein, 110 aa, Triticum aestivum
  unsure (1)..(110): unsure at all Xaa locations
  Clone ID: PAT_TA_90729.pep
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEGAIGQXQRPKPV

SEQ ID NO: 196312 - protein, 65 aa, Triticum aestivum
  unsure (1)..(65): unsure at all Xaa locations
  Clone ID: PAT_TA_90730.pep
RGPQPVRTFHTPPHPSSLLHRRSKGAQQXTLPVPXGCTDQTAKNFDPTARSDDGSCLLHLLSMPI

SEQ ID NO: 196313 - protein, 60 aa, Triticum aestivum
  unsure (1)..(60): unsure at all Xaa locations
  Clone ID: PAT_TA_90731.pep
VIXXGRPXRXKXVXRYXXMLGXXLFLVFFLMSGGRGXAMXLFLPIYSPRGMRXXTFLLRP

SEQ ID NO: 196314 - protein, 59 aa, Triticum aestivum
  unsure (1)..(59): unsure at all Xaa locations
  Clone ID: PAT_TA_90732.pep
PPGQVPPPIAKQCNDRIVDRFVTLLLFVTNRFNWGSXKKXKKXKKKKKNLETXPRPRXR

SEQ ID NO: 196315 - protein, 48 aa, Triticum aestivum
  unsure (1)..(48): unsure at all Xaa locations
  Clone ID: PAT_TA_90733.pep
XFTSDFQRXARAXXIXILSVXALXNHFLXIFRDKXXKGXTXSHEXTSE

SEQ ID NO: 196316 - protein, 76 aa, Triticum aestivum
  unsure (1)..(76): unsure at all Xaa locations
  Clone ID: PAT_TA_90734.pep
VXXNDPPGTXSXGRXGXNNPRXFXFLSYWICXPYILXYEKXPGVRXLXPFRXSQMIQGXGKERDSEXSVQKNCTTD

SEQ ID NO: 196317 - protein, 116 aa, Triticum aestivum
  unsure (1)..(116): unsure at all Xaa locations
  Clone ID: PAT_TA_90735.pep
EFTXDFERPPGQVRVFFFFLXDILYNIMRPCIYIATDSIHIRACFLXPCWYMNMDIHIFLGTNNKDKWRRKTQSNVRVDKTAMALYIWPVVSELFRPCRTPSXPGGLKAMKLTHXT

SEQ ID NO: 196318 - protein, 96 aa, Triticum aestivum
  unsure (1)..(96): unsure at all Xaa locations
  Clone ID: PAT_TA_90736.pep
SPVXGPXFXXKXGXDPKXKXXQFFYLLXFAKXXYXIXVXACHPPTXEPNTWKXXXXFXEXXKLXLKKKKKXKKKKKKKKEKKKKKKKNLEPRPRPX

SEQ ID NO: 196319 - protein, 62 aa, Triticum aestivum
  unsure (1)..(62): unsure at all Xaa locations
  Clone ID: PAT_TA_90737.pep
LGDMVMNXCDGKTVEXYSXSPXEKLYKXLYLSFLXLCFFSXKKKKKKKKKKKXPARAAARNH

SEQ ID NO: 196320 - protein, 55 aa, Triticum aestivum
  unsure (1)..(55): unsure at all Xaa locations
  Clone ID: PAT_TA_90738.pep
RGQSXXFMXSFLXXPXRLIILSYVXFXXSMRNXXIPWNSSTDEGSXXXDKHLTXY

SEQ ID NO: 196321 - protein, 44 aa, Triticum aestivum
  unsure (1)..(44): unsure at all Xaa locations
  Clone ID: PAT_TA_90739.pep
AKGERGIRTLDSSXRTIPVFKTGAINHSAISPQXNPYFTPTNRT

SEQ ID NO: 196322 - protein, 95 aa, Triticum aestivum
  unsure (1)..(95): unsure at all Xaa locations
  Clone ID: PAT_TA_90740.pep
MQIFVKTLTGKTITLEVESSDTIDNVKAKIQDKEGIPPDQQRLIFAGKAARGWPHLXDYNIXEGIQQLHLGGSRLRGGECILRQTLERGNQPLEG

SEQ ID NO: 196323 - protein, 86 aa, Triticum aestivum
  unsure (1)..(86): unsure at all Xaa locations
  Clone ID: PAT_TA_90741.pep
PPLNQXLXGLLERXXSXKLTQGKGGSXQMXYFGAIIXVPPGCTXSXLXXHXXPLXXXIXXFXXQRXQILIPLSXLTFVVTVXQVXS

SEQ ID NO: 196324 - protein, 104 aa, Triticum aestivum
  unsure (1)..(104): unsure at all Xaa locations
  Clone ID: PAT_TA_90742.pep
MKGTKLAAILILQAVLVMGVLSHVNADYFPKCCNNCRSFSXGVDVCDXAHPKCPKGCSAXPAVVXTXPRKCGRWRIWKSTSTTLGGALKGSGSMPSNEYCSRPK

SEQ ID NO: 196325 - protein, 90 aa, Triticum aestivum
  unsure (1)..(90): unsure at all Xaa locations
  Clone ID: PAT_TA_90743.pep
MKGTKLAAILILQAVLVMGLLSHVNADFFPKCCNNCRSFSGVDVCDDAHPKCPQGCSXCRVVSTSPEMWRCADMKSTVDXTCGGXPCKKY

SEQ ID NO: 196326 - protein, 121 aa, Triticum aestivum
  unsure (1)..(121): unsure at all Xaa locations
  Clone ID: PAT_TA_90744.pep
GERDPPPGLGDFPNNNXCFXXFGXCLXXGXTKGLXLQANRRVXAGVRKPXHPKTWTQXMXXXSGTPAAKFPPIEIPLVPXPFXMVPKVVHKVXXXVHTNXNXXNKXXVVFRCPXXRGLLLD

SEQ ID NO: 196327 - protein, 76 aa, Triticum aestivum
  unsure (1)..(76): unsure at all Xaa locations
  Clone ID: PAT_TA_90745.pep
ERILWVAREGDDLGGQKAVXSKKTHRVCSLSXMERWXXPVHVLVRXRLQSIIKKTRACMHRSTRGRXXKHXXQVXV

SEQ ID NO: 196328 - protein, 75 aa, Triticum aestivum
  unsure (1)..(75): unsure at all Xaa locations
  Clone ID: PAT_TA_90746.pep
NSLVISVVAAEVPTGRREGRKXKASCLCLWAMAVFKXLCMANFXVRRXGXGHHPXXXQSRRGXPHXQIXWXXQWT

SEQ ID NO: 196329 - protein, 74 aa, Triticum aestivum
  unsure (1)..(74): unsure at all Xaa locations
  Clone ID: PAT_TA_90747.pep
RRLSTTLVLPSLRGANSKLLRLEGNVIXLSRVAXHGWGVXFLRXPHQPYSXXXKIXLXQWXGGXALGXXXRXKG

SEQ ID NO: 196330 - protein, 121 aa, Triticum aestivum
  unsure (1)..(121): unsure at all Xaa locations
  Clone ID: PAT_TA_90748.pep
MQIFVKTLTXKTITLEVESSXTIDNVKAXKIQDKEGIPPDQQXRLIFAGKQLEDGXRTLADYNIQKESTLHLXVLRLRGGMXIFVKTLTXXTNQPGRXESXLTPXTNVKGQDSXTRXXIPP

SEQ ID NO: 196331 - protein, 60 aa, Triticum aestivum
  unsure (1)..(60): unsure at all Xaa locations
  Clone ID: PAT_TA_90749.pep
KLXMYVSLCXQIXVDVXHLKYFYLXLXHLDMFAKFXLXKKKKKKKKKKKXSRLDLGRXHA

SEQ ID NO: 196332 - protein, 150 aa, Triticum aestivum
  unsure (1)..(150): unsure at all Xaa locations
  Clone ID: PAT_TA_90750.pep
PNXXXPLGAXGXFFXSXRLLXPXRXGXKPLSXLGKIXYNLEPKGNNFXLVCNQITNPXQALXVMLIXQGPLQPXXGAXCSCSRKGSXHVKLXMYVXCVPKLGWVSCXQIFXPXXXHLDMYXKFVLXQKKKKKKKKKKKKXLEXRPRPXPX

SEQ ID NO: 196333 - protein, 38 aa, Triticum aestivum
  Clone ID: PAT_TA_90751.pep
NSLSDFERPPGQVESLTTTCVNYIYLAKSFYCLGSYSG

SEQ ID NO: 196334 - protein, 121 aa, Triticum aestivum
  unsure (1)..(121): unsure at all Xaa locations
  Clone ID: PAT_TA_90752.pep
MAAAFSSTVGAPASTPTNFLGKKLKKQVTSAVNYHGKSSKANRFTVMAAENIDEKRNTDKWKGLAYDISXDQXQDITXGKGIVXSLFQXPTGDGXHXXVLKLRTSAGQGSDFHQWGGLSPP

SEQ ID NO: 196335 - protein, 87 aa, Triticum aestivum
  unsure (1)..(87): unsure at all Xaa locations
  Clone ID: PAT_TA_90753.pep
GRAQLXTXKXMLPKXEVKSKKGNPKEKRLSXXPXSXPXLSQKENXGVLXXRKYKLLNLRYCVLHLXCXNXCPXSXXAKKKKKXGKXC

SEQ ID NO: 196336 - protein, 179 aa, Triticum aestivum
  unsure (1)..(179): unsure at all Xaa locations
  Clone ID: PAT_TA_90754.pep
SPPSDLAGKSLRSKRSEGSLVLLLKMQIFVKTLTGKTITLEVESSDTIDNVKAKIQDKEGIPPDQXQRLIFAGKQLEDGRTLAXDYNIQXKESTLHLVLRLRGGMQIFVKNLTGKXTINLEXESSXNIXKCEGQRFKKKEGIPXDKKRLNLLRESXFEGWAGTLADXNIXKXGPXXQLG

SEQ ID NO: 196337 - protein, 77 aa, Triticum aestivum
  Clone ID: PAT_TA_90755.pep
PRQFGLLLNPGRLRTWFPFTVWNHSPITPPHPSLCCIGGVKGAQQVTLPVPAGCTDQTAKNFDPTARSDDGSCLYTF

SEQ ID NO: 196338 - protein, 49 aa, Triticum aestivum
  unsure (1)..(49): unsure at all Xaa locations
  Clone ID: PAT_TA_90756.pep
IGLXXVAAEVFXXFFFDSYFHIFFLXNEPILYLLFYVYISIYRNLYKTR

SEQ ID NO: 196339 - protein, 152 aa, Triticum aestivum
  unsure (1)..(152): unsure at all Xaa locations
  Clone ID: PAT_TA_90757.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGRYWTMWKLPKFGCTDAKQVXNEVEEXKEGXPDPYVRIXXFXX

SEQ ID NO: 196340 - protein, 115 aa, Triticum aestivum
  Clone ID: PAT_TA_90758.pep
TSHAPAHGGPREFDFEPPRAGVWHMPALTEIFGDDSVLQFGGGTLGHPWGNAPGAAANRVALEACAQARNEGRDLAREGNEIIRAACKWSPELAAACEVWKAIKFEFEPVDTIDK

SEQ ID NO: 196341 - protein, 85 aa, Triticum aestivum
  unsure (1)..(85): unsure at all Xaa locations
  Clone ID: PAT_TA_90759.pep
ERPPGQVDXXYRHFNDIKELPPXRLAXIRRFFEDYKKNENXEVAVXXFLPSEDAXEAIXHSMXXYATYICEGPEKIGDAAPLVWE

SEQ ID NO: 196342 - protein, 94 aa, Triticum aestivum
  unsure (1)..(94): unsure at all Xaa locations
  Clone ID: PAT_TA_90760.pep
MVKAVAVLTGSEGVKGTIFFTXEGDGPTTVTGSVTGLKEGLHGFHVHALGDTTNGCMSTXGPHFNPAGHVHGAPEDEIRHAGDLGNVTAGGWCC

SEQ ID NO: 196343 - protein, 98 aa, Triticum aestivum
  unsure (1)..(98): unsure at all Xaa locations
  Clone ID: PAT_TA_90761.pep
HATSIWPXLGXVKKLRXEKGKCTXCRFPXXAGXQLSXXKIXXLLXGKXXVXQGKXKXKGFXQILXKXNYPQXMXRXXAXXQXNGQGFXRFFQGGVLGN

SEQ ID NO: 196344 - protein, 73 aa, Triticum aestivum
  unsure (1)..(73): unsure at all Xaa locations
  Clone ID: PAT_TA_90762.pep
ERPPGQVFFFFFFXFFFLAHSNXLXEEIKDTYXKGXXARLHIXNSQDIFCKTTYHXIYTLPYXNXXTLFXXEE

SEQ ID NO: 196345 - protein, 52 aa, Triticum aestivum
  unsure (1)..(52): unsure at all Xaa locations
  Clone ID: PAT_TA_90763.pep
IRGRGRXSSFFFXFXRGISIVFFLSNDXYPLSSFLXFIFQYXXRPIEHXXKY

SEQ ID NO: 196346 - protein, 58 aa, Triticum aestivum
  unsure (1)..(58): unsure at all Xaa locations
  Clone ID: PAT_TA_90764.pep
MSXXIRSNXIXCXWSHXICLRVLXFEIEHLFXRXHDXVLEMKXRATARKEVXLXVNYX

SEQ ID NO: 196347 - protein, 132 aa, Triticum aestivum
  unsure (1)..(132): unsure at all Xaa locations
  Clone ID: PAT_TA_90765.pep
RGRGRGNGTNKSQANLVSDRLEACRILLPHRLKMQIFVKTLTGKTITLEVESSDTIDNVKAKIQDKEGIPPDQQRLIFAGKQLXEDGRTLAXYNIQXKESTLQLVLRGVVAMQSSVKLNRAKNINSWRLEKL

SEQ ID NO: 196348 - protein, 42 aa, Triticum aestivum
  unsure (1)..(42): unsure at all Xaa locations
  Clone ID: PAT_TA_90766.pep
KYLYLGNKITSXPXYFXNLFEFNQLXPFXIFNYFNEIRFLKX

SEQ ID NO: 196349 - protein, 145 aa, Triticum aestivum
  unsure (1)..(145): unsure at all Xaa locations
  Clone ID: PAT_TA_90767.pep
RPGSRWSGIISRETRSRLMTAEHCQAHLRGSSTPSPQLDLGIPASMLLRPLSRVLLXTSLSKPTXPTFPSLDPVHHEPQATLPPLSCPCRAWCRGGQACGTGCVAGVCALCLRFLTPXERRTEQFHARLLFCCTIFPSVLXSGVW

SEQ ID NO: 196350 - protein, 94 aa, Triticum aestivum
  unsure (1)..(94): unsure at all Xaa locations
  Clone ID: PAT_TA_90768.pep
AWSRPRCPPXGGKGXKTXXXAFVFGXWWXSXTFAWSSSRKAXWWRTSSXISPSSPRELXTVXYFGWGKDXLNQXXXNXGLHPRLRHDLXSVXXD

SEQ ID NO: 196351 - protein, 114 aa, Triticum aestivum
  unsure (1)..(114): unsure at all Xaa locations
  Clone ID: PAT_TA_90769.pep
SSGRPGRSXWRCASXVHPPTSAIHHXHQHPALPSSPAASATITSMPLGPLPXRAHCXPSXCCSSTFLLVLXLXLLFFFFPSLFVCSSFSKSPXCFSSSLHAYCCSSSPILXHHY

SEQ ID NO: 196352 - protein, 62 aa, Triticum aestivum
  unsure (1)..(62): unsure at all Xaa locations
  Clone ID: PAT_TA_90770.pep
RAAARAGGXHXVCXCQSAEXFDSGCSQVFHVRXLTLLXAIIXVXATLLNDTGXSXEIXLXVN

SEQ ID NO: 196353 - protein, 74 aa, Triticum aestivum
  unsure (1)..(74): unsure at all Xaa locations
  Clone ID: PAT_TA_90771.pep
WPPSXDGSQPPYVQEXARXGXSSXRLTXXASXXARSXXTGWARXLLHILXRGLNEVTXXXLYXLFAXSXLSISK

SEQ ID NO: 196354 - protein, 91 aa, Triticum aestivum
  Clone ID: PAT_TA_90772.pep
WGIDEAITGTHAHTHTHKDTMGRAWESEQANHTHTHTHPCSTPSDQTLVIHVYSHTNTRTYECMQLNSCRGCTCSCRRSCSPRRTARAAAR

SEQ ID NO: 196355 - protein, 88 aa, Triticum aestivum
  unsure (1)..(88): unsure at all Xaa locations
  Clone ID: PAT_TA_90773.pep
MAAKEPMRVLVTGAAGQIGYALVPMIARGVMLGADQPVILHMLDIEFAAEALKGVKMEXIDAAXFPLLKGSWLQPDVAEGALAGSMFA

SEQ ID NO: 196356 - protein, 161 aa, Triticum aestivum
  unsure (1)..(161): unsure at all Xaa locations
  Clone ID: PAT_TA_90774.pep
RGRGRGVDLCLDRIRKLSDNCTGLQGFLVFNAVGGGTGSGLGSLLLERLSVDYGKKSKLGFTVYPSPQVSTSVVEXPYNSVLSTHSLLEHTDVSILLDNEAIYDICRPPPFDIERPTINKPQTXLGSSRSISIAGTGFPRVWMGPLKCWQMFQQSWPLTEG

SEQ ID NO: 196357 - protein, 138 aa, Triticum aestivum
  unsure (1)..(138): unsure at all Xaa locations
  Clone ID: PAT_TA_90775.pep
AWSRPRSAQGGGDDKDYKEPPPAPLFEPGELKSWSFYRAXIAEFIATFLFLYVTVLXVMGVSKSPSKCATVXVQGXIPWAFXGXDXLARLMXPXGISXGDNKPTGDFLGCSCGKKLSLXKGIFKKANALGNFVKRGSL

SEQ ID NO: 196358 - protein, 76 aa, Triticum aestivum
  unsure (1)..(76): unsure at all Xaa locations
  Clone ID: PAT_TA_90776.pep
ASMHAXYXMXXTYHXKLXXXHXXPXTVXPSXVXTSYXXSNKXXXLHVQKKKKKKKKKKKKKKKKKKKNSTSAATTL

SEQ ID NO: 196359 - protein, 134 aa, Triticum aestivum
  unsure (1)..(134): unsure at all Xaa locations
  Clone ID: PAT_TA_90777.pep
MAEQTFIMIKPDGVQRGLIGEVISRFEKKGFYLKGLKLQNVEKSFAEQHYSDLSSKPFFAGLVEXNXSPGRVXPXVWXGKSVXXNGXKINWGAXNPLXSEPGXNRGDXAXHIXKKXXQGXDXIXSXKKXNXLWX

SEQ ID NO: 196360 - protein, 101 aa, Triticum aestivum
  unsure (1)..(101): unsure at all Xaa locations
  Clone ID: PAT_TA_90778.pep
NGRPGRCPKTRXGTSXXXTPPPAPSXDAXVRCLPKIGPRXVYIRRXXVYSSVQXLXXGPFFFAGXLXXXLKPMFGKKKKKKKKKKKKKKKXKKKTSAATTL

SEQ ID NO: 196361 - protein, 88 aa, Triticum aestivum
  Clone ID: PAT_TA_90779.pep
RAAARAGLILQAVLVMGILSHVNADYFPKCCNSCRSFSGVDVCDDAHPQCPKGCSACRVVTPSPHKTFRCADMKSTVHGTCGGPWKKH

SEQ ID NO: 196362 - protein, 130 aa, Triticum aestivum
  unsure (1)..(130): unsure at all Xaa locations
  Clone ID: PAT_TA_90780.pep
MLVYQDKLSGDELLSDSFPYRELENGVLWEVDGHWVVQGAVDVDIGANPSAEGGGDDEGGDDQAVKVVDIVDTFRLQEQPAFDKKXFISHMKXRYIKNLXSGKLEGDALNXFNENVVRPKGIFLKAKGPS

SEQ ID NO: 196363 - protein, 59 aa, Triticum aestivum
  unsure (1)..(59): unsure at all Xaa locations
  Clone ID: PAT_TA_90781.pep
SCHXXVXXXIXSAIXGLENGYTPVMXAECSXGVYFXQGPIRVMXXFASXLXPSXXXTYG

SEQ ID NO: 196364 - protein, 75 aa, Triticum aestivum
  unsure (1)..(75): unsure at all Xaa locations
  Clone ID: PAT_TA_90782.pep
KIKNFSIFSYSFYLFFQKEIRIGLVXRKXFYXKIEVKIEXKIAISFLRGTYIXICMGKXSFLPTSKVLLXXGIWP

SEQ ID NO: 196365 - protein, 144 aa, Triticum aestivum
  unsure (1)..(144): unsure at all Xaa locations
  Clone ID: PAT_TA_90783.pep
MAAKEPMRVLVTGVAGQIGYALVPMIARGVMLGADQPVILHMLDIEFAAEALKGVKMELIDAAFPLLKGVVATTDVVEACTGVNVAVMVGGFPRKEGMARKDVMTKNVSIYKAQASALEAHASPNLQXFGFVCNPTKHNALXXK

SEQ ID NO: 196366 - protein, 139 aa, Triticum aestivum
  unsure (1)..(139): unsure at all Xaa locations
  Clone ID: PAT_TA_90784.pep
MQIFVKTLTGKTITLEVESSDTIDNVKAKIQDKEGIPPDQQRLIFAGKQLEDGRTLADYNIQKESTLHLVLRLGGGMQXFVKTLTXKEQQSGRVENSDNIRKCQRXKIQGXRXGIPPGTXXRPGFFAGEXTWRDGRXPW

SEQ ID NO: 196367 - protein, 52 aa, Triticum aestivum
  unsure (1)..(52): unsure at all Xaa locations
  Clone ID: PAT_TA_90785.pep
CEXXREFFFFFCFKLVVCFAMFRITRMGDITSPASIGSHGRIHKKKVSPPEL

SEQ ID NO: 196368 - protein, 53 aa, Triticum aestivum
  unsure (1)..(53): unsure at all Xaa locations
  Clone ID: PAT_TA_90786.pep
AWSRPRSPTLRRPPNFGEETRXDGKXGXEKXIPESRNXPXXRQGXKVTXXXNG

SEQ ID NO: 196369 - protein, 50 aa, Triticum aestivum
  unsure (1)..(50): unsure at all Xaa locations
  Clone ID: PAT_TA_90787.pep
TSLEFFFFFFFFFFFFLRXNPXTYIYRDAXVXXIMRTEXCKXXESXVLGI

SEQ ID NO: 196370 - protein, 109 aa, Triticum aestivum
  unsure (1)..(109): unsure at all Xaa locations
  Clone ID: PAT_TA_90788.pep
TXTMSYCIHPITXXMIRVXPIENSXXGIXNVHTRFIIIVVVIIIIHLQAKXNPQXTLVQTCXMAVHFATLXYXYXIYRNENXTKFNMXAQDXEQRXVKHKGGHXXXGXP

SEQ ID NO: 196371 - protein, 68 aa, Triticum aestivum
  unsure (1)..(68): unsure at all Xaa locations
  Clone ID: PAT_TA_90789.pep
SGSHHAMLRPHGTXGLEQQSSTMNENHIXRIQLIGHTNXHWXNXDHQXPNXGXDSXSIRRRTHIHNAL

SEQ ID NO: 196372 - protein, 69 aa, Triticum aestivum
  unsure (1)..(69): unsure at all Xaa locations
  Clone ID: PAT_TA_90790.pep
RGRGVSSFFFFFXXYFHIFFLXXEPILDLXFYVYISSIPTTXIRXDKXXGGPLPXTIKXYQWGXKRVXX

SEQ ID NO: 196373 - protein, 74 aa, Triticum aestivum
  unsure (1)..(74): unsure at all Xaa locations
  Clone ID: PAT_TA_90791.pep
RXELXSQMGTQPKQXGSAASXRFRPPXLGQSXXSLREHDXXXVDYGQXFFSLSLCLISPLVLLICGXISPALXX

SEQ ID NO: 196374 - protein, 77 aa, Triticum aestivum
  unsure (1)..(77): unsure at all Xaa locations
  Clone ID: PAT_TA_90792.pep
WTXRFPFXEEXLEAXPXKYVSLGKGSKDPFSFLLXGGEALPLIDGRXWCFALXTKEGSCLIXTFLYXCTWAERGSSA

SEQ ID NO: 196375 - protein, 80 aa, Triticum aestivum
  unsure (1)..(80): unsure at all Xaa locations
  Clone ID: PAT_TA_90793.pep
MARPQQEAIDTFISITGAXEAVAIRTLEEHAGDLXQAVXAHFTEGDSTVNALNSIPPVHDGCWPLKHVSRCFLIALHPFC

SEQ ID NO: 196376 - protein, 70 aa, Triticum aestivum
  unsure (1)..(70): unsure at all Xaa locations
  Clone ID: PAT_TA_90794.pep
SVVAAEVPTGRXEXRXXKAXXLCLWAMXGXXPPLHXXVQGXAXGGGHHXGAHQXRRGAXXRSNTLGGCXD

SEQ ID NO: 196377 - protein, 46 aa, Triticum aestivum
  unsure (1)..(46): unsure at all Xaa locations
  Clone ID: PAT_TA_90795.pep
PGRSLSAYALPXVXLCVCVCMCPCNCFIYRHYGWSDEYXRMNDLPN

SEQ ID NO: 196378 - protein, 56 aa, Triticum aestivum
  Clone ID: PAT_TA_90796.pep
KRNIYSFEHAMYTDTHTYAHTLTSVNSCTHILHYDHFQETQLIHLCNPRTCPGGRS

SEQ ID NO: 196379 - protein, 103 aa, Triticum aestivum
  unsure (1)..(103): unsure at all Xaa locations
  Clone ID: PAT_TA_90797.pep
AWSTVEVSSLSLSLSDXLXFCRTHPTHKSCWSLXLHLSLALSPSLTSHSVLSXRIPIHXPCXXPSPLXLXXXLLFSXXSFXFWXPSVSNHXXXLLWXPSSSPP

SEQ ID NO: 196380 - protein, 106 aa, Triticum aestivum
  unsure (1)..(106): unsure at all Xaa locations
  Clone ID: PAT_TA_90798.pep
MAAAFSSTVGAPASTPTNFLGKKLKKQVTSAVNYHGKSSKANRFTVMAAENIDEKRNTDXWKGLAYDISDDQQGHHQEGRASWDSLFQXAPTGXXTQRRPSSPNVT

SEQ ID NO: 196381 - protein, 107 aa, Triticum aestivum
  Clone ID: PAT_TA_90799.pep
RGRGRGAAFSSTVGAPASTPTNFLGKKLKKQVTSAVNYHGKSSKANRFTSHGKRENLERERGNNGQSGKGPCYYLTQARDIQPRRERAGTASKGPGGREPEGPSLPG

SEQ ID NO: 196382 - protein, 131 aa, Triticum aestivum
  unsure (1)..(131): unsure at all Xaa locations
  Clone ID: PAT_TA_90800.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGVXTFREAKMRXPGYYDGPATWDXWWEPYSGWQTPTG

SEQ ID NO: 196383 - protein, 53 aa, Triticum aestivum
  Clone ID: PAT_TA_90801.pep
NCISFLRVKFRCESIRLYNNKTKKHQKEVTAAAKSSLQLGQQTNNSSLNLPGR

SEQ ID NO: 196384 - protein, 121 aa, Triticum aestivum
  unsure (1)..(121): unsure at all Xaa locations
  Clone ID: PAT_TA_90802.pep
GLGLEHTXXNLKLCXSEWKXNSXVLLELSIIQTPDNTPIRNIPVISSSDRFPSVQPRADLASSTFLSVSHHQQHHAVSAEHLKTQHLSACGLPGQPPILPWESPASPGLRPPLWPSAATTL

SEQ ID NO: 196385 - protein, 69 aa, Triticum aestivum
  Clone ID: PAT_TA_90803.pep
AWSRPRFEFFFFFFFRITGQNLLIQPKHNHTNFTITITKQIPQLSESFQDTQHLTVTDTNIGESTDNHR

SEQ ID NO: 196386 - protein, 116 aa, Triticum aestivum
  Clone ID: PAT_TA_90804.pep
MAAKEPMRVLVTGAAGQIGYALVPMIARGVMLGADQPVILHMLDIEFAAEALKGVKMELIDAAFPLLKGVVATTDVVEACTGCEMLRLWVGGIPQGKGRNGKREGCLPKNFHNKSS

SEQ ID NO: 196387 - protein, 72 aa, Triticum aestivum
  unsure (1)..(72): unsure at all Xaa locations
  Clone ID: PAT_TA_90805.pep
IARYXAXXEXXXMFGCXXRXHRVIQRGXGRSKKEVPLXAYVXRIFGFDNMRQVQCVXFIAFKPPGCEESGKA

SEQ ID NO: 196388 - protein, 111 aa, Triticum aestivum
  unsure (1)..(111): unsure at all Xaa locations
  Clone ID: PAT_TA_90806.pep
RGRGRGSKWVPCLEFSKVGFIFREHNASPGYYDGRYWTMWKLPMFGCTDATQVINEVEEVKKEYPDAYVRIIGFDNMRQVQXCVSFIAFKPPGCEESGKGLKQAQLTTGQI

SEQ ID NO: 196389 - protein, 81 aa, Triticum aestivum
  unsure (1)..(81): unsure at all Xaa locations
  Clone ID: PAT_TA_90807.pep
RLSERERERERDDXEXXTRXVXWMRATELKIVRERERERWXEGERXQQXLVXWMRATELKIVRERERERERERERPRPRPR

SEQ ID NO: 196390 - protein, 100 aa, Triticum aestivum
  unsure (1)..(100): unsure at all Xaa locations
  Clone ID: PAT_TA_90808.pep
MAPTVMASSATSVAPFQGLKSTAGLPISRRSSSAGLSSVSNGGRIRCMQVWPIEGIKKFETLSYLPPLSTEALLKQVDYLIRSKWVPCLEXFTRLGFVFR

SEQ ID NO: 196391 - protein, 91 aa, Triticum aestivum
  unsure (1)..(91): unsure at all Xaa locations
  Clone ID: PAT_TA_90809.pep
MKGTKLAAILILQAVLVMGLLSHVNADFFPKCCNNCRSFSGVDVCDDAXPKXCPQGCSACRVVXTXSPEMWRCADMKSXXXXNCGXTCKKX

SEQ ID NO: 196392 - protein, 33 aa, Triticum aestivum
  unsure (1)..(33): unsure at all Xaa locations
  Clone ID: PAT_TA_90810.pep
TSXFFFFFFFFFFFFFFFFFFFFFFFRKGGLNL

SEQ ID NO: 196393 - protein, 102 aa, Triticum aestivum
  unsure (1)..(102): unsure at all Xaa locations
  Clone ID: PAT_TA_90811.pep
PWSRPRSLFMSINILXXTLGSFLGXXLTSALNMSXVXFDNLIAXXNCXXDGQSLTYRXSXSDSXGRXXDYXHRXXGXRSRSXIFSATXVXXPYSPXLTSXXW

SEQ ID NO: 196394 - protein, 67 aa, Triticum aestivum
  unsure (1)..(67): unsure at all Xaa locations
  Clone ID: PAT_TA_90812.pep
PLGRGALGCKKNCVPPKYLSLASKGPSVFVGESMHDAGGVVFAYYKEGAXDPTFLXYXAHGLKEVKC

SEQ ID NO: 196395 - protein, 64 aa, Triticum aestivum
  unsure (1)..(64): unsure at all Xaa locations
  Clone ID: PAT_TA_90813.pep
XVGRGRXFFFFFFFXEXIXRCGCITPRSHIXVCQGSGLXQSKLRKXFLGSKXXFXXFXQVXIQF

SEQ ID NO: 196396 - protein, 74 aa, Triticum aestivum
  unsure (1)..(74): unsure at all Xaa locations
  Clone ID: PAT_TA_90814.pep
MKGTKLAAILILQAVLVMGVLSHVNADYFPKCCNNCRSFSGVDVCDDAHPXCPKGCSACRVVXTXPRCGRLRGI

SEQ ID NO: 196397 - protein, 115 aa, Triticum aestivum
  unsure (1)..(115): unsure at all Xaa locations
  Clone ID: PAT_TA_90815.pep
ARAGFFFFFFFFFFFFGVNXHTNIRLYTLFQKKVRTSYNGXGSRNCLTLLYVXTLATTPHHLALPNLXSQGAQKLFLNTKHXWEPPXXFRRNXFLSXVXXHXTSVDTRNRXGVXX

SEQ ID NO: 196398 - protein, 40 aa, Triticum aestivum
  unsure (1)..(40): unsure at all Xaa locations
  Clone ID: PAT_TA_90816.pep
XWLXTXTQLAQXAPKRXQSYSSXNCXXXLRXSNXKNXXXT

SEQ ID NO: 196399 - protein, 54 aa, Triticum aestivum
  unsure (1)..(54): unsure at all Xaa locations
  Clone ID: PAT_TA_90817.pep
EXKXXVXKXXXKXKXTTLLPXIYFYLGGRVLLIFXWSYIGXGILXYKHKKXARG

SEQ ID NO: 196400 - protein, 73 aa, Triticum aestivum
  unsure (1)..(73): unsure at all Xaa locations
  Clone ID: PAT_TA_90818.pep
HLTSFSPCESKRKVGLXXSLXXVXXNTTPXNHXCHAPRQTXEXGXXFEAWLKXXXWWGGPNNXSXXXQLRXIP

SEQ ID NO: 196401 - protein, 116 aa, Triticum aestivum
  unsure (1)..(116): unsure at all Xaa locations
  Clone ID: PAT_TA_90819.pep
RGRGRGFFLRKCLLNKWQYQQEVIPKXVVLPWKLXTLXNNQXIXXXNXNANQXIXMVXKXXVXGXKXKKRXXPIPGFXVWDXXLGXEILXAPPLKFXAAKXXRLAKXXRXXXQXEE

SEQ ID NO: 196402 - protein, 130 aa, Triticum aestivum
  unsure (1)..(130): unsure at all Xaa locations
  Clone ID: PAT_TA_90820.pep
MAAAFFSTVGAPASTPTXFLGKKLKXKQVTSARELPWAKSSKGNRFTXSWQAENIDEKRNTDKWKGLAYDISDDQXQDITRGKGIVDSLFQAPTGXGTHEGVLKLLRSTSARDSKKYDFXNNMGXVLIXP

SEQ ID NO: 196403 - protein, 66 aa, Triticum aestivum
  Clone ID: PAT_TA_90821.pep
LHSGSLAQSRRRRLASSSKSFELMTLVASDLHSSDLPEMIPSVLPVGSAVPSPTISRGAFLQQAVL

SEQ ID NO: 196404 - protein, 56 aa, Triticum aestivum
  unsure (1)..(56): unsure at all Xaa locations
  Clone ID: PAT_TA_90822.pep
SVVAAEVNXKDRXXSMXYXQXFPDQXIFXMLTSPPPSGXRXSTXFXFPFEILIXHV

SEQ ID NO: 196405 - protein, 106 aa, Triticum aestivum
  unsure (1)..(106): unsure at all Xaa locations
  Clone ID: PAT_TA_90823.pep
RAAARAGLILQAVLVMGILSHVNADYFPKCCNSCRSFSGVDVCDDAHPQCPKGCSACRVVTPSPHKTFRCADMKSTVDGTXAGGPCKKQWIRSGLGSRRRCCPPKN

SEQ ID NO: 196406 - protein, 77 aa, Triticum aestivum
  unsure (1)..(77): unsure at all Xaa locations
  Clone ID: PAT_TA_90824.pep
SXGRXGRSXFFFFFFFFFLGXFFLVECLPXXNXTRLNLIRKQENXFVVLLHIXNTTPYHDHQQTSGXSKRTSDATTL

SEQ ID NO: 196407 - protein, 115 aa, Triticum aestivum
  unsure (1)..(115): unsure at all Xaa locations
  Clone ID: PAT_TA_90825.pep
XLPXKXMHLXMXSVRGLXXXRXXSXLXXVTWKKLXXKKTXXILSCDQNXXFXQXXAXXRGIXXXKRKKGXNVSCFPKSXXAENXFLIXKKKSXGHXGGXPXIFQXDRXKXXXPSK

SEQ ID NO: 196408 - protein, 100 aa, Triticum aestivum
  unsure (1)..(100): unsure at all Xaa locations
  Clone ID: PAT_TA_90826.pep
ILNSTDLLTPSRLPTLLEFWMESLSVGFWRRPISPSGVSDGHRFVLLSXDLRPRWTSLCXNXRIXVVLKFQSNAGRIEXSXGMGLIXRLGANGDFVASXR

SEQ ID NO: 196409 - protein, 115 aa, Triticum aestivum
  unsure (1)..(115): unsure at all Xaa locations
  Clone ID: PAT_TA_90827.pep
AWSRPRSRVFFFFFFFFFFFFFFFFFFPXXXFXXPLXXNLTRXTTXXFVXVFXAXGXXIRXNRGXXNQKXXLVPPSXNLXLEAALXKNVSPXXTCXLQXXLMPKARPSKGSVETG

SEQ ID NO: 196410 - protein, 141 aa, Triticum aestivum
  unsure (1)..(141): unsure at all Xaa locations
  Clone ID: PAT_TA_90828.pep
RGRGRGVDLCLDRIRKLSDNCTGLQGFLVFNAVGGGTGSGLGSLLLERLSVDYGKKSKLGFTXYPSPQVSTSVVEPYNSVLSTHSLLEHTDVSIXLDNEAIYDICRRLPLTIERPKNTTTFKQFGFLKVILIRLTSFPLKV

SEQ ID NO: 196411 - protein, 53 aa, Triticum aestivum; identical to SEQ ID NO: 196383
  Clone ID: PAT_TA_90829.pep

SEQ ID NO: 196412 - protein, 59 aa, Triticum aestivum
  unsure (1)..(59): unsure at all Xaa locations
  Clone ID: PAT_TA_90830.pep
MLVYQDKLSGDELLSDSFPYRELENGVLWEVDGHWVVQGAVXDVDIGSQIPLLRGGGDE

SEQ ID NO: 196413 - protein, 89 aa, Triticum aestivum; identical to SEQ ID NO: 117642
  Clone ID: PAT_TA_90831.pep

SEQ ID NO: 196414 - protein, 67 aa, Triticum aestivum
  unsure (1)..(67): unsure at all Xaa locations
  Clone ID: PAT_TA_90832.pep
RGRGRGFFFFFFFFFFFFFFNIYHXKXXKLAXKHSVATXSKTXEVYXRXQVTAXPVLGPVTCPXGXS

SEQ ID NO: 196415 - protein, 153 aa, Triticum aestivum
  unsure (1)..(153): unsure at all Xaa locations
  Clone ID: PAT_TA_90833.pep
CXIXFXRMDFYLKRIXCSAVILFXTSRXWVIPIXQXFITRVAFXVGYXIVFGNIXHXLTRKFFWGXIXCYXKFCLGEXLGXSLWGKLHLWCXRXNRVAFRSLLYKLVTKGAILLREGNEIIRAACKWSPELAAACEVWKAIKFEFEPVDTIDK

SEQ ID NO: 196416 - protein, 94 aa, Triticum aestivum
  unsure (1)..(94): unsure at all Xaa locations
  Clone ID: PAT_TA_90834.pep
IVVAAEEXFFFFFFFFFFFFFFFFFFLGEMANMDISQXMELSXVTFXXLIYGVTXDYTFCKTKNXKTXDXGKIQVLKFWRGQKGNRFPXXAXNP

SEQ ID NO: 196417 - protein, 72 aa, Triticum aestivum
  Clone ID: PAT_TA_90835.pep
EPSDVIGGSATEITSSAHEIMVVIAPWTEPFLAYLNRQELPEDQNEARCIVQRSKAYKVHEGELYKERAPPE

SEQ ID NO: 196418 - protein, 124 aa, Triticum aestivum
  unsure (1)..(124): unsure at all Xaa locations
  Clone ID: PAT_TA_90836.pep
RGRGRGGRREERKEKASRLWAMAEFKHLCMAKFKEGVVVDDIIQELTKLAAELDTVKYFGWGKDXAEPRRRSRRGFTHVFVMTFASAEDLAACXGHXKHSAFPATFMAAARKRSVVMDXPFGPP

SEQ ID NO: 196419 - protein, 133 aa, Triticum aestivum
  unsure (1)..(133): unsure at all Xaa locations
  Clone ID: PAT_TA_90837.pep
SSGRPGRSREHATCCRLPPVLARIGQHSGFFCNKDYVAIATDTAASRTCLFFAKCFCNKDPVAKKKLQHYLCCMGFCNMIIVAKMSLQHCLCCNGERHVRLLNGSEILKVVRXAGLLKKIRPGRTRXNSLQSX

SEQ ID NO: 196420 - protein, 72 aa, Triticum aestivum
  unsure (1)..(72): unsure at all Xaa locations
  Clone ID: PAT_TA_90838.pep
CFDHDXILHGXGRNTLPDXXSKKIMVXEIVXQDSNTIXCMQSVDXTXGFXXSHGIXPPSTXVAXXADXXXEY

SEQ ID NO: 196421 - protein, 58 aa, Triticum aestivum
  unsure (1)..(58): unsure at all Xaa locations
  Clone ID: PAT_TA_90839.pep
FLLFGCTDPTQVIKELEEFRKXSLEGYARIIGLDNMRQVQCVSFIXFKPPGCEESGKA

SEQ ID NO: 196422 - protein, 88 aa, Triticum aestivum
  unsure (1)..(88): unsure at all Xaa locations
  Clone ID: PAT_TA_90840.pep
GTRRFLLHRGEAKGATVPGGSFEKPPARDVTLGLRTIEEQFSVGRLXXCISSSPLDSVAELDXYILEGKELEFYMRKLQKKKGKGATA

SEQ ID NO: 196423 - protein, 112 aa, Triticum aestivum
  unsure (1)..(112): unsure at all Xaa locations
  Clone ID: PAT_TA_90841.pep
MAAAFSSTVGAPASTPTNFLGKKLKKQVTSAVNYHGKSSKANRFTXVMAAENIDEKRNTDKWKGLAYDISDDQQDINKGKGIVDSLFQAPKGEGNQEGVLNSXEYXKQGTQE

SEQ ID NO: 196424 - protein, 75 aa, Triticum aestivum
  unsure (1)..(75): unsure at all Xaa locations
  Clone ID: PAT_TA_90842.pep
FFSLAGRSIXSRNPYCLVYCXQRNIALRGRILRRKPPGKFLHQLXYLQTLCLLRRNIWYFWGPSLIYKRARTLVL

SEQ ID NO: 196425 - protein, 110 aa, Triticum aestivum
  unsure (1)..(110): unsure at all Xaa locations
  Clone ID: PAT_TA_90843.pep
QVSVVPASPGGPAPIIKXIVVXRKVKXSPDXMTMXDSXIXXXEXGYTPXMSAKGSGGVXFMQXSTRQNNVAVFKAHPSEEPMXENXPRGHXMSTDRMHQGNTSGNVDLEV

SEQ ID NO: 196426 - protein, 120 aa, Triticum aestivum
  unsure (1)..(120): unsure at all Xaa locations
  Clone ID: PAT_TA_90844.pep
MAKEPMRVLVTGAAGQIGYALVPMIARGVMLGADQPVILHMLDIEFAAEALKGVKMELIDAAFPLLKGIVATTDVFEGCTGVNVAVXWVGDSPXKXGMGREGVMTKNXSIQKSSSICSLS

SEQ ID NO: 196427 - protein, 40 aa, Triticum aestivum
  Clone ID: PAT_TA_90845.pep
FTQIFKNSNLNYSKFKTNGTNKKVYNFCGPKSKKKSLKNW

SEQ ID NO: 196428 - protein, 136 aa, Triticum aestivum
  unsure (1)..(136): unsure at all Xaa locations
  Clone ID: PAT_TA_90846.pep
SNRRADQNLKXFQEEXGXERGWXEERXDXREXERGPNKXLCXRCVRQXLEDCQREREXDXXRGRGXNKXCXLDACDRXEXYQRERERDRERQREREREGPTRFVCWMRATELKIVRERERERERERERVRTSAATT

SEQ ID NO: 196429 - protein, 80 aa, Triticum aestivum
  unsure (1)..(80): unsure at all Xaa locations
  Clone ID: PAT_TA_90847.pep
PFFFXXFRIXXFFFFXFFFFFFFWMATKLLHILSCFVYFNTVHNINFASYSRLNCNSRINVQDNNITMFTPTHNLPGRPL

SEQ ID NO: 196430 - protein, 34 aa, Triticum aestivum; identical to SEQ ID NO: 196257
  Clone ID: PAT_TA_90848.pep

SEQ ID NO: 196431 - protein, 67 aa, Triticum aestivum
  unsure (1)..(67): unsure at all Xaa locations
  Clone ID: PAT_TA_90849.pep
XVVAAEVTSXXHHHHFXYWQTCRVSXISGFCFLTFNSGNXHLPAQRXCGAPIILXGGXXLXTGCPXP

SEQ ID NO: 196432 - protein, 98 aa, Triticum aestivum
  unsure (1)..(98): unsure at all Xaa locations
  Clone ID: PAT_TA_90850.pep
IHVXGQLGQGVPKMXLYLKTDXQWXTXEERRIKDLVKKXXXEXSXYXISPWXXKTTEKEISADEXXEEKKDTXEGKVEDVDXEKEEKEKKKKLEAPRP

SEQ ID NO: 196433 - protein, 99 aa, Triticum aestivum
  Clone ID: PAT_TA_90851.pep
CLLKNDRYEWEMQIARRRKRKRCQMCMYPLLLDLSSELHISVFLANNIGPTLNDTVVYFLPKSSFNKQFCHVKCIIDYVAENSCPIEVHGFSQPRPRPR

SEQ ID NO: 196434 - protein, 62 aa, Triticum aestivum
  unsure (1)..(62): unsure at all Xaa locations
  Clone ID: PAT_TA_90852.pep
MLSKKNVGPATKYLXLSKLKDLQFFVGESMHDDGGVVFAYYKEGAADPTFLYFAHGLKEVKC

SEQ ID NO: 196435 - protein, 155 aa, Triticum aestivum
  unsure (1)..(155): unsure at all Xaa locations
  Clone ID: PAT_TA_90853.pep
RGRGRGELVSSFFFFFFFFFEXXSSPTNFTTXHFTDXGTCIXQLQXRXEPNNRMFFTSXXHSXXCPPXXHFXXCRXHYGPNDSSHGWXRYPLPGDRGLWSSQHVKGIRXYQRPGXGHRXXXGGXRPKXQXKIFCXXXAXPWAPGLXLFSXXLRXX

SEQ ID NO: 196436 - protein, 113 aa, Triticum aestivum
  unsure (1)..(113): unsure at all Xaa locations
  Clone ID: PAT_TA_90854.pep
MAAAFSSTVGAPASTPTNFLGKKLKKQVTSAVNYHGKSSKXNRFTVMAAXNIDEKRNTDKWKGLAYXDISDAQARPSPEGRXIVDSLXQXAHWXTXTHEAVLKLIRTSSQGTQ

SEQ ID NO: 196437 - protein, 89 aa, Triticum aestivum
  unsure (1)..(89): unsure at all Xaa locations
  Clone ID: PAT_TA_90855.pep
MKGTKLAAILILQAVLVMGVLSHVNADYFPKCCNNCRSFSGVDVCDDAHPKCPKGCSACRVVSTSPEMWRCADMKSTVDGTCGGPCXKY

SEQ ID NO: 196438 - protein, 55 aa, Triticum aestivum
  unsure (1)..(55): unsure at all Xaa locations
  Clone ID: PAT_TA_90856.pep
RRTFSIHTHHLFACIGGGKGAQQGTLPMPAGCTDQXAKNFDPTARSDDGSCLYTF

SEQ ID NO: 196439 - protein, 44 aa, Triticum aestivum
  unsure (1)..(44): unsure at all Xaa locations
  Clone ID: PAT_TA_90857.pep
AKGERGIRTLDSSXRTIPVFXTGAINHSAISPQPNPYFTPTNRT

SEQ ID NO: 196440 - protein, 61 aa, Triticum aestivum
  unsure (1)..(61): unsure at all Xaa locations
  Clone ID: PAT_TA_90858.pep
RVFFFFFQFKXDISSLIILXDPNTLVVMLQXYNXFLKXPTMXXKXQXHIHFHFQQXHGGES

SEQ ID NO: 196441 - protein, 147 aa, Triticum aestivum
  unsure (1)..(147): unsure at all Xaa locations
  Clone ID: PAT_TA_90859.pep
ARADYNIQKESTLHLVLRLRGGMQIFVKTLTGKTITLEVESSDTIDNVKAKIQDKEGIPPDQQRLIFAGKQLEDGRTLAXDYNIQKESTLHLVLRLRGGXCKIFVKTLTGXDQSPLRLRSSGHHRQFAKRTGGAIPPGQQLIWAKQP

SEQ ID NO: 196442 - protein, 63 aa, Triticum aestivum
  unsure (1)..(63): unsure at all Xaa locations
  Clone ID: PAT_TA_90860.pep
NXXXAAXRAGLXVFXXFFIFXFFXFFFFFLTTVFCIQPSYFTSCMVVVQTKPSCMHDLGRDHA

SEQ ID NO: 196443 - protein, 46 aa, Triticum aestivum
  unsure (1)..(46): unsure at all Xaa locations
  Clone ID: PAT_TA_90861.pep
RGRXRGSSFFFFFYSYFHIFFLSNEPILXLLFXVYISIYXNLYKTX

SEQ ID NO: 196444 - protein, 50 aa, Triticum aestivum
  unsure (1)..(50): unsure at all Xaa locations
  Clone ID: PAT_TA_90862.pep
ERPPGQVSSFFFFFFFXKSYFHIFFLSNEPILYLLFYVYISIYRXLYXTR

SEQ ID NO: 196445 - protein, 79 aa, Triticum aestivum
  unsure (1)..(79): unsure at all Xaa locations
  Clone ID: PAT_TA_90863.pep
RGRSRGVEFFFFFLGLKSISSISGELXQNAXXLXNRNXNLLKERAVXFXQVRXCSISSSDQTVIGWWELYVXAYTSXQL

SEQ ID NO: 196446 - protein, 65 aa, Triticum aestivum
  unsure (1)..(65): unsure at all Xaa locations
  Clone ID: PAT_TA_90864.pep
YWTMWKLLMLGCTDAXTQXINEVGEXKKEYPDAYVRIIGFDNMRQVQCVSFIAFKPPGCEESGKA

SEQ ID NO: 196447 - protein, 123 aa, Triticum aestivum
  unsure (1)..(123): unsure at all Xaa locations
  Clone ID: PAT_TA_90865.pep
MAAKEPMRVLVTGAAGQIGYALVPMIARGVMLXADQPVILHMLDIEFAAEALKGVKMELIDXAFPLLXGVXATXDVVEACTGXVNXAVMVGXFPKERKEWXXRDVMTKKXFQSTRAXASAXEG

SEQ ID NO: 196448 - protein, 51 aa, Triticum aestivum
  Clone ID: PAT_TA_90866.pep
KKYMMFSKVHHFSRHISKKKYVSPSIVMEESKVPGVPHLWPTSSDLGRDHA

SEQ ID NO: 196449 - protein, 69 aa, Triticum aestivum
  unsure (1)..(69): unsure at all Xaa locations
  Clone ID: PAT_TA_90867.pep
VEXLGAXWFCXPMSSXGFXNPFXESPHXXXFYFHILKXSTXKVVEKKKKKKKKKKKKKKKLETVHLPGR

SEQ ID NO: 196450 - protein, 151 aa, Triticum aestivum
  unsure (1)..(151): unsure at all Xaa locations
  Clone ID: PAT_TA_90868.pep
RGRGRGQLAXGSETNKVAMAEAGALDALTMYLSLSPQDSTETAIINLLGILYKNPDLLYYESSLSTLNQLVAVLRLGSKNSKLSAXRXLQNLFXVQESXRDTKVXXKAIXPILDMXXSRTEIXQQXTPGALXXLSAXNIXKGSTMFGVXNT

SEQ ID NO: 196451 - protein, 83 aa, Triticum aestivum
  unsure (1)..(83): unsure at all Xaa locations
  Clone ID: PAT_TA_90869.pep
SSGRPRQVILXLGDVVSEAXIFVTTTGXKDIIXVDHMRKDEXNNXIVCNIGHFDNXIXMXXLETYPGVXRITIXPQYPLGSSP

SEQ ID NO: 196452 - protein, 123 aa, Triticum aestivum
  unsure (1)..(123): unsure at all Xaa locations
  Clone ID: PAT_TA_90870.pep
MAEQTFIMIKPDGVQRGLIGEVISRFEKKGFYLKGLKLQNVEKSFAEQHYSDLSSKPFFAGLVEYIVSGPVVAMVWEGKSVVATGXKIIGATXPLXSEPGTXRGDFAVDIGRNVIHGRLSWRA

SEQ ID NO: 196453 - protein, 110 aa, Triticum aestivum
  unsure (1)..(110): unsure at all Xaa locations
  Clone ID: PAT_TA_90871.pep
RGRGRGNYVSSFFFFFAYNIYVYVXPVXXFSYASSSTYIGKCLHTYAHIVTYGVXXEVXLXKQEPARQMGXNMKCXSVTSTXTLXPCXVPPXTXRAGQXNFPXVXXGGXR

SEQ ID NO: 196454 - protein, 101 aa, Triticum aestivum
  unsure (1)..(101): unsure at all Xaa locations
  Clone ID: PAT_TA_90872.pep
FVVXXWHXPAHXXEIFGDXXXYYXVLGGTLGHPXWGNAPGAAXNRVALEACIQARNEGRDXAREGNEIIRAACKWSPELAAACEXWKAIKLELDPVDAIDK

SEQ ID NO: 196455 - protein, 88 aa, Triticum aestivum
  unsure (1)..(88): unsure at all Xaa locations
  Clone ID: PAT_TA_90873.pep
QCXLXKXQIXEXQRPXNCRGXXRKPXWGXICDVHMPXYCWXDVXTXXXCFQVXVYLALXKKKKKKKKKKKKKKKKKKNSRLDLGRDHA

SEQ ID NO: 196456 - protein, 90 aa, Triticum aestivum
  unsure (1)..(90): unsure at all Xaa locations
  Clone ID: PAT_TA_90874.pep
LVGXXKTREXSXLXSXXXEXXPEVNLRAXRLRXTCKRVQXARTVXXAXXLMTXXRLXLXKKAXQKELESXGATAEELXGLNFXXIVSIXX

SEQ ID NO: 196457 - protein, 86 aa, Triticum aestivum
  unsure (1)..(86): unsure at all Xaa locations
  Clone ID: PAT_TA_90875.pep
DGIPWTRGSNNXVFFFFXLLDLFRXIYSFEKIRGSEFFPIRKSQMIQGSGKRGIRTLGTKKLYNGLAIRRFSPLSHLSTFQSERFP

SEQ ID NO: 196458 - protein, 104 aa, Triticum aestivum
  unsure (1)..(104): unsure at all Xaa locations
  Clone ID: PAT_TA_90876.pep
SNGRNKNEGMCHFTTGDVKLVTLTPKGSSSASRSGSVVCFLYVGLTCAAALARSISLLLVESLYSVIVCLWNSTIYLKSGASCLFVKKKKKLXTCPGGRSNRIP

SEQ ID NO: 196459 - protein, 97 aa, Triticum aestivum
  unsure (1)..(97): unsure at all Xaa locations
  Clone ID: PAT_TA_90877.pep
SCXXKXXFFSFLKLLFPYCGGDDRXNVGGALDSALHALPPCSSRSHAFXYQMVTHAGXRSPESRLPGPYCIFFLFLDRSRNLRNRVCMGLTSAATTL

SEQ ID NO: 196460 - protein, 161 aa, Triticum aestivum
  unsure (1)..(161): unsure at all Xaa locations
  Clone ID: PAT_TA_90878.pep
RAAARAGFFFFFFFFFFFFFFXPRRLYNHXATKNTXXYSGYKXAFRXRSKTLYLXNEPTNNSQPKFPIXXLSXIKGFSLSLSLSFPIEPKPXXNLLPSXXGKITPSXITSXVNSXPQTLXXXPPNFVHPLXKVLXHXQXIXSXPFGXXSKTTNXFXXAXXX

SEQ ID NO: 196461 - protein, 143 aa, Triticum aestivum
  unsure (1)..(143): unsure at all Xaa locations
  Clone ID: PAT_TA_90879.pep
KXITHSHXTHKQLXAXKGAXGHQPLXTXNAXXXQISXETXGLACTSKLTSXPFPXRIAHYSEXFCLSFHAFFIWTCXSGLKXXXQSTXTWITRRSILSGVXXFNLSQLXSRIXNFVKXXNRXXRXXNLASTGNXGTXAQXSXE

SEQ ID NO: 196462 - protein, 44 aa, Triticum aestivum
  Clone ID: PAT_TA_90880.pep
TTFRSYSVDFFSLWNNCKLSATRMNKNQFMVGQKKKKKKNSNLG

SEQ ID NO: 196463 - protein, 126 aa, Triticum aestivum
  unsure (1)..(126): unsure at all Xaa locations
  Clone ID: PAT_TA_90881.pep
NPSRSVEPSAAAPPSALSFLLRSKMKFIAAYLLAYLSGNASPSAEDLTSILESVXCEIDNEKMELMLSQVKGKDITELLAAGXEXFAAVPSGGGGVAVSAAAPAAGXAAAPAAESKKEXKAWRRKK

SEQ ID NO: 196464 - protein, 65 aa, Triticum aestivum
  Clone ID: PAT_TA_90882.pep
PRWSVSSASSGSSASGPLSSPELMETSTGCSDLSFTSQYYQTHSPVKQSHCLLVICRPCFLMAVV

SEQ ID NO: 196465 - protein, 95 aa, Triticum aestivum
  unsure (1)..(95): unsure at all Xaa locations
  Clone ID: PAT_TA_90883.pep
MSRXXCXAPKXPAGXEKKTSWXEVVGKSIXDAKXIILNDMXNAXIDVLPAXXAXTLDFRXXRVXIIIDTVXITPSIXYALRKMDALMHSDVVSTM

SEQ ID NO: 196466 - protein, 178 aa, Triticum aestivum
  unsure (1)..(178): unsure at all Xaa locations
  Clone ID: PAT_TA_90884.pep
IGXRFDVSTNXDGVQDFXKXKDXXPTGXFXXXSVKVNVXPFGAXSSFAXXXGXEXPXXSKSXQVNXSSKRPXXERVGGXFVHAXPXVRWXCVFLACWFQXVXXHLXLXGFICLCVCHXXVFCFFXFXNVXRSVVSFLFXSIXNKXGXDFXFQKKKKKKKKKKKKKKKKKKKKKKKLET

SEQ ID NO: 196467 - protein, 96 aa, Triticum aestivum
  Clone ID: PAT_TA_90885.pep
RWWRYKSFFLRTEVQIRCLAGRVRSIYAPCRYRSICAPTALRRLVSGGPAALNGPRHVLSCSCGGTNSPRCMLPSDQRKHQDCKWREECSPKTPSL

SEQ ID NO: 196468 - protein, 72 aa, Triticum aestivum
  unsure (1)..(72): unsure at all Xaa locations
  Clone ID: PAT_TA_90886.pep
EYRTXVLXSIIKQFKVPYFNAIWFNSHHXTYVQMLQXQVXGKXIVHXXELYRLXEPXTFXXLLXGXAXXXSN

SEQ ID NO: 196469 - protein, 110 aa, Triticum aestivum
  unsure (1)..(110): unsure at all Xaa locations
  Clone ID: PAT_TA_90887.pep
LLSTPQSRCSHTSLRPRHRGPSGHLRCHGIVDVRSRRRRHLALMTSWICDSTVGENTNARSMEXTLXASXDRTARVTAGGXIRAHGADITRPIPXGXKSGVFXXTETWYT

SEQ ID NO: 196470 - protein, 42 aa, Triticum aestivum
  Clone ID: PAT_TA_90888.pep
HEIYRIQSSIVIQNCNLPTTASTITICQHKRIHSATLRGLRC

SEQ ID NO: 196471 - protein, 76 aa, Triticum aestivum
  unsure (1)..(76): unsure at all Xaa locations
  Clone ID: PAT_TA_90889.pep
XVILHDXXTXIQEXYHSHXIASITXNAWEXXFYLXXXXPKXXGDXHXPXXNPNFGAWAEPSRXHGHXNXVLXLPGW

SEQ ID NO: 196472 - protein, 124 aa, Triticum aestivum
  Clone ID: PAT_TA_90890.pep
RGASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQ

SEQ ID NO: 196473 - protein, 100 aa, Triticum aestivum
  Clone ID: PAT_TA_90891.pep
MSSSEVACTLAALILHDDGIPITSEKIATVVKAAGIKVEAYWPALFAKLLEKRSVDDLILSVGSGGGGAPAAAAAAPAAGGAAAAEEKKEEKKEEARKKR

SEQ ID NO: 196474 - protein, 64 aa, Triticum aestivum
  Clone ID: PAT_TA_90892.pep
FIYQSVSSQDPKQPTPPPDLIHGQLLRLVYSEMKKTDLLYRQLFRLKTNTAPSKASSAKSADED

SEQ ID NO: 196475 - protein, 71 aa, Triticum aestivum
  Clone ID: PAT_TA_90893.pep
LKPAVSSLGLLQCSGRLVLDLQLRLVCFSFSDRRNTSRTLMRSEVSMVAAAAPVLVLKALWVHCPNTNNII

SEQ ID NO: 196476 - protein, 127 aa, Triticum aestivum
  unsure (1)..(127): unsure at all Xaa locations
  Clone ID: PAT_TA_90894.pep
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDXRYWTMWKLPMFGCTDAHC

SEQ ID NO: 196477 - protein, 116 aa, Triticum aestivum
  unsure (1)..(116): unsure at all Xaa locations
  Clone ID: PAT_TA_90895.pep
ISEVCDDEVSMTGREVVDLLTLRLQEQXAFDKXQFISHMKRYIKXLSAKLEGDDLDVFKKNVESATKYLLSKLKDLQFFVGESMHDDGGVVFAYYKEGAADPTFLYFAHGLKEVKC

SEQ ID NO: 196478 - protein, 89 aa, Triticum aestivum
  unsure (1)..(89): unsure at all Xaa locations
  Clone ID: PAT_TA_90896.pep
XWXLSLLLXQLIIXNIIXLRXHXXLQEHHPYGIIVLLLLHHVXLLFCTCPWXLXEERLLGPIKIXKRCMKXKHPXGTXQXAINXQXWPP

SEQ ID NO: 196479 - protein, 95 aa, Triticum aestivum
  unsure (1)..(95): unsure at all Xaa locations
  Clone ID: PAT_TA_90897.pep
MALVADELKXNADVYYXXXICXQCTRLLLKEAGLPNGLLPLKDIMXCGYVEETGYVWLXXRKRIYHVFHSLXRVVSYGTEIXAFTXXGRIXKAXG

SEQ ID NO: 196480 - protein, 117 aa, Triticum aestivum
  unsure (1)..(117): unsure at all Xaa locations
  Clone ID: PAT_TA_90898.pep
MKFIAAYLLAYLSGNASPSAEDLTSILESVGCEIDNEKMELMLSQVKGKDITELLAAGREXFAAVPSGGGGVAVSAAAPAAGGAAAPAAXKERREXVEKEESDDDMGXSVRQFGDFV

SEQ ID NO: 196481 - protein, 69 aa, Triticum aestivum
  unsure (1)..(69): unsure at all Xaa locations
  Clone ID: PAT_TA_90899.pep
IGSGLXSGXGSXSANXSMXARXRPASXXWLKAEAATTPMRSTARRRXLTRXCILLVXXXSXXPGVXYVG

SEQ ID NO: 196482 - protein, 106 aa, Triticum aestivum
  unsure (1)..(106): unsure at all Xaa locations
  Clone ID: PAT_TA_90900.pep
QFPFPIAYYLTLLHYPGINYNKQKTTLGSLHTCFSGVTNSKFAGWLQQLASQKXXVARYHHRTQQCLLNLGRGISAEQAHDILHHCGITRQCDLSIACETNLPGTP

SEQ ID NO: 196483 - protein, 60 aa, Triticum aestivum
  Clone ID: PAT_TA_90901.pep
TSKPTAQTPFISTSYIAVCYSYVLLPYNGWILYDMLSHFGQDKKKKKKKKKKKLETSSPR

SEQ ID NO: 196484 - protein, 85 aa, Triticum aestivum
  unsure (1)..(85): unsure at all Xaa locations
  Clone ID: PAT_TA_90902.pep
VDMKPSRGLQEAPPRHLAKWVIPKDGSLLAASIKPSXTXXTQXHXXHXQWXXXTAFSXQHKLXTXDDRGTTXREXEXLHSRXIRA

SEQ ID NO: 196485 - protein, 122 aa, Triticum aestivum
  unsure (1)..(122): unsure at all Xaa locations
  Clone ID: PAT_TA_90903.pep
PRWXWXPXPRPXRWXXRXSSTXSRKGXPYXXQXIXXQIKSXLPRHXXSLXHYPFIMLXSAILXVXXSRCMAHAPXWQPQXRTVSLLAXLXNLLWXSLCTAXRXRYCGFAFWLALCKYALXPR

SEQ ID NO: 196486 - protein, 142 aa, Triticum aestivum
  unsure (1)..(142): unsure at all Xaa locations
  Clone ID: PAT_TA_90904.pep
RREERKEKASRLWAMAEFKHLCMAKFKEGVVVDDIIQELNXLAAXLXXVKYFGXXNDXLNXXALXXGFTHVXVMTFASAXDLAACMGHEKHSAFAATFMXALDKSSSWTPLGLVKQRLPDRSVSYNMDCNYHHLLNSGVCRY

SEQ ID NO: 196487 - protein, 56 aa, Triticum aestivum
  unsure (1)..(56): unsure at all Xaa locations
  Clone ID: PAT_TA_90905.pep
LRDHRAPGXDVIFADQRRTDLGTFSECRFAISILNKHMIFDHLLVCTIHVNSYVLL

SEQ ID NO: 196488 - protein, 53 aa, Triticum aestivum
  unsure (1)..(53): unsure at all Xaa locations
  Clone ID: PAT_TA_90906.pep
AXTKYLLSKLKXLQFFVGESMHDDGGVVFAYYKEGAADPTFLYFAHGLKEVKX

SEQ ID NO: 196489 - protein, 70 aa, Triticum aestivum
  unsure (1)..(70): unsure at all Xaa locations
  Clone ID: PAT_TA_90907.pep
IKCTTSXXCXLKHLXLMXWRRAREGAAAYLNXNCEHEXPIXHPXDKELHHXXRDLXWXCXCPSWSFXXGK

SEQ ID NO: 196490 - protein, 63 aa, Triticum aestivum
  unsure (1)..(63): unsure at all Xaa locations
  Clone ID: PAT_TA_90908.pep
PCACSXERPPXNGGRVPQXXXDAIHLSXGPXFGSWPAFRCLLLLITICRDIGKXTKNSLCVAF

SEQ ID NO: 196491 - protein, 173 aa, Triticum aestivum
  unsure (1)..(173): unsure at all Xaa locations
  Clone ID: PAT_TA_90909.pep
XYLLXXGSCWLXHXRXRPQSGXHCXXPRHXGXAFLGALXVXGPIXXXNXSGTXEXVXRMWXTLXXYVQSLXSSXNAAXTAXSPAXXTXGRRYALLXTXSXRVXAIVMXTRHGMXXSCSXIXHCXLHXETGTVQTTXHNCXHCVXDSKXRQKXVGSGISSSPXNGLWIKSXPLG

SEQ ID NO: 196492 - protein, 71 aa, Triticum aestivum
  unsure (1)..(71): unsure at all Xaa locations
  Clone ID: PAT_TA_90910.pep
PXXTSFWNXITRERPXEXRRECIXXXWKXYNFRXTXNNKTAGLIEDGIKKKKKKKKKKKKKKKKKKKNSRL

SEQ ID NO: 196493 - protein, 91 aa, Triticum aestivum
  Clone ID: PAT_TA_90911.pep
PPIKTYIVDILYNIMRPFIYIATDSILIRACFLEPCWYMNMDIHIFLGTNKKDKWRRKTQSNVRVDKTAMALYIWPVVSELFRPCRTPRSP

SEQ ID NO: 196494 - protein, 52 aa, Triticum aestivum
  unsure (1)..(52): unsure at all Xaa locations
  Clone ID: PAT_TA_90912.pep
XHXQXGSLLXLPPPLSFCHXAXSLXWGRGIXRXMGSRGXXGPHVXSLRLITA

SEQ ID NO: 196495 - protein, 47 aa, Triticum aestivum
  unsure (1)..(47): unsure at all Xaa locations
  Clone ID: PAT_TA_90913.pep
VLELVIGLCFNLYLRRPSCCSQPESCVFIWCTEYIYIXWNFCKLKKK

SEQ ID NO: 196496 - protein, 139 aa, Triticum aestivum
  unsure (1)..(139): unsure at all Xaa locations
  Clone ID: PAT_TA_90914.pep
MAPTVMASSATSVAPFQGLKSTAGLPVSRRSNGASLGSVSNGGRIRCMQVWPIEGIKKFETLSYLPPLSTEALLKQVDYLIRSKWVPCLKFSKVGFIFREXNASPGYXDGRYWXXWXLPRFGXTDATQVXTEVEEVXKT

SEQ ID NO: 196497 - protein, 144 aa, Triticum aestivum
  unsure (1)..(144): unsure at all Xaa locations
  Clone ID: PAT_TA_90915.pep
MAAATMALSSPAMAGTPVKASRAAPFGEGRITMRKTAGKPKVAASSSPWYGSDRVLYLGPLSGXPPKLLTGXVPRGNYXXGXPWXSXPNXXNFXXKPGIWXXXNXXXEXXXPLXGXFXXVAPPKGXNFXXGFXLKGXXTFFKXG

SEQ ID NO: 196498 - protein, 128 aa, Triticum aestivum
  unsure (1)..(128): unsure at all Xaa locations
  Clone ID: PAT_TA_90916.pep
XADNSQXXKDLQXFSRKAQNQSXVXIXKVXSDNGXKXKNAXVDTXLDXEGXXHEXSAXYTXXQNGVXERKNWTVLEXARXMXDEXKTPKHXWXKAXQTACHAXNRLXLXKLLGKTTXELLXGNKPQVV

SEQ ID NO: 196499 - protein, 77 aa, Triticum aestivum
  unsure (1)..(77): unsure at all Xaa locations
  Clone ID: PAT_TA_90917.pep
LAFPXQVEXQSGQGYCLRPSYLHSPSVRPMDNRPDARGPLNPGLPHRYIRVFSLSLTRIKHHKIEPXTKHLFPLQDK

SEQ ID NO: 196500 - protein, 111 aa, Triticum aestivum
  unsure (1)..(111): unsure at all Xaa locations
  Clone ID: PAT_TA_90918.pep
NXGHMSLKSHRIGILSACTXQRQAVKRFLGFNLXTFQTKGQPYLFPXSISLFSTVVAIXRSATIESXGHGGGRHKSIPRAAIGALWMEAVSLRQGMRDVLSGAWCVSYAHA

SEQ ID NO: 196501 - protein, 71 aa, Triticum aestivum
  Clone ID: PAT_TA_90919.pep
IDMARRLNAWSFSSLQEIGWGPPERKMAYKVKLGRKSNLRCKRIGLLYFILVCFLSKVVCVREGFRLGSSC

SEQ ID NO: 196502 - protein, 146 aa, Triticum aestivum
  unsure (1)..(146): unsure at all Xaa locations
  Clone ID: PAT_TA_90920.pep
CXAIXLTTXCXSQSPMMYXSCPAPXACPQFDSHVEHRXQVQKPXPRLPWFPGPASAPRSFNVNGFKVDNTFFNSAKNPHSRERISSDRFWSYLQRSYYSCILYNQGRIFPHMRLDTEAITGLPCLEEALDCFKESGLLPFVTDQEH

SEQ ID NO: 196503 - protein, 106 aa, Triticum aestivum
  Clone ID: PAT_TA_90921.pep
WNDIGYLLQRTGGSYRTWRVNIMSQIICIDLLFGMDRLFHRHQLVSINPLISMSQLNPLLWVVFASRVNLGLWINHWLLLSTWCRCQNRSISGRGSRTVRLRIKGN

SEQ ID NO: 196504 - protein, 133 aa, Triticum aestivum
  unsure (1)..(133): unsure at all Xaa locations
  Clone ID: PAT_TA_90922.pep
ERPQLEDRFRGLLMVSWTRGYSPRRLPISWXGPRTTMDVCSWASSDSXCIHEEDSTXLGDQDKDSSPPCVFDXDSCYPRPLVYCISRGQASRXVIMTLLIIPLGFTPQHMISRXINSVIIXIXXTQLQHVXXI

SEQ ID NO: 196505 - protein, 146 aa, Triticum aestivum
  unsure (1)..(146): unsure at all Xaa locations
  Clone ID: PAT_TA_90923.pep
MKTILASETMEIPEEVTVKVSAKMISVTGPRGTLTRNFKHLNLXDFQLQEGGRKLKVDAWVRAPRKTMXAAIRTAISHVQEPHHRGSTKGSRYKDALPCMLTSPINASXXAANRGIQXKEFLRREEVRKXDMLHGSAVREGKKSLG

SEQ ID NO: 196506 - protein, 156 aa, Triticum aestivum
  unsure (1)..(156): unsure at all Xaa locations
  Clone ID: PAT_TA_90924.pep
TSVAPFQGLKSTAGLPVSRRSNGASLGSVSNGGRIRCMQVWPIEGIKKFETLSYLPPLSTEALLKQVDYLIRSKWXVPCLESAXGFIFREHNASPGYYDGRYWTMWKLPMFGXTDATQVINXVEEXKXEYPDAXVXXXGKFREMVKILHGVARSGG

SEQ ID NO: 196507 - protein, 129 aa, Triticum aestivum
  unsure (1)..(129): unsure at all Xaa locations
  Clone ID: PAT_TA_90925.pep
ESNKSQSYRNGRRPGQRRRPRPEATTRRRGVGSPARGCGAGGHVAHGGGHDGPRGRGGRVQHDHRSSAPQPPALPPXTRRLLRPXRXTLPRGRXGGLMTPAXGTXSPHXXGXRXXXRGXRXSXGGYAXG

SEQ ID NO: 196508 - protein, 140 aa, Triticum aestivum
  unsure (1)..(140): unsure at all Xaa locations
  Clone ID: PAT_TA_90926.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRXXXXWXLPXFGXTEATQXINEVEESXRST

SEQ ID NO: 196509 - protein, 81 aa, Triticum aestivum
  Clone ID: PAT_TA_90927.pep
VSCQGGLRVVHEIGGRAQGVGCAPTLVDGPELFWAQLFYSGGLFWVHKNIKNGTSIGLRLGIPFPGKTPKTRKKKEMSLGS

SEQ ID NO: 196510 - protein, 163 aa, Triticum aestivum
  unsure (1)..(163): unsure at all Xaa locations
  Clone ID: PAT_TA_90928.pep
LXNNXLTXRXGGLVSXYGESFQGNPACAPKRRXFLRRCTPGDGGRSGSTARTLVTCLLAGMAVLLAVLGVAIFIKKRRQHAEAAAMAGGKLLFAKKGSWNVKSFRMMAFDEREIVGGVRDENLIGSGGSGNVYRVKLGCGTVVAVKHITRTRAAAAASAGPTA

SEQ ID NO: 196511 - protein, 93 aa, Triticum aestivum
  unsure (1)..(93): unsure at all Xaa locations
  Clone ID: PAT_TA_90929.pep
XAMVMXREEGDYEHCRXRGRAGGAAGRXXGVGRGRVPCLQXXHGQPGEQLQVLSXXWASXRXCXSXSVLRRXARRQLQVDSESYXXLLPXGHR

SEQ ID NO: 196512 - protein, 122 aa, Triticum aestivum
  unsure (1)..(122): unsure at all Xaa locations
  Clone ID: PAT_TA_90930.pep
NYPPPRLQPCSPPTRPTRFHQEVAAAAPPRAPPPLPPPAXPPPPPPXCAAAPASSSTRPPPPPPARHGPCLQRSDLRDPISGGAAPVSLRLQAQKTDSSLFILHPPRAHPRWLLPGRLCGML

SEQ ID NO: 196513 - protein, 135 aa, Triticum aestivum
  unsure (1)..(135): unsure at all Xaa locations
  Clone ID: PAT_TA_90931.pep
MAITTASASPAMQEAAKTPSASPPRATAASPARYRPSPLVIFSACLVLIGSXGPLLLRVYFVHGGATPVVSALVQFPAGRLLXPLXVSXFXGRRHGQLLSLPLGRLALLPSCFSGSACRFNLAGTGGPVPPQGLA

SEQ ID NO: 196514 - protein, 85 aa, Triticum aestivum
  unsure (1)..(85): unsure at all Xaa locations
  Clone ID: PAT_TA_90932.pep
SGYYKHETTDRLRCDYMWVYMRGNTYDPFRGQVNKLYSVRLGYQRKAHTVVLRPILIQLILVHILHLHXEQSLQLSXEXIPHPTT

SEQ ID NO: 196515 - protein, 115 aa, Triticum aestivum
  unsure (1)..(115): unsure at all Xaa locations
  Clone ID: PAT_TA_90933.pep
DQQRLIFAGKQLEDGRTLADYNIQKESTLHLVLRLRGGMQIFVKTLTGKTITLEVESSDTIDNVKAKIQDKEGIPPDQQRLIFAGQAAGGWRTLADYNIPEGSTLHLVLRLRXGN

SEQ ID NO: 196516 - protein, 45 aa, Triticum aestivum
  unsure (1)..(45): unsure at all Xaa locations
  Clone ID: PAT_TA_90934.pep
PALSCLAHSLTRVGLQAVHVDLVVKVTMFRQMAIVLXLXHGGQQX

SEQ ID NO: 196517 - protein, 161 aa, Triticum aestivum
  unsure (1)..(161): unsure at all Xaa locations
  Clone ID: PAT_TA_90935.pep
MLVYQDKLSGDELLSDSFPYRELENGVLWEVDGHWVVQGAVDVDIGXANPSAEGGGDDEGVEXTKXVERWVDIVDTFRSSRSKPAFDKEXFTXQHEPLHQRTXLPXLKGDDLRAFKEKVESAXTKXLPNKXKAFNPLLGXTSYDGAWFRHYKRTRSTSLAG

SEQ ID NO: 196518 - protein, 104 aa, Triticum aestivum
  unsure (1)..(104): unsure at all Xaa locations
  Clone ID: PAT_TA_90936.pep
XVKFSFXXILYSIPSEKRCLFFQRTQLCKFLQXKKMADGKGPQKGGKKLEVNTAFKIPADIYARYITPNEAKYGRETKNERKVRIHTIERRWAREWREYRYVTP

SEQ ID NO: 196519 - protein, 152 aa, Triticum aestivum
  unsure (1)..(152): unsure at all Xaa locations
  Clone ID: PAT_TA_90937.pep
MAAATMALSSPAMAGTPVKASRAAPFGEGRITMRKTAGKPKVAASSSPWYGSDRVLYLXGPLSGXPPSYLTGXSXGDYGWDTAGSPADPELSPRTGXGVIHCRWASGRXRCSSPDCPPQRSIRQFVAVQSRGSILGTHLALLGSSGLMAEAR

SEQ ID NO: 196520 - protein, 145 aa, Triticum aestivum
  Clone ID: PAT_TA_90938.pep
GDAAPRGGATAGRAGCPHDRFGGEEADDEEQHVIAEATDEVQAHRMRFWLEPPLLVGCLAVSLNWRPHRCTRMLVCGAGLCCVLACWVCASVSFCACHRAVVNCARVRPSRGREVCPQCALNLLACGVLPRVVSTLFTSLHVRWA

SEQ ID NO: 196521 - protein, 141 aa, Triticum aestivum
  unsure (1)..(141): unsure at all Xaa locations
  Clone ID: PAT_TA_90939.pep
MARTKQTARKSTGGKAPRKQLATKAARKSAPTTGGVKKPHRYRPGTVALREXRKYQKSTELLIRKLPFQXRLVREXAQDFXKTDLRFQSHAVLASKEAAEAYXVGLFXDTNLCAIHAKRVTSSQGHQLARRIRGRAKLPLR

SEQ ID NO: 196522 - protein, 65 aa, Triticum aestivum
  Clone ID: PAT_TA_90940.pep
RNRVKERNSSSESLVKNSNRDGFRDEARASRREEQQQARGRGSSSSSVQRRSRGSSSLVEEAEQQ

SEQ ID NO: 196523 - protein, 78 aa, Triticum aestivum
  Clone ID: PAT_TA_90941.pep
MSCCGGNCGCGTACKCGNGCGGCNMYPEAEAAGATLLVSATATHKASSGGMEMAADNGGCGCTQCKCGTSCGCSCCSC

SEQ ID NO: 196524 - protein, 120 aa, Triticum aestivum
  unsure (1)..(120): unsure at all Xaa locations
  Clone ID: PAT_TA_90942.pep
MSCCGGSCGCGSACKCGNGCGGCNMYPEVEAAGATLLVAATATHKASSGGMEMAAEDXGCRCTQXXCGTSCGAPCCTANCHRSAPRACTYYFIHHIYATDAEVAYQSSHLTTLIVYKKKK

SEQ ID NO: 196525 - protein, 120 aa, Triticum aestivum
  unsure (1)..(120): unsure at all Xaa locations
  Clone ID: PAT_TA_90943.pep
MANPRVFFDMTVGGAPAGRIVMELYKDAVPRTVENFRALCTGEKGVGKSGKPLHYKGSAFHRVIPDFMCQXGGRLQPRGNXTGRRSIYRREFADEXFVHXTXXGILSXGNARPNTNVPFI

SEQ ID NO: 196526 - protein, 70 aa, Triticum aestivum
  unsure (1)..(70): unsure at all Xaa locations
  Clone ID: PAT_TA_90944.pep
FLQXPKGTLXXVYSCSFYXTHGIYSIYLFVXVYSARTIMQRVSVXGQGYXLKVDXISCXQQQGXEXFEAI

SEQ ID NO: 196527 - protein, 96 aa, Triticum aestivum
  unsure (1)..(96): unsure at all Xaa locations
  Clone ID: PAT_TA_90945.pep
IRSKWVPCLEFSKVGFVFREHNSSPGYYDGRYWTMWKLPMFGCTDATQVLNEVEEVKKEYPDAYVRVIGFXDNLRQVQCVXFIAFKPPGCRGSRQA

SEQ ID NO: 196528 - protein, 125 aa, Triticum aestivum
  Clone ID: PAT_TA_90946.pep
SFAPYGDAWRRSKKMAVVHLLSPRRADSFAPVRAAEAAALVAGVRRAAEAGEIVELRELLSAYSNAVVTRATTGAAATAEKLKQFWVTPQRSCRPSGYSPGRRQVLRWARSRRLRRPLQKLEFPQ

SEQ ID NO: 196529 - protein, 189 aa, Triticum aestivum
  unsure (1)..(189): unsure at all Xaa locations
  Clone ID: PAT_TA_90947.pep
MAPTVMASSATSVAPFQGLKSTAGLPVSRRSNGASLGSVSNGGRIRCMQVWPIEGIKNSETLSYLPPLKHGGLPPSXVDYLIRXNWXLASXFNKLGHFPXXNASPGXYDGXYWXMWXLPSSXAPTHTXNXVXGVQEXYPDPIHHFHKCPSDAHALTTGKIRKAKHHTALACINRMLVLHYLYFKSSKSN

SEQ ID NO: 196530 - protein, 169 aa, Triticum aestivum
  unsure (1)..(169): unsure at all Xaa locations
  Clone ID: PAT_TA_90948.pep
KAHGYGEQKAYDSKVQKHGYGEQNAYDSKVQKHGYGEKAHGYGEQKAYEHGSAAAALHHDSYGAMKKHGYGGEQKRTALQREGTTPSTTTVNAKLXLRRAKAXYNXGAXRKVRXXTTERXPXTLRVGXXLXHGLSRRYNXXQXGWPTNNXVXXGKCRGKPLSQXAQXTT

SEQ ID NO: 196531 - protein, 54 aa, Triticum aestivum
  Clone ID: PAT_TA_90949.pep
FFFFVKRPAWFPWSPSSPNTGKNNRARTHYIILWRPMHQAEYLQSPPWTTPRQH

SEQ ID NO: 196532 - protein, 152 aa, Triticum aestivum
  unsure (1)..(152): unsure at all Xaa locations
  Clone ID: PAT_TA_90950.pep
MAPTVMASSATSVAPFQGLKSTAGLPVSRRSNGASLGSVSNGGRIRCMQVWPIEGIKKFETLSYLPPLSTEALLKQVDYLIRSKWVPCLRLSKXGFTFREHNASPGYYXGRXXWTMWNCLXRVHXAXQVIXRWXRQKGXPEXXSHGSKNAVN

SEQ ID NO: 196533 - protein, 169 aa, Triticum aestivum
  unsure (1)..(169): unsure at all Xaa locations
  Clone ID: PAT_TA_90951.pep
MQIFVKTLTGKTITLEVESSDTIDNVKAKIQDKEGIPPDQQRLIFAGKQLXEDGRTLADYNIQKDPPSTWVLRLRGGMQFVKTLDGARPSRLKWLRTHRQRQKKDKGSPRTTLTSPGTRWRSGRYNIQKHLHWVSASWIPETNIWRGSRAHHNSRQQDKDPRQKAEKSG

SEQ ID NO: 196534 - protein, 123 aa, Triticum aestivum
  unsure (1)..(123): unsure at all Xaa locations
  Clone ID: PAT_TA_90952.pep
MGTRGLALLLLAAVXLQTXLXASXXXGLLRIALKKRPIXRNSRVXXSLSXRXDLXRXGXTNXLRXEEXGDIVXLKXXMNSQXFGEISFXXXDXXFTVIFDXGSSNLXVPYDXCYFTIXXYLKA

SEQ ID NO: 196535 - protein, 184 aa, Triticum aestivum
  unsure (1)..(184): unsure at all Xaa locations
  Clone ID: PAT_TA_90953.pep
WPPPPLSPLPPSLGSPLRWEIGISVCLNRHPLHALRRRRRRRIDGHGRRAARLSAGRCPADPSCQSTPKSPTGSPRRSRSLLSSRRRRRRGRLPEAAAGRPVXSRRSATXSPRXREPLALNGAAXXAGKCNRTPEFLXXAGYTTHLNGEXXEIHYTGKSLSRXNLXXSXHPXGRXVNPRXXTXS

SEQ ID NO: 196536 - protein, 77 aa, Triticum aestivum
  unsure (1)..(77): unsure at all Xaa locations
  Clone ID: PAT_TA_90954.pep
FFFFPGXWPPWINXGLXVXXPLRFLXRXXXSXQXEKEVMPXGTGYPXXKEPHYXTGVYVFIFXGXKWVPPKMXYLLV

SEQ ID NO: 196537 - protein, 178 aa, Triticum aestivum
  unsure (1)..(178): unsure at all Xaa locations
  Clone ID: PAT_TA_90955.pep
RGXPVFIVHSXVFLPRFRXAPTQHCGXPPRRRETPQSXVXTMRRVRSXAKISRXYVXVRITHQGLMEFLGGSFEXRGAWRPEEDGQEERRRVVAAGAGAGEAAVLEVETRHAAAEAPRRELRVRLQELLPELRRRPRPRSPSLAAPGRMGRLLFLLLSFTSPGQTPARGWRVQSGATL

SEQ ID NO: 196538 - protein, 181 aa, Triticum aestivum
  unsure (1)..(181): unsure at all Xaa locations
  Clone ID: PAT_TA_90956.pep
GKLWFARIFVREQQSPRSKVSLLETANGFASSRHLVVRLFSLQKPVLRNXQGXIHKVPCPMDSEKILNLDEXTSIAKLRELLQXKRYLVIVDDIWSTQAWNNIKCAFPDNKYSSRIITTTRIIDVARSCCPGSDDRVYEMAALSDLHAKRLFLKRIFGSEDHCPDMLKEVSNKILKKCGGL

SEQ ID NO: 196539 - protein, 130 aa, Triticum aestivum
  unsure (1)..(130): unsure at all Xaa locations
  Clone ID: PAT_TA_90957.pep
MEMEPPPKMLATLIITILLMIMMDTSAALASDAVVLRGQARALLVWKDSLDNQSQHALRSWGNTSAPCNWRGITCGXSVHWRRRRPVITGISLRDMQLGXTLESLNFSAXXTLTRLDPSXNQLVXQSLVK

SEQ ID NO: 196540 - protein, 194 aa, Triticum aestivum
  unsure (1)..(194): unsure at all Xaa locations
  Clone ID: PAT_TA_90958.pep
ATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDAXQVINEVEEXKKEYLTLFRIIGFKTCSAMLTYRLKPRAARSGKATHHKGIKMHVTRMLGSSNYFYVQFFMFNCQNL

SEQ ID NO: 196541 - protein, 165 aa, Triticum aestivum
  unsure (1)..(165): unsure at all Xaa locations
  Clone ID: PAT_TA_90959.pep
LGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKXYPDAYFRIIGFDTSPSFXRQLIAXXPPGCKDPXRLKSHHNGYKHSFLNALVSFPFTFWLSK

SEQ ID NO: 196542 - protein, 105 aa, Triticum aestivum
  unsure (1)..(105): unsure at all Xaa locations
  Clone ID: PAT_TA_90960.pep
CLIMVXRKYNICMIPRLERGXALXCMSERRDAAGDXGLAEEAGTLPGDGRDPQGSGERQSCTATATTAGVAQWGRXEELGXGKDRGGGTYRRRTPWWLPPPPPTR

SEQ ID NO: 196543 - protein, 146 aa, Triticum aestivum
  unsure (1)..(146): unsure at all Xaa locations
  Clone ID: PAT_TA_90961.pep
FMSLLLLVYFLVLERKMIRTRYESQAPLGEHFPKVSYNDLVEATXNFSESNLLGKXSYGTXYKGNLXXHXLEXAVKVFNLXMXSAXRSFMSECXALRSVQXXNLVSIITACSXXXSDGRAFRALTYELCXRGNLRASSRGRHSGHL

SEQ ID NO: 196544 - protein, 93 aa, Triticum aestivum
  unsure (1)..(93): unsure at all Xaa locations
  Clone ID: PAT_TA_90962.pep
PVFXXSSVAGXASKCXQICLSGSXSILLRTVVGNVWLGXSFFICXPSEIILPYLXGCVIILIHERLEKDLILDIFSSFRRFSNPSICSLDILG

SEQ ID NO: 196545 - protein, 162 aa, Triticum aestivum
  unsure (1)..(162): unsure at all Xaa locations
  Clone ID: PAT_TA_90963.pep
TEGVHSTATHEPPNLRWPVIGAGAPAQFLAGRLPSIRYGLFQPYDTTFPSSSKSQPRWKKGSDLVQARSPAAALVLGITCFPSPVPPRPPTRARRCSCHCARLGYSARHXCTRTETGSTCGTRVQISACRPGFRRKGARTNRLYDLYXAXAXLNSDGKPGYH

SEQ ID NO: 196546 - protein, 116 aa, Triticum aestivum
  unsure (1)..(116): unsure at all Xaa locations
  Clone ID: PAT_TA_90964.pep
QHXXXRLSHDXFWQMLAXSMXMQTGAYFXLAXGLPXXTSDSXNXTXANGRQGRSXGSKHHGTAAVDGGLHGXHLGRRLLLXLDXCGPGHHEAAARGCRAPVDRHGRGEGRXXGERX

SEQ ID NO: 196547 - protein, 151 aa, Triticum aestivum
  unsure (1)..(151): unsure at all Xaa locations
  Clone ID: PAT_TA_90965.pep
MSLNVPKNSSMRLKAVYQRIVDNFLAVVTAAISSYSLVALVRLGPAELISWLRELQLQPAHLFLAGFVPAAAATVYLMLRPRAVYLIDYACFNSSSNRPLARIPMASFVEHTKHTPTSTPAASGSCXRXXXRSGLGEXNAGGQTPKHYAPQ

SEQ ID NO: 196548 - protein, 110 aa, Triticum aestivum
  unsure (1)..(110): unsure at all Xaa locations
  Clone ID: PAT_TA_90966.pep
TRLXSGLXHPMVSPYIXLFXPTTTSMVTIXXDGNXXCSXELTFLITYLTAGISXTXSXXTXTXGDXPRRXFQXLFMXGGEHLTMLVLVQQXTRNXQXSXSCDFXRKXPXE

SEQ ID NO: 196549 - protein, 56 aa, Triticum aestivum
  Clone ID: PAT_TA_90967.pep
YRAPPFGEEPWWNQSRAPAELFFRGNIPPGGGNRHHHHHHRSSHREGVNIQQHLHQ

SEQ ID NO: 196550 - protein, 120 aa, Triticum aestivum
  unsure (1)..(120): unsure at all Xaa locations
  Clone ID: PAT_TA_90968.pep
MQIFVKTLTGKTITLEVESSDTIXDNVKAKIQGQGGXIPPDQQRLIFAGQAXXRMAAPXADTTSXKXPTSNLGAXGPXGGCSSXVKTSNGQTSHWRVXPXDTIXDNXXARFQDKEXPFPD

SEQ ID NO: 196551 - protein, 121 aa, Triticum aestivum
  unsure (1)..(121): unsure at all Xaa locations
  Clone ID: PAT_TA_90969.pep
MGKEKIHISIVVIGHVDSGKSTTTGHLIYKXGGIDKRVIERSEKEAAEMNKRLSKYAWVLDKSKAERXERGTPLILLLWXXETTXIPALXIDVPGNRDFIQNMITGTPQLIVLCLTIPHWG

SEQ ID NO: 196552 - protein, 129 aa, Triticum aestivum
  unsure (1)..(129): unsure at all Xaa locations
  Clone ID: PAT_TA_90970.pep
MAAATMALSSPAMAGTPVKASRAAPFGEGRITMRKTAGKPXVAASSXRGYGPDRVLYLRPSPGDPPSXLTGXSPGDYGWDTXGLSXPDPRTXAXNRSWRLIHCRWASGARXVLFPDXPATLNSGLLKAF

SEQ ID NO: 196553 - protein, 89 aa, Triticum aestivum
  unsure (1)..(89): unsure at all Xaa locations
  Clone ID: PAT_TA_90971.pep
FFFFFFFFFFFWXGGXXFGSXQXCNYWIXPAXISLSKRTIVYTAXNQXSIVMGSLLXXXSPTNTHQXXSSXIQXXXTXHXNXVSMIRSS

SEQ ID NO: 196554 - protein, 65 aa, Triticum aestivum
  unsure (1)..(65): unsure at all Xaa locations
  Clone ID: PAT_TA_90972.pep
DWPEAPMXHTHWPSSDTPAAYQGGSTGLAPQGPRXSLTXGLPVSYINRGQASPMDNLIFITTISW

SEQ ID NO: 196555 - protein, 138 aa, Triticum aestivum
  unsure (1)..(138): unsure at all Xaa locations
  Clone ID: PAT_TA_90973.pep
MAPVKLYGATLSWNVTRCVAALEEGRRPSTRFVPINSGTXGEHKXPDHLXAXEPFRQXPXLQDGXFILLPXTAICKVRLPAKNXPSXLKEGDIQXXXMVDVWXQVGAHXYTPSYPFSFXXLYXPIFWGXLTXSIXDTC

SEQ ID NO: 196556 - protein, 114 aa, Triticum aestivum
  unsure (1)..(114): unsure at all Xaa locations
  Clone ID: PAT_TA_90974.pep
TKXLLRRSXXMXAAAXXRXXRXGXAAXSPXRRSPXAPDPPSRXGPXRSTNGXAVXXATXTQXRQRARXRXXAAXGAHAAPQPERRARAAPLRAGEPEGXAAAGPGELCPARPSG

SEQ ID NO: 196557 - protein, 133 aa, Triticum aestivum
  unsure (1)..(133): unsure at all Xaa locations
  Clone ID: PAT_TA_90975.pep
IIASSAYFLHYRPPQRYYRCGRAMGGCVGVXFXVFLPHTHSLHSPVLFVAPATSHRGRVSAGRHPRVVPLYFFRWSXSPPRPPXMDAGYCPLSRSLLCLXSHIWXPXXNXIVPPNFWANXSXSRWXKAPXPVX

SEQ ID NO: 196558 - protein, 105 aa, Triticum aestivum
  unsure (1)..(105): unsure at all Xaa locations
  Clone ID: PAT_TA_90976.pep
XRXFRGSYPHXXVAGVSIXPXGEXRRVLXKIQXGIXTPRDILPKGRYXGRGQSXXSRGXERPLLKXWRXESQAGEEKVPGXLAPNRRPHHVMPHXMASPPTGVWS

SEQ ID NO: 196559 - protein, 106 aa, Triticum aestivum
  Clone ID: PAT_TA_90977.pep
TVIRTRHEYVASRLCPEEPEPKSYFSLVQHFLGSVSHVYAMKRSTCIEGAQMALARVKTYWADMKASVVASQDSDESRVPAKHYFEEVLPGARLIEAQCSKDVMFE

SEQ ID NO: 196560 - protein, 50 aa, Triticum aestivum
  Clone ID: PAT_TA_90978.pep
ERICRQQKSLHIEIFEGPACCAPPRHISLLIHSLGCSLNAMDIFFSVLVY

SEQ ID NO: 196561 - protein, 87 aa, Triticum aestivum
  Clone ID: PAT_TA_90979.pep
DPDWTAVFPLKYTCKEIQISLCCFVSSRNLLGGRYMCKINTPHLISTIPKCGLLPTSFEECTFNFVEKSNIFMFDRIYTIMHQHLCH

SEQ ID NO: 196562 - protein, 101 aa, Triticum aestivum
  unsure (1)..(101): unsure at all Xaa locations
  Clone ID: PAT_TA_90980.pep
FFFFFFXRXPSAEIKFEMXRVVVKQPASFASTXPNRNHTRDRTWXLRXRLASRACNVRHGVAVGVPSTTSVSSPLXXTHXQXXLLXDXHAPXAGHSXASTT

SEQ ID NO: 196563 - protein, 62 aa, Triticum aestivum
  unsure (1)..(62): unsure at all Xaa locations
  Clone ID: PAT_TA_90981.pep
PXPXVXXYXCGTSXGGXFQXVCXSFKKTMGCWNLPLGXLVQXYXLXVLKIYRECGESSXXXG

SEQ ID NO: 196564 - protein, 62 aa, Triticum aestivum
  Clone ID: PAT_TA_90982.pep
CVLRLLIKQVMRNKMVSKMKHPTGAKIATTLLTEEDFTSMLVDPIGAGRSLGVIGVNFGGGA

SEQ ID NO: 196565 - protein, 112 aa, Triticum aestivum
  unsure (1)..(112): unsure at all Xaa locations
  Clone ID: PAT_TA_90983.pep
CGQVDSKLAPCVAYVTGRASSISKECCSGVQGLNGLARSSPDRKIACRCLKELXATSIKSIKHGAKAPGVPXAKCGVQRAFPIXIXTNWQHVNLVNIYPFPVHAWTRWWSYF

SEQ ID NO: 196566 - protein, 136 aa, Triticum aestivum
  unsure (1)..(136): unsure at all Xaa locations
  Clone ID: PAT_TA_90984.pep
MAPTVMASSATSVAPFQGLKSTAGLPVSRRSNGASLGSVSNGGRIRCMQVWPIRGHPRSSETCPTWPPLKTXGLPPSRSDYLXIRPKWGACLXEFRRVWGHLPXEXNXPWGTTNGPVLGMLXLPXSXXXTHKVSRV

SEQ ID NO: 196567 - protein, 82 aa, Triticum aestivum
  unsure (1)..(82): unsure at all Xaa locations
  Clone ID: PAT_TA_90985.pep
VPAPRPAAGGGGGGGAVDAVKAASKEPISPGSPSPASKVRPGAVSLPGWKLXDSLCKESSSAAXHDGAFPYSEARGILVILC

SEQ ID NO: 196568 - protein, 84 aa, Triticum aestivum
  unsure (1)..(84): unsure at all Xaa locations
  Clone ID: PAT_TA_90986.pep
MDVADAASSSGQEQQGHRTVSSEPPKRPAGRTKVHETRHPLYRGVRQRGRVGQWVCEVRVPGVKGSXRLWLGPSPTXEMAAERR

SEQ ID NO: 196569 - protein, 117 aa, Triticum aestivum
  unsure (1)..(117): unsure at all Xaa locations
  Clone ID: PAT_TA_90987.pep
YVTMTGTAWRGTASXSRWVISPATPXSSGAXPGPGXXIXTPAARRQDERTPVRIXQAGESRAXPDGRXYLAXDPRLXALIKTLPDXXRVSKRRSACXQREXTWXLAGNAFQPLALXE

SEQ ID NO: 196570 - protein, 90 aa, Triticum aestivum
  unsure (1)..(90): unsure at all Xaa locations
  Clone ID: PAT_TA_90988.pep
TINTWMLFLGFLPSPIQTSAKESGITFGHPLXYYRSTTNXKNWGXKGTRDFGQLLPYXEDTPLDQXMVDPGNLXXPLGEHLPISXERHKX

SEQ ID NO: 196571 - protein, 77 aa, Triticum aestivum
  Clone ID: PAT_TA_90989.pep
GYEQECCTPCPGFLFFWSGSVVDKNPCAGLYGFLQVHIHLSVVPVFITVCVHKYSTSSSILYHMTWFQPSYYGILLE

SEQ ID NO: 196572 - protein, 75 aa, Triticum aestivum
  unsure (1)..(75): unsure at all Xaa locations
  Clone ID: PAT_TA_90990.pep
DGEXWXKVXYXDRXXQXFXYXPREXLXXPXXVFXHDXEVNGGRGMIXDPRTKHIPPHTLHVGLFFSSFFSKAALS

SEQ ID NO: 196573 - protein, 127 aa, Triticum aestivum
  Clone ID: PAT_TA_90991.pep
QSKDDDEEPRPQNTGGQKKSSPQVKTVNMIYATHIPKREHKRALRDVYAIERVCSKVNPWSVLPGSPSDSLGTIPTKYPSWPVQPALGLRPNHLMVPSYVPPWTVASSLEPGYIKMLCVNGICSSKV

SEQ ID NO: 196574 - protein, 80 aa, Triticum aestivum
  Clone ID: PAT_TA_90992.pep
VIRLTIGRNGYPAPPGSCIHAALMFVTFTLPLKFELHCMYFASCEEILFSVPEISNNVPLRTPDLLVYCLVIISIEVLYI

SEQ ID NO: 196575 - protein, 71 aa, Triticum aestivum
  unsure (1)..(71): unsure at all Xaa locations
  Clone ID: PAT_TA_90993.pep
XGAHTTLSPRSHISPIVLLYIASHTLSLPRDILRSLICLSSYHSCCEISFSLADKKLRLSGSHFSLISVCM

SEQ ID NO: 196576 - protein, 189 aa, Triticum aestivum
  unsure (1)..(189): unsure at all Xaa locations
  Clone ID: PAT_TA_90994.pep
LRGARTFTFAELKKITNNFSEANDIGNGGFGKVYRGTLPTGQLIAVKRSQEGSLQGSLXEFKNRDRVLSRVHHKNVGELLRFCXDQGEQMLGYEYTPNGTLQRELNRQXRRAVDWEAESVHPPARPKLLQRATSRLSTGNQENVSGQCKAPALALQILRRGKGKHTEGTWVLDLSTHATGKSFVRMYAK

SEQ ID NO: 196577 - protein, 131 aa, Triticum aestivum
  unsure (1)..(131): unsure at all Xaa locations
  Clone ID: PAT_TA_90995.pep
AVEASDXVXHAXRLISGNPSXGXRITIIKGKVEEVELPEXADILISEPMGTLLENERXLESYVIARDRFLAPDGKMFPXTGRIHMAPFSXEYLYVXMAXXSLFWEQHXFFXVDLTXLHGSAFDXYFHXPXX

SEQ ID NO: 196578 - protein, 70 aa, Triticum aestivum
  unsure (1)..(70): unsure at all Xaa locations
  Clone ID: PAT_TA_90996.pep
SSQLGTTTDQHETKQHNEQEFIRVPLGVKLRHLHWVSSGTWQCFGKYCXPRGLQISHPRXQVILSLRKGG

SEQ ID NO: 196579 - protein, 84 aa, Triticum aestivum
  unsure (1)..(84): unsure at all Xaa locations
  Clone ID: PAT_TA_90997.pep
EFFFFFFFFFFYIIXXSYXXQXTXQGPXGLXYKXXIIDXSXXSXXSEXRHXLXKFALXKASTNLAXIDSGXAXCLGPPNYSWSS

SEQ ID NO: 196580 - protein, 38 aa, Triticum aestivum
  Clone ID: PAT_TA_90998.pep
LCEALLLCACTLCRKCELWTIRLVQDALARLKKKKKNS

SEQ ID NO: 196581 - protein, 202 aa, Triticum aestivum
  unsure (1)..(202): unsure at all Xaa locations
  Clone ID: PAT_TA_90999.pep
YQPNTSAQCQQGEAKQRGREISNYMFYLLLIRPEMLMLGAKSYLRHLGPAIKCGKQQGTTPNPTEESWARGVFNLSPSCTWIWVPKCMPSWPKALDGVWVAXERWPLIPSVWVGDXLVFPAKQMAXVPACXXXGVTAGXLTYIYSFGXSMGMGHWGXRSMSXPPFXPQGXXGIAXXACLSXPPLGKHCAMGYLHEXLLILRM

SEQ ID NO: 196582 - protein, 190 aa, Triticum aestivum
  unsure (1)..(190): unsure at all Xaa locations
  Clone ID: PAT_TA_91000.pep
SFAGKAVKDLPSSALFGEARVTMRKTAAKAKPVSSGSPWYGSDRVLYLGPLSGDPPSYLTGEFPGDYGWDTAGLSADPETFAKNREXEVIHCRWACWGALXCVFPECSPATXQXGXAVWLRPVQXXTRAARYFGNPTCQSQRPRIWAASRVGASRYAPRGPLCPTRGSRPWAPTRGLREIKRSMSKLKQT

SEQ ID NO: 196583 - protein, 69 aa, Triticum aestivum
  unsure (1)..(69): unsure at all Xaa locations
  Clone ID: PAT_TA_91001.pep
RXRSPLDLSVYRSLMILASRIXPXLXXTXWRLWXIGGXXEXXHEAAVXPSXPWISPFLSSPNYGNPRLG

SEQ ID NO: 196584 - protein, 94 aa, Triticum aestivum
  Clone ID: PAT_TA_91002.pep
VHIWILRAPQLAKLGILWIRKPAAQKKRLASHNVSGLMQLLLHSPHCRMGILGFGGGLPQVSLSDRRSFLRASLRSVASFNLTANSAISSLLRQ

SEQ ID NO: 196585 - protein, 210 aa, Triticum aestivum
  unsure (1)..(210): unsure at all Xaa locations
  Clone ID: PAT_TA_91003.pep
VELGRRFKVLDGLIQRASQVVSPSGEGSSGSGVEMEEVVEEMDARRNDVTSVAAAFGEIERANRGVGFGLNTKVRLRLCFRNGSTGDFFTFTFLIQLSIGSVCERPALHEEIFLRDHTVFCSYIQTRTHPRLSRPSLSSXSALCXVPEMAXKRRRRIVEDSQGVPELPPWXRWTSXAAXVQPXRPREXPXGLPEENAXXSXXXGXXHVQX

SEQ ID NO: 196586 - protein, 131 aa, Triticum aestivum
  unsure (1)..(131): unsure at all Xaa locations
  Clone ID: PAT_TA_91004.pep
MAPTVMASSATSVAPFQGLKSTAGLPVSRRSNGASLGSVSNGGRIRCMQVWPIEGIXKFETLSYLPPLSTEALLXQVDYLIRSKWVPCLEFSKXPGSIFREDNASPXXYDXRYWTMXWXVPMFXCTXHTVI

SEQ ID NO: 196587 - protein, 108 aa, Triticum aestivum
  unsure (1)..(108): unsure at all Xaa locations
  Clone ID: PAT_TA_91005.pep
RGCLFLQKMDAEARRPGPGLDVSQHGCRITRTPNTLDDHIFGLIFTTTRRASSRPIXCXVFNLFPVXRVIXTNLXSLRXGXQVXNIWIHPXELRXTLXLXLXXXHXCT

SEQ ID NO: 196588 - protein, 150 aa, Triticum aestivum
  unsure (1)..(150): unsure at all Xaa locations
  Clone ID: PAT_TA_91006.pep
MAPTVMASSATSVAPFQGLKSTAGLPVSRRSNGASLGSVSNGGRIRCMQVWPIEGIKKFETLSYLPPLSTEALLKQVDYLIRSXKWVPCLEFKQGWVIFREQNASPGXYYDGRYWTXWKLPMFRMNRRNQVINXVXEAKKEYLTLCPVNA

SEQ ID NO: 196589 - protein, 124 aa, Triticum aestivum
  unsure (1)..(124): unsure at all Xaa locations
  Clone ID: PAT_TA_91007.pep
DPNKPKRAPSAFFVFMGEFREEFKQKNPKNKSVAAVGKAAGERWKSLSESEKAPYVAKANKLKGEYNKAIAAYNKGESAAAAAPKKAAAKEVEEDDEEESDKSKSEINDDDDDXGSDEDEDDDE

SEQ ID NO: 196590 - protein, 173 aa, Triticum aestivum
  unsure (1)..(173): unsure at all Xaa locations
  Clone ID: PAT_TA_91008.pep
MAPTVMASSATSVAPFQGLKSTAGLPVSRRSNGASLGSVSNGGRIRCMQVWPIEGIKKFETLSYLPPLSTEALLKQVXDYLIRSKWVPCLEFSKVGFIFREHNASPGYYDGRYWXTMWKLPMFGCTDATQVINXVEESRRSXPDAYSDIXSXNRQVQCVSFXASSNGLQDPEG

SEQ ID NO: 196591 - protein, 129 aa, Triticum aestivum
  Clone ID: PAT_TA_91009.pep
GRRPRPCPSLLHYPSHHRPPPLGSPAASASRAADRRGCSGHQSPPPLGPPAAAAAWASGRRSCHRRSSHRPSPAPPTATSARAINRLRRSSARATNRRRCSGHRSPLAPPAVAESIDGCKGPLPFAPTG

SEQ ID NO: 196592 - protein, 170 aa, Triticum aestivum
  unsure (1)..(170): unsure at all Xaa locations
  Clone ID: PAT_TA_91010.pep
TSSATLGPCVAVDRMDDHLAVLARGEGXTEERHAXFLXGVERSFXXEVXVGXAGVSXERXAXRXLCHRGPPPAXGRXQXPXDXPLPXXAVESNRRGPSRDRXPXRQMTHVASMNLKVNKLARVINSXXNRSLQSXXLYXSQWKXXFQIVQYADIGLVMCFMXXDXXRWYD

SEQ ID NO: 196593 - protein, 68 aa, Triticum aestivum
  unsure (1)..(68): unsure at all Xaa locations
  Clone ID: PAT_TA_91011.pep
RRAKWGAAKPLNXXWEXAIQAFVLLSEPVXVAHPRWLKPITXKTLLYXLTXSTWDXGPRCXQARHXSX

SEQ ID NO: 196594 - protein, 145 aa, Triticum aestivum
  unsure (1)..(145): unsure at all Xaa locations
  Clone ID: PAT_TA_91012.pep
IQLCCGFTNDVLRLTLSKERESGHLMEAWLSTSPSSRFRTSPQLHLLRLLDGRPLLRDGRXWVSCSVLRRWDGVSWAAPGKLLGARAHFPEFFKASVVLGGCHTPELGVRSHEPVVARPELRQXTKXSPFQGPTTGXAGVPXKRR

SEQ ID NO: 196595 - protein, 161 aa, Triticum aestivum
  unsure (1)..(161): unsure at all Xaa locations
  Clone ID: PAT_TA_91013.pep
QVFLQILTRYQHCSPARAIPTRNTEHXQDEREGKMAGMNLHNIASALVCFIRXEIHRSERRQRAGVYHPWGPGNGRRGRRGHRGCGRGQGLPWPAAXDQAGPGNRPWPSTVPTKAPLDAGFVTPSNXLCSXPRLQPRSWXXEESSTPVRPATAGISSEXXG

SEQ ID NO: 196596 - protein, 150 aa, Triticum aestivum
  unsure (1)..(150): unsure at all Xaa locations
  Clone ID: PAT_TA_91014.pep
QGPSQGQGRREAQGGGEAERSHPSVAAAAAHQQLALFHPAEWPATTTMALSSPADQVAGAPTPPAAAARITMRKGRAKASASNSRWYGPDRVSTPAVSGEPPXXLKRRXPGRYGWEXXLSADPELXQKRESQVPLRWACXGWFPCPRVID

SEQ ID NO: 196597 - protein, 80 aa, Triticum aestivum
  Clone ID: PAT_TA_91015.pep
SGVHRSACRRREARRGRRCRSTGAAAGGAAAPAGRWSSWRRSRRCASALYGVILYLKLPIRTVEPGGTACIRTGSNTEPA

SEQ ID NO: 196598 - protein, 153 aa, Triticum aestivum
  unsure (1)..(153): unsure at all Xaa locations
  Clone ID: PAT_TA_91016.pep
MAPTVMASSATSVAPFQGLKSTAGLPVSRRSNGASLGSVSNGGRIRCMQVWPSEGIKXSETLSYLPPLNTEASFKQVXDYLIPSKWXPFLRXQKFGSLPVEXNXPLGYYDGRYWXMLXLPMFRXTDPPSVNEVXGGKEGLTLCIITNLKGRNR

SEQ ID NO: 196599 - protein, 110 aa, Triticum aestivum
  unsure (1)..(110): unsure at all Xaa locations
  Clone ID: PAT_TA_91017.pep
GCXXREGLWAIVKGAARGWTGEXAVDAGAXTGGRGRRRGLPPFSRIRGGAPGGGPASRSCLPLPFQKPMARWAAGELEDKGRLGFGAVRVRGGRWVAWGSVDDDPSTLPT

SEQ ID NO: 196600 - protein, 169 aa, Triticum aestivum
  unsure (1)..(169): unsure at all Xaa locations
  Clone ID: PAT_TA_91018.pep
KEQEKWVVDIMLSVTLVKLALALYCRTFTNEIVKAYAQDHIFDVIXXIIGLVAALLANYFEGWXDPVGAIILAIYTIRTWSMTVLENVHSLVXQSASPEXLXXLTYLCWXNHHXAXRXXDXVRAYTFSSHYFXXXGHLLPAVCRASRARHLDACKNWPADLPSAPWLTA

SEQ ID NO: 196601 - protein, 124 aa, Triticum aestivum
  unsure (1)..(124): unsure at all Xaa locations
  Clone ID: PAT_TA_91019.pep
SRHQLSQPGVTLVFSKSLLGCFLTYFLKLITLVFGXLVPPSSNADKRXFNKLDPRGQCPSVHFLIRRFXESQSSPKNSQKQXSXFPKKKGTAXXLVNXXXXGARLXFPGGXCTXXIPIHPMXXR

SEQ ID NO: 196602 - protein, 108 aa, Triticum aestivum
  Clone ID: PAT_TA_91020.pep
HFLFAQSNFNPAKRFRRLSSNTQIESTVIVRVSSQELKQVVLGLESMVVDTKEFAIFLDELPSACTANLWRILFVDKYMFGPPNGRGNKHQLPCYKQSSRMEMWVPSH

SEQ ID NO: 196603 - protein, 76 aa, Triticum aestivum
  unsure (1)..(76): unsure at all Xaa locations
  Clone ID: PAT_TA_91021.pep
PFTRXQXDPLAXPXTLRXAEFKVRXSRTPXXMFSMXGFFVQAIVTGKGPXENXADHLSDPVNNNAWAFATNFVPGK

SEQ ID NO: 196604 - protein, 143 aa, Triticum aestivum
  unsure (1)..(143): unsure at all Xaa locations
  Clone ID: PAT_TA_91022.pep
YYYSSSNPPPFTHGDRYTXPTAPPPVKRQEQGQRLSPAVXRQDNGMXSRPRQTXQQRHGKXPPXTACXXNCNGRQRQXSXAXNGKXXIGXXIXAXRAXWIXGQGXSXXRAXTRHRKIPLRXAXLXLPGNXFRFXXSRPSPFXD

SEQ ID NO: 196605 - protein, 190 aa, Triticum aestivum
  unsure (1)..(190): unsure at all Xaa locations
  Clone ID: PAT_TA_91023.pep
NVFSLRANQPQRARACVCSLAAGLEQQRWRRPWPSPPHPHAGRGSPATPSPSRRLSSAWRERDPPGASAPPLPRRSRPTCCRDPGPATKPXTGXCRRGCPXTAGGLDFXAPLGGDKSRLRDQPASLGHTLPHKPXVTRLRMGDTPIWVXQNKRSLQELRHRSVNIXWMXSWHGTNFKEPLIYCPXVXKXT

SEQ ID NO: 196606 - protein, 131 aa, Triticum aestivum
  unsure (1)..(131): unsure at all Xaa locations
  Clone ID: PAT_TA_91024.pep
MAQTMASMTGLSQGVRLPGPAGRRASRFIVRASSAEAEAAGRRAVLGXMASGXSAALRQVGAPRHRPXHRFLAGPPPSPVGSPGXDNPEQARTFDXPLEEXFYLQRQRAVPAKDPAKNPLKPSSTRTMAYS

SEQ ID NO: 196607 - protein, 102 aa, Triticum aestivum
  unsure (1)..(102): unsure at all Xaa locations
  Clone ID: PAT_TA_91025.pep
DXPXXFXXXVPFXVXXGRSXFLXFXNIFHXGPXPFIXLNGCNXCSXXLDVXHRWLSYCVXTXTVEXGVLGXGNTCAHGXKXDIGVKCASLXSVPWIRSMXVA

SEQ ID NO: 196608 - protein, 88 aa, Triticum aestivum
  unsure (1)..(88): unsure at all Xaa locations
  Clone ID: PAT_TA_91026.pep
IVQYYFSAVHEVTIQSFCVYFQMALHASDYTILLCSSXKXAVTLCVCXIXMGRHLCLXKYXXXCXHIPHLVFSVETCLFRLXLSRVAL

SEQ ID NO: 196609 - protein, 116 aa, Triticum aestivum
  unsure (1)..(116): unsure at all Xaa locations
  Clone ID: PAT_TA_91027.pep
RLSAFPPIDFTADRRVHCFPEVIAGLRIHGELTVDPARTPEVRSIRDFRRLLDDAYRPRINYLERMERKAARKQRRASGARRRQVALPSXTGGPAEKAELVIXQRTGSRVIXNXED

SEQ ID NO: 196610 - protein, 133 aa, Triticum aestivum
  unsure (1)..(133): unsure at all Xaa locations
  Clone ID: PAT_TA_91028.pep
IGTSMIISHWILWIFLLLNLGVCLLSLLALFQGRCCLRQDVVAFVSVPSHSGSPPAWRGGFLGESGGRLSSAAPXXXSGDPCTAPPLDFAGRQWAQWTGRPTVQHRAQRGRNGFAVADLYGRIGPWAAGPAAT

SEQ ID NO: 196611 - protein, 134 aa, Triticum aestivum
  unsure (1)..(134): unsure at all Xaa locations
  Clone ID: PAT_TA_91029.pep
ALSLSLSLSLSLSLSLSISXAXXDTSVAPFQGLKSXAGLPVXRRSNXXSLXSVXNGGRIRXMQVWPIEGIXKFXTLSXLXXLXXXALXKXVDYLXRSKWVXCLEFXXVGXIFXEXXHPWXXXGRYGHVELXMFG

SEQ ID NO: 196612 - protein, 73 aa, Triticum aestivum; identical to SEQ ID NO: 188591
  Clone ID: PAT_TA_91030.pep

SEQ ID NO: 196613 - protein, 61 aa, Triticum aestivum
  unsure (1)..(61): unsure at all Xaa locations
  Clone ID: PAT_TA_91031.pep
MXMXTQASAATRHLITAAWSPSXKPXPATXAMPSSXXXPDPLCVAVSDXPATXEXXAXPRP

SEQ ID NO: 196614 - protein, 140 aa, Triticum aestivum
  unsure (1)..(140): unsure at all Xaa locations
  Clone ID: PAT_TA_91032.pep
MAPTVMASSATSVAPFQGLKSTAGLPVSRRSNGASLGSVSNGGRIRCMQVWPIXEGIKNFETLSYLPPLSTXGLLKQXDYLIRXKWVPCLXFTGLGSSSXEHNXSPGYYXGRYWTXXKLPXFXCTDPTSVNXVXEVXKDT

SEQ ID NO: 196615 - protein, 80 aa, Triticum aestivum
  Clone ID: PAT_TA_91033.pep
CPILVQKKNFQPHKFKNKGKFDGKAKFDGKNKAVQHTNFKKKNDKKKGACHVCGDPDHWAPSCPNRYDKRHPGKGGKTAN

SEQ ID NO: 196616 - protein, 111 aa, Triticum aestivum
  unsure (1)..(111): unsure at all Xaa locations
  Clone ID: PAT_TA_91034.pep
LPPLSTEALLKQVDYLIRSKWVPCLEFSKVGFVFREHNSSPGYYDGRYWXTMWKLPMFGCTDATQVLNEVEXEVKKXYPDAYVRVXRFEHLRXVXCVXTPSNGCKDLRTTI

SEQ ID NO: 196617 - protein, 84 aa, Triticum aestivum
  unsure (1)..(84): unsure at all Xaa locations
  Clone ID: PAT_TA_91035.pep
KFXXXYKXKTSGTPTXNXGGTFNXFWKRIHXPSASPXFSGLPFLGFLITGPTHLGTNPKXSNGNAKRXTXXXTRXTKXXLPGCS

SEQ ID NO: 196618 - protein, 74 aa, Triticum aestivum
  Clone ID: PAT_TA_91036.pep
PPLGISVQLAFHIGIHDLLISSSVISYGNLVGASLTMFIVPALDFFAVVLLAAGAVVLFCRGGGSGVCWRGGDG

SEQ ID NO: 196619 - protein, 132 aa, Triticum aestivum
  unsure (1)..(132): unsure at all Xaa locations
  Clone ID: PAT_TA_91037.pep
FKAGSQIFSEGGLDYLGNPSLVHAQSILAIWACQVVLMGAVEGYRVAGGPLGEIVDPLYPGGSFDPLGLADDPRGXSAELKVKEIKERPLAMFSIXFFRAXIVTGKGLSETRRQLSDPXNKTLGFATIPAQL

SEQ ID NO: 196620 - protein, 92 aa, Triticum aestivum
  unsure (1)..(92): unsure at all Xaa locations
  Clone ID: PAT_TA_91038.pep
MAATTTMALSSPAIKLAGASYALGGGGRITMRKAAPKASASNXPWYGPDRVLYSGPSPASPDYSSGXFPGDYGWXTXGLSADPXTFAKNRKR

SEQ ID NO: 196621 - protein, 127 aa, Triticum aestivum
  unsure (1)..(127): unsure at all Xaa locations
  Clone ID: PAT_TA_91039.pep
MAPTVMASSATSVAPFQGLKSTAGLPVSRRSNGASLGSVSNGGRIRCMQVWPIRGHQEFETLSYLPPLSTEASSKQSTTDXSKWVPCLXFNKLXHFRXTQXSPGYYDXRYWTCXNCXYFGCTDAHKL

SEQ ID NO: 196622 - protein, 81 aa, Triticum aestivum
  unsure (1)..(81): unsure at all Xaa locations
  Clone ID: PAT_TA_91040.pep
CXLMLYPXXITPGXLTXENXGXTDRLRGGNTLXKXQVCHPCKXVPSRHGEFFYLVSFMVHQSRPTSHSPDAQGPLSPGLRH

SEQ ID NO: 196623 - protein, 107 aa, Triticum aestivum
  unsure (1)..(107): unsure at all Xaa locations
  Clone ID: PAT_TA_91041.pep
XPXSLVTLSLSXXSXXXTXVXAXNSIXPAXTVASRGLXGCPGAPSSFAASATXAGSSLAPRQRQDQALLPPVVAXVFIELLHSGLPRLHRLARENHYDGSQEPXRRN

SEQ ID NO: 196624 - protein, 205 aa, Triticum aestivum
  unsure (1)..(205): unsure at all Xaa locations
  Clone ID: PAT_TA_91042.pep
QPALPPQGKVSVLFYDDGAGSGLRPLPESMSDFLMGSGFERLLGQLAQIEAGGLTRARETPPASKAAVESMPTVAIAASHVAADCHCAVCKEPFELGAEAXEMPCAHIXHEDCILPWLQLRNSCPVCRHEMPTTRRGAVQGANAXEKKRQRGLTSGSSGKRVAVGGXRGXGQKTXPVFTKMXRXNXXPPRXSGSGNRHGRSIRXS

SEQ ID NO: 196625 - protein, 116 aa, Triticum aestivum
  Clone ID: PAT_TA_91043.pep
PTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNC

SEQ ID NO: 196626 - protein, 112 aa, Triticum aestivum
  unsure (1)..(112): unsure at all Xaa locations
  Clone ID: PAT_TA_91044.pep
NKKINNNFIIASRTYFLHERGLSGQXCPRARASPPATGRPEXRRMPPTRGTARSLAQHRGRCGRRRPTRQHGAAGEXARXPXAXSFDPGXASRXXVAGXXRSSRRRPNXQPW

SEQ ID NO: 196627 - protein, 127 aa, Triticum aestivum
  unsure (1)..(127): unsure at all Xaa locations
  Clone ID: PAT_TA_91045.pep
MSLYDPGLFLLIPRFPLHPFVXGVMYYYRXXFHNLSPNSFXNTSTFIVMCEXFLHISPHFGLWLKIFNVKPKGVSGEHAECGGAMVRKMPNVTWPSGTFNDSVKGWQQQWFYVTESRDPKWATAPEL

SEQ ID NO: 196628 - protein, 145 aa, Triticum aestivum
  unsure (1)..(145): unsure at all Xaa locations
  Clone ID: PAT_TA_91046.pep
SLRMCVDCSQLNDVTIKNKYLLPRIDDLFDQLSGAKVFSKIDLMTGYHQLKIKMEDIPKTAFTTRYGLYEYTVMSFGLTNAPAFFMHMMNKVFMDFLDKFVVVFINDILIYSKSXEEHKGYLKXILQRLRXHQLYAKFINSSKGQ

SEQ ID NO: 196629 - protein, 105 aa, Triticum aestivum
  unsure (1)..(105): unsure at all Xaa locations
  Clone ID: PAT_TA_91047.pep
RARRCCQRTTXAKAXNCSAPLRSXXGRXIDXLXXYKXDRIIXXCXNPCXGAXMXXXIGILDYXLLXSITVTYGFCPXDISXXLXXQVINXRCCCFTLLNPKXXLS

SEQ ID NO: 196630 - protein, 84 aa, Triticum aestivum
  unsure (1)..(84): unsure at all Xaa locations
  Clone ID: PAT_TA_91048.pep
HRKNKTTEISKQTQTATKSTSYTRSTGFYFXASLFLNHLVPHTFISKPDXQXGILXXKXFXXVXQDTSFXTXRXLTWXXQMHHK

SEQ ID NO: 196631 - protein, 132 aa, Triticum aestivum
  unsure (1)..(132): unsure at all Xaa locations
  Clone ID: PAT_TA_91049.pep
KEGIPPDQQRLIFAGKQLEDGRTLADYNIQKESTLHLVLRLRGGMQIFVKTLTGKTITLEVESSDTIDNVKAKXQXDKEGIPXDQQRLIFXXGKQSXDGRTLRWTTTSKKESTSTGAQVLSGINLRDPDDIT

SEQ ID NO: 196632 - protein, 132 aa, Triticum aestivum
  unsure (1)..(132): unsure at all Xaa locations
  Clone ID: PAT_TA_91050.pep
SSSGSIYMGVFLLSYNSRSFEDFVGSSCNLNSDGGLILLLCSSACYFLIYVNARMLNYINHHISSCISNSSYRMLNACMNTRYXGKISMIYSSMCNASKQIPHICTLKGSPXXLQSNPQYPYFTXMLTPLET

SEQ ID NO: 196633 - protein, 125 aa, Triticum aestivum
  unsure (1)..(125): unsure at all Xaa locations
  Clone ID: PAT_TA_91051.pep
RXLXXLXXXVRALALHLLXGXHVRPXXEEXGVXGGNXEPSXTPVSSTXGPXYXHAAPVSAPASGGRMDXXDXRGHXPQRYVXXEARAAGAEASSRIRTATAAGKRVRSSCGKAAIIAVGCCRWKM

SEQ ID NO: 196634 - protein, 215 aa, Triticum aestivum
  unsure (1)..(215): unsure at all Xaa locations
  Clone ID: PAT_TA_91052.pep
XGXIXXVGLLKXTKXXTLXQXPFFEXXRGIXXFEXYXKXNXMGNLXVCKAXFKXXEXXLLCGWSXXPWNXSFXQFKTPXEMXTIXXSLSRPNVIXGCDXKKAIVIKSVTIPWXEPTLSTRIVIHPXXASMSNCEYXAVKHLRREEFAXWLRXDKDTFALLHHSXDIEXCFKSENCNFKXDIIKKSKNDTWAPWYWERANFPSIYWELGRFIGDHQ

SEQ ID NO: 196635 - protein, 71 aa, Triticum aestivum
  Clone ID: PAT_TA_91053.pep
TFFFLDYDLWEVARVRAMIWLWRRHLTILHSRITSLPIFRYGALQQNSSLFLYHLCYNLLLILLHFFGNFK

SEQ ID NO: 196636 - protein, 166 aa, Triticum aestivum
  unsure (1)..(166): unsure at all Xaa locations
  Clone ID: PAT_TA_91054.pep
NXENLLWDCSXXFRNQRFCSVVTXLRXSXRGSSXEILNSKXXKWLPVISGKAFXSWYKQSLKVLLLGNXLLSLHPQLFYNWRSXRXLAGDPAVSLFDDEAYPPSSHWPTLTPVIFGSYLVFRVCLDLVPLAQPAPKQCFTPRCPVNCCASTHFGENQLALGSSGIS

SEQ ID NO: 196637 - protein, 75 aa, Triticum aestivum; identical to SEQ ID NO: 106874
  Clone ID: PAT_TA_91055.pep

SEQ ID NO: 196638 - protein, 143 aa, Triticum aestivum
  unsure (1)..(143): unsure at all Xaa locations
  Clone ID: PAT_TA_91056.pep
SDRVLYLGPLSGDPPSYLTGEFPGDYGWDTAGLSADPETFAKNRELEVIHCRWAMLGALGCVFPELLARNGVXFGEAXWFKGRSQISSEGRLDYSGXPSSQRAXILAIWAASXVMAPVRFPAARQFNRLPGGTSPWAPPKDPK

SEQ ID NO: 196639 - protein, 74 aa, Triticum aestivum
  unsure (1)..(74): unsure at all Xaa locations
  Clone ID: PAT_TA_91057.pep
PPLGDLNLVVTXIDCYQFLACSLIFPGCXEEQEVEAGRYLRSGCYLTSGLLLFIHERVLFLLCHSAGAKKHPSV

SEQ ID NO: 196640 - protein, 133 aa, Triticum aestivum
  unsure (1)..(133): unsure at all Xaa locations
  Clone ID: PAT_TA_91058.pep
SQRKLVLPNTFLDILHNPSVKLPTEEDFVVPXPEAQLLPALHVVPDWTVPYLAYMNQGELPDDEVLARXIVRRPKSMVIHNGELHHCSISGVFQRCVSPEEGQEILQEIHEGDCGHHAGSKCLVAKAFCHGFY

SEQ ID NO: 196641 - protein, 168 aa, Triticum aestivum
  unsure (1)..(168): unsure at all Xaa locations
  Clone ID: PAT_TA_91059.pep
MAAAFSSTVGAPASTPTNFLGKKLKKQVTSAVNYHGKSSKANRFTVMAAENIDEKRNTDKWKGLAYDISDDQQDIPRGXGIVXDSLFKAPTGDGTTSRPNSYEYVSQGTQEXRFXNTWELNRSCFKDNCFIQELMTCQHQIHHLGTGEEGEIFNVTVSQAPSYMRKLE

SEQ ID NO: 196642 - protein, 54 aa, Triticum aestivum
  unsure (1)..(54): unsure at all Xaa locations
  Clone ID: PAT_TA_91060.pep
MADVEYRCFVXGLAWAXDDQSLQNAFSKYXXVIDSKIITDRXTGRSLXFXXVTF

SEQ ID NO: 196643 - protein, 180 aa, Triticum aestivum
  unsure (1)..(180): unsure at all Xaa locations
  Clone ID: PAT_TA_91061.pep
SRFHFDGXRSLXGPYLALXALGTKSADXITPCXXGFSVARRRCEDSAVPLVQRARRRERRRRVDDLVRCTRSRSSRGTRSISSNRAVLRSTSACWGASALAGGGDACSRYASSAERLSRSTAFFHMSRYDGPPPRPPSPETARTTTTRCPARCRAWGRRRRPRKRWRWGAAGMMGAELVA

SEQ ID NO: 196644 - protein, 91 aa, Triticum aestivum
  unsure (1)..(91): unsure at all Xaa locations
  Clone ID: PAT_TA_91062.pep
XIFGLSXLIAWQIVGPIEXXFXCXVSTQRTQTVGTDXFDAGGSRADEELLFTRGPEHVVLNVERRQGGNAATYERMQILKHGGNEVPMQCK

SEQ ID NO: 196645 - protein, 96 aa, Triticum aestivum
  unsure (1)..(96): unsure at all Xaa locations
  Clone ID: PAT_TA_91063.pep
NWXXXPQXIYRLGXFPGRRGRYLAGXDKHNHVRAKNRGRIHPELRRDLARYRGAARPLCLTDEVMEHEFPEEFKPVNIESYDGTTDPAVWIEDFLL

SEQ ID NO: 196646 - protein, 99 aa, Triticum aestivum
  unsure (1)..(99): unsure at all Xaa locations
  Clone ID: PAT_TA_91064.pep
NQLKHKKKTSTNTLKFTRKSRQGRKISSLVCCYRFSYRTQCKMNQFIWDLWVKIMXIPILWEXXMNFNXXXKGXXXQGLXHXGAHXXTFLGRQXGLKXP

SEQ ID NO: 196647 - protein, 64 aa, Triticum aestivum
  Clone ID: PAT_TA_91065.pep
GTNDNDHETSEQDTTEARRSTRLRSAPEWYGNPVLEVMLLDHDEPTNHEEAMVSPDSAKWLEAM

SEQ ID NO: 196648 - protein, 119 aa, Triticum aestivum
  unsure (1)..(119): unsure at all Xaa locations
  Clone ID: PAT_TA_91066.pep
XXKNGXXXRSRSXLSAPEXXXRFXLXVDCXGSRSPYDLSWPGXHISVPWHHWPXXYGXGXGWPRXIPTXFXGEXXSRRSQESXXNXPXXSTPRXPVXKEVSLKGRSXVEWALXXYGXRA

SEQ ID NO: 196649 - protein, 80 aa, Triticum aestivum
  Clone ID: PAT_TA_91067.pep
KDTRTSLHIIISQNLIAQQLERNKSLEQSSMHGGRRSLPAPSIPMPPPIPTTSHHHAPLFLALSLIFHFSMTFSRYHFLI

SEQ ID NO: 196650 - protein, 59 aa, Triticum aestivum
  unsure (1)..(59): unsure at all Xaa locations
  Clone ID: PAT_TA_91068.pep
SPSYVVTFGYTQSTPTVSGSTRSHGSKEEILDIGXSPSKTNYTSVLCLRIGALSITSSS

SEQ ID NO: 196651 - protein, 108 aa, Triticum aestivum
  unsure (1)..(108): unsure at all Xaa locations
  Clone ID: PAT_TA_91069.pep
MGHGLSCSRDGDXHDFFRAAQAGDVDALDALLAADPALARRATIYDRLTALHVAAANGCLPAVDILLARAXRPEVVEXPETHPXMSXHQXHIDAPCLLXXXANIYVHR

SEQ ID NO: 196652 - protein, 75 aa, Triticum aestivum
  unsure (1)..(75): unsure at all Xaa locations
  Clone ID: PAT_TA_91070.pep
MAAATMALSSPAMAGTPVKASXAAPFGEGRITMRKTAGKPKVAASXXRXYGPERVLYXGPXSXEPPSIXTGVSPG

SEQ ID NO: 196653 - protein, 70 aa, Triticum aestivum
  unsure (1)..(70): unsure at all Xaa locations
  Clone ID: PAT_TA_91071.pep
AAFALPGFKSVVICLNTDNARSSASSALGHPLLSWGAFVGNTRRGWACLGIHHDPFGSDIVGLFXSQGGG

SEQ ID NO: 196654 - protein, 88 aa, Triticum aestivum
  Clone ID: PAT_TA_91072.pep
PNLLLHLRPPPRPDRRGGAPPIHQPHKIPPSPSIRHRATAPPPTAPPSPPSRRRSHPSSALPPAQPSTIPFTLYPSSFFSMPICGFHR

SEQ ID NO: 196655 - protein, 133 aa, Triticum aestivum
  unsure (1)..(133): unsure at all Xaa locations
  Clone ID: PAT_TA_91073.pep
CVFPELLARNGVKFGEAVWFKAGSQIFSEGGLDYLGNPSLVHXQSILAIWACQVVLMGAVEGYRVAXGXLGEIXDPLYPGGSFDPWASPMTRAFXGLKVKEIXNGXSPFLHVRFXLQXIVTGKGPSKTQQLAR

SEQ ID NO: 196656 - protein, 157 aa, Triticum aestivum
  unsure (1)..(157): unsure at all Xaa locations
  Clone ID: PAT_TA_91074.pep
MAALSSAAVSVPSFAAGAKVAAPRSSRMVVRASLGKKAASAAVAMAASAMLLGGSAMAQDVLLGANGGVLXVFRAQRLSVXAGETITFKXNNAGYPHTWVFDEDXVPPGVNSPXXPKKXYSXPPGXTSPXXQLPGTVLMQPNPEPDVGHRTTSTLQR

SEQ ID NO: 196657 - protein, 65 aa, Triticum aestivum
  unsure (1)..(65): unsure at all Xaa locations
  Clone ID: PAT_TA_91075.pep
GXXXXTXKFRLDXREXVXXXXPVHAFPXSXXPXSREAEHPRRSPRPRRSESPARSLARSRGRGRG

SEQ ID NO: 196658 - protein, 176 aa, Triticum aestivum
  unsure (1)..(176): unsure at all Xaa locations
  Clone ID: PAT_TA_91076.pep
GXWFXPGXQLXWFPEPXRGPLAGVIXXXWNGXPXFXLGPXXFXAGXXPFYXKXFKALGRANLXGQGXRIPXEGLSQAGXXGRRFKGGLTFLRSCDLTMXXDTQAGASARSXLVSSLVLRRQAQARSTGGIKQRFPYQCNETEDQQDGKTEVTVEPKTASPPEPFAGEDHFCQDSLD

SEQ ID NO: 196659 - protein, 108 aa, Triticum aestivum
  unsure (1)..(108): unsure at all Xaa locations
  Clone ID: PAT_TA_91077.pep
PRQAAVWNILGLVLLRGGQLQSGISVFSTLTTVAPDYLDSLANLGVAYIQSGDLELSTKCFQELVLKDQSHPXAALVNYGALLLCXXRAFGARAIXXVHXRFXLHQXX

SEQ ID NO: 196660 - protein, 50 aa, Triticum aestivum
  Clone ID: PAT_TA_91078.pep
SVISSAVLAFLILCFRHGGERPARLPERPSGEEAGPLGLQPLVVAVEVPG

SEQ ID NO: 196661 - protein, 75 aa, Triticum aestivum
  unsure (1)..(75): unsure at all Xaa locations
  Clone ID: PAT_TA_91079.pep
LSFAGCTLSINGIMFLGPTTLVSVDTFWATTYPEAMRYEDIISFKGKHGRCSNLVKEGNFEKNTQCLTIIWLDXL

SEQ ID NO: 196662 - protein, 71 aa, Triticum aestivum
  unsure (1)..(71): unsure at all Xaa locations
  Clone ID: PAT_TA_91080.pep
ALVRSCVRACHLSSHPWRWHLCREQXGRXHHIKSVTLLFXAXPLCLTXXSXFLIXTXSXTXFXPXXXRVIY

SEQ ID NO: 196663 - protein, 88 aa, Triticum aestivum
  unsure (1)..(88): unsure at all Xaa locations
  Clone ID: PAT_TA_91081.pep
DIKPGNILLNEYFNAKLGDFGLSMIASKNRATVVTTAVGSVGYMDPHLMKDGAVEFKXRKSDVYSFGIVLLKIARTQNQGNLADARWQ

SEQ ID NO: 196664 - protein, 64 aa, Triticum aestivum
  unsure (1)..(64): unsure at all Xaa locations
  Clone ID: PAT_TA_91082.pep
WRWXHWSGGSRDRPTLHTAVHDISTRRGEKKRSIYMDRSTKKKAPRLEKLNLMIHQWYTSLATN

SEQ ID NO: 196665 - protein, 64 aa, Triticum aestivum
  unsure (1)..(64): unsure at all Xaa locations
  Clone ID: PAT_TA_91083.pep
LVRXEXRTMXACXXCXCDHXXCVMXAXXISRNVXQLRPRTRIXSWWRPPCRVRACXCNXSLLWR

SEQ ID NO: 196666 - protein, 98 aa, Triticum aestivum
  unsure (1)..(98): unsure at all Xaa locations
  Clone ID: PAT_TA_91084.pep
WHLELASPSSTTLYVLPKTRFXGLGCSHFARRYYGNRFCFLFLXGYLRCFSSPGCLLPAHGFSRQFKRLTYLGISGSMLIFNSPKHFVACYALPRLWV

SEQ ID NO: 196667 - protein, 63 aa, Triticum aestivum
  unsure (1)..(63): unsure at all Xaa locations
  Clone ID: PAT_TA_91085.pep
NLXGRXGVQSACNXYVRYVDLGSVSHXTLSYSSFKSKXHFRLSSWMYSHLVGCFAPXFGIKFS

SEQ ID NO: 196668 - protein, 176 aa, Triticum aestivum
  unsure (1)..(176): unsure at all Xaa locations
  Clone ID: PAT_TA_91086.pep
SMVPTGSSELSSXIPXGLXXSHIECQWRFXANDGIGVQXVMCSRGAHFXETGYTGYIRSGVGEVCRMSEXGXPQDALLRQIFSRSRWYGRKRTLERERKNRPPMLQVTSGGQRGVAEFVASFVVRLVLTECNLFEFHMIKSQKSPISKSLRLYNSGVHHIVLGQDFILFYKIQTLS

SEQ ID NO: 196669 - protein, 69 aa, Triticum aestivum
  unsure (1)..(69): unsure at all Xaa locations
  Clone ID: PAT_TA_91087.pep
SXFFFFLNKXMLGCLGXPTXFXFXTDEMSXXKXTMRIIIIXXIKSHFHVHVTLXXDRECXSFXHXLHMH

SEQ ID NO: 196670 - protein, 107 aa, Triticum aestivum
  unsure (1)..(107): unsure at all Xaa locations
  Clone ID: PAT_TA_91088.pep
MSCCGGSCGCGSACKCGNGCGGCNMYPEAEAAGATLLXVSATATHKASXGGMEMAAENGGCGCTQCNCGPSAVSCCSAKSIIDMHHLPRACIISMIDLHLLQLPWPR

SEQ ID NO: 196671 - protein, 125 aa, Triticum aestivum
  unsure (1)..(125): unsure at all Xaa locations
  Clone ID: PAT_TA_91089.pep
GRGPGHVHYICGLAMTLCGRLAAARYPLIPSPRRASGRVRPPRREPRRPGXSWSIMSSNEGEGEGKAGVNGEHXLEXGEGEGXLXAVMEQLAXEGVTGAARXGLRRSGTPYCXTRGXRRXAXRCC

SEQ ID NO: 196672 - protein, 109 aa, Triticum aestivum
  unsure (1)..(109): unsure at all Xaa locations
  Clone ID: PAT_TA_91090.pep
LCLTKLFYFTKVDNALPTRQGMAGRNALQLTKTNWGISHVHHHHASSLTEEPSAPNSAAAHCPIPXCRGXSWPLSVHLLELAGERPWAGIXWPPGDPEISPRGXPGQAR

SEQ ID NO: 196673 - protein, 117 aa, Triticum aestivum
  unsure (1)..(117): unsure at all Xaa locations
  Clone ID: PAT_TA_91091.pep
AHVLSIDMSPTYLYFLLFXAIYYPFWCLMGLSTHLYILGQLLTGGHHMLFLGYSIFKENFQTDQTDEPXEXIWTIVRKPXESXIPSHNIEGPXGFTFXARNTXFSKXRPKXXTXNSR

SEQ ID NO: 196674 - protein, 123 aa, Triticum aestivum
  unsure (1)..(123): unsure at all Xaa locations
  Clone ID: PAT_TA_91092.pep
LXGXGXDTXXVQALCWXWSRCWIVGCPYPSSVKSCXXLGVHXFXXKAILKSIXLQLILIIISAFLXXKDVXVXEDLIQPSLLIKIVLVETPQFDDNFIVLASFEVPFLMVLDEANVLGIVVEA

SEQ ID NO: 196675 - protein, 150 aa, Triticum aestivum
  unsure (1)..(150): unsure at all Xaa locations
  Clone ID: PAT_TA_91093.pep
FGRMISMIWSRGDSFPTNLRASRGKKSNPSLLMVSASSSPPISIVDSLCLLILFSGALELLXXRNSTLYSQSNVXLLLSFPWCXNSXGXRPIXDLXQSXLXLXSVNXAIDFKRPRXQHQGPGXVWEKXFLYXSLSPXVXSIGLWLTXAQE

SEQ ID NO: 196676 - protein, 109 aa, Triticum aestivum
  unsure (1)..(109): unsure at all Xaa locations
  Clone ID: PAT_TA_91094.pep
AKDSAVAAAREPEPGWKAPAEIASPPPPLETAALTPHRKTLQQAVSSVPPCMKXXSLQYFLSMHVQXMMXXIXLMNXTPRXCXHTSWVMRYLLCWXTETINXRQXFEQP

SEQ ID NO: 196677 - protein, 131 aa, Triticum aestivum
  unsure (1)..(131): unsure at all Xaa locations
  Clone ID: PAT_TA_91095.pep
CFLXXWRWXXXTRYHHXXWCXXEEXXTFNVCXGNSHXNXSVTHXXSSSLRXLXRXTGXXRKVHLEXLXLKDLTXQXXXAFPXIXKTYNWRXXXRSFXXKFPLQXXRXVFPFWIKXLXHTXXGLFFXGGDFX

SEQ ID NO: 196678 - protein, 172 aa, Triticum aestivum
  unsure (1)..(172): unsure at all Xaa locations
  Clone ID: PAT_TA_91096.pep
LPHLSRHLHPHSTILTCPTETPTPSPIPPMKPRPTRGHQGGSALTVAFYLLFDLTGLPVLDTEQPWRVSIDGIVASHFIHGVYPPCHCFLNGDSTPALSCSCSGLARVVVYPGCXQAAXMVLLXXXLRLSALCIKLLSVLLSSXCXXSGLARDAAAXNSDSTGLLLXIAHKR

SEQ ID NO: 196679 - protein, 56 aa, Triticum aestivum
  unsure (1)..(56): unsure at all Xaa locations
  Clone ID: PAT_TA_91097.pep
VYFXYPLPVSPVSFFRTQSSILAXTSHTPRYVYLYKRLNYPYVVPPKAMIIGRKKR

SEQ ID NO: 196680 - protein, 118 aa, Triticum aestivum
  unsure (1)..(118): unsure at all Xaa locations
  Clone ID: PAT_TA_91098.pep
WVPPKRLYTNCRIFFLIRSHGAAGARSGADTARLHPLQHRRPLHPRRHSLGGDVHISXSCCCFSSRSRCCSAPCSPSPAWFALAMLXLALLSRSCSCLRSAXDLTTXNXLNHFWVNPF

SEQ ID NO: 196681 - protein, 113 aa, Triticum aestivum
  unsure (1)..(113): unsure at all Xaa locations
  Clone ID: PAT_TA_91099.pep
LIFAGKQLEDGRTLADYNIQKESTLHLVLRLRGGMQIFVKTLTGKTITLEVESSDTIDNVKAKMQXKEGIPPXDQXRLIFXWXEVXDGRTXTRXHIQKDSTLQLWWPNSLCST

SEQ ID NO: 196682 - protein, 100 aa, Triticum aestivum
  unsure (1)..(100): unsure at all Xaa locations
  Clone ID: PAT_TA_91100.pep
HHRXEXGGHCPGWXGRXPPXRWXXXAAGXAAPAASLRPFYPXASPRRTGXQQRXPPDSLXGALPREXEXXSPERAEHRRACALXXXFLXGSSGRRARQXS

SEQ ID NO: 196683 - protein, 153 aa, Triticum aestivum
  unsure (1)..(153): unsure at all Xaa locations
  Clone ID: PAT_TA_91101.pep
PTFSGHSGGTSSISPATTAPWSRPRRPTRWRGTRRRGRXRRRRSWAAVRRRRSPAGGRAGRCGPSCPSSSPXASLYXXAAXPRLXRRXLLSPRXCSKXPXGSLAXCGATIRXRGQXAXGPARPVXLXLRSQXIPARVAXLXRRXXTFLXVAXR

SEQ ID NO: 196684 - protein, 139 aa, Triticum aestivum
  unsure (1)..(139): unsure at all Xaa locations
  Clone ID: PAT_TA_91102.pep
RPPGHLTRFSASLAVALCXXQECRTGLLENRVLKVKRKRKKRKKRNDTNGSPYCGLAAFCACRGHGPSTMPMVLQSAIRSRNTGLXXXTKAGXXGRIXTLXQKLASRPAVSYXGRXTMSDWLIGRLEDSLKXCSEFXQX

SEQ ID NO: 196685 - protein, 125 aa, Triticum aestivum
  unsure (1)..(125): unsure at all Xaa locations
  Clone ID: PAT_TA_91103.pep
NLGDFNXLRSPXDKNTSNFRQSGSKHVQIPLLTQRALIELPLLDRCYTWSSKRDQPTLEKIDRVFINVDWDSTTISSLTRFVSDHVPLLISIDTVIPRPALFRFELRWTTRPACLTVVQNAWAAA

SEQ ID NO: 196686 - protein, 65 aa, Triticum aestivum
  unsure (1)..(65): unsure at all Xaa locations
  Clone ID: PAT_TA_91104.pep
IGQXRDPXNPSAAIGPTRSPRRTQGVRATWSVRLLSRNAQESPLTCKQLVERRCKGRSSVLSRQG

SEQ ID NO: 196687 - protein, 119 aa, Triticum aestivum
  unsure (1)..(119): unsure at all Xaa locations
  Clone ID: PAT_TA_91105.pep
MAGVVEELVKKAGGCAVIDXGFATXLEALGADINDPLWSAACLITKPHLIKEVHMQYLEXXADVIISSXXQATIPGFLAKGLXLXEADYCNQVHLRNATLESFRTQTKHPCGQSEYGLT

SEQ ID NO: 196688 - protein, 121 aa, Triticum aestivum
  unsure (1)..(121): unsure at all Xaa locations
  Clone ID: PAT_TA_91106.pep
PRDANRGVTYLAGXSLELPFLMVHHNPNVWGEEFPEFKPQXFAEGISKATQXPGGFFPFGWGPXRICIGNNFXAMLEAKMAVSMILQRFGVPXLSPSYAHAPCTVITLHPQHGAQIILKSL

SEQ ID NO: 196689 - protein, 103 aa, Triticum aestivum
  unsure (1)..(103): unsure at all Xaa locations
  Clone ID: PAT_TA_91107.pep
MSCCGGNCGCGTACKCGNGCGGCNMYRRPKAAGATLLVSATATHKASXGGMEMAAENGGCGCTQCKCGTXSCXCSCCTARSLIIDACTAPTSISYYYIQCYRY

SEQ ID NO: 196690 - protein, 208 aa, Triticum aestivum
  unsure (1)..(208): unsure at all Xaa locations
  Clone ID: PAT_TA_91108.pep
XEGVSXXLPRXDDFADSXGSSVNXHLTARXFQQGQXRXSXXCFNXEQWSQSVLRFNVERAFNMDMMHALAPQLEGARETKGFGGSGRSEAGMGANRXPETPHICLLICRRKVCSAAPWPDTGRIKWIPWYKRMRRGLRMDVGHARRNILFSFPPTWSMLIEFRTFVYLEESHIFKSSVKLPLLVKKKMSNCPIMFISQSTKYRRVLHL

SEQ ID NO: 196691 - protein, 152 aa, Triticum aestivum
  unsure (1)..(152): unsure at all Xaa locations
  Clone ID: PAT_TA_91109.pep
AKALASCSSLVLPGDERSPPSSPSRRAPPSFGGGGSPGTIAAIVTALGGXPAAVGIVRLSGADAVAVRXRRVFRPARREPGALGGPKPLPWDYGVPLEXDGGVIDEVLXVPMLVPRSYTXXDFXGLQCHGNDXCLRPVXKXCXEAGASSPTW

SEQ ID NO: 196692 - protein, 130 aa, Triticum aestivum
  unsure (1)..(130): unsure at all Xaa locations
  Clone ID: PAT_TA_91110.pep
YVVKLWTQNMQNNXKILPRPAPLFRLLLLNHRLSSPFPNPNAAPLLSXSISKTTPLLSCSNPKQAXSSPXQSKTXRPLLSNQKHAXNEXAWRIIMGXQRHEXTDGTXXXDWXNLXAQAIXTXTGNXKTKX

SEQ ID NO: 196693 - protein, 65 aa, Triticum aestivum
  unsure (1)..(65): unsure at all Xaa locations
  Clone ID: PAT_TA_91111.pep
RRELTXNQTLXXXRYNIGRLCRAGSTYXLLSLTWXSYHXIYSCICVYIYIYICVCDLXVISIYXW

SEQ ID NO: 196694 - protein, 98 aa, Triticum aestivum
  unsure (1)..(98): unsure at all Xaa locations
  Clone ID: PAT_TA_91112.pep
TLSKIGGLLGVQAANFKGESVGSPAVXFSLTQPLDWSTLKHVILTQPICASLLRFLPRPASTLAIVFPPGKLRQRGHEGLQRCDLPCNNASLARRRAT

SEQ ID NO: 196695 - protein, 94 aa, Triticum aestivum
  unsure (1)..(94): unsure at all Xaa locations
  Clone ID: PAT_TA_91113.pep
VYISSRTSSSKISSFVIPHPCLPCQCKLPTILGNFIQVQHNEARIGVCSGVLFNGHAAHXDNEHTGIATQASKXRCCGLRSPLHPQVRRIPGKR

SEQ ID NO: 196696 - protein, 104 aa, Triticum aestivum
  unsure (1)..(104): unsure at all Xaa locations
  Clone ID: PAT_TA_91114.pep
DYHLLLRQPSHYRHSFRQIMLPAGLQNRAHPSSQPKEHNSALLLSFPQHAIKLFRTLITHSNNINRLXVTVGVPTSGMNGSTPHLPGNGPVSGVSIPPRLFPNT

SEQ ID NO: 196697 - protein, 70 aa, Triticum aestivum
  Clone ID: PAT_TA_91115.pep
GVARLRPPASRPRPRTLRQAMATLACAEASPSLARRSSVAPGRAPRPPALRRARGPSTRPPPWSGLPLVA

SEQ ID NO: 196698 - protein, 100 aa, Triticum aestivum
  unsure (1)..(100): unsure at all Xaa locations
  Clone ID: PAT_TA_91116.pep
PPGQMDAEGTHPPEEWGRNTTSQGAKDXXTPFFXKPXAFPXQISGFLNFLMCPPNDXGTSLSSRSRTXRXSLGGNXDLRXPXGPVXQFPLXDLXPPNGVV

SEQ ID NO: 196699 - protein, 77 aa, Triticum aestivum
  Clone ID: PAT_TA_91117.pep
LPCCLLHRAAADDRQLLIRIKRVWRDPPVLAAWNGSGDHCTWPYVTCDASGRVTSLSLGNTGVAGPFPNAIGGSPAH

SEQ ID NO: 196700 - protein, 136 aa, Triticum aestivum
  unsure (1)..(136): unsure at all Xaa locations
  Clone ID: PAT_TA_91118.pep
HNCHCNVSQESLSLPLGLCGLLHKRPKVLLEVVTQXFASLLLVPSMERSVGASYRPKPVTHQETPLLHLQAYLSQTPTQSXGAGKLGQHTVIRRTGNASFAEGSTCHSNVSEVRMCKSAIVPCGNDEHLFAYGDES

SEQ ID NO: 196701 - protein, 102 aa, Triticum aestivum
  unsure (1)..(102): unsure at all Xaa locations
  Clone ID: PAT_TA_91119.pep
MAASMITSPIVAPTSVPSLSRRGSSFAVVCSGGKKIXVDKPXGLGGGLTVXDIDANGRKVRKKACTILFDKXRCQRPTVQXIYTPREWPDPGDRYPGGTTGS

SEQ ID NO: 196702 - protein, 88 aa, Triticum aestivum
  unsure (1)..(88): unsure at all Xaa locations
  Clone ID: PAT_TA_91120.pep
XEXMPYXLTAXASGFXRAXXHKXVISXKTHPRRGGRHXGLTGKLXRHPRTGLTHAXKXKSPTEAEKYVRRDXDCXXXCPXQXRXDGSA

SEQ ID NO: 196703 - protein, 138 aa, Triticum aestivum
  unsure (1)..(138): unsure at all Xaa locations
  Clone ID: PAT_TA_91121.pep
SAXVCXLVMNRTXRXAKNRMTGXDLTIXLLCXRSVGVXPRIXPRPEEXIEPNIGFAQTVCRVGSSTVVTPCRCSRVVMDDAVDVVVVTRSLPSSEVASCRQVCQRTLDVHLVDGGGGSVLMMMVMKTTLMKTLAMKCR

SEQ ID NO: 196704 - protein, 72 aa, Triticum aestivum
  unsure (1)..(72): unsure at all Xaa locations
  Clone ID: PAT_TA_91122.pep
MMINLMSGSFGGMVLKXSPIPITKKPDLNDPVLXRAKXLKGWGHNYYGEPAXANDLLIIFQVXIXGTNACYV

SEQ ID NO: 196705 - protein, 154 aa, Triticum aestivum
  unsure (1)..(154): unsure at all Xaa locations
  Clone ID: PAT_TA_91123.pep
ATETETFAFQAEINQLLSLIINTFYSNKEIFLRELISNSSDALDKIRFEXSLTDKSKLDAQPEXFIHIIPDKATNTLTIXXDSGIXMTXXDLLKQLGTSXSPGQGFMEASXPGRLSLGWSTRYSPGLFPTSKHTHIGKGLTYPELGERRVKRPY

SEQ ID NO: 196706 - protein, 100 aa, Triticum aestivum
  Clone ID: PAT_TA_91124.pep
PHRLRGPRGDVQFRGTVFNSCFAECADYPRISKGPRKVPNYTTDLQPEAWVESYDTAMEMLDVDEAVCAKYFTMMLEGTARTWLKSLPTNSIGSWAELKH

SEQ ID NO: 196707 - protein, 66 aa, Triticum aestivum
  Clone ID: PAT_TA_91125.pep
QHNACIALPQPRFHGLGCSHFARRYYGNRFCFLFLWLLRCFSSPGCLLPAHGFSRQFKRLTYLGIS

SEQ ID NO: 196708 - protein, 151 aa, Triticum aestivum
  unsure (1)..(151): unsure at all Xaa locations
  Clone ID: PAT_TA_91126.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWTMWKLPMFGCTDXTQVXNKWRSQEGLPDPYVASDQHRK

SEQ ID NO: 196709 - protein, 132 aa, Triticum aestivum
  unsure (1)..(132): unsure at all Xaa locations
  Clone ID: PAT_TA_91127.pep
MAAATMALSSPAMAGTPVKASRAAPFGEGRITMRKTAGKPKVAASSSPWYGSDRVLYLGPLSGDPPSYLTGEFPGDYGWDTAGLSADPEXFAKNRELEVXHCRWAXLGALGCSFRSVANGSSSQAFVKAVQF

SEQ ID NO: 196710 - protein, 189 aa, Triticum aestivum
  unsure (1)..(189): unsure at all Xaa locations
  Clone ID: PAT_TA_91128.pep
SIGDAAKLQSIDVSSNELYGEIPASIGKLVHLESLDIAGNGISGAIPASLGSCSALSTMNLAGNKLTGAIPSELRGTSLNLLDISSNELSGAVPAILAELKLSYLNLSDNRLDGPVPAGLAISATXELQGEPGLCATTEPVLRRCTPGAFEHRARCSRMASCSPLGLFNKKGPAGMRKLCKVTNLQYGH

SEQ ID NO: 196711 - protein, 79 aa, Triticum aestivum
  unsure (1)..(79): unsure at all Xaa locations
  Clone ID: PAT_TA_91129.pep
XXPLSLASXQTRSXTIFRXSPPVPVATGMXSAVSVSLAXSSSXLAXIXRAXAGARXPIXRXXSSVARXPKPMPXLXTLV

SEQ ID NO: 196712 - protein, 85 aa, Triticum aestivum
  unsure (1)..(85): unsure at all Xaa locations
  Clone ID: PAT_TA_91130.pep
YALPTPVRTCQQPVTLPPGSYRRRRFPPHPVSPVSALTLQLFPPSSGRLRFSSAEXGAAXIFPFFFSVCPPNCSALSFSPSFLPI

SEQ ID NO: 196713 - protein, 162 aa, Triticum aestivum
  unsure (1)..(162): unsure at all Xaa locations
  Clone ID: PAT_TA_91131.pep
MAPTVMASSATSVAPFQGLKSTAGLPVSRRSNGASLGSVSNGGRIRCMQVWPIEGIKKFETLSYLPPLXTEALLKQVDYLIRSKWVPCLEFSKXGFIFREHNAXPGYYDGGTGTMWKLPMFGCTDATQVINKWEKXRRIPDRTSARQVHASVHRLNRLKIRG

SEQ ID NO: 196714 - protein, 106 aa, Triticum aestivum
  unsure (1)..(106): unsure at all Xaa locations
  Clone ID: PAT_TA_91132.pep
SALQAPAKELALALSLPCAGPRARSLDRSGKRIPSLDPSLARMLARSQFFMSQKXRSIPRFLLKNTSFLFLRXKNXLQMLRKILHLKNSNLQKGNDFGKRQCMTSQ

SEQ ID NO: 196715 - protein, 89 aa, Triticum aestivum
  unsure (1)..(89): unsure at all Xaa locations
  Clone ID: PAT_TA_91133.pep
MKGTKLAAILILQAVLVMGVLSHVNADYFPKCCNNCRSFSGVDVCDDAHPKCPKGCSACRVVSTSPEMWRCADMKSTVDXTCGGPCKKY

SEQ ID NO: 196716 - protein, 53 aa, Triticum aestivum
  unsure (1)..(53): unsure at all Xaa locations
  Clone ID: PAT_TA_91134.pep
YLICGSCAHNDIKFIFCGGGLITVACHWGPXVSPSALHYCLGXRTPINKKKXK

SEQ ID NO: 196717 - protein, 89 aa, Triticum aestivum
  Clone ID: PAT_TA_91135.pep
MYIKFYKKQRQRKQSEDEHVANANTVARRRPKRPATTSAVVRLVHKLASTSLEHRLWRCRCYWNLGRHARADHPEQPEHEPETVRPLGR

SEQ ID NO: 196718 - protein, 82 aa, Triticum aestivum
  unsure (1)..(82): unsure at all Xaa locations
  Clone ID: PAT_TA_91136.pep
KMXXPHFKILTXXXKCYXNXFEIVGNXXKKCWTVXEXYXSSVXKMLNXXLKNXXQGFWKTLXKXXNFFXKYLESVEQVFEKC

SEQ ID NO: 196719 - protein, 147 aa, Triticum aestivum
  unsure (1)..(147): unsure at all Xaa locations
  Clone ID: PAT_TA_91137.pep
VFKSRFXXCXAVLLFQHXAXTVVAXXVARSSKKTGRFQHHXRHXSRXPPRLQXQXXAVAAPRATGCSFGHXXCSXRXRXXQFPPPPWLYLPRFTSPXFHXVTLQQRPAPPVQQRRAATMHPSLPCHGAHGRAAWAGSRERDGCRPWL

SEQ ID NO: 196720 - protein, 95 aa, Triticum aestivum
  Clone ID: PAT_TA_91138.pep
KRGNYLDGWIVQRSHGKSINNTCYWSEIGHDDFVIYVPDCVVEIDYNRQKIIIPENDIIELWADDLENWAGLKPSPNNCGSPGERAWGGDIYKLK

SEQ ID NO: 196721 - protein, 114 aa, Triticum aestivum
  unsure (1)..(114): unsure at all Xaa locations
  Clone ID: PAT_TA_91139.pep
AKLIAKEGKSATLRLPSGEVRLVSQNCLATVGQVGNVGVNQKSLGKXAGSKCWLGKRPVVRGVVMNPVDHPHGGGEGKLPLGKKKTTTXXVILRLGRRTXKRKKYTIXYLPPRK

SEQ ID NO: 196722 - protein, 167 aa, Triticum aestivum
  unsure (1)..(167): unsure at all Xaa locations
  Clone ID: PAT_TA_91140.pep
MAAQGLLSGRQLLGRPLQSSISRSSSSRKSPFVVRASSSPPAKQNDNRQLWFASKHPSPTSDGTLXPGDLGSDPWGLSDPEGTGXSSTQGXGYGEIFNGRTEMGXXGIXXPXALARWAWCPREXXSWFKXGIXPXALQLWATITLRFKPFTRVWKPAMENIGLISGR

SEQ ID NO: 196723 - protein, 140 aa, Triticum aestivum
  unsure (1)..(140): unsure at all Xaa locations
  Clone ID: PAT_TA_91141.pep
MAPTVMASSATSVAPFQGLKSTAGLPVSRRSNGASLGSVSNGGRIRCMQVWPSXGIKNSETLSYLPPLSTEASSSKWDYLXIRPKWVPFLXFXQVRFIFXFXXASPGYXXGRXWTCWXLLISGATDXPXVNKLEESXRIP

SEQ ID NO: 196724 - protein, 80 aa, Triticum aestivum
  unsure (1)..(80): unsure at all Xaa locations
  Clone ID: PAT_TA_91142.pep
MSCCGGNCGCGTACKCGNGCGGCNMYPEVEGXPAPPSSVSATATQKASPGGIGDGRPENGGCGCTQCKCGTSCGCSLLQC

SEQ ID NO: 196725 - protein, 122 aa, Triticum aestivum
  unsure (1)..(122): unsure at all Xaa locations
  Clone ID: PAT_TA_91143.pep
LVVLPGGPPRPVGMHVHSLXKNFTAEELTXASHLHFCGWWEDLAMLHVDTNQTLXFXPVSPSSVTFKSVXXTSRQLSSSMLNNGNDGKTPASPTNXVHFPKVPGMGXLSFFQRKGRKTXNAV

SEQ ID NO: 196726 - protein, 104 aa, Triticum aestivum
  unsure (1)..(104): unsure at all Xaa locations
  Clone ID: PAT_TA_91144.pep
YLTSNKSIQAPPWTLWVPFTXVPKSSNHLFXCDVGEMKEGSXKRADEQSXKKTRVMSXEWAATADNHXGAGHRRXRPIXGNGTRTGXGLXXXTSHWSRAGSGAF

SEQ ID NO: 196727 - protein, 89 aa, Triticum aestivum
  unsure (1)..(89): unsure at all Xaa locations
  Clone ID: PAT_TA_91145.pep
VPFPRVDESGRPRRVVKTYIWHNVGTHVENADCIEWHLGSVNDSNPRGDFSVXLLLRWWDLRYGSIFPIAKGGGPRVPNXPYSDPYYXR

SEQ ID NO: 196728 - protein, 154 aa, Triticum aestivum
  unsure (1)..(154): unsure at all Xaa locations
  Clone ID: PAT_TA_91146.pep
MRCGGVSVTRTLGIXLPXXRFRXIPGXETXXQGIXFPXRRFYLXPLPPAEXAVXAKGSAQESXTXKAXXDKKXMPYVIEXLRFEASLLALGXQDRHLLPGPPKEEKKASKASPASSFATLDGLDHAAKIKSPTEAEKYYGETKTVLGDVLAKLG

SEQ ID NO: 196729 - protein, 85 aa, Triticum aestivum
  unsure (1)..(85): unsure at all Xaa locations
  Clone ID: PAT_TA_91147.pep
MAPTVMASSATSVAPFQGLKSTAGLPVSRRSNGASLGSVSNGGRIRCMQCGPXKGIKNSKXPTGNVNGPNKKTDSPQMAFPQFRG

SEQ ID NO: 196730 - protein, 54 aa, Triticum aestivum
  Clone ID: PAT_TA_91148.pep
HRLGNILAFLSVMNLGSQWINLGVNKGSKIEDIVLPLSYPTIRLVPDRKRGSKA

SEQ ID NO: 196731 - protein, 42 aa, Triticum aestivum
  Clone ID: PAT_TA_91149.pep
MLAQSEGNYAEALQNYYEATRLEIDPYDRSYILYNIGLIHTS

SEQ ID NO: 196732 - protein, 130 aa, Triticum aestivum
  unsure (1)..(130): unsure at all Xaa locations
  Clone ID: PAT_TA_91150.pep
MYVIQSSIYIWHEHHGRLHLNLTHTPAASVVLVAKPFTCRSIXSERLPPPAESTSMKDADGLADAXAALVGSRKLRTLGDGAPRSGACLARPSXAEQXPPPXSEKRPXPXITIIYIXXCCPXXTFAXXHT

SEQ ID NO: 196733 - protein, 187 aa, Triticum aestivum
  unsure (1)..(187): unsure at all Xaa locations
  Clone ID: PAT_TA_91151.pep
AVAAASLFSATAPSFCHLMKETSSSQATSSSYTSCPSPWPELPKSSPLCTLQCYRGRRHPRIRNRKHQVHHPAKTWDLRDTPXTPFRVSNTAKRQXQRRPXTARRYTAIIRKNPRPTILEEASTLPNNVRHXRXRPVLHKLXXTTXALTYFQGDPLTXFPLDTXPTXXXLSRYSSKXYXRGAVPIPI

SEQ ID NO: 196734 - protein, 84 aa, Triticum aestivum
  unsure (1)..(84): unsure at all Xaa locations
  Clone ID: PAT_TA_91152.pep
MXSPMLSXDMEPLXRGMLEFXGLRSSSSLPLRRNATSXDFMSXVSFMTYSVXTXXGXRNAPTXAKLNVXIXXFWRIKAQFLPGA

SEQ ID NO: 196735 - protein, 92 aa, Triticum aestivum
  unsure (1)..(92): unsure at all Xaa locations
  Clone ID: PAT_TA_91153.pep
SPTPAHPSPGAPPRRIPAPAPPFXATPAPARLXPGAPSPGDPSPGAPQPXVTPISGLLPPSPPRLSPPPSATNPDXSEHRXPSPAIPATACF

SEQ ID NO: 196736 - protein, 69 aa, Triticum aestivum
  unsure (1)..(69): unsure at all Xaa locations
  Clone ID: PAT_TA_91154.pep
XNXGXXPVTPGGFRXQRXMLXVTNTXXSPLTNXXGQEFNTEMFVNYXSKKKGNXIQTMTSKRRELMPIX

SEQ ID NO: 196737 - protein, 99 aa, Triticum aestivum
  unsure (1)..(99): unsure at all Xaa locations
  Clone ID: PAT_TA_91155.pep
AFGVPMGLGGRGRTRTAQNAVKHIRAXKCVISFFLFPFFFSYPQDPFTRALSGSRLAKSRMQQPREGERRRRISRWSPLRALNLFYTPLRSLPLEGGHV

SEQ ID NO: 196738 - protein, 113 aa, Triticum aestivum
  unsure (1)..(113): unsure at all Xaa locations
  Clone ID: PAT_TA_91156.pep
XLDXTGGLECMHAAXSCISRDWNLPNLVITSXCFEVISEHQQQCITQFMLRIIKEFLLVGIVFLLFHSVLSVGIIILRPHSIAKGAASLSMGRHVWLGICPDIACISDVLNFE

SEQ ID NO: 196739 - protein, 134 aa, Triticum aestivum
  unsure (1)..(134): unsure at all Xaa locations
  Clone ID: PAT_TA_91157.pep
MAPTVMASSATSVAPFQGLKSTAGLPVSRRSNGASLGSVSNGGRIRCMQVWPIXEGIKNSETLSYLPPLNTXGLLKQVDYXDSAPSGVPFLQFNKLXHLPXYTTISLGYYDGXYWDMLXLPIXGCTGRTQXVRK

SEQ ID NO: 196740 - protein, 105 aa, Triticum aestivum
  unsure (1)..(105): unsure at all Xaa locations
  Clone ID: PAT_TA_91158.pep
SLKQEQLXGEGGQPRVGQLRRSMSRSGSIPTASSIGTSARRMARXPRSARATMDDLLHHSQTCQNLIARWXVSDXXRTMCVMHRLXSCTILLHLRXTIVXXVCKE

SEQ ID NO: 196741 - protein, 89 aa, Triticum aestivum
  Clone ID: PAT_TA_91159.pep
AELPFSSSFLKQAAHCLTLSVPSQWGLLAAYYHNLAGLHPGPLNDWVASRMLAIELCSMQLVGWLFLSYFTFCICHHYLLFFKSPHKRI

SEQ ID NO: 196742 - protein, 191 aa, Triticum aestivum
  unsure (1)..(191): unsure at all Xaa locations
  Clone ID: PAT_TA_91160.pep
TAALYKAGQSSHFNMSLKQQLLPSNFLPNPTGDRRHEGNRPRAPHRLALCYPVPQSGSPVENGXGGTPVPVACXFSCVSXRALXWXPREELLDPSLVRVSRRPRKGSLSVXQNGGITTESTQSPHVLSXXGNSPFQXWGQTTSHKRKVSGXSXVXNALAXXTXXVXTRSSLAKXXXTVPPQTQALGXXFPS

SEQ ID NO: 196743 - protein, 78 aa, Triticum aestivum; identical to SEQ ID NO: 106977
  Clone ID: PAT_TA_91161.pep

SEQ ID NO: 196744 - protein, 158 aa, Triticum aestivum
  unsure (1)..(158): unsure at all Xaa locations
  Clone ID: PAT_TA_91162.pep
TITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLXDYNIQKESTXHLVLKLRXWMQIFVKTSPRHHLKWII

SEQ ID NO: 196745 - protein, 53 aa, Triticum aestivum
  Clone ID: PAT_TA_91163.pep
NLQSTVSLAPYFLTTTPVDSGSGLVERRPSEQALNIRLPCRSYVILISCHLLF

SEQ ID NO: 196746 - protein, 154 aa, Triticum aestivum
  unsure (1)..(154): unsure at all Xaa locations
  Clone ID: PAT_TA_91164.pep
YQPPCVHHTPPSSEQIMRMFXERRRNDLIELLKSVQAMVGQNGNXNGHHSKLSDFQRXKPPSFSQVIDPMEXDDWLRXIEKKLEIARTKEXDKVPFXXHYVEGXAXIWWDNXKXYVACGNXKAMWPXDEEITWTKFNDHFXKYHIPVGIMKVKQ

SEQ ID NO: 196747 - protein, 69 aa, Triticum aestivum
  unsure (1)..(69): unsure at all Xaa locations
  Clone ID: PAT_TA_91165.pep
MVXXAMHXXTSFLGTAPRRDXLVRXVGDFGGRIXMRRTVKSAPQXIWVRPDRHNYLXFSEXXPSYLXGI

SEQ ID NO: 196748 - protein, 63 aa, Triticum aestivum
  unsure (1)..(63): unsure at all Xaa locations
  Clone ID: PAT_TA_91166.pep
LLLEKPKLCTHEFSLVKSHKRDFALILFDSDQXTNFTXXPXLVXFLEFQKCALVTHCYRLFCF

SEQ ID NO: 196749 - protein, 125 aa, Triticum aestivum
  Clone ID: PAT_TA_91167.pep
VSLHQSFCLMQSLFDASSWSLSTKFDVIIINILTPSSISNEFMMISAILVPSYFELPSITFLPSFHHKLIHVMGATCYPACIMFYLEVLLSFMSRMLWVLPHLLRILGIVILLTITILSWYPCCF

SEQ ID NO: 196750 - protein, 141 aa, Triticum aestivum
  unsure (1)..(141): unsure at all Xaa locations
  Clone ID: PAT_TA_91168.pep
LIVAARNLHLMWLYDGNVTFLSQLSVGCLHAKGDLLSIAPXGLLLGPRAAXLLALTXTSRPGIQATAAXGMGTGTVXXNAKPSRGXKXEQAGQATFHGXNKDTSSXXSGPXIPTGVXHHPGTKXELXAYTSSCEHINGMRX

SEQ ID NO: 196751 - protein, 162 aa, Triticum aestivum
  unsure (1)..(162): unsure at all Xaa locations
  Clone ID: PAT_TA_91169.pep
FESVPNLSPPRATTYTTPGRCWAPCSTTATASPDLALHRSKTGPTPPPQPSSSPAYQSAQSCIILRHAPIHVVDLGXWGAKARLRNDKERXFSXTIVPSXLXSKDIKPNLXSTFLXLTIKSYXATFQIKSKRTXIFEFQTFFSXRKSVXLKGPXKYKGETKX

SEQ ID NO: 196752 - protein, 179 aa, Triticum aestivum
  unsure (1)..(179): unsure at all Xaa locations
  Clone ID: PAT_TA_91170.pep
WAXYDHXXIGTGPPXYXSLSHXYGPRAYTGALAYSYAPMPVYVGXAYTALCSSITDALSSATLRGPSFCKDTEKRRCSQXPKGKVVQKGTDVYVMIPPNLSNADPLLIVRLSYGLKSTEKKRGETPSSMSFEGHQIVLCLGMIYLKCSAHTISPQKHCHQSPKLLRDKYALTISPFLVD

SEQ ID NO: 196753 - protein, 168 aa, Triticum aestivum
  unsure (1)..(168): unsure at all Xaa locations
  Clone ID: PAT_TA_91171.pep
KDVLRKFGMEDCKGVKIPMPTNGHLCTDENGIDFDHKVYRSMIGSLLYLCASRPDIMLSVCMCARFQAAPKESHHKAVKHILRYLAHTPTLGLWNPKGLLLISLGYSDLDYAGDRVDRXSTSGTCHSSGRSLAXWPXKKQNAFHVHYGTKYIVAGPACQMLPSPRQAT

SEQ ID NO: 196754 - protein, 96 aa, Triticum aestivum
  unsure (1)..(96): unsure at all Xaa locations
  Clone ID: PAT_TA_91172.pep
LTIFSFVQQVSSSTPPXKKXIXNSHXARTTTRSTTXPLTRLXHRTGRPLAXTYTPYDXDISHXXPTTLVXSLXFRGLLXXXQRXXRPXPPXRXHXS

SEQ ID NO: 196755 - protein, 97 aa, Triticum aestivum
  unsure (1)..(97): unsure at all Xaa locations
  Clone ID: PAT_TA_91173.pep
RTSSSRPSTSGDALADADASPAMHARTYGTAGIGADDHDHWRPGVXKGHAMPPAAAGRRGVXVIEPCPLXHPILGSXVVYTIHXVXGSVDYRSXXIK

SEQ ID NO: 196756 - protein, 89 aa, Triticum aestivum
  unsure (1)..(89): unsure at all Xaa locations
  Clone ID: PAT_TA_91174.pep
FXPNXEXDTKKFXTPXXEILXXKXENXVPXKGFENFLIMLKKMLPKDNELSDSMYEAKKDICPLGLEVLKIRACPNDCILCSDEYKXLN

SEQ ID NO: 196757 - protein, 136 aa, Triticum aestivum
  unsure (1)..(136): unsure at all Xaa locations
  Clone ID: PAT_TA_91175.pep
MGKIKIGINGFGRIGRLVARVALQSDDVELVAVNDPFITTEYMTYMFKXYDTVHGHWXKHSDIKLXKDDKTLLFGREPFTVLXRQEPEEFPLGXXWCPYXVXPTGVFXDKDKXAVTRVVPRKGALCPKNALCGWVN

SEQ ID NO: 196758 - protein, 90 aa, Triticum aestivum
  unsure (1)..(90): unsure at all Xaa locations
  Clone ID: PAT_TA_91176.pep
TPYYMNIIXPLEXHGHXGEGTTXDTPNXRLNRIRGSKFCHFFFLTFRXPISGKACAAVQSPNTQCNSPGRQQXTPNVPGGLYNELNTCLT

SEQ ID NO: 196759 - protein, 68 aa, Triticum aestivum
  unsure (1)..(68): unsure at all Xaa locations
  Clone ID: PAT_TA_91177.pep
LXSPXLPVRVLVRFGSESSXPSLGFPXIGXERNGQIHXGXRLTXLXGXPXXXHRRXQPPAXLQPCXXR

SEQ ID NO: 196760 - protein, 194 aa, Triticum aestivum
  unsure (1)..(194): unsure at all Xaa locations
  Clone ID: PAT_TA_91178.pep
YSTCSQSITLISHLVSESIFPESPCSFICSTATKRSAQKDGRIPLHTCIHTYWVYNIHHTNYELYIFSSNISSKIGNDEVSSVVVLGQLHLRLLALGAHRXSCRSSVAGPAAAXRKSRDSAAVCPLWCRRWASXTVHSGTSNSLNRXERRTSVXGPYQKRRAXTPTGRITDXDPARAKRPLGGGSGPLXEXGAC

SEQ ID NO: 196761 - protein, 87 aa, Triticum aestivum
  unsure (1)..(87): unsure at all Xaa locations
  Clone ID: PAT_TA_91179.pep
PPFRXVRSSKSEPAAQXEDGWXDIASGAATSTVIEPNTDFVPHKARDSNVPDSSPNSETPAPALIESDWAPIMEFTAVDVFQHSPFE

SEQ ID NO: 196762 - protein, 124 aa, Triticum aestivum
  unsure (1)..(124): unsure at all Xaa locations
  Clone ID: PAT_TA_91180.pep
IAPPCPPSSPSMSPSSPRPPPSSPWPPTSSPRPWASWVPCHLPHLVRFFYCLHNSSIAFLELIISFPLLLFFXLSXTHPVVLXXSKKXIWVXGFSCRHXXDGSXSXHXKXMVPXVWLPXXKASX

SEQ ID NO: 196763 - protein, 67 aa, Triticum aestivum
  unsure (1)..(67): unsure at all Xaa locations
  Clone ID: PAT_TA_91181.pep
MAVDLTPRQPAKAYGGEGGAYYEWSPAELPMLGVASIGAAKLALAAGGMSLPXSYFESAXVAYVLQG

SEQ ID NO: 196764 - protein, 89 aa, Triticum aestivum
  unsure (1)..(89): unsure at all Xaa locations
  Clone ID: PAT_TA_91182.pep
IQTEKIISLMIRLLGKSXNCRVXANWLLXSGLDGHNRPTPITMXQAXXMTYGXKXTGYTSHPFQXKHTMVVSILXSAALRXXDCCTSTT

SEQ ID NO: 196765 - protein, 55 aa, Triticum aestivum
  Clone ID: PAT_TA_91183.pep
FFFCLTSCRCLLSYSGICYALWDWVPLFENYELCLSLILKILYAILCCSVKKKKK

SEQ ID NO: 196766 - protein, 118 aa, Triticum aestivum
  Clone ID: PAT_TA_91184.pep
PPPTTEDRGLSLKCQANSVCLSMFSRYILHRHILGMDSKLSHPLRQAWIEVAGRINCPAPLPEEQVFPLLTKVLFPAPYDGPEKKAKKAAKGTRSGFRQKGLWDAMSEDETHLHPPKR

SEQ ID NO: 196767 - protein, 157 aa, Triticum aestivum
  unsure (1)..(157): unsure at all Xaa locations
  Clone ID: PAT_TA_91185.pep
RVLYLGPLSGDPPSYLTGEFPGDYGWDTAGLSADPETFAKNRELEVIHCRWAMLGALGCVFPELLARNGVKFGEAVWFKXAGSQIFSEGGXDYLGNPSLXHAQSILRHLGPAKSCSMXAVXXVRVAXGGPVGEICRPLYPGGXSTPGPCRHPELRLK

SEQ ID NO: 196768 - protein, 126 aa, Triticum aestivum
  unsure (1)..(126): unsure at all Xaa locations
  Clone ID: PAT_TA_91186.pep
WALPTTVNGPAHYQGFSFNLCTEGTDAPSWTPHARPRRGMSPCPTILRSVQLDKSIVAXPWANLKLPLPFPPSARSLSIWXXSRXRDXVAPGIPIAPPPKLRQXSXXTSPLSSLXGGAVPIXLYDL

SEQ ID NO: 196769 - protein, 109 aa, Triticum aestivum
  unsure (1)..(109): unsure at all Xaa locations
  Clone ID: PAT_TA_91187.pep
IWACQVVLMGAVEGYRVAGGPLGEIVDPLYPGGSFDPLGLAEDPEAFAELKVKEIKNGRLAMFSMFGSSVQXIVTGKGRPRTRRHSPTPSTKPWAFATILPGIYPSVNS

SEQ ID NO: 196770 - protein, 87 aa, Triticum aestivum
  unsure (1)..(87): unsure at all Xaa locations
  Clone ID: PAT_TA_91188.pep
MSCNCGSGCSCGSDCKCGKMYPDLTEQGSAAAQVAAVVVLGVAPGEQGGAFXVAXAGQSGEGXCAAGDNCNCNPCNWSCMPYYVCWC

SEQ ID NO: 196771 - protein, 89 aa, Triticum aestivum
  unsure (1)..(89): unsure at all Xaa locations
  Clone ID: PAT_TA_91189.pep
FMLIYVFCXLXYFLILXAFSFRKXXXSVSALSFQNLEXTFLVFLFSLLLYLFYFVVNFTIKIVFPVFLICFLHYLFSFVFCFNFNYVCF

SEQ ID NO: 196772 - protein, 93 aa, Triticum aestivum
  unsure (1)..(93): unsure at all Xaa locations
  Clone ID: PAT_TA_91190.pep
NGRRNPAKLRRQYEPSPRVGTRQVVPPFAFLSLLRKKECNLVPHGACXNCXXLNWCTVPTXFCAMFSPLWCLXVXITYLXGGXKXPVLPXPQG

SEQ ID NO: 196773 - protein, 79 aa, Triticum aestivum
  unsure (1)..(79): unsure at all Xaa locations
  Clone ID: PAT_TA_91191.pep
RXXRPSGKRLTVDLSKSAAGQRKPVKDCLHIAPXTNHXSRPLRSNRDLAXVADIWPSQYNSQPVVTSGPCMAHDVFRPI

SEQ ID NO: 196774 - protein, 143 aa, Triticum aestivum
  unsure (1)..(143): unsure at all Xaa locations
  Clone ID: PAT_TA_91192.pep
THQHSSSSSPWFVMPRASSSSSSSWPSRSPARPLPPNVGLLLRPGRPVLGPLXKEEPNLKKAAGNYPVFXXPXTTXXXGSTXSGXTRKMXXNXXWGTXKKFKXFPRXNRGXNPXPGRXXKGXXSXRPXLGKXXXTFPPXNKKN

SEQ ID NO: 196775 - protein, 56 aa, Triticum aestivum
  Clone ID: PAT_TA_91193.pep
HHSCTTQNILFMRSGLCSTSKVYNRNVLKSVYLFSQNEKYIHLSANNIKAYHLRYF

SEQ ID NO: 196776 - protein, 73 aa, Triticum aestivum
  unsure (1)..(73): unsure at all Xaa locations
  Clone ID: PAT_TA_91194.pep
KIXGIKEFXXFPRXLXXHTXYYFLKFQKKIQKGNQKSXKFGFVXKHWSCXLFXXGRVYXVAGSTQVXSLRSLS

SEQ ID NO: 196777 - protein, 105 aa, Triticum aestivum
  unsure (1)..(105): unsure at all Xaa locations
  Clone ID: PAT_TA_91195.pep
ARTRRYGPTRHHDFRGSTFRSRIPHRFAWSSGATYCGLLLRLRPPSSSTPSNPLLHTFAYAPSTFPSTNLMPPPSLSLCCVVCVCCVCVCXFPKLILQQQVRSTS

SEQ ID NO: 196778 - protein, 148 aa, Triticum aestivum
  Clone ID: PAT_TA_91196.pep
MAVHVVLPLLLLLLVATVLPYTALAAFSPDFKIFLACGAGADVPFPSDNPARTFVRDDGYLPSVTPPGACTTCTAATPENIINRDVNPQTSSSTGGRTAAARLPRWPTSLAHRPSLGKTTLARRQGKFGTQPEYIKNGRSSQSGGAPR

SEQ ID NO: 196779 - protein, 151 aa, Triticum aestivum
  unsure (1)..(151): unsure at all Xaa locations
  Clone ID: PAT_TA_91197.pep
MAAAFSSXVGAPASTXTNFLGKKLKKQVTXXXNYHGKSSKXNRFTXMATENIXXKRNTRPVERSCXHISXEQQDITKREXXXWTPSFKGPXGKGTQXGLXKSQXYXPPGPKNYXXKHXGGXKTRFELQSPNSPSKKPPLGSQKEIPPQGPH

SEQ ID NO: 196780 - protein, 159 aa, Triticum aestivum
  unsure (1)..(159): unsure at all Xaa locations
  Clone ID: PAT_TA_91198.pep
GYASWWXRRRLRGYPGVALAASCPSTSATIHRCRALRSRWSAVLRLRRWHTGVTARTRXXNALPXVPMMFLCELPFLGAFFSXGLLRSLLMVEXVLGGXXPEVXVQXFRWSLCNFPXLLXFXKFWSXPGRSSGFPLHFXXPQVFVRRQXSSNWDIQAWX

SEQ ID NO: 196781 - protein, 108 aa, Triticum aestivum
  Clone ID: PAT_TA_91199.pep
FFFFWLLFGAFSARYLAGYYSAPLAPVTGVFANGRIPTLRAGPAHLLFSLFCFSHKKAAKVRLEHRTCRLKLAPTYHPATNSHVTTNIFPFYSLCSEIVVLGELFPNK

SEQ ID NO: 196782 - protein, 163 aa, Triticum aestivum
  unsure (1)..(163): unsure at all Xaa locations
  Clone ID: PAT_TA_91200.pep
MAAAFSSTVGAPASTPTNFLGKKLKKQVTSAVELPWQESKANRXTSMAAENLDEKXNTDXWKGLXYDISRTTKQAHXRGKXIXGSSFQAXPTGERTHEASLXPYDYXNQGXKXSLTNHGSSNPPSWALPLSKIHTCPTQHHWWEEGQGNHHATSQMNHHIFRN

SEQ ID NO: 196783 - protein, 134 aa, Triticum aestivum
  unsure (1)..(134): unsure at all Xaa locations
  Clone ID: PAT_TA_91201.pep
MAASLQAAATLMPAKIGGRASSARPSSHVARAFGVDAGARITCSLQSDIREVASKCADAAKMAGFALANSXLLVSRAXXEGAPKKLTXXEIQSKTXMXVKXTGTRTIAEQPTGGXSFPXKAXNXNEKXCLEPTP

SEQ ID NO: 196784 - protein, 152 aa, Triticum aestivum
  unsure (1)..(152): unsure at all Xaa locations
  Clone ID: PAT_TA_91202.pep
MAPTVMASSATSVAPFQGLKSTAGLPVSRRSNGASLGSVSNGGRIRCMQVWPIEGIKKFETLSYLPPLSTEALLKXVDYLXRSKWVPCSXFXKVGLTFXXXKQSLGXNNGRYWTIXXLPKFGCTDATQVXNKWKSQEGVPDXTRIIGSQHRK

SEQ ID NO: 196785 - protein, 102 aa, Triticum aestivum
  unsure (1)..(102): unsure at all Xaa locations
  Clone ID: PAT_TA_91203.pep
PNSVRFGLRTNDREFASNQQPIHSTVQGLIDTLIXXPKILTVWTTMPXKGKTKSTITGAGRQFFVXVFXGGKPKQTMTTXQXINQDKLLXIQKTSLGRPINR

SEQ ID NO: 196786 - protein, 169 aa, Triticum aestivum
  unsure (1)..(169): unsure at all Xaa locations
  Clone ID: PAT_TA_91204.pep
NEKVQDLLLLDVTPLSLGLETAGGVMTVLITRNTTIPTKKEQVFSTYSDNQXPGVLIQVFEGERTRTRDNNLLGKFELSXIPPATKGVPXITVCXTFIPNVSRKSPLXXXTXGXKNKXTNQQPQXKXXKGDIXKMSKXPQKXNLXAKXQXKRFAKKXLXXXKGNIRENF

SEQ ID NO: 196787 - protein, 42 aa, Triticum aestivum
  Clone ID: PAT_TA_91205.pep
SKNERPTINLKAIGLIEGKNPNNTVHLLESTRGPRKNGDGEK

SEQ ID NO: 196788 - protein, 156 aa, Triticum aestivum
  unsure (1)..(156): unsure at all Xaa locations
  Clone ID: PAT_TA_91206.pep
MATTAMALSPSSFAGKAVKDLPSSALFGEARVTMRKTAAKAKPVSSGNPWYGSDRVLYLGPLSGDPPSYLTGEFPXDYXWDTAGLSXAEPENFAKNRELEXIQCPVGXLGXLXCVFPGLXXXXGFARPFVKGSNFTRGVNTRNPLIGKNSHWAAIQ

SEQ ID NO: 196789 - protein, 104 aa, Triticum aestivum
  unsure (1)..(104): unsure at all Xaa locations
  Clone ID: PAT_TA_91207.pep
GXFNRRQSRAXLDRPXARXXEXLGPXRRQRHRKVEGCSPXPXSAXLHRKQACLHAQLLVVVVSFSAGRTAPPATSVAIGYRLRGRRETRRXRHXSPPAARRSPS

SEQ ID NO: 196790 - protein, 98 aa, Triticum aestivum
  unsure (1)..(98): unsure at all Xaa locations
  Clone ID: PAT_TA_91208.pep
MAPTVMASSATSVAPFQGLKSTAGLPVSRRSNGASLGSVSNGGRIRCMQVWPIEGIKXXETLSYLPPLSTEASSSRSDYLXPSKWVPCLRFNKLXHFP

SEQ ID NO: 196791 - protein, 108 aa, Triticum aestivum
  unsure (1)..(108): unsure at all Xaa locations
  Clone ID: PAT_TA_91209.pep
MADQLTDDQIAEFKEAFSLFXDKDGDGCITTKELGNXMRSAGGKTQREAXSQGHDSMKSDAGWQRTIXFPRFLKPGWPXKMKDTDSXGRXXGASKVFFTKDQNVHLCC

SEQ ID NO: 196792 - protein, 88 aa, Triticum aestivum
  unsure (1)..(88): unsure at all Xaa locations
  Clone ID: PAT_TA_91210.pep
EFVHSAGGGLAGSTNSSRSTPSAIRVATAMKVSIKVRKSCFWVLGDLDCCQLVLSHLLAVGHEPKTEPHQAXHRAETPPLLHSVKDSV

SEQ ID NO: 196793 - protein, 106 aa, Triticum aestivum
  unsure (1)..(106): unsure at all Xaa locations
  Clone ID: PAT_TA_91211.pep
SSHXXPCISXSXEFXSLRNNTXXCFVKVTELAPXVWSPLRYWVSVXEPVFVKHPGPMXFFMCQIFHFAKGTMCPAXSCNQVSSIQMDRSAYETLTRGMDPTVAPFR

SEQ ID NO: 196794 - protein, 130 aa, Triticum aestivum
  unsure (1)..(130): unsure at all Xaa locations
  Clone ID: PAT_TA_91212.pep
PSSHVARAFGVDAGARITCSLQSDIREVASKCADAAKMAGFALATSALLVSGASAEGAPKRLTFDEXQXSKTYMEVKGYRTANXCPTSTGGQSFPFKGRKXQNEXFCLEXTXLTXKAXDQXEXPXASNKP

SEQ ID NO: 196795 - protein, 79 aa, Triticum aestivum
  unsure (1)..(79): unsure at all Xaa locations
  Clone ID: PAT_TA_91213.pep
MSCCGGNCGCGTACKCGNGCGGCNMYPEVEAAGATLLVSATATHKXASSGGMEMAAENGGCGCTQCKCGTSCGCSCCSC

SEQ ID NO: 196796 - protein, 105 aa, Triticum aestivum
  unsure (1)..(105): unsure at all Xaa locations
  Clone ID: PAT_TA_91214.pep
MAQTMASMTGLSQGVRLPGPAGRRASRFTVRASSAGGXAAGRRAVLGLMAXGVVGSAFAQVVHAGTVAAIKVWAPAAVSGGTPRNGQXDQARDSDLPLKNRSNCS

SEQ ID NO: 196797 - protein, 137 aa, Triticum aestivum
  unsure (1)..(137): unsure at all Xaa locations
  Clone ID: PAT_TA_91215.pep
NLXNLALNENTLSGSIPKSLGNLTKLTTLYLSQNQLSGKIPQELGHLVNLKDLNLNYNKHIGSIPNSLGNLTKLAILQLXENQLSGENPQXXGRLLNLRAHGSLGSNTLTXSXPNTLRNLDKTTTYTFPYNQLLALP

SEQ ID NO: 196798 - protein, 108 aa, Triticum aestivum
  unsure (1)..(108): unsure at all Xaa locations
  Clone ID: PAT_TA_91216.pep
XPSALXDYLSLKXCXNWGNXDSAEXMGFMRAGCVIKPQXPPGHVNIHGFCVVAFPPLEDXXLGPGSVCCCFSLSATVTSSVAPVDIFYLSCCGLQFVRLSADIYTMNL

SEQ ID NO: 196799 - protein, 119 aa, Triticum aestivum
  unsure (1)..(119): unsure at all Xaa locations
  Clone ID: PAT_TA_91217.pep
CLSPPTLACXXSKPYMRVRRTVDLXTQCMAWEGXIHPCTCIADLAPSPTINGSNGFPXQRCXFXRRXXGPAPITVRLXHXXXPGTGXKDALLXTXXELHGENRRXKRGHPXVPRHEXSX

SEQ ID NO: 196800 - protein, 181 aa, Triticum aestivum
  unsure (1)..(181): unsure at all Xaa locations
  Clone ID: PAT_TA_91218.pep
DSLFQAPTGDGTHEAVLSSYEYVSQGLKKYDFDNTMGGFYIAPAFMDKLVVHLSKNFMTLPNIKIPLILGIWGGKGQGKSFQXCELVFAKMGINPIMMSAGELESGNAGEPSKLIKQRYREAADMIKKGKMCCLLINDXDAGAGRIGXDTQYTSTTNGERSRNRRCPTKSKHKKGGTATGT

SEQ ID NO: 196801 - protein, 78 aa, Triticum aestivum; identical to SEQ ID NO: 106977
  Clone ID: PAT_TA_91219.pep

SEQ ID NO: 196802 - protein, 195 aa, Triticum aestivum
  unsure (1)..(195): unsure at all Xaa locations
  Clone ID: PAT_TA_91220.pep
ASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGYYDGRYWXTMWKLPMFGCTDATQVINXVEXVKKEYPDXYXRIIGFNNIRXVQCVSSSPATGSRSGRLTTQHLNACICNLIAWFLHYFYCPKEVK

SEQ ID NO: 196803 - protein, 90 aa, Triticum aestivum
  unsure (1)..(90): unsure at all Xaa locations
  Clone ID: PAT_TA_91221.pep
PPYTDFICYIYSXLTLTYLVQYTHSHPVAASQPPLSCLTWDPLPPTRSPTTSLVLRAAQIAAASIPSSPLLLAQXPEAYXSSSIRXDXVA

SEQ ID NO: 196804 - protein, 192 aa, Triticum aestivum
  unsure (1)..(192): unsure at all Xaa locations
  Clone ID: PAT_TA_91222.pep
ALDREKIWSRLTTSETIEVLEKDLAIFGFFIALGRSTQVYLSSKSHTDSNDSINSIVRYLIGGSVLYYPQLSSISSYQXLYVEVVCEELEWLPFYYEDVPTPIVNTEGXKEMPKRELIXRVLNVCTXWVTSFIKYNSRLEKPLNGXXXRSYLKGHAMLXDCMXNLHSKKYLKTFQKWWVIEQLMQALNLGTW

SEQ ID NO: 196805 - protein, 81 aa, Triticum aestivum
  unsure (1)..(81): unsure at all Xaa locations
  Clone ID: PAT_TA_91223.pep
KPEWRALLDDMATVATEEYRAIVFQEPRFVEYFRCATPETEYGRMNIGXSRPSKRKPGRXXQXLRAXPLIXPLXQTXXQSP

SEQ ID NO: 196806 - protein, 146 aa, Triticum aestivum
  unsure (1)..(146): unsure at all Xaa locations
  Clone ID: PAT_TA_91224.pep
MQIFVKTLTGKTITLEVESSDTIDNVKAKIQDKEGIPPDQQRLIFAGKQLEDGRTLADYNIQKESTLHWCSAFXXGMQIFXKTLTXKTSRFKVGSSGTXENXKAKFKXKGGIPRAXXXIXAGKXFVAAGKIQRGSTTGVPFRGKNF

SEQ ID NO: 196807 - protein, 111 aa, Triticum aestivum
  Clone ID: PAT_TA_91225.pep
RPETGLDKLRRAAATQPLAINTAAGEAIKQSPSMPTTPTTPVTPSSSTPPRGGSVWRSVFHPGSNLATKSLGANLFDRPQPNSPTVYDWLYSDETRTRSKPTLNKSRPAKN

SEQ ID NO: 196808 - protein, 84 aa, Triticum aestivum
  unsure (1)..(84): unsure at all Xaa locations
  Clone ID: PAT_TA_91226.pep
YAIILGRXFLNTXGGIIDCTKGNVTFLLMVMSIRXTFPGNDLKXIVSILSEKFHRLYLEVLNFLFKRKYYILIIGDVHIPVEAT

SEQ ID NO: 196809 - protein, 154 aa, Triticum aestivum
  unsure (1)..(154): unsure at all Xaa locations
  Clone ID: PAT_TA_91227.pep
VSRRSNGASLGSVSNGGRIRCMQVWPIEGIKKFETLSYLPPLSTEALLKQVDYLIRSKWVPCLEFXKVGFIFREHNASPGYYDGRYWXTMWKLPKFGCNDATQVXKEXVRKSKKEXPDPYXRIXGFDNMRQXVQCVKLNGXKAXGCKDPGKAKQ

SEQ ID NO: 196810 - protein, 119 aa, Triticum aestivum
  unsure (1)..(119): unsure at all Xaa locations
  Clone ID: PAT_TA_91228.pep
MAASMITSPIVAPTSVPSLSRRGSSFAVVCSGGKKIKVDKPLGLGGGLTVDIDANGRKVGKKGVYQFVDKYGANVDXYSQSTRQEEWSESGDRYAXXXTGLXXWXVXLAXLLXGGVLLV

SEQ ID NO: 196811 - protein, 175 aa, Triticum aestivum
  unsure (1)..(175): unsure at all Xaa locations
  Clone ID: PAT_TA_91229.pep
HFNSKEPRKDTITYIPGVPTIEPHELMSYLQETDTTSVVHRIIFKAFEEARGADYVLCNTVEELEPSTIAALRAEKPFYAVGPIFPAGFARSAVATSMWAESDCSHWLDAXPPGSVLXISFXSXAQVXXQELHXXPEDPGNGASSVVIQRNLNSTNRTAAGPGSPAGWWCVCQWP

SEQ ID NO: 196812 - protein, 151 aa, Triticum aestivum
  unsure (1)..(151): unsure at all Xaa locations
  Clone ID: PAT_TA_91230.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFISVSXMRLPGYXQRRYWTMXXXLPMFGXTTHTGDQQVEESRRIPDPSAHRSQHRK

SEQ ID NO: 196813 - protein, 117 aa, Triticum aestivum
  unsure (1)..(117): unsure at all Xaa locations
  Clone ID: PAT_TA_91231.pep
MQIFVKTLTGKTITLEVESSDTIDNVKAKIQDKEGIPPDQQRLIFAGKQSKDGRTLADYNIQEGIQXSXGXQIRGGNXXFXXXLNGKNXTLGVXPXXTXXXFXGKXKDKGXIPXGKN

SEQ ID NO: 196814 - protein, 163 aa, Triticum aestivum
  unsure (1)..(163): unsure at all Xaa locations
  Clone ID: PAT_TA_91232.pep
PFDVWGLIHGXFPSSNGXTHXLVVVDYVXKWXEVIPISSVDHNTSIKMLKELXFPKVWVPRYLMTDGGSHFIHGASRKMLAXKYDVNHRIASPYHPQSSGQVELSNREINLILQKAVNRSWKNWSKKLDDALWAYRIAYKNPMGMSPYKMVYGKACHLPLKLE

SEQ ID NO: 196815 - protein, 173 aa, Triticum aestivum
  unsure (1)..(173): unsure at all Xaa locations
  Clone ID: PAT_TA_91233.pep
EFPGDYGWDTAGLSADPETFAKNRELEVIHCRWAMLGALGCVFPELLARNGVKFGEAVWFKAGSQIFSEGGLDYLGNPSLVHAQSILAIWACQVVLXGAVEGYRVAGGPLGEIVDPLXPGGSFDPXGLADDLXLRGAQVKEXKNGRSHVLMFGSXAXIVTARAPXELATTSDP

SEQ ID NO: 196816 - protein, 134 aa, Triticum aestivum
  unsure (1)..(134): unsure at all Xaa locations
  Clone ID: PAT_TA_91234.pep
MASTSCFLHQSTARLAASARPAPAVGRTQLFVCKAQKNDEXAASDAAVVTSRRAALXLLAGAAASPFKSPPAAXAAYGEATNVVXARXXKDTXFXALXGKGFKLXIXASWTPTRAXFLGSVPGKQELVLSTHKE

SEQ ID NO: 196817 - protein, 186 aa, Triticum aestivum
  unsure (1)..(186): unsure at all Xaa locations
  Clone ID: PAT_TA_91235.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWXTMWKLPMFGCNDATQVIXXVEXVKKEYXDAYXRIIRIDNMPKCMRQLIASSNGLQDPARLNTNHTGNINAFV

SEQ ID NO: 196818 - protein, 154 aa, Triticum aestivum
  unsure (1)..(154): unsure at all Xaa locations
  Clone ID: PAT_TA_91236.pep
KYIRAYFPGQRDDANIRHGTTVHNARYYRAGADVKNYIRPYYREAMALGQGTTVLQLGGSDTTVGHPRYYRPRRAVLPCWALMLKITSAPTTATQRYXDGKHVLRLQRSGTTVGPAIYPQGNEESRTRVPDSXLHTVXKTXXXIXILXSDGXPX

SEQ ID NO: 196819 - protein, 155 aa, Triticum aestivum
  unsure (1)..(155): unsure at all Xaa locations
  Clone ID: PAT_TA_91237.pep
LYTNXGXTQIXCXQSXXIHXVTFPRSGLSGIAXPDXSLHDTXFIVYXCRGVSLPXRTVSLVHRDNSVXVFLLKTHLTCTHQLISHVSGSPTTLVKQTLSGEATTSRSMESIYXVCSKGCPSPXRQPETPMPPDPGGLPTQLQPVSSTMASLYGVR

SEQ ID NO: 196820 - protein, 71 aa, Triticum aestivum
  Clone ID: PAT_TA_91238.pep
GQIFLGGGASWSPMYYADVCVIGAPVWHTVSLSEPCLLCHPTCLMFINLAKNDAGEGQNTNTLACGPNLYI

SEQ ID NO: 196821 - protein, 75 aa, Triticum aestivum
  Clone ID: PAT_TA_91239.pep
SSLVLSYSQIATPLLVPCMLHVESFNSSSHCPSIINLRIIFLILICKLSIGDLSPVFGEQLRVHKSHIKKVDINL

SEQ ID NO: 196822 - protein, 77 aa, Triticum aestivum
  Clone ID: PAT_TA_91240.pep
HKDINTQASQQTIMSFKISTLKKVIPTKSYNVVMLCLLYTKHLSCTTPMTSREIGSYLLTRFSFFNPHAIHERKPWI

SEQ ID NO: 196823 - protein, 179 aa, Triticum aestivum
  unsure (1)..(179): unsure at all Xaa locations
  Clone ID: PAT_TA_91241.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATXVINXVEXVKKEYLTVRRIIGFTTSPSAVSSLKQRAARSARLNSTRQYNANL

SEQ ID NO: 196824 - protein, 152 aa, Triticum aestivum
  unsure (1)..(152): unsure at all Xaa locations
  Clone ID: PAT_TA_91242.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEXKKEYLTVFRIIGFTTS

SEQ ID NO: 196825 - protein, 65 aa, Triticum aestivum
  unsure (1)..(65): unsure at all Xaa locations
  Clone ID: PAT_TA_91243.pep
RVTQXSIIFTIQGALQLNVDSFTIIVLKSCSENSNYHDNERKGKTLKELFFSKVEQLRINPRNET

SEQ ID NO: 196826 - protein, 180 aa, Triticum aestivum
  unsure (1)..(180): unsure at all Xaa locations
  Clone ID: PAT_TA_91244.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDCRYWXTMWKLPMFGCTDATXVXNEVEEXKKEYLTRTSHIGFTTSQVQCSTQCLKHGLEDKANITRHINASF

SEQ ID NO: 196827 - protein, 80 aa, Triticum aestivum
  unsure (1)..(80): unsure at all Xaa locations
  Clone ID: PAT_TA_91245.pep
MSCCGGNCGCGTACKCGNGCGGCNMYPEAEAAGATLLVSATATHKASSGGMEMXAXNGGCGCTQXCKCGTXSCGCSCCSC

SEQ ID NO: 196828 - protein, 140 aa, Triticum aestivum
  unsure (1)..(140): unsure at all Xaa locations
  Clone ID: PAT_TA_91246.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNAXPGYYDGRYWTMWKLPMFGVHRPTQVXXQVEEXRRIT

SEQ ID NO: 196829 - protein, 140 aa, Triticum aestivum
  unsure (1)..(140): unsure at all Xaa locations
  Clone ID: PAT_TA_91247.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATXVXNEVEESRRST

SEQ ID NO: 196830 - protein, 113 aa, Triticum aestivum
  unsure (1)..(113): unsure at all Xaa locations
  Clone ID: PAT_TA_91248.pep
VKSVEMXXGVLLGXVLGDXRGFNVKNVLLRXLKRGFVASXNSKDDPAQGGXANFTSQVIIMNXHPGQIGNGYAPVLDCHTSHIAVKFAELVTKIDRRSGKELEALPKFLKNGD

SEQ ID NO: 196831 - protein, 138 aa, Triticum aestivum
  unsure (1)..(138): unsure at all Xaa locations
  Clone ID: PAT_TA_91249.pep
GRFRLHSVRDEDAKFKLCKVRSVQFGQKGIPYLNTYDGRTIRYPDPLIKANDTIKLDLXETNKLFDFIXFXVXNVGXWYXXGRNNAFLXDSKNKEKHXGNFXNIHXLGXPXGPFFTXXWNIXTNXGRDNLWVSSPKGX

SEQ ID NO: 196832 - protein, 133 aa, Triticum aestivum
  unsure (1)..(133): unsure at all Xaa locations
  Clone ID: PAT_TA_91250.pep
QXEXKXGIXXXQWSKPXGVYXMNFXDQNXYXQENGVXEAXEVPXRQGAXXSXVGXXCPFQTTSFFLKFLNIPKLIKNAIGVILESVYLPYHVPMPFRSLEHSGWTTEEEEDYDPKGKEETSSDEEDDPLPQTW

SEQ ID NO: 196833 - protein, 58 aa, Triticum aestivum
  Clone ID: PAT_TA_91251.pep
WGVTTLEALPNRGTSLRQHRRFSSFFNLHLHLTFVLSSKSILISLQFHSSLRYMIFTI

SEQ ID NO: 196834 - protein, 130 aa, Triticum aestivum
  unsure (1)..(130): unsure at all Xaa locations
  Clone ID: PAT_TA_91252.pep
PKWVLLRKSTHGVIQPNCDFSCPPTTFTYTNPSXCFFIXSECDWAVPPXXLTQLIRSQFSMSXNLNPFKSHXSLTTEICXMKLIPXXCXGLXSNLXXKTGXXHQIQLXXRGTXPETRQGTXNSAXFXXKX

SEQ ID NO: 196835 - protein, 108 aa, Triticum aestivum
  unsure (1)..(108): unsure at all Xaa locations
  Clone ID: PAT_TA_91253.pep
APEDTAAAVPVVLPKVGGSGAALFDYSRGGPQFGADGLLIGPPLTAVMGVFTGPDASVGVGDLRRARSRLGLSYAKREDGXESLFGDESNVELDXVLVFCXPQIASMY

SEQ ID NO: 196836 - protein, 104 aa, Triticum aestivum
  unsure (1)..(104): unsure at all Xaa locations
  Clone ID: PAT_TA_91254.pep
MANPRVFFDMTVGGAPAGRIVMELYKDAVPRTVGELRALCTGEKGVXKSGKXLHYKGTPFXRVIXDFKFQXGXFTKXNERGDSSTNPTKFNRFFQGQSGQKRIF

SEQ ID NO: 196837 - protein, 88 aa, Triticum aestivum
  unsure (1)..(88): unsure at all Xaa locations
  Clone ID: PAT_TA_91255.pep
MAPTVMASSATSVAPFQGLKSTAGLPVSRRSNGASLGSVSNGGRXKVMQXFWPXEGIKNFETFLXCNVXRXLLXQVHYLIRSKXGLPS

SEQ ID NO: 196838 - protein, 135 aa, Triticum aestivum
  unsure (1)..(135): unsure at all Xaa locations
  Clone ID: PAT_TA_91256.pep
WPLLWPKSQIRLGAGDTTPKTTPPVVPAPSRPHGKTAATVPDIPMPLDPNMHMAQDQERRRRRYICQRRLSTLPIHGDGGDFMGLLSQRTQPNKRRVHSNWYRXEAXFKXXLLNSLLRNLPXAXXTXSKXQGPIY

SEQ ID NO: 196839 - protein, 75 aa, Triticum aestivum
  unsure (1)..(75): unsure at all Xaa locations
  Clone ID: PAT_TA_91257.pep
IQLLISXSYXDSLFMARISXPMGMIFIPCYKGYSHKXPEGYASPEDMANGVQMLXLTMAQTIAGVSMAWREIKRD

SEQ ID NO: 196840 - protein, 102 aa, Triticum aestivum
  unsure (1)..(102): unsure at all Xaa locations
  Clone ID: PAT_TA_91258.pep
KXYPPLERIKXHPFGTFXSNCTLLXWTLLNKMFNGAKKKGGPRTXSPYXXPIRRHGVXLXSWTXNLGXPIXPWQXPPXQLXYTKGARCLQNCHXMQWTXCXE

SEQ ID NO: 196841 - protein, 124 aa, Triticum aestivum
  unsure (1)..(124): unsure at all Xaa locations
  Clone ID: PAT_TA_91259.pep
MVVVFGKYRCVVVMEANNSKVFEGFRRGDLYIVDFSTGPQPAVCLLAKASEGWLWHRRLGHAGMRNLHTLGKKKHVIGIXNVKFLKDHLCGAXCKLGKMTKAKHPAKTIMTTTQPXELLQVPSV

SEQ ID NO: 196842 - protein, 88 aa, Triticum aestivum
  unsure (1)..(88): unsure at all Xaa locations
  Clone ID: PAT_TA_91260.pep
YXXRGCRKAXXGXIVAGLPPRPSLXPCSEEXMSGAVGLSQSHGLPSFFAFFCFFSFRSFVFCFSYFLFSIFIYCLLFFCLVGNTFSCR

SEQ ID NO: 196843 - protein, 102 aa, Triticum aestivum
  unsure (1)..(102): unsure at all Xaa locations
  Clone ID: PAT_TA_91261.pep
IPLLXSGXFGYAXCFGXPRXXYSHPNXQSYIQLYPSFNTYQETFGKPCTSXFEKHPLYGVMEILPNSRXSTGWRXGYLTNNCIKEIFDVGDLRYSRTATIKL

SEQ ID NO: 196844 - protein, 68 aa, Triticum aestivum
  unsure (1)..(68): unsure at all Xaa locations
  Clone ID: PAT_TA_91262.pep
XXNSHVPNTQRLLGXIISPHRMWXIPQRXXRCDHVCFVEDVSQTGCHIPEXVCICKILCPIXLNMEYF

SEQ ID NO: 196845 - protein, 81 aa, Triticum aestivum
  unsure (1)..(81): unsure at all Xaa locations
  Clone ID: PAT_TA_91263.pep
KFKMTPATCNVLLETLFKHDKHKEANDLWETMIDNHSPPSFIGMNSDPTXVMVNXCFKGRQVPRCIEXFHRPRRNSKWTSV

SEQ ID NO: 196846 - protein, 105 aa, Triticum aestivum
  unsure (1)..(105): unsure at all Xaa locations
  Clone ID: PAT_TA_91264.pep
RRAIKSQVLADFVAEWTEAKLPKEYGAYSNXIMHFDGSKMLAGLEAGVVLTSPTGRXVQYILQILYTDSNNAARIRGLLHVFRMASLMGIQCLEGAQDSTPYITN

SEQ ID NO: 196847 - protein, 131 aa, Triticum aestivum
  unsure (1)..(131): unsure at all Xaa locations
  Clone ID: PAT_TA_91265.pep
MAPTVMASSATSVAPFQGLKSTAGLPVSRRSNGASLGSVSNGGRIRCMQVWPIEGIKXFETLSYLPPLSTEALLKQVDYLNPLKVXPCPQXXXVGSTSLEQXXTPXEXNGRYXVEPAFDPTNVKVSKRPIR

SEQ ID NO: 196848 - protein, 111 aa, Triticum aestivum
  unsure (1)..(111): unsure at all Xaa locations
  Clone ID: PAT_TA_91266.pep
LAXSKNAXXNXTWVAIGSYXFIIFSISLYXLLPINTXEAAEXAGAGGDDGGVGQGGGRXSRVRREARPREEREEEAARSLREMLLYIPTCEKTKTPSAWHENNDGGTRYFQ

SEQ ID NO: 196849 - protein, 115 aa, Triticum aestivum
  unsure (1)..(115): unsure at all Xaa locations
  Clone ID: PAT_TA_91267.pep
MAVSRQRTSRACAHTVQLAVYCCSTSCHWATEYICCSGXRLTPKVKPXLTHCGELQYSTAESHSNANGKIQGKXGXPTXXRNTXNHLAXAXGXTFPXVGPLAKPTRSIIRALQRP

SEQ ID NO: 196850 - protein, 152 aa, Triticum aestivum
  unsure (1)..(152): unsure at all Xaa locations
  Clone ID: PAT_TA_91268.pep
VWGXGAFTGTGPVRGFPGRPLPAFTGRSXGRLICPPWFCIPATRSHALWGQRRWSWETGRXQRFGPDPCLPLPLIXXAGXPTPTPPLIKSEMGXQEPXLXLPFXNFXPLLSTAMXKXNPSLQVXXKVPQXRSTXXASTSDGRMXLGSREPXX

SEQ ID NO: 196851 - protein, 128 aa, Triticum aestivum
  unsure (1)..(128): unsure at all Xaa locations
  Clone ID: PAT_TA_91269.pep
MAPTVMASSATSVAPFQGLKSTAGLPVSRRSNGASLGSVSNGGRIRCMQVWAHRGHQEFETLSYLPPLSTEASLXKAXYLFASXWVACFXFNKGGXTSVXQXXSPGYYXGRYWXMWKLLSSGCTDASD

SEQ ID NO: 196852 - protein, 135 aa, Triticum aestivum
  unsure (1)..(135): unsure at all Xaa locations
  Clone ID: PAT_TA_91270.pep
PLGIPAPRVFQPTLLDARGGYPTGSARVYLGDPLXXKSGGIXPVVXNMHELEKKLCVVALXCIRMXSRXRPAMSEVIEILEXGVDGLQMPXRPFFCDEGHIHVEALTHFTSELTAVSEEELTVVWEEDNGEIYSV

SEQ ID NO: 196853 - protein, 57 aa, Triticum aestivum
  Clone ID: PAT_TA_91271.pep
YCLNFTNKKPRPSSFPLKMEDLINCILSLSFLYHHYAEDGHNSMTTRLIIATRAWHR

SEQ ID NO: 196854 - protein, 147 aa, Triticum aestivum
  unsure (1)..(147): unsure at all Xaa locations
  Clone ID: PAT_TA_91272.pep
MAASMITSPIVAPTSVPSLSRRGSSFAVVCSGGKKIKVDKPLGLGGGLTVDIDANGRKVGKKGVYHSFDKYGANVDXYSQSYTQEEWPXPGDRYPGGTTGFLXXGFXSARLXPRGVSLLKHQLRVKYVLKGRSAPNTGKRGGPVPFP

SEQ ID NO: 196855 - protein, 139 aa, Triticum aestivum
  unsure (1)..(139): unsure at all Xaa locations
  Clone ID: PAT_TA_91273.pep
WLARHLGQEKPKSMAVLTTLMTHFCVGQDSWLARSNNISKNHGTSDTKDGNGRSHRNKHKCRINSDNTEDTAVNAGFKGSKPGQAEKAFKKKHXGARPVWDRIXXRFCQNTRDPRQSKQTKQTGLLVFKXGWXFNGKQR

SEQ ID NO: 196856 - protein, 164 aa, Triticum aestivum
  unsure (1)..(164): unsure at all Xaa locations
  Clone ID: PAT_TA_91274.pep
RQRDSPNGHTRESRGPHRSRRFLSRNTXGHCVPHSXGDIDXAXXLXPQGXRXIPCCRDGRDPEDWRPXXFAPXERFVLGGGXEWLXLTGQQGDQDDPFGAXRXICAGLGVAMLHLEYFVANMVREFXEWKEVAGDEVDFAEKREFTCVMQKPLRPRLVPRIKDE

SEQ ID NO: 196857 - protein, 92 aa, Triticum aestivum
  unsure (1)..(92): unsure at all Xaa locations
  Clone ID: PAT_TA_91275.pep
WGSFVFPTVNTSGRLLTSGSSGTGGVIXTNCCRACSHPLKXLKILPRLLPSIKKLIILPHSNTRVTSWWIFKFTYRQVDKKGVKKQMWRQPS

SEQ ID NO: 196858 - protein, 140 aa, Triticum aestivum
  unsure (1)..(140): unsure at all Xaa locations
  Clone ID: PAT_TA_91276.pep
YNTNXDXTKRLNTQSDAMGQGDIANGSKQEKKAERMKAISILLPKEQLLRAPHPWARYFGGGLLRRERSPRRCRRFRRXNASPPPLCAPSPALFLELLXASAPSSSPSCSLASSLNXXSNFRXLGSSPNKVISAKNFNGL

SEQ ID NO: 196859 - protein, 61 aa, Triticum aestivum
  Clone ID: PAT_TA_91277.pep
VPFPCPPRRPRSFPPPWPPPPGHSPAPSRPCTPPPRPHPPLPPTRKETTTMLITAGRRARP

SEQ ID NO: 196860 - protein, 88 aa, Triticum aestivum
  unsure (1)..(88): unsure at all Xaa locations
  Clone ID: PAT_TA_91278.pep
RQLHEKKVDHATAAAAAAVIAGSASFPPPTVPTTPAXMGSTDETGTPLMANYTMLEXGXGSCTWXSENLRISXTGSLXVXLVPISLAA

SEQ ID NO: 196861 - protein, 47 aa, Triticum aestivum
  unsure (1)..(47): unsure at all Xaa locations
  Clone ID: PAT_TA_91279.pep
GFRXSEEDRKGXIHXGDRVXLLXGRLTWXXXLTQPPXXXQTVQXDXL

SEQ ID NO: 196862 - protein, 91 aa, Triticum aestivum
  unsure (1)..(91): unsure at all Xaa locations
  Clone ID: PAT_TA_91280.pep
SFMFNTIIESLDLREIELSGRKFTWANSLPTPTFEKLDRVLASVDWEQKFSXVTVQALSRGISDHTPLLXDSGEATHVGNKNTFSFELAWF

SEQ ID NO: 196863 - protein, 92 aa, Triticum aestivum
  unsure (1)..(92): unsure at all Xaa locations
  Clone ID: PAT_TA_91281.pep
LTGAALLLASLLALAAIASGNTEGDILYSQRLAWKDPXNVLQSWDPTLVNPCTWFXVTXTNVXNXNSVIRLDLGXEGSKAPGFLGTMVTLST

SEQ ID NO: 196864 - protein, 160 aa, Triticum aestivum
  unsure (1)..(160): unsure at all Xaa locations
  Clone ID: PAT_TA_91282.pep
QHGTMYDDVQTLHQQTKPRQPPACRHDRHGSFLCYASAAQSWTWPLLRAERAVSRTASPSSDLGRPPQRRRRRTVAGDPTPPAGRXKDREQEQXRTWDTRPDWTPFGVRERSFNSRRSNGGQVTGGDYVKDVRATRSPMARQTRQPAGRYPKITGAHXGX

SEQ ID NO: 196865 - protein, 135 aa, Triticum aestivum
  unsure (1)..(135): unsure at all Xaa locations
  Clone ID: PAT_TA_91283.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNAXPGYYDGRNGTMVELLSSDAPTPPSDQVEESR

SEQ ID NO: 196866 - protein, 84 aa, Triticum aestivum
  Clone ID: PAT_TA_91284.pep
TKESKTGPPLYLGSPCRREQEWAHPSLAHESLDIQSVFCNPSQAPWLHLPPHCRKQVTHSMSTNTLSLCNPWATAPAHPGHWIC

SEQ ID NO: 196867 - protein, 129 aa, Triticum aestivum
  unsure (1)..(129): unsure at all Xaa locations
  Clone ID: PAT_TA_91285.pep
EEXRRSCEEKPRRTDPFSHLXMYARMFKXHVDWELLNLSLANLLRRIFLGEAEDAPPQGAADYVCSMGERRSEFRRSMPCCEMGMLDWTHAHQHATGAGAGGFPYLTSPPNLQKIEIRLAICFNCVTPG

SEQ ID NO: 196868 - protein, 126 aa, Triticum aestivum
  unsure (1)..(126): unsure at all Xaa locations
  Clone ID: PAT_TA_91286.pep
VPSIVRFHRCGGRLFEPATTIFAHPRAKCFQIFSDSGWRVLARHHYIWSCCHLPRLYWGGGLLHAPVTSIQDLTYPPVVGAHCKHKLFLHPLSPPPASWRPPMPTAXSQSTXSKGVQGASSPSPXP

SEQ ID NO: 196869 - protein, 140 aa, Triticum aestivum
  unsure (1)..(140): unsure at all Xaa locations
  Clone ID: PAT_TA_91287.pep
XRXGLDXGXDCRERSSGACKSPALECRGAELQXREAMGGAPASGCPWARAPGAGVAMGASSQAQGWPWAGPLASDRLARPLASEWPWARAPASGRPWAHELRPRDSHGRELQAQGRPRARAPPAVFSPSHCKWAPVCMQL

SEQ ID NO: 196870 - protein, 148 aa, Triticum aestivum
  unsure (1)..(148): unsure at all Xaa locations
  Clone ID: PAT_TA_91288.pep
MAPTVMASSATSVAPFQGLKSTAGLPVSRRSNGASLGSVSNGGRXRCMQVXWPIKGIKKFXETCPNCQRSTTEGLLKASRXLIRSKWVPLPRIQTKVGFNLXREQQASPWGTNXGRLLGQCWKLPKFXGCTDATKLXTRLEXVKKXXP

SEQ ID NO: 196871 - protein, 70 aa, Triticum aestivum
  Clone ID: PAT_TA_91289.pep
PHFQSEDNLLLDRSFTRSVGFHSTFYSIDRFSLDLLLDRWVFTRPFTRSIGFHLTFYSIGGFSLDLLLDR

SEQ ID NO: 196872 - protein, 104 aa, Triticum aestivum
  unsure (1)..(104): unsure at all Xaa locations
  Clone ID: PAT_TA_91290.pep
MAAATMALSSPAMAGTPVKASRAAPFGEGRITMRKTAGKPKVAASSSPWYGSDRVLYLGPLSGDPPSYLTGEFPGDYGWDTXGLSADPENFAKNRDWRPLPLAI

SEQ ID NO: 196873 - protein, 97 aa, Triticum aestivum
  unsure (1)..(97): unsure at all Xaa locations
  Clone ID: PAT_TA_91291.pep
LXXNSARAXARHATTRHDXAVVLLLXRRPRPPLPLLPHXLPCXPARVLPPLPPXXLPDPRASLHHGLAVXLGGSCCDXXASXDXDXSAPLRHXGQVP

SEQ ID NO: 196874 - protein, 93 aa, Triticum aestivum
  unsure (1)..(93): unsure at all Xaa locations
  Clone ID: PAT_TA_91292.pep
CKXXSXDGXSELHYVXDVNGIDVGSGKPSSGHGLASTSVSMMDQFINLNNDNDQSNPNQXMSDFHGMRXPSLVXAXTVPTPTPPSLXXDYTAN

SEQ ID NO: 196875 - protein, 182 aa, Triticum aestivum
  unsure (1)..(182): unsure at all Xaa locations
  Clone ID: PAT_TA_91293.pep
SCRIRHEIQSSPPTISPGNLRSERSEGSLVLLLKMQIFVKTLTGKTITLEVESSDTIDNVKAXIXDKEGIPPDQQRLIFAGKQLEDGRTLXADYNIXQNESTLHXVLXLRXGGMQFLVKTSTGKTSTWXLIXQDTIDNVKAXSRXXRDPPGPTXLFLXGRIQDXATLRLKQKNSWAKSLGII

SEQ ID NO: 196876 - protein, 81 aa, Triticum aestivum
  unsure (1)..(81): unsure at all Xaa locations
  Clone ID: PAT_TA_91294.pep
XYIPIPIXPXLSXHKIIVQLSYHQXQLHYIXDNITNGLXLVLXIXHKGHLFLXTLXXXDLRDNGXXTAEXXLQXIRRHDVP

SEQ ID NO: 196877 - protein, 56 aa, Triticum aestivum
  unsure (1)..(56): unsure at all Xaa locations
  Clone ID: PAT_TA_91295.pep
GPLYTPEPFLSSKGIANLYSPHSLALPIHYIVXSSFHXNELSXEXTVFNYXSWLNS

SEQ ID NO: 196878 - protein, 78 aa, Triticum aestivum
  unsure (1)..(78): unsure at all Xaa locations
  Clone ID: PAT_TA_91296.pep
RDRFRFVYEQKELLLYMSASCEITVNQSVSEFYTSFNKIRKPPPSLSPLLGGGSEEAIIXXXRASSIVGHEXSIISRI

SEQ ID NO: 196879 - protein, 167 aa, Triticum aestivum
  unsure (1)..(167): unsure at all Xaa locations
  Clone ID: PAT_TA_91297.pep
PMSPQFLDYSNNLFSSIPRDLMPRLTSSFYLSMANNTLRGGIPHIICDANNLKLLDLSYNYFSGHVPSCLVDGRLTILKLGHNQFEGTFPDGIQGVGCASQTIDLNGNNMXGQLPKSXSXSXLXGLEVGGTICQSSELGDTKLSWLNTDYWPCRAVPPTRPTKYLSA

SEQ ID NO: 196880 - protein, 84 aa, Triticum aestivum
  unsure (1)..(84): unsure at all Xaa locations
  Clone ID: PAT_TA_91298.pep
ASRLGQFXXXQSXXRSSXXEHHXHXDRSXXMHEXLHRGGQGMHSXERSGSLXGVAPLSNPDVVNAXAXHHXLGQXETHGDXYCA

SEQ ID NO: 196881 - protein, 143 aa, Triticum aestivum
  unsure (1)..(143): unsure at all Xaa locations
  Clone ID: PAT_TA_91299.pep
MAQTMASMTGLSQGVRLPGPAGRRASRFIVRASSAEAEAAGRRAVLGLMASGVVGSAFAQVVHAGTVAAIKVGPPPPLSGGLPGTDNSDXARDFDLPLKXRFYLQPLPPAEAAVRAKDSPKESSTQAAHHKXQWAXVTTPGSN

SEQ ID NO: 196882 - protein, 99 aa, Triticum aestivum
  unsure (1)..(99): unsure at all Xaa locations
  Clone ID: PAT_TA_91300.pep
MAEHKEEPVAESMMDXISDKFHGGDXSSSSXSDSDDEKXGSAAGVKAKIYRLFGRDXPXHXVXXXGXPADLVLXXNXKVSGXVLAGXTAIWXLFDVHGT

SEQ ID NO: 196883 - protein, 63 aa, Triticum aestivum
  unsure (1)..(63): unsure at all Xaa locations
  Clone ID: PAT_TA_91301.pep
IXXGXCXEVEMXXXPQVEXXILCVXQXNXQVNXXQPVRPLSARVAXHXXGSKYXSCSXRIRHE

SEQ ID NO: 196884 - protein, 117 aa, Triticum aestivum
  unsure (1)..(117): unsure at all Xaa locations
  Clone ID: PAT_TA_91302.pep
SNFSGYRGKXGAADXXXKHXNXXRGDIXHXAAXDKRFXTLPXSDALPRNXPISGXIFVCNXDTXXENLXRXVFXLPSXYRDSXKXDXGXXCPXSFXKYSXXQLXRIXXAAIFXWTNI

SEQ ID NO: 196885 - protein, 127 aa, Triticum aestivum
  unsure (1)..(127): unsure at all Xaa locations
  Clone ID: PAT_TA_91303.pep
MAPTVMXSSATSVAPFQXLKSTAGLPVSRRXNGAXLXSXSNXXXIXCMXVWPIXGIKEFXTLSYLPPLKHXGLLXXVXLPDPXPKWVXXXXFXQXWVILPINTRXPLXYYXGRYWQCXTAYVGRSTQ

SEQ ID NO: 196886 - protein, 135 aa, Triticum aestivum
  unsure (1)..(135): unsure at all Xaa locations
  Clone ID: PAT_TA_91304.pep
MAPVKLYGATLSWNVTRCVAALEEAGVEYELVPINFGTGEHKSPDHLARNPFGQXASFARMVTXYVXNHRAICNMPCRXNKPRAVEXRXTSKESXLVDFWXKVXAITRRSDPIPNALPPKLGSDRHCETIRLLGH

SEQ ID NO: 196887 - protein, 135 aa, Triticum aestivum
  unsure (1)..(135): unsure at all Xaa locations
  Clone ID: PAT_TA_91305.pep
XFXAXXSXSLFPFLAFLCFLSXRVRXYPFCXRRXIXWQSFSERSXFPXPLQFPPPXXRFLSKFLILPNRFTQFSPSLPDWDMXXIRXXLXRXSSGGLXSGGXDXGHAPXXPAGXKSIGXPXGKLSXVXXGCXXFD

SEQ ID NO: 196888 - protein, 50 aa, Triticum aestivum
  unsure (1)..(50): unsure at all Xaa locations
  Clone ID: PAT_TA_91306.pep
XGXMSSXYXXIICLDXYGXWFXVXRCXSXHVLPPGPXLEXWRXNRTXXXV

SEQ ID NO: 196889 - protein, 100 aa, Triticum aestivum
  unsure (1)..(100): unsure at all Xaa locations
  Clone ID: PAT_TA_91307.pep
LVPNSARGLALELNSTMPSPILPAKEVXEVVTANEQVTDIIXQRVXYWXPPTVRALXXMRADXLSLSTAPSSAXFXXSLILLYXSIATVXGVPETXXXRR

SEQ ID NO: 196890 - protein, 110 aa, Triticum aestivum
  unsure (1)..(110): unsure at all Xaa locations
  Clone ID: PAT_TA_91308.pep
GFXAXDSXSLXPVLAFXCFLSXRVRPYPFCXAXRYILAKFLGKEPLHFXASIPTSDQXXSYPVSXSAXSIQFNSGFLARMDLXSIRCCXVRXSXGGXXIXXGSDXXXQHP

SEQ ID NO: 196891 - protein, 135 aa, Triticum aestivum
  unsure (1)..(135): unsure at all Xaa locations
  Clone ID: PAT_TA_91309.pep
MAXNIXDXPXVELMTELLRRAKCSSKPDKRIILVGPPGSGKGTQSPLIKDEYCLCHLATGDMLRAAVXAKTPLGIKXKEXMDKGQLVSDDLVVGIIDEAXKPSCQKXFILDGFPRTVVQAXKLXECWQTSLVGQI

SEQ ID NO: 196892 - protein, 63 aa, Triticum aestivum
  unsure (1)..(63): unsure at all Xaa locations
  Clone ID: PAT_TA_91310.pep
ARXDMXLFWSSGIKFCFYYGIXHTHVPXNVXIXXXEQPXTXIXGFVXSKRXKXDGRXRAEKXK

SEQ ID NO: 196893 - protein, 92 aa, Triticum aestivum
  Clone ID: PAT_TA_91311.pep
ILFIAGPKPGKRRRVQPQKLSVTPKIHDLVFENCPFSPFYYFSVIWGLHYPSLVKEPVRCNGNMHVSSISKCIVYFFFIVIKLFFILYTLLL

SEQ ID NO: 196894 - protein, 85 aa, Triticum aestivum
  unsure (1)..(85): unsure at all Xaa locations
  Clone ID: PAT_TA_91312.pep
MMINNNGAGVLAFNVSLVSTVLSAPLRQVSTPATCPHLESIVLSXVQAXLQXKVALATGLLXIFXXXCFPQGCDTSSVPRGCHQH

SEQ ID NO: 196895 - protein, 129 aa, Triticum aestivum
  Clone ID: PAT_TA_91313.pep
MEEEEEISGKELLRLDNSLAEAEDAAVASRLTDDLIVEILSRLPFRSVCRFKCVSKPWRDLIAHPAHRKKLPHTLAGVSTQHHRCRRLSLPPGRLAAGVLSRPLTSCTYVKDLSWRMLLLCLQPRNVVP

SEQ ID NO: 196896 - protein, 73 aa, Triticum aestivum
  unsure (1)..(73): unsure at all Xaa locations
  Clone ID: PAT_TA_91314.pep
GRSXIGVNXYRRQKKQXGXXXAXAXKKRXGXXAGAGGRRRKLGVGRRRRGRSRMGVGRRGKKRVGVEPAPLPC

SEQ ID NO: 196897 - protein, 75 aa, Triticum aestivum
  unsure (1)..(75): unsure at all Xaa locations
  Clone ID: PAT_TA_91315.pep
STWPLMVEERLSTLRKFASRLAFISLIYSFWVGEQHRCGFNFLIQGMPKYSFHLFIGIYGVPLKKTXSKIDLKLV

SEQ ID NO: 196898 - protein, 133 aa, Triticum aestivum
  Clone ID: PAT_TA_91316.pep
SRPRPGSKKREVSHRAGMSAVVAQDVAPPIEAASAAEVEWAACACCGLREECTAAYAAGVRAQYAGRWLCGLCGDAVGEELAAAGAGGGGARRKGDREHAASAVVAAAERSSPRSALLEPDGRNRGLVSVKLN

SEQ ID NO: 196899 - protein, 90 aa, Triticum aestivum
  unsure (1)..(90): unsure at all Xaa locations
  Clone ID: PAT_TA_91317.pep
RRSREGRGCGRGTSSSRPRAPVSAAPPPAAPSXRRRRRPSRMGAGXRGXGXGGRGGGRGGGRRSGAGAAAGSRGEGGGGGGAWLVPNSAR

SEQ ID NO: 196900 - protein, 96 aa, Triticum aestivum
  unsure (1)..(96): unsure at all Xaa locations
  Clone ID: PAT_TA_91318.pep
MAETEYRCFVGXLAWATDDNNLQQAFSQYGEILDAKIINDRXXGRSRGFGFXTFGSEEXMRQXIXEMXGMELXRXNITVIXXQSRRSGGXXGSSGY

SEQ ID NO: 196901 - protein, 156 aa, Triticum aestivum
  unsure (1)..(156): unsure at all Xaa locations
  Clone ID: PAT_TA_91319.pep
MIKLAFLIRGTALLLCLLIFQAASTSHGLSVSGACISSERDALLSLKASLLDPAGRLSSWQGEDCCQWKGVRCSNRTGHLIKLNLRNINMNDMGYYMYDYVYDXSTTATTRARSLSLSAGEMSSSLAXLQHLXYLDLNWDYXNGTSIPVXLXSLKN

SEQ ID NO: 196902 - protein, 90 aa, Triticum aestivum
  unsure (1)..(90): unsure at all Xaa locations
  Clone ID: PAT_TA_91320.pep
SPRPXAILTSXCLXLRFRRRCPPLQXLQHLXRNHRKYXKTGXTNRIYXDLIHXTXTMXLLXPALXFXIRPXYIXLGPSSCXRLFPXSLLX

SEQ ID NO: 196903 - protein, 118 aa, Triticum aestivum
  unsure (1)..(118): unsure at all Xaa locations
  Clone ID: PAT_TA_91321.pep
KQRNPPDPIPSSAPHHDPPSHHAPPPRAATPXPAVSPCPAAAQRHPMTRHRTTPRRRALPPHDPPPHHTPPPRASTPCPAATRIHLLPRRRAPPPPVPPPRAQDSTGRRSREPDQPRP

SEQ ID NO: 196904 - protein, 114 aa, Triticum aestivum
  unsure (1)..(114): unsure at all Xaa locations
  Clone ID: PAT_TA_91322.pep
MTTEKGSSASLGRPCILIIVXAGVERFAFKGVASNMVNYLTGVVGMSTAAAAXSVSAWVXITXMLPLVNAVLADSYWDRTQRHAYPCSMSRAGRQLMGMLKMIMATSLSLFGKG

SEQ ID NO: 196905 - protein, 82 aa, Triticum aestivum
  unsure (1)..(82): unsure at all Xaa locations
  Clone ID: PAT_TA_91323.pep
VGFIFREHNASPGYYDGRYWTMWKLPMFGCTDATQVXNEVEEVKKEYPDAYVRIIGFXNMRXVXCVSFIAFKPXGCEESGKA

SEQ ID NO: 196906 - protein, 123 aa, Triticum aestivum
  unsure (1)..(123): unsure at all Xaa locations
  Clone ID: PAT_TA_91324.pep
MGCFAFKGGKGRRRPAGGGKPPPAEPKPDGPKRSKASSSSASTPTRSIQELSEERGAARLRVFGLEELGSATNGFSRALKIGXGGFGSVYRAFFRSAAGGRVVLAVKRLNQRNLQGHKQWLAK

SEQ ID NO: 196907 - protein, 165 aa, Triticum aestivum
  unsure (1)..(165): unsure at all Xaa locations
  Clone ID: PAT_TA_91325.pep
SSPRATAASSRPPSRSSTPTPSSPSPSPSSTPTPSPPPSSSTSACWPGRTTATTSTRRNATRRFGDTXRSCSSSTSRTSPAKLVTRVAVALAASATCADRRPRSLANSFRRQDRGTWQRRLVASQVARRGSLLPLVLWTPGCAGRKARVLRYCVPLFLNAGSRVR

SEQ ID NO: 196908 - protein, 101 aa, Triticum aestivum
  unsure (1)..(101): unsure at all Xaa locations
  Clone ID: PAT_TA_91326.pep
MPAGXXLXSRTRDLFXRPFRKKGYIPLTTYLXTYKVXEHVXXKVNXAVHXXMPXKFXHXRXXRSAXXQSAPSVXYNXQVXNRISRXGSFRXXHSAQVHDSH

SEQ ID NO: 196909 - protein, 113 aa, Triticum aestivum
  unsure (1)..(113): unsure at all Xaa locations
  Clone ID: PAT_TA_91327.pep
MARGLKKHLKRLNAPSHWMLDKLGGAFAPKPSSGPHKARECLPLILILRNRLKYALTYREVQSILMQRHIMVDGKXRTDKTXPAXGFMDIISIPKTVXIXVXYDTXVPSLLQG

SEQ ID NO: 196910 - protein, 64 aa, Triticum aestivum
  Clone ID: PAT_TA_91328.pep
MEEACEIRLPEELLSAALARTTPRDACRAAAVSPAFRAAVDSDDVWAGFLPPDSRPRLWGFHLV

SEQ ID NO: 196911 - protein, 63 aa, Triticum aestivum
  unsure (1)..(63): unsure at all Xaa locations
  Clone ID: PAT_TA_91329.pep
MXETXYRCFVGGLAXATDDHKLQQAFSQYGXILXXKIXNDRXTGXXRXFXFVXFXIXESIPHL

SEQ ID NO: 196912 - protein, 87 aa, Triticum aestivum
  Clone ID: PAT_TA_91330.pep
QSSRDAPRTAQLALSPVHRRSPFVSSRRGVGGRGWDADVVVDLLDCSTRQTSIAARLLDCGTCGIWCRPPHLQEYASVQPLGKRQYN

SEQ ID NO: 196913 - protein, 163 aa, Triticum aestivum
  unsure (1)..(163): unsure at all Xaa locations
  Clone ID: PAT_TA_91331.pep
FFFFAKIGXNXEVCNCTCPXXKSVQKFVVQQTEXCAKXRVVXQXXSCSXKKMSXNFPHLSPWFSIVAQPPPRCFQRFHRLVAAKTAASSSIAVSPGCTPSPRLQHTEHPRVAVARGASSRTPGLHELQCVVTAVVAPQSHGCSTWCTSVSHHGGHAMACGRIE

SEQ ID NO: 196914 - protein, 75 aa, Triticum aestivum
  Clone ID: PAT_TA_91332.pep
TSNKEPRMNHANSSGSSPEKQPRSSDRGISLVQEKRETRLGFLRQPERFDRKHGEFRQDDDLASGFTEEGIGPFA

SEQ ID NO: 196915 - protein, 168 aa, Triticum aestivum
  unsure (1)..(168): unsure at all Xaa locations
  Clone ID: PAT_TA_91333.pep
PPCRFAPPTHAEGTENHTHHHPYRASPRRASQSTIQPATQANQSPPSPLHLAWINGSPPRPALLSRLLGTVAAASPAHPARFGAAPRERERHGAPQERPSAAAPPPRXRGGHXRGGCXTTPPPXRATXSLYRACXKNVXXWEPXRGSFKTXXSXRXXPXXRIXXHXXS

SEQ ID NO: 196916 - protein, 77 aa, Triticum aestivum
  unsure (1)..(77): unsure at all Xaa locations
  Clone ID: PAT_TA_91334.pep
MAAALSLRAPFSLRAVAPPAPRVALAPAALSLAAAKQVRGARLRAQATYKVKLVTPEGEVELEVPDDVYILDQPKXE

SEQ ID NO: 196917 - protein, 100 aa, Triticum aestivum
  unsure (1)..(100): unsure at all Xaa locations
  Clone ID: PAT_TA_91335.pep
GPXFGFLKKPXXGPKNFFXXGXVXPXFFPLEWXPRLPPXXFFLPXXGVSPQXLFXLGTTXPXFPEXSFXSPXGXPXLSFLGAGPPTPXVELPSFLFPLLV

SEQ ID NO: 196918 - protein, 149 aa, Triticum aestivum
  unsure (1)..(149): unsure at all Xaa locations
  Clone ID: PAT_TA_91336.pep
RFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGXVKQMICCCNKMDATTPKYSKAVMRKSSRNFVPERVPEKSLRPPG

SEQ ID NO: 196919 - protein, 85 aa, Triticum aestivum
  Clone ID: PAT_TA_91337.pep
KNKLFQFVFALGNIVNHWEREDHCGNETSELHLKKVFLLFASMQVFRRELRSIHLLDYYEAGPNELQLKCKRRRRTAFSKKQHRN

SEQ ID NO: 196920 - protein, 137 aa, Triticum aestivum
  unsure (1)..(137): unsure at all Xaa locations
  Clone ID: PAT_TA_91338.pep
MQIFVKTLTGKTITLEVESSDTIDNVKAKIQXDKEGIPPDQXQRLIFAGKQSEDGRTXAXYNIQEGXTSNLVXKSVXVAIFQNLNXKTSLXLXSNTFISXSKFKTRXIQXTTTLXXLGTTQDGDLSDXTSXRSSXLG

SEQ ID NO: 196921 - protein, 106 aa, Triticum aestivum
  unsure (1)..(106): unsure at all Xaa locations
  Clone ID: PAT_TA_91339.pep
ELLGVKLTAIMVGYCCTKIGEDDWCFVFRILQKWIESSVLLVEEMTDGVNDAVIHRTSAXGIFWEKLKLIACTXEELTLLFAESCXGTLCCLQPLTSPNEPQTPAY

SEQ ID NO: 196922 - protein, 52 aa, Triticum aestivum
  Clone ID: PAT_TA_91340.pep
SAQHRGGGAVVGAVILVGFWLLRGGVGGGGGVSRDHRHRSPVEQCLTPGPGW

SEQ ID NO: 196923 - protein, 141 aa, Triticum aestivum
  unsure (1)..(141): unsure at all Xaa locations
  Clone ID: PAT_TA_91341.pep
MQIFVKTLTGKTITLEVESSDTIDNVKAKIQDKEGIPPDXQRLIFAGQAVEDGRTLXDYNIQKXXTSTLVLKSVGGMQFSVXDLXREDITLRLSPPETIDNFKASFKDKEDSPRTNTLTSPLEDRPFYKSRRTLTVGGDEF

SEQ ID NO: 196924 - protein, 134 aa, Triticum aestivum
  unsure (1)..(134): unsure at all Xaa locations
  Clone ID: PAT_TA_91342.pep
MAAAFSSTVGAPASTPTNFLGKKLKKQVTSAVNYHGKSSKANRFTVMAXENLRREEEHGQXKXLPYDISDDQQXTXREKXXGSLFQAPTAXGPRXVLNSLXILNQGSKNSLXTHMGXSNRPALMDNXLSTLQDH

SEQ ID NO: 196925 - protein, 112 aa, Triticum aestivum
  unsure (1)..(112): unsure at all Xaa locations
  Clone ID: PAT_TA_91343.pep
MADQLTDDQIAEFKEGLQXLSDKDGDGCITTKEWXTXCVPLGAKPTEAXSXDMXNEVRCXNGTDIDFPDSXNLNXRKXKDTDSRGXXQRSFKVXXQRTKTFISFRLTPFNDE

SEQ ID NO: 196926 - protein, 80 aa, Triticum aestivum
  unsure (1)..(80): unsure at all Xaa locations
  Clone ID: PAT_TA_91344.pep
MSCCGGSCGCGSACKCGNGCGGCNMYPEVEXAAGATLLVRRHRHPQGESGGMEMAAEXGGCGCTQCKCGPVPLSCCSANY

SEQ ID NO: 196927 - protein, 97 aa, Triticum aestivum
  unsure (1)..(97): unsure at all Xaa locations
  Clone ID: PAT_TA_91345.pep
GDPNLRAGVHHSMDMYGSGGMGNPEYGLQRNRSYSFNEGVDFFQPRRADPNFRVDVHHSMNIYGSGAMGNSEHGFQMNQSYPFDEGANFFQPGRXRP

SEQ ID NO: 196928 - protein, 92 aa, Triticum aestivum
  Clone ID: PAT_TA_91346.pep
VGTRRTQSKDDCRFGGAISEPTPRIQPPLLLQQPLLASGRVNRQSPHLDPPARETTIPPVQSNQAITAAVDSHSHHIPPPLLQPAPSSRVST

SEQ ID NO: 196929 - protein, 119 aa, Triticum aestivum
  unsure (1)..(119): unsure at all Xaa locations
  Clone ID: PAT_TA_91347.pep
MVAPAAVSTFSSFSSSSSSVAPRTHRRGLLSTRAPLPPARTVASSRAPLVVSSPPPTPAPAPGHAKVDRSGRFCSPRAARELALMVSYAACLEGXDVVRXFDXRXGXRRXLAMFNSLNL

SEQ ID NO: 196930 - protein, 152 aa, Triticum aestivum
  unsure (1)..(152): unsure at all Xaa locations
  Clone ID: PAT_TA_91348.pep
MLVYQDKLSGDELLSDSFPYRELENGVLWEVDGHWVVQGAVDVDIGANPSAEGGGDDEGVEXTKAVKVVDIVDTFRLXEQPAFDKKQFISHMKALHXKNLSAKLEGDDXDVXRKNVESATKYLXNKLXDFNSWWRKHHDDGXVVFAYTRRNC

SEQ ID NO: 196931 - protein, 137 aa, Triticum aestivum
  unsure (1)..(137): unsure at all Xaa locations
  Clone ID: PAT_TA_91349.pep
MSGRKKTREPKEENVTLGPAVREGEHVFGVAHIFASFNDTFIHVTDLSGRETLVRITGGMXVKADRDESSPYAAMLASQDVAVRCKELGITALHIKLRATGXGNKTKTPSPGCSKLRLKLXTSGMKIGRIEDVTRSN

SEQ ID NO: 196932 - protein, 110 aa, Triticum aestivum
  unsure (1)..(110): unsure at all Xaa locations
  Clone ID: PAT_TA_91350.pep
MDSVASWGLTPLADADPDVFDLIEREKRRQRSGIELIASENFTSFAVIEALGSASPTSIRGXPGARYYXGNDXIDEXRELCRDRALAAXXLDAASWGVKVQPTPVARKAA

SEQ ID NO: 196933 - protein, 51 aa, Triticum aestivum
  Clone ID: PAT_TA_91351.pep
VHRSNRSLIVLMTKVGMSNISNGQMLAKHWLYINFRCQSHKRLRLLNVGNF

SEQ ID NO: 196934 - protein, 57 aa, Triticum aestivum
  Clone ID: PAT_TA_91352.pep
MAAKEPMRVLVTGAAGQIGYALVPMIARGVMLGARPACYLHMLDIDLLLNSLKGQMV

SEQ ID NO: 196935 - protein, 181 aa, Triticum aestivum
  unsure (1)..(181): unsure at all Xaa locations
  Clone ID: PAT_TA_91353.pep
MAASLQAAATLMPAKIGGRASSARPSSHVARAFGVDAGARITCSLQSDIREVASKCADAAKMAXFALANSALLVSXASAEGAPKXXFXEISKQDYIXVXGNGTANXCPTSTXVILPFXGGSTDEEFCLEHSLTSRIKRTTAGFKTSHTANTQWKALKSGTFRRIISRTLPRNRAFLSPRTQ

SEQ ID NO: 196936 - protein, 146 aa, Triticum aestivum
  unsure (1)..(146): unsure at all Xaa locations
  Clone ID: PAT_TA_91354.pep
MAASASRISLVVLLVALATAASGQLSPTFYDTSCPXALATIKXXLXAXLSKQPPHXASLLPAEFQHCFLQSCXSVLLSGMDKTGSELYSLXAFXVIRYIKXQLXGYMQQDVSCAESCGRDPSPRGAMILEKDHRSQTKMSKLKSTG

SEQ ID NO: 196937 - protein, 104 aa, Triticum aestivum
  unsure (1)..(104): unsure at all Xaa locations
  Clone ID: PAT_TA_91355.pep
FRHIMGICRKYPYRITKSGNKEAGKLNASRYSSXKGIEEILRSXKDGIDLKKELTSEPIALTTNFGIDQMHNYIAHHXFVTLLRNQAKXXHSNXVSXSISGXGK

SEQ ID NO: 196938 - protein, 181 aa, Triticum aestivum
  unsure (1)..(181): unsure at all Xaa locations
  Clone ID: PAT_TA_91356.pep
LEQREKXWICTQKLSAQERVDTGGEEXGEEXACKXGQTCXRLSTLGESSKIHHLVNGSTRSXFPQGDTNPWKKQRRLGERERPPKEEKRNRIGAAGARFMACMRTAYLIPKEQGARLGRRSPDKIGLRWGHSKQDKASSCLFPAVDAGKDGCEAMERQGEMDRLIDGGTSPKGERELTERG

SEQ ID NO: 196939 - protein, 98 aa, Triticum aestivum
  unsure (1)..(98): unsure at all Xaa locations
  Clone ID: PAT_TA_91357.pep
VRGKVDPGLQPLPVMSPGGASIPNIETXPGSSGQPDEEYKPNAAMEEMIITFLIRVSLVIEPKEKESSSMYKQALDLLTQALEVWPNANVKFNYLEKL

SEQ ID NO: 196940 - protein, 106 aa, Triticum aestivum
  unsure (1)..(106): unsure at all Xaa locations
  Clone ID: PAT_TA_91358.pep
XXIFFPNQPTXLKVXRHLLMLQYPGPEHFSMASSSKKSVVGVLGSEPASHPGLFFDLGRGGGKEVADEEKVRGKRRGWCVSHGGGRRWWWRRQTREREREKVREAE

SEQ ID NO: 196941 - protein, 140 aa, Triticum aestivum
  unsure (1)..(140): unsure at all Xaa locations
  Clone ID: PAT_TA_91359.pep
MAPTVMASSATSVAPFQGLKSTAGLPVSRRSNGASLGSVSNGGRIRCMQVWPIEGIKXFETLSYLPPLXTEALLKQVDYLIRSKWVPCLXSTSWVHLPVEHNASPGYYDXRYWTMXELLCFGCTDAXQVXNEVEEVKKDT

SEQ ID NO: 196942 - protein, 109 aa, Triticum aestivum
  unsure (1)..(109): unsure at all Xaa locations
  Clone ID: PAT_TA_91360.pep
LVPNSARAGAPYPCEHGRSRPESSPSATARVPSHRRPAATTSGPRPPPPXAAGTGPPPAPPPSFLGQPPPPPPPGATPATSPXAVQGGRSTTDCALHLKPAGYHQWRER

SEQ ID NO: 196943 - protein, 115 aa, Triticum aestivum
  unsure (1)..(115): unsure at all Xaa locations
  Clone ID: PAT_TA_91361.pep
ELVSSFFFFFFFFAPNNILTKPIINPFXXPXXTXXNPXVQNTGALDXRXXQSDXSPNPVWRTHXHLLMVDVMGXSTARFXXSPXGXLLXGSDAGLLGXAPWGPTEFIGRXGVXXX

SEQ ID NO: 196944 - protein, 144 aa, Triticum aestivum
  unsure (1)..(144): unsure at all Xaa locations
  Clone ID: PAT_TA_91362.pep
ERGITIDIALWKFETTKYYCTVIDAPGHRDFIKNMITGTSQADCAVLIIDSTTGGFEAXGISKDGQXTREHALLAFTLGVKQMICCCNKMDATTPKYSKXRYEEFQGSLLLKKXVHLTVPFPIXGFKGDNMIESHNFTTKAYLL

SEQ ID NO: 196945 - protein, 57 aa, Triticum aestivum
  unsure (1)..(57): unsure at all Xaa locations
  Clone ID: PAT_TA_91363.pep
WPKNLSMPXYNKINLFXRVMXXIKXFSXVXPVHEPREESIASPRSSYXSAXXLXTRT

SEQ ID NO: 196946 - protein, 157 aa, Triticum aestivum
  unsure (1)..(157): unsure at all Xaa locations
  Clone ID: PAT_TA_91364.pep
MAAAFSSTVGAPASTPTNFLGKEAQRSXLTSAVNYHGKSPRPTGHXMAAENIDEKRNTDKWKGLAXYDISDDQQEYQEGKGSXGSLFQAPLGERNHEASQSYDTAKIKNTLQTWSSNPHGLLSKMTCQHSTGYWEEGKEILINCLARWITIIYAELK

SEQ ID NO: 196947 - protein, 171 aa, Triticum aestivum
  unsure (1)..(171): unsure at all Xaa locations
  Clone ID: PAT_TA_91365.pep
KTLPAKTITFESXPLETXQVKXKFQDKEXSPXXXVSXFAXNTXRLRTXAXYNIQKXSTSTGLKSVXGMQIFCQNLTGKTSPXRLILKHIYNVEXKFKDKEGIPPDQXLHLWLXTLEDGXTFQDYNIKRIISTGKVDISKSRKTSPEVSLEHCKLGKSGIPASTSIRTVKQP

SEQ ID NO: 196948 - protein, 162 aa, Triticum aestivum
  unsure (1)..(162): unsure at all Xaa locations
  Clone ID: PAT_TA_91366.pep
SHRDARRRELLPFALTPWRRRRRRTQPPGSSCPARPERLVPSSRASIQYGSEAAPPYASSGASSCAKSIFEQSRCPGTSRCPXIPLLGKXXKFXVXNXXEILPEFXGPFLSPXXLNQXHXXRXNLNXRQXGLSXISSXKYXXKEQXRIPQKGKTLRLXLRXG

SEQ ID NO: 196949 - protein, 149 aa, Triticum aestivum
  unsure (1)..(149): unsure at all Xaa locations
  Clone ID: PAT_TA_91367.pep
LFYMIRQYIXQDSLXKRXTXLFSGIFQVLFLNRIFEIVGASFWXKYGFLFXXLXCKEFSDNSFXPXYLIXXSRASSRVTALFXNGXGRSFGKDTPTTTQSRWEWKRRRDLSAVGGGGMEXRAPIXRVKRRRRXGRLSKLGFWLENLGAV

SEQ ID NO: 196950 - protein, 86 aa, Triticum aestivum
  Clone ID: PAT_TA_91368.pep
STTSRWHPRRSRQQPPPPPPPCPAAPAPPLPPPPLHSPSCPLPVPSPPPPGAAPSPSPPRATHGAAGTRRRRRARDSPRRAAAART

SEQ ID NO: 196951 - protein, 66 aa, Triticum aestivum
  Clone ID: PAT_TA_91369.pep
PPPLGQVVIHRDIKASNVLLDKQMNGRLGDFGLARLYDHGTDAQTTHVVGTMGYLAPLSMTNRSTP

SEQ ID NO: 196952 - protein, 131 aa, Triticum aestivum
  unsure (1)..(131): unsure at all Xaa locations
  Clone ID: PAT_TA_91370.pep
MPAALRALTVLYALAVLAGNQVEGRHHQPDCPSFSCGLLGNISSPFRRASDPPGCGYRSYELGLQVIPKATIHIGGATLLCVXGINYSNPPFWVXDADLVTTASTPVGSSITRLHIQLPCTTPGCFVKSPR

SEQ ID NO: 196953 - protein, 82 aa, Triticum aestivum
  unsure (1)..(82): unsure at all Xaa locations
  Clone ID: PAT_TA_91371.pep
RGXRXGRGLPHFPEVXFVLVXFSXLGNRRXRRRCRCGHHRLGRSTRTCRRRRQRRAGSPRPPCGGTGGGASPPTWLADRLAS

SEQ ID NO: 196954 - protein, 44 aa, Triticum aestivum
  unsure (1)..(44): unsure at all Xaa locations
  Clone ID: PAT_TA_91372.pep
GEKCXTSIXXXRXRKLRQKSXIIXTSRNQSRSDEIPTITDAKRG

SEQ ID NO: 196955 - protein, 134 aa, Triticum aestivum
  unsure (1)..(134): unsure at all Xaa locations
  Clone ID: PAT_TA_91373.pep
MLLLTIPRILELAEELCMPLAAVKYSRGMFIFPGAQPAPHRSFSEEFDVLNRYSGHLXXGGNAMLIXGRPSEAGRKWNLLSTNLSSHGTWNFMTGLARRALSSNTDAVPCPRNTILRINTNGGCDSIPWGTHEP

SEQ ID NO: 196956 - protein, 44 aa, Triticum aestivum
  Clone ID: PAT_TA_91374.pep
YKCLPRLLCLSSFWILCNPLRPTTINLVHHFVSYVKQTMTILCV

SEQ ID NO: 196957 - protein, 157 aa, Triticum aestivum
  unsure (1)..(157): unsure at all Xaa locations
  Clone ID: PAT_TA_91375.pep
HGLXLASXRXDISTTLPGPGSVRQHVRISAERHATGRWSATGEQLLSXYIPPLQXNDILVPQYTQIVREMKTWRPPLKVELKKSRXRALVAGYPQLLVETWKXNNATQXFPKLMTGXTSKXXLPSPXXTGRXSXXPXVXTFXKEEXLXXLXRXLKHQ

SEQ ID NO: 196958 - protein, 160 aa, Triticum aestivum
  unsure (1)..(160): unsure at all Xaa locations
  Clone ID: PAT_TA_91376.pep
SXLRXPRXPGQNDXWKNNPTSRGSILRVSLGLGRKAAGQEVXEHRXRSECNGALASXFEQDFESLDLTGXHXNSVLRHYXXPXITIRLAVRSXSSLPNCPVLFLPKKNISXXRLANKXDXNXRXTQXVLDPAXNSVCVSTALXRRDPVLCACQGLRXSQT

SEQ ID NO: 196959 - protein, 127 aa, Triticum aestivum
  unsure (1)..(127): unsure at all Xaa locations
  Clone ID: PAT_TA_91377.pep
MQIFVKTLTGKTITLEVESSDTIDNVKAKIQGQGGHPPGTKQRLIFAGXSSPXMGAPFRDYNIQKGSTSNWFSRSVXXMQNFSKTSTGKTITLXFNPQNTIXKVXGXFQXXXGSQPGKNFGTEWRTR

SEQ ID NO: 196960 - protein, 179 aa, Triticum aestivum
  unsure (1)..(179): unsure at all Xaa locations
  Clone ID: PAT_TA_91378.pep
MAPTVMASSATSVAPFQGLKSTAGLPVSRRSNGASLGSVSNGGRIRCMXVWPSEGIKXIRDLSYLPPLNTEXLLKQVDTDSVQWGAFLXLTRSGXIFRXHNALPGYNXGXYWXCXNCLFPGGTDXXKVINELXGGQEGLLIIHKSQCMLNLCNHGKIGRLKYTGTLMHFYMLGFSILYS

SEQ ID NO: 196961 - protein, 119 aa, Triticum aestivum
  unsure (1)..(119): unsure at all Xaa locations
  Clone ID: PAT_TA_91379.pep
LVPNSARGGSLFKVPEALIPPAGARVMSLTDGLSKMSKSAPSDLSRINLLDPNDVIVNKIKRCKTDSLPGLXNSDNPERPECXNLLSVYQFTLGKTKEEVLSECQDMNWGDFKVPLRMP

SEQ ID NO: 196962 - protein, 123 aa, Triticum aestivum
  unsure (1)..(123): unsure at all Xaa locations
  Clone ID: PAT_TA_91380.pep
GFXLRRRPXXMSLSSRLXSDXDQDAAVARDPGMAPVAGVRRRRRRXLRGVDSPKISVKDDGSTAGSSFLWWVWLLQADSTSSRVGFSGNGFSNSRRSAPSPIQQAAPLSQSDVIKRLQYFFGT

SEQ ID NO: 196963 - protein, 135 aa, Triticum aestivum
  unsure (1)..(135): unsure at all Xaa locations
  Clone ID: PAT_TA_91381.pep
PCWVDAHTDLKLRGRLPSHLISSEGDGLQSAVAAAASSSRRRRRSAAAGFRGASAAAVREEYXRTLXSSPNPSQGSAVVYAVLPPKTRAQRRRNLRGFPEXPXGXQQRFPPDQAQGKQVPAAXXLRKLSQQXGAI

SEQ ID NO: 196964 - protein, 95 aa, Triticum aestivum
  unsure (1)..(95): unsure at all Xaa locations
  Clone ID: PAT_TA_91382.pep
GLTLXCSQGSLDCLFVSLSKHVISTLVSPQRVTRPSRHGCYGGDGQGHGATTAFDAQTSIQCLQRRPTRGNVFDNGGSNSDGPAVPVCGGAEFGT

SEQ ID NO: 196965 - protein, 90 aa, Triticum aestivum
  unsure (1)..(90): unsure at all Xaa locations
  Clone ID: PAT_TA_91383.pep
RCQPYPSPGSTSDLDSVADTRSTMNSRRLASPCTVPEETHACSGGPELQVRYAGLADSDLAMETVLSQIHGPIEIQLNGAHIXEIRYFLF

SEQ ID NO: 196966 - protein, 168 aa, Triticum aestivum
  unsure (1)..(168): unsure at all Xaa locations
  Clone ID: PAT_TA_91384.pep
MALSPSSFAGKAVKDLPSSALFGEARVTMRKTAAKAKPVSSGSPWYGSDRVLYLGPLSGDPPSYLTGEFPGDYGWDTAGLSADPETFAKNRELEVXHCRWAMLGALGCVFPELLARNGVKFGEAXWFKGGPSXKQGGSITRPTSQARSCIWAASLYGPSRYAPGPRKL

SEQ ID NO: 196967 - protein, 87 aa, Triticum aestivum
  unsure (1)..(87): unsure at all Xaa locations
  Clone ID: PAT_TA_91385.pep
DWGXNKRQXQXPXAPARCRLRSXILAAGPXLXSXMXGTGXSMLLSLXLFAVTLXLLXMYXXWITXXXAXXHLRRIXQLPPLRXPXQL

SEQ ID NO: 196968 - protein, 114 aa, Triticum aestivum
  unsure (1)..(114): unsure at all Xaa locations
  Clone ID: PAT_TA_91386.pep
MSDTDEHHFESKADSGASKTYPQQAGAIRKGGHIVIKARPCKVVEVSTSKTGKHGHAKCHFVAIDIFNGKKLEDIVPSSXNCDVPHVDRQDYQLIDITDDGXSLLTXNGNXKDD

SEQ ID NO: 196969 - protein, 137 aa, Triticum aestivum
  unsure (1)..(137): unsure at all Xaa locations
  Clone ID: PAT_TA_91387.pep
MALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWXKAVQIFTAAH

SEQ ID NO: 196970 - protein, 87 aa, Triticum aestivum
  unsure (1)..(87): unsure at all Xaa locations
  Clone ID: PAT_TA_91388.pep
VAGSFFQARGQRSISLPTAWELSTVSRSISLPTXGFFSPFPHGTTSLSVTQEYLALQGGPCXFTRDSTCPMLLGSERKLVMLSATGL

SEQ ID NO: 196971 - protein, 46 aa, Triticum aestivum
  Clone ID: PAT_TA_91389.pep
HHCQLGLWCIQMRSCDRPTMGEVIEILEAGTDSLQMPSRPFFCPSS

SEQ ID NO: 196972 - protein, 99 aa, Triticum aestivum
  unsure (1)..(99): unsure at all Xaa locations
  Clone ID: PAT_TA_91390.pep
PXFXGXRXLCHVDELMLLXGFEHLXYFAVRTXAAMPFSPCTPEQHSLLNRGRPSPSRTPRTARAWSPTCPHGQRRRGXPAGHHQHHRXQDHGGQPQPCC

SEQ ID NO: 196973 - protein, 125 aa, Triticum aestivum
  unsure (1)..(125): unsure at all Xaa locations
  Clone ID: PAT_TA_91391.pep
GKGFPRFVXKQPTGPYMVGVGAEAAQSGPKEGQGKERNKSDKRXIXKKEELAIAAPHQNLPXXSKIRKRRHLINTSKTDHDDDGCCCQGFPPLHGRRRRGRVAPTPSRKVRWHPQAPPRRCWPCR

SEQ ID NO: 196974 - protein, 90 aa, Triticum aestivum
  unsure (1)..(90): unsure at all Xaa locations
  Clone ID: PAT_TA_91392.pep
TAEIHRNSTRCRSTSECMRSLGEQEHASVGDSGFYMDGTQEQQYVLHTSTTYPQFSTTCTPTLQXCPYLTPFALGLAVKLKQQDTAWIXD

SEQ ID NO: 196975 - protein, 131 aa, Triticum aestivum
  unsure (1)..(131): unsure at all Xaa locations
  Clone ID: PAT_TA_91393.pep
MAVTFSDLHTADGLKALEAHLAGKTYISGDGIXTKDDVKVFAXVPVEASAXFPNAARGYDTVAAAVASXFPWHPLGEXSSGPAATVLPLSKDXRHXXEWFCFGNKTKXGQXIAXNLRCKPAXKKKWKPLPQ

SEQ ID NO: 196976 - protein, 162 aa, Triticum aestivum
  unsure (1)..(162): unsure at all Xaa locations
  Clone ID: PAT_TA_91394.pep
MAASLFRLSRPRRVLLPLSALRLPFSTQPLPQPRDPSSPNSNRGLPAFLSFLAAAAAGGITGSVALCDAGPTTGXAGKDNTRLLVRXGNAXAFQGIHRKXASFLRGRTDVVTKEKTFQRDPQEYFNKESKCRLXLXPXPNMKXRICDXCXXYKXPMYKWXGQ

SEQ ID NO: 196977 - protein, 192 aa, Triticum aestivum
  unsure (1)..(192): unsure at all Xaa locations
  Clone ID: PAT_TA_91395.pep
PSSLSSPHPHDPCPSILPPQMQPATQPPTPSQPSPLLPPSSARRSPAGSTPSPAINAPAHSXXPPSLPRYPTPPSAESMXXPRPLPRRPCSPTPDXKATPRTAGDGFGHTVMPAPPNRPTAGSRRAGPLAARCRWFKPRRSPSPTRLKARGLLPPGIANKNSVVARLNRTLSLTLAIGTLGHVGGRSPPRLH

SEQ ID NO: 196978 - protein, 120 aa, Triticum aestivum
  unsure (1)..(120): unsure at all Xaa locations
  Clone ID: PAT_TA_91396.pep
RWPASAAVYEYSVSPMSQFYLPVSTYRQTDNEDVEIRYIPKGNSKMGVISIEKTSHLQSSLQFKLFXDGEEFGSNIIFKPTHKRRRPKPMLFNKIEPQIGQELKNSLNGDKYKYINSKKK

SEQ ID NO: 196979 - protein, 140 aa, Triticum aestivum
  unsure (1)..(140): unsure at all Xaa locations
  Clone ID: PAT_TA_91397.pep
SCRIRHEPPPLRRGAGRSGAGEAARVSHAPPPLPHSVDRMALVPSGDQAAACKATIPWSEMFRSASVRRPKQAEDPPKPAPTSPGKKAAPPAEAEGLSLGAGRAPGALHRHGARGARHGLLVSXGFXXCSPLXRXVXWAL

SEQ ID NO: 196980 - protein, 155 aa, Triticum aestivum
  unsure (1)..(155): unsure at all Xaa locations
  Clone ID: PAT_TA_91398.pep
MAPTVMASSATSVAPFQGLKSTAGLPVSRRSNGASLGSVSNGGRIRCMQCWPIRGHQEFRDPVLLPPLNTXASLXVDYLIPLQVGPCLQFNKXFIFPFSTTTPGYYDGXYWAXWXLPIFXCTDXTQVINEVXGVQEGYLTLCRINRHNSACVNTP

SEQ ID NO: 196981 - protein, 31 aa, Triticum aestivum
  Clone ID: PAT_TA_91399.pep
VTSLYITSISNCQSFIGNLLSKPFLVPNSAR

SEQ ID NO: 196982 - protein, 118 aa, Triticum aestivum
  unsure (1)..(118): unsure at all Xaa locations
  Clone ID: PAT_TA_91400.pep
KSPRREKKRRKGNTPQAYRRAVLKRRYPDHQVICCKGCRNSRASXLACRFFQXFMASAPSKNLENXLXFKGXRAYPDYGNIRLPKVSXKPWHCGNHVSSXFXQIAWFDPKVXXXNPLT

SEQ ID NO: 196983 - protein, 145 aa, Triticum aestivum
  unsure (1)..(145): unsure at all Xaa locations
  Clone ID: PAT_TA_91401.pep
XPYPLYIYIXSGPIXYAGXEFHPLGNDIARXRXXXKQIMVXXFGLXLVLMSXXPPFFLXRDSLVASFAIFXIQQSXLGSANIVCIVKHTIFSHITFKQVSDEHRXEFQIASFTDLTSDLVFFLGWQFIFWEYNMLSLPMWWRYSW

SEQ ID NO: 196984 - protein, 138 aa, Triticum aestivum
  unsure (1)..(138): unsure at all Xaa locations
  Clone ID: PAT_TA_91402.pep
MAPVKLYGATLSWNVTRCVAALEEAGVEYELVPINFGTGEHKSPDHLAXRNPFGQVPALQDGDLYXFQXRAICNYAFRKNXPDCLKEGDIKESXMGGCVVQXEGHQLHRRLTHSLQCLXXPXLXGXTDKKXLXTLVKI

SEQ ID NO: 196985 - protein, 92 aa, Triticum aestivum
  unsure (1)..(92): unsure at all Xaa locations
  Clone ID: PAT_TA_91403.pep
MAASLQAAATLMPAKIGGRASSARPSSHVARAFGVDAGARITCSLQSDIREVASNXADAAKMAXFALRHSALLVSXAXGGGRPRDFTNSKQD

SEQ ID NO: 196986 - protein, 68 aa, Triticum aestivum
  unsure (1)..(68): unsure at all Xaa locations
  Clone ID: PAT_TA_91404.pep
MAXTXYRCFVGGLAWATDDNNLQQAFSQYGXILDAKIINXDRETGRSPXGXGFVTFCSXESMRXAIHG

SEQ ID NO: 196987 - protein, 102 aa, Triticum aestivum
  unsure (1)..(102): unsure at all Xaa locations
  Clone ID: PAT_TA_91405.pep
PFQVTAAARGRKPTARAVRDMVRRLKPAVLRRLTTSVIKIYTPSHHFLKTATXKEGVHSNTYVSLNGPTKVKEQTLSITLDPLLNGFSXDNTTQTDFTIXNT

SEQ ID NO: 196988 - protein, 50 aa, Triticum aestivum
  unsure (1)..(50): unsure at all Xaa locations
  Clone ID: PAT_TA_91406.pep
RXEXTGHXXPSSWSPCHCPRKGFTGXPXSCRIFSXXXLQXMDSLCXXDYX

SEQ ID NO: 196989 - protein, 223 aa, Triticum aestivum
  unsure (1)..(223): unsure at all Xaa locations
  Clone ID: PAT_TA_91407.pep
PPPTSQPRPPLHRRRPLPLSLDAYPLEQHSPRSDPPLRPRARNPSRPAMATDRRHRPRRRWRHGAELPLPGTPLMCSSRSAAPSSSPRPKDKQQQHEGTTLSLDFLLIPPFPFPKAWDLLSLVXARISSSLQFVVLLHEHTFYSRDLISFVDFQKEKITLLDIXTFNELKTXIKQDFLEYCVTIINDWFXMLILXGVISKQSVSTXKXXLXKSPINRIPLVRK

SEQ ID NO: 196990 - protein, 127 aa, Triticum aestivum
  unsure (1)..(127): unsure at all Xaa locations
  Clone ID: PAT_TA_91408.pep
MLLSGPQPPTPPLLLPXSSGEDGGAHDHDSSSRASVPKKRAETWVQDETLSLIALRREMDNHFNTSKXNKHLWEXISAKMREQGFDRSPXMCTDKWRNXLKEFKKARSKPARRRRRERSAKMATTGD

SEQ ID NO: 196991 - protein, 157 aa, Triticum aestivum
  unsure (1)..(157): unsure at all Xaa locations
  Clone ID: PAT_TA_91409.pep
MATAAATAAKPAARTTVNVAGAVYRVQLALLDGAAASNEPLLHAAAAILSRADYDDVVTERSIAXACGHPACXSSLPDPANPKAAPRFXISLREQRVYXXRRPQFCSERCLVASAGFAASLRRRPSGSAQQDPGRVFKATGTSGVRFGRGKKEQGRK

SEQ ID NO: 196992 - protein, 48 aa, Triticum aestivum
  Clone ID: PAT_TA_91410.pep
PPNDWMLPPTQVTLLSLYRGANHEMFYFAILRQNHMVPQTNKTRLLAT

SEQ ID NO: 196993 - protein, 88 aa, Triticum aestivum
  unsure (1)..(88): unsure at all Xaa locations
  Clone ID: PAT_TA_91411.pep
FSTYPPVSVSGTGTLLLKVVRAFPGSMASVTYFSAVAPGMSLVEKQSLVHGAHTSALQRLXVLGPRLEAFSLPLLTLKKQGHLVSLNL

SEQ ID NO: 196994 - protein, 136 aa, Triticum aestivum
  unsure (1)..(136): unsure at all Xaa locations
  Clone ID: PAT_TA_91412.pep
GGIQRWRSCWARRSGSTTTTGFLLPREHPVLLHWRLLRKPHHQMCLNGPSLDLPQPPRASRLSVDETENGHSTTPNRQVRSMSRLQTXHQCSXQAFFXQFETTTRQEDNIFLSMHHSTHSMEHITTRSKPQLPVXS

SEQ ID NO: 196995 - protein, 83 aa, Triticum aestivum
  unsure (1)..(83): unsure at all Xaa locations
  Clone ID: PAT_TA_91413.pep
KXDVWHXIVEYYGXQNXETXKLDNCILSSAKELHFITFLWVLTIIXVSASFCLFQQDQTIITQEDPIGFARHKHLIKTQKTQS

SEQ ID NO: 196996 - protein, 187 aa, Triticum aestivum
  unsure (1)..(187): unsure at all Xaa locations
  Clone ID: PAT_TA_91414.pep
VSSQAMLWKTLSSEHSTGFLGVHPAVNRVLWWASVALTVIVSITYLLKVVFYFEAVRREFHHPVRVNFFFAPWIACLFLVKGLPRPEREXNHIVXXLLMTPTSGLDXKIXGXWMSSGERKLSKVATVXQLAVVGTCGNIPVPNGSVVAIFLAVAHNSLVPLQRSHNVCKESISLLHYQVQLASGIGK

SEQ ID NO: 196997 - protein, 188 aa, Triticum aestivum
  unsure (1)..(188): unsure at all Xaa locations
  Clone ID: PAT_TA_91415.pep
XVTGSXLXGALGXFXRXXGGRTWRXXGPFEGGRESXATGXLVMXSXRRSTATVDERPGXAAGTGAEGKLLAGVLIRSLKQSARGSRCAATXAGTNSGLCPPXPXTTGAGTLNWARGXRSRNGXDAGVWNGRRRGSLRRVAVQRMRRLGAVRAQRSGXIWRQGREGHPCWLRSLAAMEAEGELRPFPDR

SEQ ID NO: 196998 - protein, 193 aa, Triticum aestivum
  unsure (1)..(193): unsure at all Xaa locations
  Clone ID: PAT_TA_91416.pep
LTLVLPVDHPVVAAAFPGTGPPAPLSLRDDLKSLSSGDVHLYCKACSARLTKQPLRDVVEMPSLNWEDVADNWFGGCCTSFGGASEKLISHYINAYGRLQRTTLLXATSIIIEKDYLETDIVSRVDTSPMLILLHKKYVKVTLESDTAEKIKLNNSEEVCMKRNWSNTATQFFGKVLYDTGKNEDPRYVDINY

SEQ ID NO: 196999 - protein, 120 aa, Triticum aestivum
  unsure (1)..(120): unsure at all Xaa locations
  Clone ID: PAT_TA_91417.pep
QNKPEVIQQEVLLLRQEIDLLQKGLRYMYGENDINHMNLNELQALESNLEIWVHNIRYTKMQIISREIEMLKTKEGILKAANDILQXERIIEQSGILDTGSNMMMPQFPFQRTMEVGYYF

SEQ ID NO: 197000 - protein, 155 aa, Triticum aestivum
  unsure (1)..(155): unsure at all Xaa locations
  Clone ID: PAT_TA_91418.pep
SSTPSSLSSPPSSSARAHHPALACSPPGPVTAAPLGLVRRGFPRGRSRDGGRPQAVHTSWGGKELGGDGVGSGGAXXELDSPPPEPAVAASLGLVRRGFSMGNHTTAARLLLLLNARAAXLSFSSLXXCRGRIPPFRXNSSVQMLVGWKNLNATX

SEQ ID NO: 197001 - protein, 185 aa, Triticum aestivum
  unsure (1)..(185): unsure at all Xaa locations
  Clone ID: PAT_TA_91419.pep
LSFVLFGKTDPYVAMILGDQVIKSKKNSQTTVTGLPGEPIWNQDFHMLVANPRKQKLCIQVKDTVGFTDITIGXGEVDLSSLKDTVPTDKIVTLYGGWGFFGKRSSGEVLLRLTYKAYXXDEEDETSKSIHGLHFGRHLTCPTRTSGAFNMRGESMDCWPLLGSSMFALQTRGAVQSLRIYTPKA

SEQ ID NO: 197002 - protein, 82 aa, Triticum aestivum
  unsure (1)..(82): unsure at all Xaa locations
  Clone ID: PAT_TA_91420.pep
ETEXAAXPQAXXXEWVXXRRAKALXRXRXPRDLRGXVEAGEXRGRXGRGHDAGGXWXPXVGGRAXWEQSGDGGGRARXGGLA

SEQ ID NO: 197003 - protein, 191 aa, Triticum aestivum
  unsure (1)..(191): unsure at all Xaa locations
  Clone ID: PAT_TA_91421.pep
DGEEGCSLFLRSIGLREYSRYLAFNHPCSHEKPLLAHLRFFPWVVNEVYFKVWRQGRTGYPLVDAGMRELWXATGWXLHDRIRSSVSSSLVKVSNCHGRWGMNYSWDTLLDADLXSDPLGWQLISXGSPPDGRXTPTAXDNRRXKVQFRPXRXNFRRWXPGTGQGTTEWYTPWGSPIEGARMSNTSPMANK

SEQ ID NO: 197004 - protein, 154 aa, Triticum aestivum
  unsure (1)..(154): unsure at all Xaa locations
  Clone ID: PAT_TA_91422.pep
EQHMAVNYYPRCPEPDLTYGLPKHTDPNALTILLMDPHVSGLQVLKDGAQWIAVDPRPNALXSVNLGDQYRQLSNGXYKSVWDRAVVXAGAGXACPWIFLCPXNTRDARTLLGTGTPYATTLQRYRFARLDKTCWLTVKSFAQLLNNVVMGATQ

SEQ ID NO: 197005 - protein, 105 aa, Triticum aestivum
  unsure (1)..(105): unsure at all Xaa locations
  Clone ID: PAT_TA_91423.pep
FGEAVWFKAGSQIFSEGGLDYLGNPSLVHAQSILAIWACQVVLMGAVEGYRVAGGPLGEIVDPLYPGGSFDPLGLADDPEAFAEXXVKEXKNGRSHVSSVLLQAS

SEQ ID NO: 197006 - protein, 73 aa, Triticum aestivum
  unsure (1)..(73): unsure at all Xaa locations
  Clone ID: PAT_TA_91424.pep
TIGARDSRRPPTSPRRNPSQPASQPGYRRRAAPVAGDERGRRRAEAEPARCRLGGEEGARCLCXSXXXLXGXQ

SEQ ID NO: 197007 - protein, 129 aa, Triticum aestivum
  unsure (1)..(129): unsure at all Xaa locations
  Clone ID: PAT_TA_91425.pep
MAASMITSPIVAPTSLPSLSRRGSSFAVVCSGGKKIKVDKPLGLGGGLTVDIDANGRKVGKKGVYQFVDKYGANVDGXPIYTREEWSESGDRYAGGTNGLPXWGVXLAGSSGGGPPLKKPRKTLFKGRF

SEQ ID NO: 197008 - protein, 149 aa, Triticum aestivum
  unsure (1)..(149): unsure at all Xaa locations
  Clone ID: PAT_TA_91426.pep
LPRCLPLSLETLTRAASMPPRRPPPAAAAAHSGTQPRPHTAPLLFLPPHLSLSFQTLDHLPAPSPSPRRSSRSGRMRRRPPPWSSRRKKGTXRRXPRXAWRXRPKKAGTWQRXKRXRFLDEPSSPTKAAKGWMRDLRWILSQEVYCTTG

SEQ ID NO: 197009 - protein, 139 aa, Triticum aestivum
  unsure (1)..(139): unsure at all Xaa locations
  Clone ID: PAT_TA_91427.pep
MAPVKLYGATLSWNVTRCVAALEEAGVEYELVPINFGTGEHKSPDHLARNPFGQVPALQDGDXYVFRTTCYCKYAXPQRTSQDFLKGGDIKDSTMVDVXXQVXXANNXTAXLNPIPFQWPYXPKLWGTTKRHRNFNKIE

SEQ ID NO: 197010 - protein, 109 aa, Triticum aestivum
  unsure (1)..(109): unsure at all Xaa locations
  Clone ID: PAT_TA_91428.pep
GLFXGXKLLXLSXPVXKLPGPFXTLXXGGPSREANPRSALFXIGWKLSSRPXSCVVIRLFVPLRMXEEKFAIGXDXPVNGEEAYALWGDGEHYDDTKHGAEHSAAVAPV

SEQ ID NO: 197011 - protein, 133 aa, Triticum aestivum
  unsure (1)..(133): unsure at all Xaa locations
  Clone ID: PAT_TA_91429.pep
FPQXTPYLKRNPDPQSPTPISRSKRTTAAILILFFRDHHISIPLLPRERAGPGGSTTGREPAGAAAAFFNPGLALLPXRLAEXXGKXTXICWXNCRASXKALNRLRPCGRGASARKQKXGXKDFKEAAXXRGA

SEQ ID NO: 197012 - protein, 76 aa, Triticum aestivum
  Clone ID: PAT_TA_91430.pep
MSCCGGNCGCGSGCKCGNGCGGCKMYPEMDEGVEHRLPRPSSWAFAPSKGTRPSEAAAENGGCKVRPNCTCNPALQ

SEQ ID NO: 197013 - protein, 82 aa, Triticum aestivum
  unsure (1)..(82): unsure at all Xaa locations
  Clone ID: PAT_TA_91431.pep
HXPXXAPXXXRAIHGTPSASPXPXSSARXSRXLRPXLPPLPXXXLSXALXRAGSXPSDXTXXRHRRRDXFRHISAFXDAXVY

SEQ ID NO: 197014 - protein, 85 aa, Triticum aestivum
  unsure (1)..(85): unsure at all Xaa locations
  Clone ID: PAT_TA_91432.pep
PXLXKXCSPLCXXLKRTALFFXFFPEKLVGVXXRSSNXGXESGXHXVDCXFPXLAXCXXXLKXSINGLELTWXKERVRWLSKYRC

SEQ ID NO: 197015 - protein, 187 aa, Triticum aestivum
  unsure (1)..(187): unsure at all Xaa locations
  Clone ID: PAT_TA_91433.pep
RPQPPPSPPQPPQIDGLASHRRPFSSPPPVHQRGKLAGXATRSTHIWPRCNWRRPRCWRAAPTCRSRPWSCSCRATQTRLSPARLPAASSPNTQPTAGTCLCWRWPLLHKSCSTRRVRFPSSAXTLVSPPXPNNGKDRXXNEVSPGNDXVSNHSWRCCWTVCPVXVLGXGIPXFGQLRAFXQXIXGP

SEQ ID NO: 197016 - protein, 123 aa, Triticum aestivum
  unsure (1)..(123): unsure at all Xaa locations
  Clone ID: PAT_TA_91434.pep
SDHXIAQXLEAPGQREKFRPWXHQFYRLVVGWRTDNSRRPLFGIRNAREELRRRHESFPGDPGIPSGYSERPTIRTVSSSHRAPMTPGRSDWATQVGFHWPWKSYLADLMGLSAASKLRQIAA

SEQ ID NO: 197017 - protein, 128 aa, Triticum aestivum
  unsure (1)..(128): unsure at all Xaa locations
  Clone ID: PAT_TA_91435.pep
FALATSALLVSGASAEGAPKRLTFDEIQSKTYMEVKGTGTANQCPTIDGGVDSFPFKAGKYEMKKFCLEPTSFTVKAEGIQXKNEPPAFQKTKLMTRXXYTLDEMEGRSSPGQRNLKFXEKDGINYAA

SEQ ID NO: 197018 - protein, 109 aa, Triticum aestivum
  Clone ID: PAT_TA_91436.pep
CSTIDEKTQVVARGTAGYVDPEYLLEYQLTHKNDVYSFGVLLLELLTGKKPLSKQRKSLVVMVQESMEDGTLHELLDSEIVGDASMGVALQAVELATRCLSYAKEQAGE

SEQ ID NO: 197019 - protein, 144 aa, Triticum aestivum
  Clone ID: PAT_TA_91437.pep
GLSADPETFAKNRELEVIHCRWAMLGALGCVFPELLARNGVKFGEAVWFKAGSQIFSEGGLDYLGNPSLVHAQSILGEAGVAAAGVKRVHDAERAAGEVTLQGANEQQLAGPAEFDKGGARKPGKPQPFKPGKLGYQLLRPPNG

SEQ ID NO: 197020 - protein, 135 aa, Triticum aestivum
  unsure (1)..(135): unsure at all Xaa locations
  Clone ID: PAT_TA_91438.pep
SCRIRHEGRAAHGRTTRSPIAAPLLVRRSTSSFLPLRCAAGPLPPSLPAAPPALSLASARARRGSSPSLHILRRRTSSSIHLLRRRFPFLLPLLRCRRVGRSKISSPLWVSVDXQGGGITTVGXCTLXPTPSFMD

SEQ ID NO: 197021 - protein, 165 aa, Triticum aestivum
  unsure (1)..(165): unsure at all Xaa locations
  Clone ID: PAT_TA_91439.pep
AASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLKGRRXXLTRPRGPLXEXVDPLXPGGNFNPWAPXDXKSRLK

SEQ ID NO: 197022 - protein, 71 aa, Triticum aestivum
  Clone ID: PAT_TA_91440.pep
VRVALLSFLTQYIRKRSYIRAYTLTPMNTHTHVLPYEHLQETEPTYHLMIYEVIVGASSLTGTPPPTKSAS

SEQ ID NO: 197023 - protein, 85 aa, Triticum aestivum
  unsure (1)..(85): unsure at all Xaa locations
  Clone ID: PAT_TA_91441.pep
LLKVPRXLSXXNXQVEPTXCRHHXWRTSXQLRXVCVIEXEIGXGRHRRNCTCSTTSDEMPDQLGNTEPSAVLSSDFVXCCFVDQL

SEQ ID NO: 197024 - protein, 168 aa, Triticum aestivum
  unsure (1)..(168): unsure at all Xaa locations
  Clone ID: PAT_TA_91442.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFRXEHNASPGYYDGRYWDNXKLPKFXCXPTPPSXXKVEEVKKGVPDAYFASIGFDNMLKCIRQANNLKPEG

SEQ ID NO: 197025 - protein, 53 aa, Triticum aestivum
  Clone ID: PAT_TA_91443.pep
MQGLLILFHGLHYICWLVISFTNCPYFPICFPFNPAMRQLLQNSGNQPLITNA

SEQ ID NO: 197026 - protein, 81 aa, Triticum aestivum
  Clone ID: PAT_TA_91444.pep
VISAFCKNKDFEGAVDVMKELLEMCMAPDKVLLHEFFEALSKAKKLHLAEDLWSADKGGKFIPSIYYTGDYRNNGEEKTAC

SEQ ID NO: 197027 - protein, 157 aa, Triticum aestivum
  unsure (1)..(157): unsure at all Xaa locations
  Clone ID: PAT_TA_91445.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKLGSSSXEHNASPGYYDGRYWXTMWKLPMFGCNDXTQVINKWKSQEGVPDXYXRIIGFTTSQVHA

SEQ ID NO: 197028 - protein, 136 aa, Triticum aestivum
  Clone ID: PAT_TA_91446.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDPPSDVEESRRT

SEQ ID NO: 197029 - protein, 121 aa, Triticum aestivum
  unsure (1)..(121): unsure at all Xaa locations
  Clone ID: PAT_TA_91447.pep
HPWRASIPCRAAPCSKGPRLRPXGAKPPAQGASXCRASNVQWTGXGSXXGSNKNPTPSSPGNGXKIXPPQLTRTSGLTSIPXXTTXXNNFPKLAIKKXGPSLXRHFKPXFNXTXGQXLVEV

SEQ ID NO: 197030 - protein, 88 aa, Triticum aestivum
  unsure (1)..(88): unsure at all Xaa locations
  Clone ID: PAT_TA_91448.pep
RGPITNVSKLPCXSSTGPQVKTXNQFXXXXERLGXQGEXXQVKLYXNAXFKXQFGKINKDXKATMXXXHPQQXSPHEQIXPXNGGNPF

SEQ ID NO: 197031 - protein, 133 aa, Triticum aestivum
  unsure (1)..(133): unsure at all Xaa locations
  Clone ID: PAT_TA_91449.pep
MALSPSSFAGKAVKDLPSSALFGEARVTMRKTAAKAKPVSSGSPWYGSDRVLYLGPLSGDPPSYLTGEFPGDYGWDTAGLSXDPEXFAKNRELEVIHCRXWASLGALGALPQLLXPTGQFCKAFKGGPKFKAQ

SEQ ID NO: 197032 - protein, 64 aa, Triticum aestivum
  unsure (1)..(64): unsure at all Xaa locations
  Clone ID: PAT_TA_91450.pep
SRLSVXCNDRELEYRSXPGLIRXGXXRKKQHVLVSXSRSVXXSXGDAAIXFXHGLGCDXGIXYV

SEQ ID NO: 197033 - protein, 212 aa, Triticum aestivum
  unsure (1)..(212): unsure at all Xaa locations
  Clone ID: PAT_TA_91451.pep
LTGTPLQNNIGEMYNLLNFLQPASFPSLASFEEKFNELATAEKVEELKKLVAPHMLRRLKKDAMKNIPPKTERMVPVELTSIQAEYYRAMLTKNYQVLRNTGKGGAHQSLLNIVMQLRKXCNHPYLILGTEPESSSPXFLHEMRIKAXKLTLLHSMLKVLHSDGHRVLIFQMTKLLTSRRRPGIGINRMVVSWVQAHFNRTFDLYNGMVLRT

SEQ ID NO: 197034 - protein, 172 aa, Triticum aestivum
  unsure (1)..(172): unsure at all Xaa locations
  Clone ID: PAT_TA_91452.pep
MAAATMALSSPAMAGTPVKASRAAPFGEGRITMRKTAGKPKVAASSSPWYGSDRVLYLGPLSGDPPSYLTGEFPGDYGWDTAGPLRRPETSPKTGTGVIXCRWASGPSAGLPDWSPQRVNSASWKAVQISIRGLNTREPTWGPQKNSIGLKWAALRVPPGGPRKGYPGPGQD

SEQ ID NO: 197035 - protein, 149 aa, Triticum aestivum
  unsure (1)..(149): unsure at all Xaa locations
  Clone ID: PAT_TA_91453.pep
MLVYQDKLSGDELLSDSFPYRELENGVLWEVDGHWVVQGAVDVDIGANPSAEGGGDDEGVXLTKAVKVVDIVDTFRLQXEQPAFDKKXFISHMKRYIKNXSAKLEGDDLDPSKKNVNPPQIPPNKLKDLILVGKTSYDALVFAYTRRNC

SEQ ID NO: 197036 - protein, 105 aa, Triticum aestivum
  unsure (1)..(105): unsure at all Xaa locations
  Clone ID: PAT_TA_91454.pep
QFRCXHRXTXDXLSESISPMSVLAFAXQAXLPXLRDQNWLYLXGXPGLALPILFFTPSAILXHVANPPTEAGEETPNLKEVYAWLCKLSPPXGSGAYVHIFSKVD

SEQ ID NO: 197037 - protein, 74 aa, Triticum aestivum
  unsure (1)..(74): unsure at all Xaa locations
  Clone ID: PAT_TA_91455.pep
MASATLLKSSFLPKKAEWGVARQVAAPRXVMVVXAGAYXINXXKTAKXIASPGRGILAMDXXNATCGXAPLDWA

SEQ ID NO: 197038 - protein, 96 aa, Triticum aestivum
  Clone ID: PAT_TA_91456.pep
FFFQIRSISQHETQGSIIIQKYILHHSYPSQAKQCLMLSINSTDKKNCNHQLTRFSCLLSKYSCQHDHLSCKTWELFLVQNHGSRKASTKKPPPTS

SEQ ID NO: 197039 - protein, 189 aa, Triticum aestivum
  unsure (1)..(189): unsure at all Xaa locations
  Clone ID: PAT_TA_91457.pep
RSAEXCDXDLLVGEGTIXPRHXAAADLSLLQXCSQRXRGPSQLDEAPRIEARTRVPASKPCAVLSRRHIPVVVHRDVMERGQHAEVEVEGRRRKKGSSHLRRGRLLMTTRVRLDLAPEVGRGRGADVPSCRQRSRSKPWCVCVRGGESGSGGRRRGQMRHGWRRQGQTGRWVVVAMCGWEGTVDVWDVR

SEQ ID NO: 197040 - protein, 147 aa, Triticum aestivum
  unsure (1)..(147): unsure at all Xaa locations
  Clone ID: PAT_TA_91458.pep
MGVDDGHGPRASTNGPPPLPCVGVVVVPGGFSREPAHAMPCSVXPSTGQMGDPSSYAVAGKLLVAAAGALAGVLLXLVALHAYSXGRXRRSRDRLRLLHXLPVISAXXPXXRXXGXFPEGAGPXXLRXLXVVXPALTRLCAPGSPGR

SEQ ID NO: 197041 - protein, 158 aa, Triticum aestivum
  unsure (1)..(158): unsure at all Xaa locations
  Clone ID: PAT_TA_91459.pep
EGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTSPGRXITLEVESSDTXDKSRQVQDKEXSPGQA

SEQ ID NO: 197042 - protein, 147 aa, Triticum aestivum
  unsure (1)..(147): unsure at all Xaa locations
  Clone ID: PAT_TA_91460.pep
MQIFVKTLTGKTITLEVESSDTIDNVKAKIQDKEGIPPDQQRLIFAGKQLEDGRTLADYNIQXKESTLHLVLRLRGGHAVFXVKDLTGQDITLRLRAPTHLQRQGKFKDKEGSSTSTLIAKQLEDGPTLTHPGSTSTCPASAWGMKS

SEQ ID NO: 197043 - protein, 130 aa, Triticum aestivum
  unsure (1)..(130): unsure at all Xaa locations
  Clone ID: PAT_TA_91461.pep
KTSSHPLHRPSHLPHSPFLHHQLPPSIAGGQARFTATDPPSSCRIWAAEVAREGLRARHAPRQARSKLHREADAGGARLHASPLPCSFFESNRLSAXRRHPAWXLSXKRALLSVARRXMNPQLXXDXQLK

SEQ ID NO: 197044 - protein, 89 aa, Triticum aestivum
  unsure (1)..(89): unsure at all Xaa locations
  Clone ID: PAT_TA_91462.pep
KNACIVLPXTPFSTGLGCSXFARRYYGESLLLSFPLGYXRCFSSPGCLLPAHGFSRQFKRLTYLGISGSMLIFNSPKHFVACYALPRLW

SEQ ID NO: 197045 - protein, 113 aa, Triticum aestivum
  unsure (1)..(113): unsure at all Xaa locations
  Clone ID: PAT_TA_91463.pep
GNFDPPQQLRELHLSIPSTRLPAWVHVSRVPMLSHLVVSLKSKEDQDLDILGCFAKSSSSLQLGAAVESGLKHHWVLPVHSPRLXYFPTSXTSKFXKRRYAXXGSLHFYXILL

SEQ ID NO: 197046 - protein, 125 aa, Triticum aestivum
  unsure (1)..(125): unsure at all Xaa locations
  Clone ID: PAT_TA_91464.pep
MAAATMALSSPAMAGTPVKASRAAPFGEGRITMRKXTAGKPKVAASSSPWYGPDRVLYSGPLSGDPPNYSTASSPGDYXWXTXAFRPTPKLXXKNRXEVISNALGXLGXFVVFXEXFXPTFKPFV

SEQ ID NO: 197047 - protein, 90 aa, Triticum aestivum
  unsure (1)..(90): unsure at all Xaa locations
  Clone ID: PAT_TA_91465.pep
FGAQELLFINWKLQITSFQDAHFLQNXTMGCSNIXALTLPXXXALICNCXILPFFXGLNIQANXNDIAKXEPPTRNGTFQFKXSPQXXRV

SEQ ID NO: 197048 - protein, 188 aa, Triticum aestivum
  unsure (1)..(188): unsure at all Xaa locations
  Clone ID: PAT_TA_91466.pep
MAILTAMAPTVMAXSATSVXPFXGLKSTAGLPVSRRSNGASLGSVSNGGRIRCMXVWPIXGIKKXETLSYLPPLSTEALLKXVDYLIRSKWVPCLEFSKVGFIFXXHNASLGTNDXXYWTXXXLPKFXVHRPTHVINXVDEVXKESLTXIPXIRFXNMXKGSYRLPRARPKSHHNGIDLKSWVSFISV

SEQ ID NO: 197049 - protein, 141 aa, Triticum aestivum
  unsure (1)..(141): unsure at all Xaa locations
  Clone ID: PAT_TA_91467.pep
MATAYAPPMASQVMKSGLVSSKPRGLSGASLTRRPRFVVKAVKSDKGTYXVXVQPINGDPFIGSWETPVTSKPLVAXWVLSNFPALPNGVNRSFRESKSAPSSAFGSTAAPQKQFTARGTGQSLQPVCSQRVLNRGSTGVN

SEQ ID NO: 197050 - protein, 104 aa, Triticum aestivum
  unsure (1)..(104): unsure at all Xaa locations
  Clone ID: PAT_TA_91468.pep
RAEFGTSLSLALHYLSFASCFPLPHFTLAVLFSLSFPISSSLSRLPFPVAFLFARVLVCLLVIMSEIGGNYCWAWVIIISWENLKLLLKNPYLSYKKISNRWGX

SEQ ID NO: 197051 - protein, 105 aa, Triticum aestivum
  Clone ID: PAT_TA_91469.pep
RSVWCLESTANILMANGTTVPVRTHLHAGASGQRRRPLSAGPCRRRPRCRKANSEARVHLRLPRRLPAPAPDPNDASAWRACACVARLPHPCPLGNARWPVTLTN

SEQ ID NO: 197052 - protein, 93 aa, Triticum aestivum
  unsure (1)..(93): unsure at all Xaa locations
  Clone ID: PAT_TA_91470.pep
KLQPHXKKVKVLISSLRPADGDDAVLLATVVDFCYPPGDLICYNPIFPQLMLLLHPTPSPPMVMVVTALWEVRKGRWTRGHARSAPWLHTLQR

SEQ ID NO: 197053 - protein, 168 aa, Triticum aestivum
  unsure (1)..(168): unsure at all Xaa locations
  Clone ID: PAT_TA_91471.pep
GGFEAGISKDGQTREHALLAFTLGVKQMICCCNKMDATTPKYSKARYEEIVKEVSSYLKKVXGYNPDKVPFVPISXGFEGDNIIXEKSTNFDWYKXPTSLXALDQFKRXPRGVXXTPPLXLPDVXKFGGFGXVQLPXLXXVNNPGXFVTFXPVRKRGNPLNHNELPVG

SEQ ID NO: 197054 - protein, 45 aa, Triticum aestivum
  Clone ID: PAT_TA_91472.pep
AGHRPQLLQPPPWPPPPPPRPSAAAGVCLHRPPPPPPAVVWKVRK

SEQ ID NO: 197055 - protein, 150 aa, Triticum aestivum
  unsure (1)..(150): unsure at all Xaa locations
  Clone ID: PAT_TA_91473.pep
YXEDSRRVXAERASXXPALEACGXPPAQXPSGXVPXAVPXXARAVTHTAPSCLXAVXDRSYRRAPWRAWRSXTGVRLNFSFSXAVRATXQGEPGGARRSRAXELRARPPSRPPRARAPGGIRIRSARDGAAGSRGGGERGLGGKSRAGWV

SEQ ID NO: 197056 - protein, 113 aa, Triticum aestivum
  unsure (1)..(113): unsure at all Xaa locations
  Clone ID: PAT_TA_91474.pep
MAMASARSSLEIVPHSGDLEVPPADVPRQDSLYRDATXRPAHGGHHGQXNWVRTLRLGFQCVGXLYADLGTSPLYVFSNTFKYGVRHKDXXLGVLSSSSTLPALRMASYLIAL

SEQ ID NO: 197057 - protein, 130 aa, Triticum aestivum
  unsure (1)..(130): unsure at all Xaa locations
  Clone ID: PAT_TA_91475.pep
MELEIIVVVTFGALFGDESNGRWCRYGFAFTQFLLFXSSIVAALTRMMMKLPPDPFPGSAPASELLRKTLLLLLLVTAHTLAAEWLGEDVVLFCMPEVALVLLWYSLHLDRPHHNPIISVDKMKPHMKGL

SEQ ID NO: 197058 - protein, 98 aa, Triticum aestivum
  unsure (1)..(98): unsure at all Xaa locations
  Clone ID: PAT_TA_91476.pep
LVPNSARAARHILSRHDAGRPPPPPTTTKXXPRLLLSPPXPRPVSSYPLQGLAPSALIXSTXSPRXLLSPPRPCLXANPADLPWXDSAAFILLPQMIS

SEQ ID NO: 197059 - protein, 178 aa, Triticum aestivum
  unsure (1)..(178): unsure at all Xaa locations
  Clone ID: PAT_TA_91477.pep
SVSQDPNMKRVLMDILLQIDEREYRSLTGSTFDAKLLINIIRRVIGSKRYFIVIDDIWDVKSWKFIKDALDTRCGSRVVITTRLLGSCCQXLGDVYKLKALSHSHSXELFNTRLFGGQRQCPSVSCRRYLKNLRAIVLGFLANKLTIGMIANGTPPHSVKLGGVPIRLYDLLPPHGVV

SEQ ID NO: 197060 - protein, 159 aa, Triticum aestivum
  unsure (1)..(159): unsure at all Xaa locations
  Clone ID: PAT_TA_91478.pep
AAPPPPPAAASLLRSSPIPGVNSLLVAPQEQLKKAHFFGSKPSSQIIYSQHHRICPGDXVIPLGGKHLWDIXQVCQILFFLQTGSQTSPNWWXHNGEHQNLWSNRKAPKEAKTSDVXLVNGXNRXXRXKIXXVLTEKGGPVXFWLKSRXXXDMXGQMWT

SEQ ID NO: 197061 - protein, 143 aa, Triticum aestivum
  unsure (1)..(143): unsure at all Xaa locations
  Clone ID: PAT_TA_91479.pep
RAEFGTRTARSRVAPLKPKQKPRCEICASRHTTTTTAMAAPRVLLLLAAAALLAVSSVRGTLXAKGPRRAQSAGCSSKXWPFAHPTPLPFXRSKARRLNXGXPPXPNNPTLRXNAKVSTLXXXLPXPNQPPFXGLVGXSCPGI

SEQ ID NO: 197062 - protein, 92 aa, Triticum aestivum
  Clone ID: PAT_TA_91480.pep
APEPSTCSRPAPPPRPTAPPPLPAPSPRPTAPPPSVPLHRRRPWAKAEEPPQRRHRPPHPLPPATATPSDGLSVFTAPPSSSESSPKPRYLI

SEQ ID NO: 197063 - protein, 131 aa, Triticum aestivum
  unsure (1)..(131): unsure at all Xaa locations
  Clone ID: PAT_TA_91481.pep
NXLNLRXSXKKXXSKSKXLNPXXEXNXXKAXYPXXXLGGAINGDXSXRXSAALXXXATKXXAKVRXXFPTXPXSPGTPXYHLPPRSAMRARADGVVLLLPNQVPGRPVYGAGGGEESRLSCCRRLWARLVV

SEQ ID NO: 197064 - protein, 68 aa, Triticum aestivum
  unsure (1)..(68): unsure at all Xaa locations
  Clone ID: PAT_TA_91482.pep
MGIDLVAGGRNKRTKRVAPKSDDVYLKLLRQLYRFLGEEGPKSNFNAVHPXRXLSMXKTNRPPSCAAS

SEQ ID NO: 197065 - protein, 100 aa, Triticum aestivum
  unsure (1)..(100): unsure at all Xaa locations
  Clone ID: PAT_TA_91483.pep
KTKWETALSVPDELCSFLXFCFGXASVMGMAKXDLPFTXXMETKLXKXXVQXXTRXPXELAFXIRTRMNLEXKKEXQTFFXKXXFXKRENWKEGDILXXC

SEQ ID NO: 197066 - protein, 147 aa, Triticum aestivum
  unsure (1)..(147): unsure at all Xaa locations
  Clone ID: PAT_TA_91484.pep
MVSLKLQKRLASSVLKCGKGKVWLDPNEVNEISMANSRQXNIRKLGKGWFIIKEPQEDSLQSXCKGGHXXAKQEGLXPGYXKXRGTKEAKSPTKXLXXMRRXMPFLKXFLRXXRLGQEIXQXMFHDIXLKAKGHFQKQEXSMEPQQG

SEQ ID NO: 197067 - protein, 146 aa, Triticum aestivum
  unsure (1)..(146): unsure at all Xaa locations
  Clone ID: PAT_TA_91485.pep
QXXPRXPXAXKRXXDDEDAKRPPLKRAGHXGAVPRRPGEGSDAPSASXSXTAAAPGGTGAPSPSPPTPVPSNGGTAGRRRRREAPPPGLPRVGAGFGSRWRRRGAWREGEAAMGKGRGMQTAVRVRRAERPSEWWRTGSNSGGGLE

SEQ ID NO: 197068 - protein, 122 aa, Triticum aestivum
  unsure (1)..(122): unsure at all Xaa locations
  Clone ID: PAT_TA_91486.pep
TXXRKRVHWXKSXXLVRVXTXTLXQNXVLRRSGTPXLAXGLERPKKPDGMSGRPDRRRAPSSLRPRGPFARSVPEGGDGEKGRGGEEEEDARRRHGRRGGGVARCADLAAGFLFGPRAEFGT

SEQ ID NO: 197069 - protein, 162 aa, Triticum aestivum
  unsure (1)..(162): unsure at all Xaa locations
  Clone ID: PAT_TA_91487.pep
ETTLRLSHSLTLPYGCRPASAARARRAWNSPGRWRQGSKRPAHGRLPGWSRSGCRRTRASLPSQYSTKTMRRRCYAVRTAASSLXPPAASRSKMDGLRRSXXDNRPTTTKVWPPTXTTHXDNTYKGNGXQRRYPWXQRKPWXGPTXWXKPXRCXTGXRKRAX

SEQ ID NO: 197070 - protein, 142 aa, Triticum aestivum
  unsure (1)..(142): unsure at all Xaa locations
  Clone ID: PAT_TA_91488.pep
LVPNSARGTPAARARQWXTRSSSCGASASVSRRGCRLRSAPECRRHSRNASGSGLASASQALRCRSGATRSTPASRRXSGGSXARSTTTMRSVLFXDIVDAVRGGLPLGRAPRGIXTCXXXPPTRXVGMXSQHCMAYIGDSL

SEQ ID NO: 197071 - protein, 211 aa, Triticum aestivum
  unsure (1)..(211): unsure at all Xaa locations
  Clone ID: PAT_TA_91489.pep
DRQTTGRPGHARCKPEGTTVEAMASRRGHGGGCRVRQNQRGWVTRHRQANGSLNPGTARCSFDVXPTGATLLAKVMEIAFXXQTNFSFGDXXPEXDGVXPRRPSAAPSXDIFMXHYVYFXHTLFPDXFXKTLXLLXASHITTXXXHKALSFPNXHFLLFXLXSNLNNXDVXFXIIXKSXHLXTXTXQKXXSXERXTSKXSTXXXLGTEGPP

SEQ ID NO: 197072 - protein, 160 aa, Triticum aestivum
  unsure (1)..(160): unsure at all Xaa locations
  Clone ID: PAT_TA_91490.pep
MASTSCFLHQSTARLAASARPAPAVGRTQFSVCKAQKNDEAASDACRSSPAGRAALSLLARCRRIAVKVSPAAAAYGRKQPTFFRQGERXNTLXLAXTGXGFXMMIPGKVGPNKTLXPWXXSPYEGNXXANNNSPXYQPTSRKHHDVPEDPKSGSGKILG

SEQ ID NO: 197073 - protein, 77 aa, Triticum aestivum
  unsure (1)..(77): unsure at all Xaa locations
  Clone ID: PAT_TA_91491.pep
KFKXHANPKFAIISSSWXPPSEALGIIIPFNFKYTPPVPKNNGLKXKYNFGTRLXQNXRHLFWDGRSIAXGNSXTKC

SEQ ID NO: 197074 - protein, 166 aa, Triticum aestivum
  unsure (1)..(166): unsure at all Xaa locations
  Clone ID: PAT_TA_91492.pep
TPRNYTLLDFRMYIRDIFSLPPDGLGIPYKEANKNASGGVDGGTGKRKPRLMLINRGRNRKFVNIPEISAAVQAAGFEVVVVEPRRDLRLEEFSKAVDSCDVLMGAHGAGLXNFFFLPQXAAMLQVVPWGHMEHSGMIFYGCKQGDELRDSINITPRDTSTERTTA

SEQ ID NO: 197075 - protein, 143 aa, Triticum aestivum
  unsure (1)..(143): unsure at all Xaa locations
  Clone ID: PAT_TA_91493.pep
MATRRAISSVLRTASRIRAASPSPCPRAPLHRPSPAGFLLNRAAAYSVIRRGASRSGHAATHSDNTPALXTDEFTGAGAXGXVFQVIGXVVDXRSXRSPPILTALEVSTTHPPCLQVDTFRENFSHILWTDGSSPRQRFSRSR

SEQ ID NO: 197076 - protein, 158 aa, Triticum aestivum
  unsure (1)..(158): unsure at all Xaa locations
  Clone ID: PAT_TA_91494.pep
RPTCLDDVFGQDLVGPNGILRGLIDQDRVPSMILWGGSGTGKTTIARCLADRVGSRFVEINSTSSGVAECKKIFAEARGELSLSGRKTIIFCDEIHRFSKSQQDVFLRPVESGHITLXGRDYREPSFKGQXCFTSRCRTLSXLSHNEDISRFXKKALP

SEQ ID NO: 197077 - protein, 93 aa, Triticum aestivum
  unsure (1)..(93): unsure at all Xaa locations
  Clone ID: PAT_TA_91495.pep
FDVRVRDLPLRXRAQGTASAXGVNRLMSAVLGMXSYRLYGAVGMPGSFYIFAGCAAASWVFVYALLPETKGRTLEEMEALFDDSAKSPSPTTQ

SEQ ID NO: 197078 - protein, 142 aa, Triticum aestivum
  unsure (1)..(142): unsure at all Xaa locations
  Clone ID: PAT_TA_91496.pep
GAAKADAKLAVKSKGAEKPAAKGKKGKAGKDPNKPKRAPSAFFVFMGEFREEFKQKNPKNXSVAAVGKAAGERWKXSLSESGKGPYVAKANKSKGXYNKXIAAYNKGEXPSXXXPKXRFRRRRGKLGRTIQFGFMPHYHLHQ

SEQ ID NO: 197079 - protein, 133 aa, Triticum aestivum
  unsure (1)..(133): unsure at all Xaa locations
  Clone ID: PAT_TA_91497.pep
MVSGSGVCAKRVVVDARHHMLGRLASIVAKELLNGQRVVVVRCEEICMSGGLVRQKMKYXRFLRKRMKQSLHGPSIRAPXKFFWRXIRXMIPXKTQGXRPXSQVXGXXGFPPFQKXRQCIPNVKVLKPASKSR

SEQ ID NO: 197080 - protein, 80 aa, Triticum aestivum
  unsure (1)..(80): unsure at all Xaa locations
  Clone ID: PAT_TA_91498.pep
RAASSHSILKGGRRDRVGSGAEPTSAGALLMAMVTXXFSAHPLSLXXQXGPRXXXLHLXXFXRXXSXXXPRXRRRGXPRR

SEQ ID NO: 197081 - protein, 141 aa, Triticum aestivum
  unsure (1)..(141): unsure at all Xaa locations
  Clone ID: PAT_TA_91499.pep
XXSXIIGADRSXPVXLWXAXELEPVAXVSTSRVHVRETPPXPXRARCPPRRSHLGEARRLLDGARRRERCGPTSPGAAPXTVEPATAPPPNHRRRVALVWCGPHPRGWCGGASPGWCRAAMPPCTGAPLKRGIGLVPNSAR

SEQ ID NO: 197082 - protein, 121 aa, Triticum aestivum
  unsure (1)..(121): unsure at all Xaa locations
  Clone ID: PAT_TA_91500.pep
MGKEKTHINIVVIGHVDSGKSTTTGHLIYKLGGIDKRVIERFEKEAAEMNKRSFKYAWVLDKLKAERERGITIDIALWNSETTKYYCTVIDAPXHXDFIKNMIXGTPKADCAVLIIDPHWF

SEQ ID NO: 197083 - protein, 140 aa, Triticum aestivum
  unsure (1)..(140): unsure at all Xaa locations
  Clone ID: PAT_TA_91501.pep
MAPTVMASSATSVAPFQGLKSTAGLPVSRRSNGASLGSVSNGGRIRCMQVWPIEGIKXFETLSYLPPLSTEXLLKQVDYLIRXKWVPCLQXNKVXSSSXEHNALLGYYDCRYWTMLXLPKFXCTDAKXXSXKVEESRKDT

SEQ ID NO: 197084 - protein, 92 aa, Triticum aestivum
  Clone ID: PAT_TA_91502.pep
LVPNSARGTTRVTAAWCSANWGGLPGGALCCSPGGLDLGWLFSELGRPGVRRLPRSSAALSAKLWQAIASAVLLFGIEIWVGCTRGGEQPQF

SEQ ID NO: 197085 - protein, 90 aa, Triticum aestivum
  unsure (1)..(90): unsure at all Xaa locations
  Clone ID: PAT_TA_91503.pep
VGRTKQPSXQSSXSAXSXEENXXSLRXSLXWFLLSLXXLXFFSWXDGXAPADVXXMXLXKTFXAHGAKKRKHXAEXXKDMXKAIALSKPP

SEQ ID NO: 197086 - protein, 78 aa, Triticum aestivum
  unsure (1)..(78): unsure at all Xaa locations
  Clone ID: PAT_TA_91504.pep
MSCCGGNCGCGSGCKCGNGCGGCKMYPEMDEGVNTASQXTLIMGVAPSKXPRPFRGRPPENGGCXCGXNCTCNPCTCK

SEQ ID NO: 197087 - protein, 57 aa, Triticum aestivum
  unsure (1)..(57): unsure at all Xaa locations
  Clone ID: PAT_TA_91505.pep
HXXARXSXXXPEXDAXQAREAGXRXXRRRDHRRHSGCTWGVXAGVGEERVEVAAAAV

SEQ ID NO: 197088 - protein, 99 aa, Triticum aestivum
  unsure (1)..(99): unsure at all Xaa locations
  Clone ID: PAT_TA_91506.pep
PLRRSRRRRRSPRRRRPRSRRLLPPSRSWRPRRRHRPPPRRRMPRRPSQQLRPSRRPRRPKRQRRQPCPPGRSPLLLKEHRXEATXARQXSPAPPVATS

SEQ ID NO: 197089 - protein, 100 aa, Triticum aestivum
  Clone ID: PAT_TA_91507.pep
EIRDAWVGFLLHAASKSRPEMHAAQLARGGEFLTFVWLLMAHCNLGNSRGCPIGLLPISGDVQVALCLPYSPSTTILIGAAQALYGFPTTARLCVLIDSA

SEQ ID NO: 197090 - protein, 63 aa, Triticum aestivum
  unsure (1)..(63): unsure at all Xaa locations
  Clone ID: PAT_TA_91508.pep
MXSLXTTTASSPXALPXAASAXPATXSSVSPTXXASKRPHXAXDDPXWRXXAVXXAXIXLVSR

SEQ ID NO: 197091 - protein, 63 aa, Triticum aestivum
  unsure (1)..(63): unsure at all Xaa locations
  Clone ID: PAT_TA_91509.pep
MAETEYRCFVGGLAWATDDNNLXQAFSQYGEILDAKIINDRETXRSRGXRFVXFGSXVHPQTA

SEQ ID NO: 197092 - protein, 182 aa, Triticum aestivum
  unsure (1)..(182): unsure at all Xaa locations
  Clone ID: PAT_TA_91510.pep
MAPTVMASSATSVAPFQGLKSTAGLPVSRRSNGASLGSVSNGGRIRCMQVWPIEGIKNSETLSYLPPLSTEALLXKQVRLPDPSNWVPCLXXNKXXIFPXHNHLLGYYDGXRYWAMXELPIXXCTGPTQXITXVEESKKDTLTRMFRINXFHKCSSAXVXFIAXKQRXQRSGKAKQTAYKMQ

SEQ ID NO: 197093 - protein, 79 aa, Triticum aestivum
  unsure (1)..(79): unsure at all Xaa locations
  Clone ID: PAT_TA_91511.pep
YXIQILXDTGCRSVWLTKDRNCSYXWFNHTLRQFFVKFRIGLLPVRSSMKRTKVLSGGAFLSLNLLVHPGASRLTRFTI

SEQ ID NO: 197094 - protein, 116 aa, Triticum aestivum
  unsure (1)..(116): unsure at all Xaa locations
  Clone ID: PAT_TA_91512.pep
EALLKQVDYLIRSKWVPCLEFSKVGFIFREHNASPGYYDGRYWTMWKLPMFGCTDATQVYERXEEVKKEYPDAYVRIIGFXNMRQVQCVSFIRXSKPPGCEGVPARPKQSLNDRHI

SEQ ID NO: 197095 - protein, 130 aa, Triticum aestivum
  unsure (1)..(130): unsure at all Xaa locations
  Clone ID: PAT_TA_91513.pep
LEDGRTLADYNIQKESTLHLVLRLRGGMQIFVKTLTGKTITLEVESSXDTIDNVKAKIQXDKEGIPPDQXQRLIFAXGKQLEDGRTLQDYNXPXGINLNLVXKXLXXYANFVXXLXGKTNHXQVDPQNTL

SEQ ID NO: 197096 - protein, 131 aa, Triticum aestivum
  unsure (1)..(131): unsure at all Xaa locations
  Clone ID: PAT_TA_91514.pep
SYILYTYCTTSHFSSLQRTTSALSFKSYSISLPALQNVSTYNKFFLSQIFITLLQYHKMLLSRRDLGVVQRNPLKPIPVSFNEYIQRYPMKKDKRTSKRKKKKMIIQYLNICNFLXNLGXYANXKNIGXRF

SEQ ID NO: 197097 - protein, 99 aa, Triticum aestivum
  unsure (1)..(99): unsure at all Xaa locations
  Clone ID: PAT_TA_91515.pep
GQXIXXXNRXEEXEXAKPXXEXAQXVAVLPQXKRIHRXPXTVAQTAGGGARRWATXEEEEGVRXRPAAAGGGRAPGRRPDSSSAGTPAATLASMTSXRV

SEQ ID NO: 197098 - protein, 179 aa, Triticum aestivum
  unsure (1)..(179): unsure at all Xaa locations
  Clone ID: PAT_TA_91516.pep
SRRQPVPLGILPHPTGALLWIPSIYQPAQPMAPDPLRLPSSRSICSFARASLSFSLLTRSRPAALLGAGHSSSPRPTPRLSLGPSSSSFFLPLSLSQSLSLLQEFPRQHXAIAAQSPEPLLRRXEHSCVAKIRALARFGGPXPRPSGLVLPACQXAXRPWPLXSXSAXDGWRSALRDCP

SEQ ID NO: 197099 - protein, 87 aa, Triticum aestivum
  unsure (1)..(87): unsure at all Xaa locations
  Clone ID: PAT_TA_91517.pep
SFEVPHCTPFSVRSRVQLLQWVLCLFSYVDHFCLPAPFHPAQQLVGVSLSTAPFKDVHCKTMLPGICISQPEXLKCMCVQNFNACSY

SEQ ID NO: 197100 - protein, 188 aa, Triticum aestivum
  unsure (1)..(188): unsure at all Xaa locations
  Clone ID: PAT_TA_91518.pep
DIAGCKLXXAPFRSXTERXXRXRSPXPWIXCTVLXXXEPSLPFRIXPXPPGXGXPXIPGPVTRRRGREXLXIEERPKVWTRRCLQPARXGRSXVRRREESSSDDGXSDGVRGRSARATAISAQMAAASATXASLAPRPPPMTADGDARLGPGARRPGARRRRVSQPAAAVGLHGSAHHLRWLGQCVWD

SEQ ID NO: 197101 - protein, 140 aa, Triticum aestivum
  unsure (1)..(140): unsure at all Xaa locations
  Clone ID: PAT_TA_91519.pep
PGRMFGAIXEGXRSQEXQXSKGTPMLRWQKPPXVKCAWATCGXXKNVVQLDAAECARXKVPLRTNRVPASPXTYGRTRCLLLXKCGERMALLRENLSAARVLGLLVARGSALLNKALQLTYSSSAGSPALLATQVLQQRA

SEQ ID NO: 197102 - protein, 102 aa, Triticum aestivum
  unsure (1)..(102): unsure at all Xaa locations
  Clone ID: PAT_TA_91520.pep
MAQTMASMTGLSQGVRLPGPAGRRASRFTVRASSAEAEAAGRRAVLGLMASGVVGSAFAQVGARRHRRGIRFXGPPPASPGGSPRKDNPDXXKDXNLPLKTV

SEQ ID NO: 197103 - protein, 60 aa, Triticum aestivum
  Clone ID: PAT_TA_91521.pep
MSRIKVMYFREFRGEQSEIAFLKLFYKSAKMLEAAVVIMANPSFTPFRADVAFSKSVASV

SEQ ID NO: 197104 - protein, 111 aa, Triticum aestivum
  unsure (1)..(111): unsure at all Xaa locations
  Clone ID: PAT_TA_91522.pep
WRFKQIISILKLAATNPAFPNEXWVIRSKCSLYLPTSAAYFNTIRSTFEYHLITFLPDDRSLTFFXXPNYRRSHNESQNQALKKXKXKTXGGARYHXPXGXFXAHGRRXNS

SEQ ID NO: 197105 - protein, 61 aa, Triticum aestivum
  Clone ID: PAT_TA_91523.pep
CLFCRTDEGSIRARWGCIWVRTCQESQSKLTVEQTLESQDAVGPQRGNWTKIMGSKNDAKH

SEQ ID NO: 197106 - protein, 143 aa, Triticum aestivum
  unsure (1)..(143): unsure at all Xaa locations
  Clone ID: PAT_TA_91524.pep
MAAAFSSTVGAPASTPTNFLGKKLKKQVTSAVNYHGKSSKANRFTVMAAENXDEKRNTDKWXGLAFDISDRQARXPXGKGXXGPLFQGAKGXRDHXASVLVQGTIPREVPRPGTWLAIPKNRPGQKHQLNWGRARSSMQLSQV

SEQ ID NO: 197107 - protein, 109 aa, Triticum aestivum
  unsure (1)..(109): unsure at all Xaa locations
  Clone ID: PAT_TA_91525.pep
TEWRNTATTGRKSLRNFNAPSALSSEQPASXGPRPSISSNQPXVNRLINVXLASPGNSNHXARXGSQSXXKRKXPXSXXPRXPELFXTHQQXXHXXSGXGPXNWKXXTT

SEQ ID NO: 197108 - protein, 110 aa, Triticum aestivum
  unsure (1)..(110): unsure at all Xaa locations
  Clone ID: PAT_TA_91526.pep
VTFHVGGESFLAHRAVLAARSSVFRAELFGGMKEKAGGPIEIXDMESDVFKALLHFIYTDEYEPVPEDDRWMXKHGENGXMAGHLLVAANXYXIQGLKLICKXRVATHNP

SEQ ID NO: 197109 - protein, 127 aa, Triticum aestivum
  unsure (1)..(127): unsure at all Xaa locations
  Clone ID: PAT_TA_91527.pep
ATXEMXXKXXDKMIKXLNXGRDPKKXPGGSFAQLEYAAENSWRLPAGRSLQCCTEGVRTSRDLLLLDFLPPFDSISTFTKGSWEKLYGNPDPERARLFRFRSQEFPLSRTRSRALPTSSSLSFFLLI

SEQ ID NO: 197110 - protein, 180 aa, Triticum aestivum
  unsure (1)..(180): unsure at all Xaa locations
  Clone ID: PAT_TA_91528.pep
MAAAFSSTVGAPASTPTNFLGKKLKKQVTSAVNYHGNSSKANRFTVMAAENLDEKRNTDKWKGLAYDISDDQQDITRGKGIVDSLFQAPTGDGTHEAVLSSYEYXSQGLKKYDFDNTWEASNRSCFMDKLLSSLQRTHDLPXIKFTILGIWGXKVKEIICNLPPKWQPIMIRNNEPSSKY

SEQ ID NO: 197111 - protein, 80 aa, Triticum aestivum
  unsure (1)..(80): unsure at all Xaa locations
  Clone ID: PAT_TA_91529.pep
PRRTALPWPPPXSAPPSSPPXPSAGSPPPPRRAXPASXSPRCRGSXGLACPTRPXSPPPPCRLGPRRRSTRCSDADPVNG

SEQ ID NO: 197112 - protein, 107 aa, Triticum aestivum
  unsure (1)..(107): unsure at all Xaa locations
  Clone ID: PAT_TA_91530.pep
CARRCAGLMLSTEXYSRSAXCLLESLHMLHDRHRGSSTAHHHSCRPAAVCELLHTRHALPCEPCHGHAAAARLSHTTHRAAPIQRRASIGRWRSRRCIGGGGWWRLR

SEQ ID NO: 197113 - protein, 109 aa, Triticum aestivum
  unsure (1)..(109): unsure at all Xaa locations
  Clone ID: PAT_TA_91531.pep
PITFPTRLIPNERSIPNNTIQYVQSIEQTKILEEVVSEGVVRRRRPQPRRRRPPPSHPXRRRRRGRPWRRRRCGGRRPAWRPPPRGAAPPSWPPPPPAPPGRRAPWPSP

SEQ ID NO: 197114 - protein, 162 aa, Triticum aestivum
  Clone ID: PAT_TA_91532.pep
ELRAHQETSDASQRSAVAAPLSPSSCDSVPGGKDEVSVIKAGLRKVKILRHIVSARRSKKTFQSDEGSEDNCYIHSDGTEYPYGTEPVDEDLDDRTHEDEVAGFNYQETFNLWSLHPSTKFGDQGRVINRSDPVTSMNTSSTALERLQLLNGYLLGEERVTH

SEQ ID NO: 197115 - protein, 78 aa, Triticum aestivum
  unsure (1)..(78): unsure at all Xaa locations
  Clone ID: PAT_TA_91533.pep
MATVPAPASQEPRAPXGXTLKDXNPHEFVKAYSAHLKRSGKMELPEWVDIVKTARFKELPPSDADXYYIRAASMXRNF

SEQ ID NO: 197116 - protein, 84 aa, Triticum aestivum
  unsure (1)..(84): unsure at all Xaa locations
  Clone ID: PAT_TA_91534.pep
PPPXLKXMEPEYPEVEEPRIVLLLLLPFLTKECPPADSLTGCVVLIGAILCYWLLSAQYGHVPSYEHGVIILSYWLCYIGWCIL

SEQ ID NO: 197117 - protein, 156 aa, Triticum aestivum
  unsure (1)..(156): unsure at all Xaa locations
  Clone ID: PAT_TA_91535.pep
VNLKSTEILEHPNVQICNEGRQSALVEILEILTVVCEEHKLPLAQTWVPCKYRSVLAHGGGVKKSCLSFDGSCMGEVCMSTSDVAFHVIDAHMWGFXRDACVXEHHLQKGQGVPGKXFXQHRPCFSKEXQFCKLDTPCALSXXLGLAGCLPNVTLN

SEQ ID NO: 197118 - protein, 80 aa, Triticum aestivum
  unsure (1)..(80): unsure at all Xaa locations
  Clone ID: PAT_TA_91536.pep
NIVNLFIVPLDNLVQGQHVSQDSEXHRRDXGKXHFPTXCXIFLCREXPXVINKXXKPPTGXKGFLAXXPFXXGXXLXILK

SEQ ID NO: 197119 - protein, 142 aa, Triticum aestivum
  unsure (1)..(142): unsure at all Xaa locations
  Clone ID: PAT_TA_91537.pep
MAPAVMASSATTVAPFQGLKSTAGLPVSRRSSGSLGSVSNGGRIRCMQVWPIEGIKNSKTLSYLPPLSTEXLLKQXDYXIRSKWVPCLXSTRLXXLPFSXNIPPGYYDXPYWTIWKLLCSGCTDAXTSVNXVXXVXKDYPEX

SEQ ID NO: 197120 - protein, 91 aa, Triticum aestivum
  unsure (1)..(91): unsure at all Xaa locations
  Clone ID: PAT_TA_91538.pep
IMXXTSXPXXXGGGGRRXEAXPRAPRGXDXAARRXRSARRRGCGGAGEGVRRGRARTDRAPRPWRRPARRRSRAPPWLRGAGSGERGSASG

SEQ ID NO: 197121 - protein, 89 aa, Triticum aestivum
  unsure (1)..(89): unsure at all Xaa locations
  Clone ID: PAT_TA_91539.pep
XGRGAPTRSSGPXPIALRESLPXAGGXAXYSGRGTGPTHTTACSSPRCRRPEFRPCXVCPVHWSDVVADSSVEACQIIATTIPWLKWXA

SEQ ID NO: 197122 - protein, 71 aa, Triticum aestivum
  unsure (1)..(71): unsure at all Xaa locations
  Clone ID: PAT_TA_91540.pep
YVRLHSCIKQXTLRAKFVFTRLXDASSXEYPXDEHRCRISTSTMXHLITRLNGGXIAXIPAXKSVYXGHXS

SEQ ID NO: 197123 - protein, 126 aa, Triticum aestivum
  unsure (1)..(126): unsure at all Xaa locations
  Clone ID: PAT_TA_91541.pep
MADQLTDDQIAEFKEAFSLFDKDGDGCITTKELGTVMRSLGQNPTEAELQDMINEVDADGNGTIDFPEFLNLMARKMKDTDSXEELKEAFXVFDKDKXFISAAXLXHVMTNXGEKLNDXEVDEMIT

SEQ ID NO: 197124 - protein, 154 aa, Triticum aestivum
  unsure (1)..(154): unsure at all Xaa locations
  Clone ID: PAT_TA_91542.pep
MAPTVMASSATSVAPFQGLKSTAGLPVSRRSNGASLGSVSNGGRIRCMQVWPIEGIKXFETLSYLPPLSTEASSSRSDYXIRSKWVPCLRFNKVGSSPVEHNHLLGYXNGRIGHXELPIFXXNDXQSDNEVEEVKKDTLPYFRSGTNASRHQTL

SEQ ID NO: 197125 - protein, 96 aa, Triticum aestivum
  unsure (1)..(96): unsure at all Xaa locations
  Clone ID: PAT_TA_91543.pep
RQEXRLXXRRACXRGXXSNVGMRPRDXXIWXXLXXXCWLESVTXSFSERAKXQSIIDXESVTXXFSERXKLQXXIDVESVTVSFSERXKLXSIIDX

SEQ ID NO: 197126 - protein, 97 aa, Triticum aestivum
  unsure (1)..(97): unsure at all Xaa locations
  Clone ID: PAT_TA_91544.pep
PVESVYEDQAFVFSENFASKMTIPSKHFNLCLXIARSNGXPKLQYLHLLIHASQNAKLNLXPTCPNNVGWQVXALXTPXTLPIEXKWIWVXXGXGFW

SEQ ID NO: 197127 - protein, 188 aa, Triticum aestivum
  unsure (1)..(188): unsure at all Xaa locations
  Clone ID: PAT_TA_91545.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGXTSQADCAVLIIDSNTGGFEAGISKDGXTREHPSXLHLGVXXMICCXTRWXHNPSTKGRYEEMXGSPLPEKXGXPXKVPRPPG

SEQ ID NO: 197128 - protein, 115 aa, Triticum aestivum
  unsure (1)..(115): unsure at all Xaa locations
  Clone ID: PAT_TA_91546.pep
VGSSASQLRGHSISDLSMSLITDDPDRSPRDCATKRHHHHHSGGWRQRRLLIAAASGAXSLLALCIILWLNLRPSSPRFTLLAATATFSNASNGRRPXAPRRGLMXTXPXPXXXV

SEQ ID NO: 197129 - protein, 48 aa, Triticum aestivum
  unsure (1)..(48): unsure at all Xaa locations
  Clone ID: PAT_TA_91547.pep
LFLFCCCMGSXQXHXARVXXDGXSRWXYXAQPSXAXLLIXTXKLTYYY

SEQ ID NO: 197130 - protein, 131 aa, Triticum aestivum
  unsure (1)..(131): unsure at all Xaa locations
  Clone ID: PAT_TA_91548.pep
MAPTVMASSATSVAPFQGLKSTAGLPVSRRSNGASLGSVSNGGRIRCMQVWPIEGIKXXETLSYLPPLSTEXLLKQVDYLXIRSKWXLASXXNKVGSTFRXENASLGYXXGXYWQGTAGAPTHYGGGQEDT

SEQ ID NO: 197131 - protein, 137 aa, Triticum aestivum
  unsure (1)..(137): unsure at all Xaa locations
  Clone ID: PAT_TA_91549.pep
MMSRSYTNLLDLAEGNFAALGPAGGGARRRSGSFGMKRMSRVMTVPGTLSELDGEDESEPAANNSVASDVPSSVSGERLLVVSNKXPILARRRPTAAVVLLWDXTRCPQLRDXIRQMSVSAGRIPRDKTVPRLTRSS

SEQ ID NO: 197132 - protein, 95 aa, Triticum aestivum
  Clone ID: PAT_TA_91550.pep
IGKGRTDPAPRPCSDPPPHRRRASPRASTPLQPRMPPPSNGQGPHHRELPRPSPPPSVDLHHRPPRASPATPAPPRALPRPPYLIDEHRDPDGCR

SEQ ID NO: 197133 - protein, 142 aa, Triticum aestivum
  unsure (1)..(142): unsure at all Xaa locations
  Clone ID: PAT_TA_91551.pep
MIFKKGDDLRQDQLVIQMVSLMDRLLKLENMDLHLTPYQVLATGQDEGMVEFIPSSPLAQIISXHRSITSYLQKFHPDEDGPFGITAQCLETFIKSCAGYSVITYIXGVXDXHXDNLLXRNDGCLFQVDFGLIRVQIQSSLK

SEQ ID NO: 197134 - protein, 194 aa, Triticum aestivum
  unsure (1)..(194): unsure at all Xaa locations
  Clone ID: PAT_TA_91552.pep
LEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESNLHXVLRLRGGXQIFVKTSTXKTYSGGLNXTHHNVKXSQDKEXFPGQQRLCGTLRMALLYSKSHWGR

SEQ ID NO: 197135 - protein, 79 aa, Triticum aestivum
  unsure (1)..(79): unsure at all Xaa locations
  Clone ID: PAT_TA_91553.pep
MHPDATSPSHRIARVAAHLNPTRXXMDEGAXLRPAVCRAKGXAPGFXVAVVGAAGGIXQSLXSAHEDNPLVXXIHLXDV

SEQ ID NO: 197136 - protein, 152 aa, Triticum aestivum
  unsure (1)..(152): unsure at all Xaa locations
  Clone ID: PAT_TA_91554.pep
LVPNSARAGPSLAPGKDLFNTLREKHGLAGFQKLIKEKIVPLAGDVGTRNFGLDSSTSDDLCQEIDVIVHGAATTSFYERYDVALASNALGAQYGCEFAKKCPNLKLLLHVSTAFVAGTQEGLYWEKALKMGEALXAGCHLDIEAEFNWLRQ

SEQ ID NO: 197137 - protein, 78 aa, Triticum aestivum
  unsure (1)..(78): unsure at all Xaa locations
  Clone ID: PAT_TA_91555.pep
XAGPDPEPRTEPTXECRRAIYPSXTCLRWQLRPPRRLCXPARSVRALLHIXPHSQRRRGEDGMVVHENLSXTALVAGG

SEQ ID NO: 197138 - protein, 116 aa, Triticum aestivum
  unsure (1)..(116): unsure at all Xaa locations
  Clone ID: PAT_TA_91556.pep
FXXPXVLTXYILGAXRRDPXGNFVXXGFXXCXXHHXXRGVKXXLFXGAAXXRGXFCWPXXXQALRRDHKGPGGGGRRGGAALRRRPWRRSGAAGMGXGGCCTVRRVVWVYFPPLIS

SEQ ID NO: 197139 - protein, 63 aa, Triticum aestivum
  unsure (1)..(63): unsure at all Xaa locations
  Clone ID: PAT_TA_91557.pep
QQVIFSVXVVVFLCQSVLSXMCRSVDVVFLIASSSVALSGVNXSMVTRGRNNMCYXSVGXVRR

SEQ ID NO: 197140 - protein, 53 aa, Triticum aestivum
  unsure (1)..(53): unsure at all Xaa locations
  Clone ID: PAT_TA_91558.pep
MSISQDNCNQKGVCHASVDESXLTFXSFCTCDRDHGGFDCSDELVSXNGKSHV

SEQ ID NO: 197141 - protein, 145 aa, Triticum aestivum
  unsure (1)..(145): unsure at all Xaa locations
  Clone ID: PAT_TA_91559.pep
MRTNPTTSPPGASTIEEKSTGRIDQIIGPVLDVTFPPGKLPYIYNALVVQSXDTDDKQINVTCEVQQLLGNNRVRAVAKSATDGLMRGMEXIDTGAPSXXVGGAXLDFKFWGTVDNWSCINFPIAPPYNNYHLKIRRILPYPGKI

SEQ ID NO: 197142 - protein, 140 aa, Triticum aestivum
  unsure (1)..(140): unsure at all Xaa locations
  Clone ID: PAT_TA_91560.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATXVXNXVXESRRST

SEQ ID NO: 197143 - protein, 51 aa, Triticum aestivum
  unsure (1)..(51): unsure at all Xaa locations
  Clone ID: PAT_TA_91561.pep
LFSPPASGXSKHSASLPLSPPAWXLSSARXXPLXPXPSPARXSPRRTMLCV

SEQ ID NO: 197144 - protein, 139 aa, Triticum aestivum
  unsure (1)..(139): unsure at all Xaa locations
  Clone ID: PAT_TA_91562.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGXHXAVLSSYEYXSXGLKKYDFDNTMGXFXIAPXFMDKLVXHLSKNS

SEQ ID NO: 197145 - protein, 62 aa, Triticum aestivum
  unsure (1)..(62): unsure at all Xaa locations
  Clone ID: PAT_TA_91563.pep
XDVGAXGTTCLIAGAVXXALVXTXFPSFFXREDTCPXCDXAGFVRTXGXXXRANAAXRXHSA

SEQ ID NO: 197146 - protein, 69 aa, Triticum aestivum
  Clone ID: PAT_TA_91564.pep
IASGCLIYIPPDIQLYIFKWGAKHQPTPGSSSAVKIHSGKTAAQGASCYVTDAGLEFKTCIKMVSHHFS

SEQ ID NO: 197147 - protein, 204 aa, Triticum aestivum
  unsure (1)..(204): unsure at all Xaa locations
  Clone ID: PAT_TA_91565.pep
AITSHFRDKLGQGGYGSVFKGVILPSNVHVAVKMLEGNPNCNGEDFINEVSTIGRIHHVNVVRLMGFCSEEMRRALVYEXYMPQGSLXDKYIFSXPEKISPWGQAGPEIALGIAXGIDYLHQXXDMQIFTXTXQPHNILLXNXFFPKSGXIGLAKXIPRDTLFATRPYGNITYPRITLLTTSLLGALQNPRKSIGTNLLDGIKT

SEQ ID NO: 197148 - protein, 95 aa, Triticum aestivum
  unsure (1)..(95): unsure at all Xaa locations
  Clone ID: PAT_TA_91566.pep
MAWPLXQQLLLIXAXXTAAASSSXXTPDGPGPWXEQFHAVLFXNLTNVSIXXTGPPLRLHDXYYXWXXRXNLKLIXXQLSGXXLYXLXWNNGSRF

SEQ ID NO: 197149 - protein, 130 aa, Triticum aestivum
  unsure (1)..(130): unsure at all Xaa locations
  Clone ID: PAT_TA_91567.pep
LLPVAPSHRPSSSLVCTRVRGRARAADTRPWPWXRRRGYLSPPPSHSSTPVTLLHSSRISPVLARPRAXSPRPPSPXWPPQPSSKIRPSRAPSPPSTAXALXPILXRXXPXTPXVGRTHVAPISSKXXXL

SEQ ID NO: 197150 - protein, 92 aa, Triticum aestivum
  unsure (1)..(92): unsure at all Xaa locations
  Clone ID: PAT_TA_91568.pep
APRCLIXGRCRXRLGINPGEKCTSLNVHGAXLAQGRRRXXHXRKANMKXXPXRSTDLXPASEFXXFAQRXXAEDLHTXXIGAPXXRREAIPS

SEQ ID NO: 197151 - protein, 54 aa, Triticum aestivum
  unsure (1)..(54): unsure at all Xaa locations
  Clone ID: PAT_TA_91569.pep
XXSTYPPVSVSGTGTLLLKXXRAFPGSMXSVTYFTAXXPGSXPXCRXNRYXTGL

SEQ ID NO: 197152 - protein, 70 aa, Triticum aestivum
  unsure (1)..(70): unsure at all Xaa locations
  Clone ID: PAT_TA_91570.pep
XAHAALXATRIPTSARLHSXAASKHRVXFAXFSGLXXGSCXVXAXAXXXSFSXVLGAQLFASASXDNTVX

SEQ ID NO: 197153 - protein, 52 aa, Triticum aestivum
  unsure (1)..(52): unsure at all Xaa locations
  Clone ID: PAT_TA_91571.pep
CTFXVTXLXCDXWXTQSTXTVSGSYTIVMXQGTDTXTXEKLXQTNYTILCYX

SEQ ID NO: 197154 - protein, 70 aa, Triticum aestivum
  unsure (1)..(70): unsure at all Xaa locations
  Clone ID: PAT_TA_91572.pep
GFIHPKGIFLFLMFSRTYVPPIQVYPLXLINSSLLPIKGGRSIGRVTGLTCDILYPKTNALPSALHPFSN

SEQ ID NO: 197155 - protein, 130 aa, Triticum aestivum
  unsure (1)..(130): unsure at all Xaa locations
  Clone ID: PAT_TA_91573.pep
MARTKQTARKSTGGKAPRKQLATKAARKSAPTTGGVKKPHRYRPGTVALREIRKYQKSTELLIRKLPFXRLVRXDSQDFKXDLRXIPRRLALXEGGPAYSXXFXGHKLXXINXXXVXXIXRXLADPWANP

SEQ ID NO: 197156 - protein, 132 aa, Triticum aestivum
  unsure (1)..(132): unsure at all Xaa locations
  Clone ID: PAT_TA_91574.pep
MAPTVMASSATSVAPFQGLKSTAGLPVSRRSNGASLGSVSNGGRIRCMQVWPIEGIKKFETLSYLPPLSTEALLKHVDYLIRSKWVPCLXFSXVGFIXXEHNASXGXXDGRYWEMWKCLCSGCTTHTXXTKV

SEQ ID NO: 197157 - protein, 51 aa, Triticum aestivum
  Clone ID: PAT_TA_91575.pep
EPAAWLATAACGWRFISQCCWRNYTFAIRSQNDQDKVNTIMKIECYPPASA

SEQ ID NO: 197158 - protein, 102 aa, Triticum aestivum
  unsure (1)..(102): unsure at all Xaa locations
  Clone ID: PAT_TA_91576.pep
FGAHVMCRVWLIFYMVGTPXQISXXFHLGHGCIIFIXVSXSTLIFLKVHLRNVDWSFXDIYIYIYVCVCVCVCVCVCVCVCVCVFCPLQHSIIAMYSNLPFS

SEQ ID NO: 197159 - protein, 88 aa, Triticum aestivum
  unsure (1)..(88): unsure at all Xaa locations
  Clone ID: PAT_TA_91577.pep
EVDXXCHLFSRFFCLSLLECRMGSXACXHVXNSCLLHAHACMKCISILVCVCFFFSLCLLLFSAHVCFRFLFFIFQLSFFFFACIFRC

SEQ ID NO: 197160 - protein, 103 aa, Triticum aestivum
  Clone ID: PAT_TA_91578.pep
YTYFRHYRRGQCLVPAHTARRSNNKVVRSNRPYLMYRRTATSLLERSAWFNVIFDSPVNCTTLWTARHGRHGVVPLHSKGCMCSIILILSPSLSDQLHAMHSF

SEQ ID NO: 197161 - protein, 78 aa, Triticum aestivum
  Clone ID: PAT_TA_91579.pep
EREREREREREREREREREREREREREREREREREREREREREREFFWAKFSFRPRQGILHPVRILSSDMNAHRMLRV

SEQ ID NO: 197162 - protein, 170 aa, Triticum aestivum
  Clone ID: PAT_TA_91580.pep
FSDLTSEEFTEKHLGYRHQHGVDSTPVAAVNMSNAQFDSTPDSVDWRAAGAVTQVKNQGSCGCWWAFAAVAATEGLVKIATGNLISMSEQQVLDCTGGANSCNGGDINAALSYVASSGGLQPEESYAYTGQQGACRSTAPAQTRPPHRRPRMVETRQTSGLRPWRAMEAT

SEQ ID NO: 197163 - protein, 89 aa, Triticum aestivum
  unsure (1)..(89): unsure at all Xaa locations
  Clone ID: PAT_TA_91581.pep
AFPPATRIFSHPFHLGRQHPPPHRPPACHSISPPNLHRQLPLPKIHCRTLSGAGVLYLAVCLPFSVNPXSTVIHXDVGARASHXVCSLA

SEQ ID NO: 197164 - protein, 89 aa, Triticum aestivum
  unsure (1)..(89): unsure at all Xaa locations
  Clone ID: PAT_TA_91582.pep
MKGTKLAAILILQAVLVMGVLSHVNADYFPKCCNNCRSFSGVDVCDDAHPKCPKGCSACRVVXTSPEMWRCADMKSTVDGTCGGPCKKY

SEQ ID NO: 197165 - protein, 89 aa, Triticum aestivum
  Clone ID: PAT_TA_91583.pep
RLISAVRGHTTTFWSIMPLLCSTVFNLLSSSMNLHKDSPGIATVRRSFGICYNVLIVLHMFCFTGDVSHTLYYKYNSIALLWKECSAFL

SEQ ID NO: 197166 - protein, 72 aa, Triticum aestivum
  unsure (1)..(72): unsure at all Xaa locations
  Clone ID: PAT_TA_91584.pep
HHVSSLHRLNSANIAFIPKKXDGADDISDFRPISLIHAVAKIITMMMACNSSCLHMSALVSNTQSAFIKKKP

SEQ ID NO: 197167 - protein, 101 aa, Triticum aestivum
  unsure (1)..(101): unsure at all Xaa locations
  Clone ID: PAT_TA_91585.pep
SVVGRCSGRSHMYLLRPLKLEQMRRPGGGVDGXAXGSRTLSGRIDRNTNLSLMSLCCLNPWIRPRPRAPNHPRPCLSKLSGHRSWSFSPRISFSTRPWATY

SEQ ID NO: 197168 - protein, 72 aa, Triticum aestivum
  unsure (1)..(72): unsure at all Xaa locations
  Clone ID: PAT_TA_91586.pep
LRALXVEVQWGIHQVNPDALNMQLNNPPVRQCPXTGSTKELCPPVDKPTSDSWNKXGLKQKTEGXDTSQGGG

SEQ ID NO: 197169 - protein, 89 aa, Triticum aestivum
  unsure (1)..(89): unsure at all Xaa locations
  Clone ID: PAT_TA_91587.pep
NGAQPKLSMRAQDECFPXNYNEHQAHASQLXCXKNITNIHKAYIFSNNPRYKTNYTERXVNSFMQEKHEWSKGSSELYTVKSSXPLVNP

SEQ ID NO: 197170 - protein, 201 aa, Triticum aestivum
  unsure (1)..(201): unsure at all Xaa locations
  Clone ID: PAT_TA_91588.pep
SSXXPNFLXPFLAEXXSXYXVXQFPLLYTLEMFIFPVQSSVSCILLCHSVLYLGXGMDHCSCNKEVVEQCPXXIGXSEXFSLCAMLKAIGCXFPXRNXRKGGIIIFILFHISSQVGLLGNCSALPVVVXXPPNRNSLKAVAPFAGFDPHSSTRGEEPGAVDGRAAEEGLRRGRSAKDGNGGPQQVRSHPAARVAGESELTL

SEQ ID NO: 197171 - protein, 151 aa, Triticum aestivum
  unsure (1)..(151): unsure at all Xaa locations
  Clone ID: PAT_TA_91589.pep
NVKAKIQDKEGIPPDQQRLIFAGKQLEDGRTLADYNIQKESTLHLVLRLRGGMQIFVKTLTGKTITLEVESSXDTIDNVKAKIQDKEGIPPDQQRLIFAGKXXEDGRTLADYNIQKXSTLHLVLRLRGGSVFVKDLNGQDITLESIFTLTM

SEQ ID NO: 197172 - protein, 113 aa, Triticum aestivum
  unsure (1)..(113): unsure at all Xaa locations
  Clone ID: PAT_TA_91590.pep
XLVEVKRXRXGLVLALESXIXNNGEGNSXFXTAPSRILVDCVXRTVQDSXLRRGRXPXKLKSHCLARGEPAVEHDXDNVDDLEFLFTMFLNTCFGVRSALPNYPRTGPSLSRR

SEQ ID NO: 197173 - protein, 99 aa, Triticum aestivum
  Clone ID: PAT_TA_91591.pep
LKHRWPRPPPSRIEVCDSCSLASALVGLLAVVSRLSFCTMCVESGWSCAGRYYRCEGAVLPPNRAVLPLIRLSGTTAPHHGTTAEGRGQGVKSWAGVVS

SEQ ID NO: 197174 - protein, 34 aa, Triticum aestivum
  Clone ID: PAT_TA_91592.pep
VKHLHVANRVATQIIWYTYPCNKLMKKCHPDAFV

SEQ ID NO: 197175 - protein, 110 aa, Triticum aestivum
  unsure (1)..(110): unsure at all Xaa locations
  Clone ID: PAT_TA_91593.pep
GAXTAWTXWRSAXLXVRRTPXVXQVVVLXRFGRHRGRRRGLXGEAAXAAVVPRPGRRGAGRGRAVGXVERGDDRRRSRRARRRHGSDHGRRRLLARALDEERQQKLCSLS

SEQ ID NO: 197176 - protein, 140 aa, Triticum aestivum
  unsure (1)..(140): unsure at all Xaa locations
  Clone ID: PAT_TA_91594.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGXIFREHNASPGYYDGRYWTMWXLPMFGCTDXTQVXNEVEESRRIT

SEQ ID NO: 197177 - protein, 75 aa, Triticum aestivum
  unsure (1)..(75): unsure at all Xaa locations
  Clone ID: PAT_TA_91595.pep
XYCXAXXGYFXHTQXGXCXXLXSTYFTXWXHXXSXVXKRLMCGXXGVXFLGXXPPXFENEXAXAIIXLKIXXXSS

SEQ ID NO: 197178 - protein, 48 aa, Triticum aestivum
  unsure (1)..(48): unsure at all Xaa locations
  Clone ID: PAT_TA_91596.pep
RLRWKRGGESPPPSSSSLTSSLDGRRISPLVHGLHGXEGREPLRDWIS

SEQ ID NO: 197179 - protein, 121 aa, Triticum aestivum
  unsure (1)..(121): unsure at all Xaa locations
  Clone ID: PAT_TA_91597.pep
KRRXGDXXFGXXVRPPWDGXPKWXVLSLXSLXXLPGFLFXXRNWXNRGFPXXDLDFGXXKWTXNWNILXXTQVTYPTYPSXKFPKFLNDXFPLRKIFFFSXKFISELCAXKQXQFFLLKTI

SEQ ID NO: 197180 - protein, 108 aa, Triticum aestivum
  unsure (1)..(108): unsure at all Xaa locations
  Clone ID: PAT_TA_91598.pep
HDPLLKFQGISVLPEYAPLRQFVMPRQHMMSGSNKLYVHVQRVXDSFAHPNTRGGAXYQFAYXILYAXHGVVXXSDXKPAYQLIAXXSPSHCVYEXPHXASKVXXMXW

SEQ ID NO: 197181 - protein, 65 aa, Triticum aestivum
  Clone ID: PAT_TA_91599.pep
TAATAAWPPSPTTQPWTALKHHYYYISWSMHHRIWFISYKLLVRTIPVPCNMHAAAVQHIYGFFF

SEQ ID NO: 197182 - protein, 159 aa, Triticum aestivum
  unsure (1)..(159): unsure at all Xaa locations
  Clone ID: PAT_TA_91600.pep
GIARGLQYLHEDSQLKVVHRDLKASNVLLDADMSPKISDFGLARLFGRGQTQGVTNRVIGTYGYMAPEYLMRGNYSVKSDVFSFGVMVLEIVTGRKNSDTSQSEDLLTMMWEHWTAXTVLEKMDPCMNNSFSXSDARXCIQVALLCSRRTRGQPMMSWA

SEQ ID NO: 197183 - protein, 147 aa, Triticum aestivum
  unsure (1)..(147): unsure at all Xaa locations
  Clone ID: PAT_TA_91601.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPXCKVWCCKPTNTMLHPEGFAQLS

SEQ ID NO: 197184 - protein, 104 aa, Triticum aestivum
  unsure (1)..(104): unsure at all Xaa locations
  Clone ID: PAT_TA_91602.pep
RMIQXQLVAXKFELRLLIHKTCNDGFVLVVQLCGYLHEVGVVSSHSIEQVLQLDKGEGVRLMAGRTLINIRMKLTTMIHVSQINQVAERKKKRMKPKQSELTDE

SEQ ID NO: 197185 - protein, 51 aa, Triticum aestivum
  unsure (1)..(51): unsure at all Xaa locations
  Clone ID: PAT_TA_91603.pep
XTISTXQXVVVYAAXAXVSXSHHTLLXQTSWXTSSHSPXLDAXEPENXGAA

SEQ ID NO: 197186 - protein, 170 aa, Triticum aestivum
  unsure (1)..(170): unsure at all Xaa locations
  Clone ID: PAT_TA_91604.pep
MAPTVMASSATSVAPFQGLKSTAGLPVSRRSNGASLGSVSNGGRIRCMXVWPIEGIKKFETLSYLPPLSTEALLKQVXYLIRSKWVPCLEFSXVGFIFREHXASPGYYDGRYWXTMWXLPMFGCTGRHTMINEVXXVKXXYLDXYVYRNPSALRKLTPSVRRKAKHHEPY

SEQ ID NO: 197187 - protein, 122 aa, Triticum aestivum
  Clone ID: PAT_TA_91605.pep
NMGTRVLRFIPNTPALAAWGQKPRTSHLSDWINGQTEGNILNSHKRCIAHMKQVFIIQDHTSKFTQILHPWNIRPLQDGHPSGHPHNKFGGVRCSLPCGGPSLISFTASSLATAPLHGRKPA

SEQ ID NO: 197188 - protein, 112 aa, Triticum aestivum
  unsure (1)..(112): unsure at all Xaa locations
  Clone ID: PAT_TA_91606.pep
FHQNRQLCIKNGSVLXKAVCSNMNIQHISVTPKILKNLGKIKKLYXKVVQKVSEPFDVXVKKCKIAHYSQSXCPAPHKPTSIVNIQKKNLGTLFLLYNGIVQGIIIFVEKFL

SEQ ID NO: 197189 - protein, 163 aa, Triticum aestivum
  unsure (1)..(163): unsure at all Xaa locations
  Clone ID: PAT_TA_91607.pep
NGLANIGQYTSNVQEVVVHLVHAPEYAXPRLFSIKSDVFSFGVLXLESLAEKDSHECGNFINLLGHAWQLFEEESWVDLIDTALLPNGHSEEMMRCINIALLCVQESAIDRPTMLDVVAMLSNKTMIVDKPKHPAYFTGDKEAPTTNQSCSVNDVTISTLTPR

SEQ ID NO: 197190 - protein, 202 aa, Triticum aestivum
  unsure (1)..(202): unsure at all Xaa locations
  Clone ID: PAT_TA_91608.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKXYPDAYXRIIGFXNMRQVQSSAQCLKHRAARSRPNSHGTYKNEFVILLGSSIASTVKKAVSMPE

SEQ ID NO: 197191 - protein, 59 aa, Triticum aestivum
  Clone ID: PAT_TA_91609.pep
IEYCRHKLSKGASYLIYYTILGFFFCSRSFKFLAPGISSHLVFLSCMITSRLQHICTMK

SEQ ID NO: 197192 - protein, 101 aa, Triticum aestivum
  unsure (1)..(101): unsure at all Xaa locations
  Clone ID: PAT_TA_91610.pep
LWPCASVPLSXDLCEKNHSQFPDGSAPXGNLVDQLGSDELFCREXPSGRGNHRHRHHTKILPLGGVNLHQHLHQHHLLSNPSSSLVSQFLSLSLGLVPMGC

SEQ ID NO: 197193 - protein, 70 aa, Triticum aestivum
  unsure (1)..(70): unsure at all Xaa locations
  Clone ID: PAT_TA_91611.pep
KGTLLFLWWELICFLLLLREVQIDLVLCRVILFSRFFLHFSCSFFSGIYSXIGNREHDSPVSCXNCFFTR

SEQ ID NO: 197194 - protein, 102 aa, Triticum aestivum
  unsure (1)..(102): unsure at all Xaa locations
  Clone ID: PAT_TA_91612.pep
AEWXLRAVAARNYSWEELGXXGTRHAGRAETWXCGTRRAAVLVVVDGGRXQARVSARFLVVGLIHRRIRMRGEGNRDTAGARCRRVQNTRSXRARCTHVRCL

SEQ ID NO: 197195 - protein, 171 aa, Triticum aestivum
  unsure (1)..(171): unsure at all Xaa locations
  Clone ID: PAT_TA_91613.pep
RSFPFLAAAAASYPLEADPTMADVDVDTEVAAGAQPKKRTFRKFSYRGVDLDALLDMSTDDLVQMFPAXRARRRFKRGLXKRKPMALXKKLRKAKKDAPXLGGEXDQLRTHLXRNMIICXLEINXXLNRVYNGKLXTKXEINPEMIGITCRFSTPYNQTCRPVLCIFRSSS

SEQ ID NO: 197196 - protein, 150 aa, Triticum aestivum
  unsure (1)..(150): unsure at all Xaa locations
  Clone ID: PAT_TA_91614.pep
KHVPVDLAFYIAREVACALLEMHRKLVIHRDIKSENVLVDLDSKRSHGTPVVKLSDFDRSIPLHSLSHTCCIAHLXGTYPPNVCVGTPCWMAPEXLXAMHEKTXYGLXEVDIWSIMDVLXSEMLHFVYXTRTTRSRIYDLIIKEEQSQGN

SEQ ID NO: 197197 - protein, 54 aa, Triticum aestivum
  unsure (1)..(54): unsure at all Xaa locations
  Clone ID: PAT_TA_91615.pep
CTDATQVINEVEEVKKEYPDAYVRIIGFDNMRQVQCVXSFIAFKPPGCEESGKA

SEQ ID NO: 197198 - protein, 77 aa, Triticum aestivum
  unsure (1)..(77): unsure at all Xaa locations
  Clone ID: PAT_TA_91616.pep
LNPTSSXILLILPGTVHAXVXDEXFWHVKXFLELSLVEVASQCIKGWLDLSXEFLETKKDEFHQIWQFWFKLAASKN

SEQ ID NO: 197199 - protein, 139 aa, Triticum aestivum
  unsure (1)..(139): unsure at all Xaa locations
  Clone ID: PAT_TA_91617.pep
GTWTTVWTDGLTSLDRYKGRCYHIEPVAGEDSQWICYVAYPLDLFEEGSVTNMFTSIVGNVFGFKALRAXRLEDXXIPXTYXKTFKGPPXXIKFXXXNXXNXXXXLMGIPXNPXFGIXXKNLGXXXXDVHVXGXFPKSE

SEQ ID NO: 197200 - protein, 93 aa, Triticum aestivum
  unsure (1)..(93): unsure at all Xaa locations
  Clone ID: PAT_TA_91618.pep
PKEAPPPKGGGTMLLILLPHLXFKVARMIFMXESXICCYFXIXVGIFHYXTWXAYSNDGXPQNVXGXCXQXSWXHTHXXCFVELXYTCXXSAX

SEQ ID NO: 197201 - protein, 73 aa, Triticum aestivum
  unsure (1)..(73): unsure at all Xaa locations
  Clone ID: PAT_TA_91619.pep
DXAPNSLXTSXIPPDENXPYRIRANRTGAIRAWAENPEDPADSDGRLRVGRMGGLAPPRARRAKSGGGRWGMG

SEQ ID NO: 197202 - protein, 151 aa, Triticum aestivum
  unsure (1)..(151): unsure at all Xaa locations
  Clone ID: PAT_TA_91620.pep
MAPTVMASSXTSVAPFQGLKSTAGLPVSRRSNGASLGSVSNGGRIRCMQVWPIEGIKKFETLSYLPPLSTEALLKQVDYLIRSKWVPCLQXSKVGYLPVSTXHPLGYYXGRYWAMWXLPMSGXTXXTQXXNEVQEVXKIPXATSHSGLKAQ

SEQ ID NO: 197203 - protein, 80 aa, Triticum aestivum
  Clone ID: PAT_TA_91621.pep
CLIRFKWIWLAVDRELCLIMFISAELFFFHADTFGSASCWAVKPTHLRMRTRTSAWPIQTDGKADKARVRLGHPVGVALT

SEQ ID NO: 197204 - protein, 51 aa, Triticum aestivum
  Clone ID: PAT_TA_91622.pep
PPFLEKNIRNLILNIICVKWSGLLSGLYRSTGPILDPLTQHLQHYSTHSHA

SEQ ID NO: 197205 - protein, 45 aa, Triticum aestivum
  Clone ID: PAT_TA_91623.pep
SESSSASDALLANCDCSLPSTYMLLVQVALLFIFYLHCMLNHLTY

SEQ ID NO: 197206 - protein, 98 aa, Triticum aestivum
  Clone ID: PAT_TA_91624.pep
GFWCRDLLAVSRLCLIFLIMVFMPLTLFCQVSTTLDIWDKYFLFSSLASCLHKYMMIYFFWSCCHEFACRRYGLLTEIRRAISTIIWTLFLSRLQMEY

SEQ ID NO: 197207 - protein, 116 aa, Triticum aestivum
  unsure (1)..(116): unsure at all Xaa locations
  Clone ID: PAT_TA_91625.pep
XRFSIPSLNDGXXXVIDSYRRIGTGPPFXPNTCNSTCLRRDTSQPTNITVIIITHLLLALYSGQQHRVTTTGSGACHVCTIARAHHYRLYVIISRKSSPAKRSDRDVELGYRRRRR

SEQ ID NO: 197208 - protein, 94 aa, Triticum aestivum
  Clone ID: PAT_TA_91626.pep
HSCFHCHLQIVHPIPVIFISISTKIISSFQRHTWFAKVMPCSFFLFRSTHMHCISHHACHAMFCIMFLVHCTVIDCWSFACVIALGRAGRRVCD

SEQ ID NO: 197209 - protein, 67 aa, Triticum aestivum
  Clone ID: PAT_TA_91627.pep
AVKYIHPVVFGGPIINIPNYLQICILPLIQTQLCNSIIAVTHKLFHHTPSRAPKLNNNNRARAPWGG

SEQ ID NO: 197210 - protein, 118 aa, Triticum aestivum
  unsure (1)..(118): unsure at all Xaa locations
  Clone ID: PAT_TA_91628.pep
CQWTAARNSIHCLWDGDTPLVRPSDIRVHVDGFYKALFSPTPRGGAALAPDTWSANQLVSDAANAALVAPFSKDEVLVAIKGMNPSSAPGPDGLPVTFFKMFSQTIKLEVMXLFDEFY

SEQ ID NO: 197211 - protein, 135 aa, Triticum aestivum
  unsure (1)..(135): unsure at all Xaa locations
  Clone ID: PAT_TA_91629.pep
XXXPFXXXFNFPANXGFKYMFARNKTLDSRPTDYFQVHXPIXPEKYINXDDDMLKVKXANXSLTPNCHIMLGTEXRATITRNWSEFRRCANIHEGDICAFPFQPYHRAPPDSHHPCALNGPSTATQAFCMHSLWL

SEQ ID NO: 197212 - protein, 204 aa, Triticum aestivum
  unsure (1)..(204): unsure at all Xaa locations
  Clone ID: PAT_TA_91630.pep
MTTVHAMTATQKTVDGPSSKDWRGGRAASFNIIPSSTGAAKAVGKVLPELNGKLTGMAFRVPTVDVSVVDLTVRLAKPATYDQIKAAIKEEXEGNLKGILGYVDEDLVSTDFQGDNRSKXSSDAKAGIALNDNFVKLVSWYDNEWGYTPRGRPQPVKITHKLMAYRENGCPKDVKLSENNFEGLALNFMVTRCGWLTPIGDKSA

SEQ ID NO: 197213 - protein, 173 aa, Triticum aestivum
  unsure (1)..(173): unsure at all Xaa locations
  Clone ID: PAT_TA_91631.pep
YRGIYPXPTPARAQPEIFPSRXAFPXGGALXXPHXPSSARASHAAPXHXRALCXIGHLLLAPPAPLEKLRRHPAPAALPVPAIXCSRSPPRWRSCSSRHVPPALLEEPKRPPALAALPTGRGRRETEEAEQRNGRTKACRRWRRVRWPKEPRLVAPASVDRDASEVVGVSCMR

SEQ ID NO: 197214 - protein, 133 aa, Triticum aestivum
  Clone ID: PAT_TA_91632.pep
PSESSTTSVKRRGPKKKLSSDEKFEIIAIAPDGQPIEPIRTKNAFVAQCGVLVRDKIPISIQQWFKPATEDPEVSYVNDMQKNDLWTELKSNFTLPPEDNPENPVKEQLIKSFALKRMEELFRRWKKELNKFV

SEQ ID NO: 197215 - protein, 81 aa, Triticum aestivum
  unsure (1)..(81): unsure at all Xaa locations
  Clone ID: PAT_TA_91633.pep
KTIPNPSARPPTHHCSPTXFSPPRSXGXXPRXRCWVRXASDXAGGLXPAPXPLXXPQRXLSXLXLSPPQXLVLAXQYPFFL

SEQ ID NO: 197216 - protein, 123 aa, Triticum aestivum
  unsure (1)..(123): unsure at all Xaa locations
  Clone ID: PAT_TA_91634.pep
XLXNPIFTQXSAEVGITSIRRPNLXKCVPVSCYLRSLDAQFGTXYPRSAGFDTDIGAFIETSVVSSSQGLMAPSVFYKNAALREVFLPGQIFVFGGFALRVNSLGHLEQIDSYAPGHRLVLEI

SEQ ID NO: 197217 - protein, 60 aa, Triticum aestivum
  unsure (1)..(60): unsure at all Xaa locations
  Clone ID: PAT_TA_91635.pep
EXXXIPXEQLSQFXIXXQTITTACIMXNXYXRLXTKLIFFLKXXSFXKGMXSXAEIIFLS

SEQ ID NO: 197218 - protein, 148 aa, Triticum aestivum
  unsure (1)..(148): unsure at all Xaa locations
  Clone ID: PAT_TA_91636.pep
MAVGKNKRISKGRKGSKKKAVDPFTKKQWYDIKAPLLFTSRNVGKTLVSRTQGTKIASEGLKHRVFEVSLADLXNDXDQAYRKIRLRAEDVQGMNVLTNFWGMDFTTDKLKSLVRKWXTLIEAHVDXXTXDNYMLRMFNIGSQXEPNK

SEQ ID NO: 197219 - protein, 92 aa, Triticum aestivum
  Clone ID: PAT_TA_91637.pep
LVVLSVHFAMPCIFKADMHHTCLCIMPCLCDGCLLCCLLLFGLLLSLASVPFRSCEDSFDSVYSLSSWTRSSSLRDFRQDDHTLEITSIFAC

SEQ ID NO: 197220 - protein, 114 aa, Triticum aestivum
  unsure (1)..(114): unsure at all Xaa locations
  Clone ID: PAT_TA_91638.pep
PHMHSSSNRKTRRGRKKHQPMRSFTISPTMLQLFLLLSLVSPATSCTEXEKHALLQFLTGTSGDGPSPRPGAMRQIAASGKDHLQWRWGRHLXLLASKGLEXXSRNSRRLKAAQ

SEQ ID NO: 197221 - protein, 129 aa, Triticum aestivum
  unsure (1)..(129): unsure at all Xaa locations
  Clone ID: PAT_TA_91639.pep
SPPPPKHPAAPPTPTPVPADCFRPTSIRDWIVKAARRRRRRSGKGSHQLAVHARRDGVPAPLVGPGRARTYEIDRLTERGQSSFCSHQRRTPRQNSARRLRPVLVATPGRTAERAPLARXRGKATPPVG

SEQ ID NO: 197222 - protein, 143 aa, Triticum aestivum
  unsure (1)..(143): unsure at all Xaa locations
  Clone ID: PAT_TA_91640.pep
PIAKMESVTLLIALAAQESWKIHHMDVKSKFLNGVIEGDMYVNQPPSFIKEGEEHKVLKLQXVFYGLWQGPREWNIKLDRALLFLGFEKAPLEHPMYKRGEEKDRLLIGIYVDDLLITEADEEVIAKFNLQKKEFFKMNDQVF

SEQ ID NO: 197223 - protein, 68 aa, Triticum aestivum
  unsure (1)..(68): unsure at all Xaa locations
  Clone ID: PAT_TA_91641.pep
MGTAYCYKIVGLCTYLPLELNSPCXTLNPVQERPMKAEWRREDWISIHLTTWHGTLVDXXCXPMFASM

SEQ ID NO: 197224 - protein, 151 aa, Triticum aestivum
  unsure (1)..(151): unsure at all Xaa locations
  Clone ID: PAT_TA_91642.pep
FFDTVIQGSFNKLXDVPVEVNHLSRQIDTMVLHGVTHRFDKLVRPETTSLPNETKIFGRDKELKQVLGFLNVPLLQPTWEGRSQAARVREGRILLARRLASRFVDSRRLRLLVVRCMSRLLRQGCARRPEVVAEGACLLDSWTRIGGSLVL

SEQ ID NO: 197225 - protein, 97 aa, Triticum aestivum
  unsure (1)..(97): unsure at all Xaa locations
  Clone ID: PAT_TA_91643.pep
GXEAQXGXVAXAXXPLKNGGLPLAAASPFSSSPQHXLPLXQPLPLSSFRACVXLCLHRXHAPXTSXRQSCLQLIXVGSXSSASPVVTXDQXXPAQXS

SEQ ID NO: 197226 - protein, 138 aa, Triticum aestivum
  unsure (1)..(138): unsure at all Xaa locations
  Clone ID: PAT_TA_91644.pep
MAPMVEWLPWFGSAVASAIFLWSMVQNHVPDTLRLYLTTRAAKLAACFNPYHEITISEYGAKRFQRSEFFLDVEAYLSDACAHHARRLKAELGKDSKNPQITVDDHEEVTDDFXGTTLWWYASKQQSKAMSSAYTRPG

SEQ ID NO: 197227 - protein, 70 aa, Triticum aestivum
  Clone ID: PAT_TA_91645.pep
GSGCSCGSDCKCGKMYPDLTEQGSAAAQVAAVVVLGVAPENKAGQFEVAAGQSGEGCSCGDNCKCNPCNC

SEQ ID NO: 197228 - protein, 121 aa, Triticum aestivum
  unsure (1)..(121): unsure at all Xaa locations
  Clone ID: PAT_TA_91646.pep
CAXPPEMTPANMGLQAVNSGSATLLPCXCFELLPPNRRKSESPPXVASSHHAVDSTHAAAPNRLGAILFAAAVVKPGCPSSNRRPLCRAPTTGLIRLPLRWLAKRFSSTRGFKSRMPHLLP

SEQ ID NO: 197229 - protein, 91 aa, Triticum aestivum
  unsure (1)..(91): unsure at all Xaa locations
  Clone ID: PAT_TA_91647.pep
PKWCXPWVQQGWFIFREHNASLGIRCRYWTMXKLPMFGCTDATQVINEVEEVTKEYPDAYVRIIGFDNMXQVQCVXFIAFKPPGCEESGKA

SEQ ID NO: 197230 - protein, 204 aa, Triticum aestivum
  unsure (1)..(204): unsure at all Xaa locations
  Clone ID: PAT_TA_91648.pep
AGCTSGGXGFLXEPGXFRGRXIGTXGGXEDXSRNGPAAAPAAKRRXCSEVHNXSERKXRNRINEKMXALQELVPHCNKSDKASIXDEAIEYLKSLQLQVQIMWMTTGMAPMMYPGAHQLMPPMAMGLNSACMPATQSLSQLQRIAPFMNHHLPNQMPRVQSPAIDSLNVGNQMQNNGVCGEPRNPFLHPDDTLTAASQLPDMFP

SEQ ID NO: 197231 - protein, 36 aa, Triticum aestivum
  unsure (1)..(36): unsure at all Xaa locations
  Clone ID: PAT_TA_91649.pep
HXLGLKXTSXXXIXXLSSXKVSXKQCFDILSARFQX

SEQ ID NO: 197232 - protein, 67 aa, Triticum aestivum
  Clone ID: PAT_TA_91650.pep
IQAHHHRLKLVSQKGYQFLIFSKAISRRVVQIPAYNGGVLNRHRPRAAGYLNSGLTYQQMRYSKSLW

SEQ ID NO: 197233 - protein, 114 aa, Triticum aestivum
  unsure (1)..(114): unsure at all Xaa locations
  Clone ID: PAT_TA_91651.pep
MVCFQCFFXLSFSXQGFHXTLPXXSSEVPSMQMNYAIKLXYXSFAPLLFQDVMAIFXYIISELVYVKFGEKNKVVILLGKWKKSRYFGQAVPVSGLAYYVTTPPTLVCTHIHFF

SEQ ID NO: 197234 - protein, 47 aa, Triticum aestivum
  Clone ID: PAT_TA_91652.pep
ILQLTITDCASGNAKSMPTYSYLQSELRLIQVAHALDITRGIKTGCT

SEQ ID NO: 197235 - protein, 77 aa, Triticum aestivum
  unsure (1)..(77): unsure at all Xaa locations
  Clone ID: PAT_TA_91653.pep
TXPXYSFXLXXKKPSRXXFXFQNXCKFEVDXIKHAKHXYLFSITRXXSPSIXSSPXXVHYLGLXLSXXKRGPRDRPE

SEQ ID NO: 197236 - protein, 141 aa, Triticum aestivum
  unsure (1)..(141): unsure at all Xaa locations
  Clone ID: PAT_TA_91654.pep
YPRARTTKSGRSSDTGLKIGSGFGFNSIHPDISALLSMHQQSLETVHHFWARFLLVKNKIKDCRDKDAISSVSATIARTRDPQTPSTAITYYTLLTWATTCKXYSAWEXPKKLXAXGGGPXPHQPSFKTKRXTSRDARDKW

SEQ ID NO: 197237 - protein, 171 aa, Triticum aestivum
  unsure (1)..(171): unsure at all Xaa locations
  Clone ID: PAT_TA_91655.pep
VSRRSNGASLGSVSNGGRIRCMQVWPIEGIKKFETLSYLPPLSTEALLKQVDYLIRSKWVPCLXEFSKVGFIFREHNASPGVLXWPGTGTMWKCLCSGCTDATQVINXVEEVKEXXPDAYSASIRFRQHAQVXCVXFXAFKPPGRPASLNHPRQAYIKMEFCQSECLGFLN

SEQ ID NO: 197238 - protein, 93 aa, Triticum aestivum
  unsure (1)..(93): unsure at all Xaa locations
  Clone ID: PAT_TA_91656.pep
TSSRQESDSTEPPAEGDGDLYCLLPPRNGNSGRSSSDSKRSTSSHKDDGDLFCRLSKNGGHSGGSSGGSKRSVGVRSVFRAIRRSSXFSSDIH

SEQ ID NO: 197239 - protein, 136 aa, Triticum aestivum
  unsure (1)..(136): unsure at all Xaa locations
  Clone ID: PAT_TA_91657.pep
SKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLXLPTDDVLLGXVXDXGFADGXGLILSVMSAMGEEXAL

SEQ ID NO: 197240 - protein, 162 aa, Triticum aestivum
  unsure (1)..(162): unsure at all Xaa locations
  Clone ID: PAT_TA_91658.pep
DEXTVTXSRPXQXEXGTAXVSXPXRTXEPXXGXRXRTXVAXRXRXPRRXXGDSXXALXGRVHEAEAXRRPPGGRCXQRXLPHXXGERAAPGRRSRGSAGXGASPAPGTPEDPXWSTRRRSAWLPDQQTDRAHARCRVRSSAADVSSRADRNQRVRLRGNFTF

SEQ ID NO: 197241 - protein, 180 aa, Triticum aestivum
  unsure (1)..(180): unsure at all Xaa locations
  Clone ID: PAT_TA_91659.pep
RRRWRRTSKYCSFLPSPPPQTVPLISTCVHLCRDAETLAQRVKRAKASAGAAAHRWVVLSSPRQQPRHSPGVSPSFAPPSTCVGGXGPLGANLAAIQXGDTTXGAQRATPTXRPRASRKEPXRAMNXGEEXIGVXLLMQNGGRDXSAGRXXCLLXSFLDLICSPTFRTXSXGPXXXYKSX

SEQ ID NO: 197242 - protein, 178 aa, Triticum aestivum
  unsure (1)..(178): unsure at all Xaa locations
  Clone ID: PAT_TA_91660.pep
QNYLEAYNKAKAIADGHEEQGKSANASLVDKYNSSKRSVSLVQKHRESKKEKKKQKQQRGKEEWEENHPWKXWDREKDLTCGRXKCGLDPXENTAQGLSSRFSSXSWKLPGEDLKLLLTQRSMPGGRFLGPTFGGKNQKRGWKLFFRKKLPKKKFAGIKVPSLFCLELKGKGNPRPLA

SEQ ID NO: 197243 - protein, 95 aa, Triticum aestivum
  unsure (1)..(95): unsure at all Xaa locations
  Clone ID: PAT_TA_91661.pep
MQIFVKTLTGKTITLEVDPPDTIXNVKAKIQGQGGXPPGLSSVSPRWQAAXRMGRTWADYNIKKXPHPLVLKSVGGCXLXQDLTGKTHLEAEHRH

SEQ ID NO: 197244 - protein, 76 aa, Triticum aestivum
  unsure (1)..(76): unsure at all Xaa locations
  Clone ID: PAT_TA_91662.pep
GMSAPXRFXXXMXLGFRQNRVLCXPXVRKPXXLVYVRYVPXVNSXPXLIDXPXXTCRVSLYIGGXRPTXSESRPGL

SEQ ID NO: 197245 - protein, 108 aa, Triticum aestivum
  unsure (1)..(108): unsure at all Xaa locations
  Clone ID: PAT_TA_91663.pep
SAVPDGDRXLLAHPRAQVGAQRHXKLLNXSSSXLPACSLRDSASXXQNSPWXHPLTLTHARXLGTVPLSPRKSRXLHTVGXGTPCKRSXNAXPCRAPGTQXFXGXPXN

SEQ ID NO: 197246 - protein, 101 aa, Triticum aestivum
  Clone ID: PAT_TA_91664.pep
SNKNSQWSHNLYISAWEPPLACLAWKILITDGREVNKKGACLKIPFTSILKTWSSGHLCKSLLPSTKGTIYLLLMLVSSLLKISTKNLENTVVMLDALVYN

SEQ ID NO: 197247 - protein, 141 aa, Triticum aestivum
  unsure (1)..(141): unsure at all Xaa locations
  Clone ID: PAT_TA_91665.pep
PKQKLSRVRARVSRNHPVEQIFDDIQTGRIACSKTCLANFCEHXSFISSIEPMKVEXALEDPDRINAMHEELHNFGRNQVWTLVEKPDEKHNGIGTKWXFRNKQDEDGQVVRNXARLVAQGYTQVEGMDYGETCTPLLELS

SEQ ID NO: 197248 - protein, 128 aa, Triticum aestivum
  unsure (1)..(128): unsure at all Xaa locations
  Clone ID: PAT_TA_91666.pep
RPPQECXKLKAXPAXGQLXXLXVPEIKEXCVVARIDGGLCGGXAFPKLKKIVLDDMKELVAWNDNDMPKVAFPLLRDVSIADCPLLSSLSGLGRCTGPIHLRVKGCPHITPDTLPAAFRNGVSTCKFH

SEQ ID NO: 197249 - protein, 107 aa, Triticum aestivum
  Clone ID: PAT_TA_91667.pep
QHLQLRHEHTSSHLCSPLQDELYASYFLSTKTALEEETKKASYLSNLVDSDEQRSHQVCLDQFSQQHYPHQLCYYQVGNQLSHVGYASVCHQDFNLTSSSSKHLSSP

SEQ ID NO: 197250 - protein, 31 aa, Triticum aestivum
  Clone ID: PAT_TA_91668.pep
TPSMLSLTNKHNNQCWIKEHKIKYYRFSPSG

SEQ ID NO: 197251 - protein, 88 aa, Triticum aestivum
  Clone ID: PAT_TA_91669.pep
APVGSTSPDRKNRQEDCQVGPHRCISVGFSTGFQIVGTRCLVHGNGNVGNSLFRPEHIDRLIAVEASQLDLVRNENLSEGKGGEATSY

SEQ ID NO: 197252 - protein, 163 aa, Triticum aestivum
  unsure (1)..(163): unsure at all Xaa locations
  Clone ID: PAT_TA_91670.pep
KDGFTYDGFSNGVLRLDGVASIASRALMLTDGVARSVGRAFFGGRFDSISSFSTTFVFVITPPYSDLSAYGLAFTISATTDSLLDALPSQYMGMFNRENVGNVTNRLFAVELDTSXSTEFGDINXNHVGIDVTPWGXQSPLLGTTSKMDVELLIGKPINMVVI

SEQ ID NO: 197253 - protein, 174 aa, Triticum aestivum
  unsure (1)..(174): unsure at all Xaa locations
  Clone ID: PAT_TA_91671.pep
FSCHTNGIVFHIYXSQEFLDDHVIDGLAKLFSDGVTVAXAVLKEMLGAYARHWLVSLGLCIPAPAGSARLRQQWEGRLFGRMALTTYRRCAKPCCDLAFLCLLSFPNNRPSWPSLLLFINGGHVHIRTIISTIFMNFPYLSYLSDCPVQIMLLKSETSGLISGLRRKDFFRFKK

SEQ ID NO: 197254 - protein, 67 aa, Triticum aestivum
  Clone ID: PAT_TA_91672.pep
NKDDYMLKKNIFMSLHVHAHIEVRRIRTKNTTSQGKTERTHFLHSNSRVQTANAPCVEEEAGKIFYS

SEQ ID NO: 197255 - protein, 203 aa, Triticum aestivum
  unsure (1)..(203): unsure at all Xaa locations
  Clone ID: PAT_TA_91673.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEEXKKEYPDAYVRIIGFXNMRQVXCVSSIASTGLPGSGLNTNHTGIKMHSVNPNCLFLHYLLMSKKWPV

SEQ ID NO: 197256 - protein, 132 aa, Triticum aestivum
  Clone ID: PAT_TA_91674.pep
VSPPLCPRIMFYYGLDFHDLSPKSFLNISAFIVVCEAFLRIPPNFGLWLKIFNVKPKVVDGQHAECGGAMVSKMPNVTWPKGTFVETVKGWQQLWFYVTEPRDATWAAAPKFKSGAPMRLTSWLEKDLNWSS

SEQ ID NO: 197257 - protein, 86 aa, Triticum aestivum
  Clone ID: PAT_TA_91675.pep
SSWPRQIVRRSKSMVIHNGKLHHCSVSGVLQRCVSPKEGQEILREIHEGDCGHHAGSISLVAKAFRHGFYWLTAHADAEDLVKRCD

SEQ ID NO: 197258 - protein, 59 aa, Triticum aestivum
  Clone ID: PAT_TA_91676.pep
EPCWVCSFLHAGRLGFGKGAVASYSFTTLARLQGRGSLELSYFVSLLSRGALHLETFFF

SEQ ID NO: 197259 - protein, 162 aa, Triticum aestivum
  unsure (1)..(162): unsure at all Xaa locations
  Clone ID: PAT_TA_91677.pep
PDLEILIGSSWSKKQAGHKALVCCRPGQAWRKTKSPGLRAPPERRLGLKARQWRRRQPGGPCRERRRRHHSPGEPLLKRTTRHSTTRHGRRQGSHXRPXYXXXRTSVQARLEDXPTWXAAIHSSSGPGSRGGLTGXGSYNSHQNSAXCQWHSRXKXXRSHSG

SEQ ID NO: 197260 - protein, 175 aa, Triticum aestivum
  unsure (1)..(175): unsure at all Xaa locations
  Clone ID: PAT_TA_91678.pep
IAVMMMAPAALRCHRKXRAREPPLSSSSLTFSLDGRRVSPLVHGLHGXEGREPLRDWICLSXLCFCAPRSGLSPFLIFPEIGNSDWXEIXNMIFIRILVSFGRKKGPNRLTGVHEXGGRAFHPGGAPSASVGPPSTLALIHSQKSHRFQKXSSXPVGPLIWISANNMNKQENGHR

SEQ ID NO: 197261 - protein, 141 aa, Triticum aestivum
  unsure (1)..(141): unsure at all Xaa locations
  Clone ID: PAT_TA_91679.pep
NSIKTLTLLAPLSIFADVVDLGAMGVVLGQDVSTWLSEKPPVFAFGGPAELLYGLGVAVYAFEGIGMVLPLEAEAADKRKFGGTLGLSMVFIAVMYGLFGAMGYLAFGAXTRDIITTNLXAGWLSVAVQLGLXINLFFXGR

SEQ ID NO: 197262 - protein, 97 aa, Triticum aestivum
  Clone ID: PAT_TA_91680.pep
PISGCDYVWSSTLSISANSGPFRALLLTVLGPRAISMINDPRSAFTCPSSTLIVLANSDPFRGLLLTVFGPRSDFHSRSTPRCAYMSVVNTRSFARF

SEQ ID NO: 197263 - protein, 171 aa, Triticum aestivum
  unsure (1)..(171): unsure at all Xaa locations
  Clone ID: PAT_TA_91681.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGYYDGRYWTMWKLPMFGCTDATQVINEVEEARRIPDXYSASSDRHMRQVQCVSSSLKQRAQDPEG

SEQ ID NO: 197264 - protein, 58 aa, Triticum aestivum
  Clone ID: PAT_TA_91682.pep
LDKFPNRKYHLYTYYVVEHTTLHVTGDVKLISLEETIRKRISCKCLWIHHSWIFPTTQ

SEQ ID NO: 197265 - protein, 141 aa, Triticum aestivum
  unsure (1)..(141): unsure at all Xaa locations
  Clone ID: PAT_TA_91683.pep
FXXFCXLSXXQQLFXEFELFAXXCQFCVXKGVLRMKFLVPLLGAVLPXYFRXYFRSGPKTXHNSSGGRHGCNFLVPLASSSTATLSSSTATPSGSTMRSSGTTAPTVLLAFLPPHCCVSKGYYRPSGSTAPWSGSTARCGL

SEQ ID NO: 197266 - protein, 100 aa, Triticum aestivum
  unsure (1)..(100): unsure at all Xaa locations
  Clone ID: PAT_TA_91684.pep
PIPXFSPWGXSPLVWLSXVSTRLPYSGMXLWKXPCHQKSGCHVVVLHHCLPYRTVVLKGNGPGNAFAPHCDVPGDRTDIMFSCMAARDLWSFLREALGPD

SEQ ID NO: 197267 - protein, 146 aa, Triticum aestivum
  unsure (1)..(146): unsure at all Xaa locations
  Clone ID: PAT_TA_91685.pep
FHGDLAVAERPRRRSGQAAAGAVLRAGRLGDKAGGGPRPRPRLAASPRARSATTCRWVFXKNPKPLPLLAVPPDGVRAPPPRHPRRAAAAGKNRPRGALRKEDRTCTTASKTXTTRXLAXVPQVQXKRYPCTXAXVXXYPGXXSXT

SEQ ID NO: 197268 - protein, 130 aa, Triticum aestivum
  Clone ID: PAT_TA_91686.pep
PHRYRPGTVALREIRKYQKSTELLIRKLPFQRLVREIAQDFKTDLRFQSHAVLALQEAAEAYLVGLFEDTNLCAIHAKRVTIMPKDIQLARRIPRGARIDCPEKHVRLSVPSPPGFRLAGKRDFYLVKVG

SEQ ID NO: 197269 - protein, 82 aa, Triticum aestivum
  unsure (1)..(82): unsure at all Xaa locations
  Clone ID: PAT_TA_91687.pep
YXLKPXXIVILNLPIWPSLLQTLKNEFXQRSLCPIGKMFPLWAKVITPLSALYFXPQATWKDMISLXKFKLFRVRLAFLYTN

SEQ ID NO: 197270 - protein, 107 aa, Triticum aestivum
  unsure (1)..(107): unsure at all Xaa locations
  Clone ID: PAT_TA_91688.pep
MAPTVMASSATSVAPFQGLKSTAGLPVSRRSNGASLGSVSNGGRIRCMQVWPIEGIKKFETLSYLPPLSTEXLLKQVDYLIRSKWVPCLXFSKVGFIFREQNASLGT

SEQ ID NO: 197271 - protein, 105 aa, Triticum aestivum
  unsure (1)..(105): unsure at all Xaa locations
  Clone ID: PAT_TA_91689.pep
GYDXXGCXAPXTNXLRGXXEXRXCVXXQPCXQIXGVXWXXAPRGPTELHRGXXXWVRTPGGFXSLLPAAVVVPWSRMIGXRAGGRSHSRXLLVRACTMVDKVVLS

SEQ ID NO: 197272 - protein, 85 aa, Triticum aestivum
  unsure (1)..(85): unsure at all Xaa locations
  Clone ID: PAT_TA_91690.pep
CPYVCVQEEGWVVCRAFKKRTAYPXPGHDGRMGSNYXYNESMPCLTAVPXPXHGXTTRNGQMGKGPLXGEXXXXRAPPQXNSXTL

SEQ ID NO: 197273 - protein, 105 aa, Triticum aestivum
  Clone ID: PAT_TA_91691.pep
ILKKAMDTLTPIAALQDGMGLEARIETQKIKQKDLVPLSVPYNTACSDAEGSAVGNFSGLRAPERKRKPGRPTTSRDKPPYDDQSAKNNHTLLMCMLRMVMGTSK

SEQ ID NO: 197274 - protein, 60 aa, Triticum aestivum
  unsure (1)..(60): unsure at all Xaa locations
  Clone ID: PAT_TA_91692.pep
HQPTYLLXLYILPYHKNIRSNHENLIPPPQPSVFARSHLGAIAGASPEGESTTKGLYIIS

SEQ ID NO: 197275 - protein, 61 aa, Triticum aestivum
  Clone ID: PAT_TA_91693.pep
SSAGWNSWLPRPSSLICSSDNAPPQRSFRSTPMASQKLHPLELWPEGGGRGCRRTLGQPWR

SEQ ID NO: 197276 - protein, 169 aa, Triticum aestivum
  unsure (1)..(169): unsure at all Xaa locations
  Clone ID: PAT_TA_91694.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGXIFXEHXASPGYYXGRYWTMWXXPMFGCTDANRXXNEVEXVXKXYPDAYVXSSVRIASAMRKFMASTTGFKDPG

SEQ ID NO: 197277 - protein, 150 aa, Triticum aestivum
  unsure (1)..(150): unsure at all Xaa locations
  Clone ID: PAT_TA_91695.pep
QWPXQLHXXITCVYIGRXFFXNMTIPILDXCGPAFRGTFFMNTVXVRWSLLSGEDHYFPRXKEHFLAMAVDPAVSSPRTVLFRWKSFLDHVDHASPRAPRAVDDGEAWEGDDAEPRKMRQWIPRGEEYESSLVRLRCEAAVATGPGQRWQ

SEQ ID NO: 197278 - protein, 77 aa, Triticum aestivum
  unsure (1)..(77): unsure at all Xaa locations
  Clone ID: PAT_TA_91696.pep
SSASLAKLETEEGGGFIEAQLQELRKIKPKKDNTQRNMLVSMMPVQRKIVGLISESRDVLTSEHKSIWWSQXIPREE

SEQ ID NO: 197279 - protein, 129 aa, Triticum aestivum
  unsure (1)..(129): unsure at all Xaa locations
  Clone ID: PAT_TA_91697.pep
MAASMITSPIVAPTSLPSLSRRGSSFAVVCSGGKKIKVDKPLGLGGGLTVDIDANGRKVGKKGVYQFVDKYGANVDGYSPIYTPGGMAESGDRYPGGTTGXLIWPXPXPAPXGGVLLVXNNTSPPVKIY

SEQ ID NO: 197280 - protein, 151 aa, Triticum aestivum
  unsure (1)..(151): unsure at all Xaa locations
  Clone ID: PAT_TA_91698.pep
MEATNCSIALETADHAAAHGTSAPALLLLSSVAVIGAFLVYFYAPFWALRRVPGPPARFPLGHLHLLANHGPDVFRAIAKGARPIFRXFHMGKQPLXVIVANAELCKEVGSXNSRNPETGPAAEGGLKDGSSQKGSNWQGYARLQRGRRSD

SEQ ID NO: 197281 - protein, 45 aa, Triticum aestivum
  Clone ID: PAT_TA_91699.pep
HLMKLVIYFMRPGMSISSFSREENIKLLFWPFSCPIDTHIGTKSV

SEQ ID NO: 197282 - protein, 161 aa, Triticum aestivum
  unsure (1)..(161): unsure at all Xaa locations
  Clone ID: PAT_TA_91700.pep
IRHXRIMXQLYVSRSSSDAVLVMSLTIFCRLEGKRRRGSSGACRWSGDRALHPVRSSNKLPPSSELTSPLNGAIEEARGNAGLEETGIDATHRPAAKRANKDALRHDLGAPRTSQGELDAAELQQQQSRPSGDLKQQEQQPQMDLRGSNPGRKKSLKWEGT

SEQ ID NO: 197283 - protein, 119 aa, Triticum aestivum
  unsure (1)..(119): unsure at all Xaa locations
  Clone ID: PAT_TA_91701.pep
ELRMIPITWSFATWGLXMVGLFKRSKDKKTHLLVAVNKFTKWVEVEPVSKCDAATTIQFVKKVIFRFGFPHSIITYNGTNLSKGAMKEFCQREHIRLDVSSVAHPXSNGQAERANQDIX

SEQ ID NO: 197284 - protein, 72 aa, Triticum aestivum
  unsure (1)..(72): unsure at all Xaa locations
  Clone ID: PAT_TA_91702.pep
MSSLYDVILYTDTPSGLYRHRRGXGLYRVGLQRKESYPNAKLAIHAKESPIRTWEEIFCLVSSWPISPAHVT

SEQ ID NO: 197285 - protein, 71 aa, Triticum aestivum
  Clone ID: PAT_TA_91703.pep
FFFFFLDLARQFHLTIICNTYMSANNTLIKIIVLRMIENGGGCLAEKVSKGDLLIDHFLQYHSNIITELHT

SEQ ID NO: 197286 - protein, 73 aa, Triticum aestivum
  unsure (1)..(73): unsure at all Xaa locations
  Clone ID: PAT_TA_91704.pep
SVPGPVPFRSLFSSGEEXXXVXXRCFVGXLAWATDXQSLXNAFXKXGDVIYSXIITDRXTVRSRXFXFVTFAV

SEQ ID NO: 197287 - protein, 50 aa, Triticum aestivum
  unsure (1)..(50): unsure at all Xaa locations
  Clone ID: PAT_TA_91705.pep
SSIQISMHSTIISKSTSSXGVRTXSNIXTNIAXLIHXXXVVXDGYHRGRS

SEQ ID NO: 197288 - protein, 167 aa, Triticum aestivum
  unsure (1)..(167): unsure at all Xaa locations
  Clone ID: PAT_TA_91706.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKXNXDXYVGIIGSQHRKVNASLHNGQDPEG

SEQ ID NO: 197289 - protein, 90 aa, Triticum aestivum
  Clone ID: PAT_TA_91707.pep
IVISGSCNPAATKNREDSGARFASPASSSTRALLQLAGDGSRNYRRRHLPPRRRSTPAATPTSRARRRGCQPLAAASGGRSPGLRPRQVP

SEQ ID NO: 197290 - protein, 188 aa, Triticum aestivum
  unsure (1)..(188): unsure at all Xaa locations
  Clone ID: PAT_TA_91708.pep
MAEFDCLXDIXXLCEEGPNPXRSAXEAQGAPITXMAPRASSRVDPXSQIHIXXKKISVSFYPIWTPFDMDFLRNKKHATNRNWHWALDQYVSLKNSIKNCQKYVTVVEYWHGIIKNYRYDGDVSMAQTGTSTLLWSRLVPRSGTKGLCFPPFGLLKTDLWSRLVAQTGTKRVYWSRFAPPTETKSCGI

SEQ ID NO: 197291 - protein, 81 aa, Triticum aestivum
  unsure (1)..(81): unsure at all Xaa locations
  Clone ID: PAT_TA_91709.pep
VHXIPXWWLXIXLSLPHXSASXLXSKSQREXGRRPGDXFARKKGNXYGGAGPLVAGGGGRDSGGGGWIRPRRWRGRGRGKG

SEQ ID NO: 197292 - protein, 62 aa, Triticum aestivum
  Clone ID: PAT_TA_91710.pep
RHSTEDLMVSEGTKKITQSSHTKRKAFTSTSVYYCTSELSHLMETTSLTICNVAVRPHKGTL

SEQ ID NO: 197293 - protein, 95 aa, Triticum aestivum
  unsure (1)..(95): unsure at all Xaa locations
  Clone ID: PAT_TA_91711.pep
MLXVFDXXVAKCPXGLRSPPAVGAAAGGXGAXALXKXFAGXNNXAVNVXLXSXGXLXYSXVXRXXLXTXXFXXVNXIFCLFHGHXXKIGNLXEAL

SEQ ID NO: 197294 - protein, 124 aa, Triticum aestivum
  unsure (1)..(124): unsure at all Xaa locations
  Clone ID: PAT_TA_91712.pep
MQAHRGISSRPVLLPPLSTEAFXKQVDYXIRSKWXXCXEFSKVGFICREHNASPGYYDXRYWTMWKLPMFGCTDATQVINEVEEVKKEYPDAYVRIIGFDNMRQVQCVSFIAFKPPGCEESGKA

SEQ ID NO: 197295 - protein, 63 aa, Triticum aestivum
  unsure (1)..(63): unsure at all Xaa locations
  Clone ID: PAT_TA_91713.pep
CYTAALPCAFPISLLSVFTAASVIRSCVRNKFILMCTSYKLDDFPVXCCGNLKYFFGLASKGG

SEQ ID NO: 197296 - protein, 48 aa, Triticum aestivum
  unsure (1)..(48): unsure at all Xaa locations
  Clone ID: PAT_TA_91714.pep
XVLQRXXMXXNVVXSQRXQVPXARQLRXQHTFSSMTSLELLDVVEAEG

SEQ ID NO: 197297 - protein, 106 aa, Triticum aestivum
  unsure (1)..(106): unsure at all Xaa locations
  Clone ID: PAT_TA_91715.pep
MAXPRVFFDMTVGGXPXGXIVMELYKDAVPRXVENFRALCTGEKGVGKSGXPLYYKXSSFHRVIPDFMXQXXXFTKGXXTGGEXIYXEXFAXEKXXXNXTKPGSSQ

SEQ ID NO: 197298 - protein, 85 aa, Triticum aestivum
  unsure (1)..(85): unsure at all Xaa locations
  Clone ID: PAT_TA_91716.pep
XHIIVLSSYSPFEXXTPXWLWLXGDIXXXLDREKTPWIXXLMHAPMYXSXXAHFMXGXSMRAAFEKCACQRXXWTWXXASHVXAY

SEQ ID NO: 197299 - protein, 141 aa, Triticum aestivum
  unsure (1)..(141): unsure at all Xaa locations
  Clone ID: PAT_TA_91717.pep
MAPTVMASSATSVAPFQGLKSTAGLPVSRRSNGASLGSVSNGGRIXRCMHVLAIXGIKXFETLSXLXPLXTXASXSRWDYLDPSKWGALPLXXKGRXIFPWRXXXPGXXXGXXWXIXKXPYFGCTDATXVXNEVGXAKXDT

SEQ ID NO: 197300 - protein, 165 aa, Triticum aestivum
  unsure (1)..(165): unsure at all Xaa locations
  Clone ID: PAT_TA_91718.pep
MGVEARSLLEKLCDVMRFPXXFWVEVSPXHIFINIQTXFAXTGSIPLRXLFDHSPGYSALRVXFGCVCYVLLAPRRCTQIPLQSVGVCFFLGYSDEHKGYRCWDPVGRRMHISRDVTFDESRPFYPRPSSSTFSVEDISFLTFPDTPPSMPHIPTPPSRPTIADP

SEQ ID NO: 197301 - protein, 104 aa, Triticum aestivum
  unsure (1)..(104): unsure at all Xaa locations
  Clone ID: PAT_TA_91719.pep
QVIYFYMLALHEEYLTRRYFLQCLNLLGGLVGSGLSGFGTLKSRRKSGSRXSEXAPIXXFXHXTWXLGDSSTRALXLSXGXXKGECFGXERPLRSHXXGALXTT

SEQ ID NO: 197302 - protein, 60 aa, Triticum aestivum
  unsure (1)..(60): unsure at all Xaa locations
  Clone ID: PAT_TA_91720.pep
XGXPLSSFXXXDXXIXXPKKXYIXIXEDSSAYDXNISRSXKLFXYFYLXSLRISISLRND

SEQ ID NO: 197303 - protein, 70 aa, Triticum aestivum
  unsure (1)..(70): unsure at all Xaa locations
  Clone ID: PAT_TA_91721.pep
YPSLTGXXGFPYMVSLIXFSCCTIPITIKSQKHSFDVFTFVTRYPPTYHITLLLKYLSNQILKFPRCGLN

SEQ ID NO: 197304 - protein, 104 aa, Triticum aestivum
  unsure (1)..(104): unsure at all Xaa locations
  Clone ID: PAT_TA_91722.pep
RKESQLLSPWGMRIITRNRCLQLARSDQEHKYIHGNIKGSDLNSWHSGPSASITHSKALQHQSPEHSWILGVKTLTKLTPITWIXSIQPHRLAKLTMGYPRHGV

SEQ ID NO: 197305 - protein, 110 aa, Triticum aestivum
  unsure (1)..(110): unsure at all Xaa locations
  Clone ID: PAT_TA_91723.pep
LEDFXSXPXKSSITYXXRGPRLPFSXYKMRRDGPPLXISXCSTRFFFLASMLVATPMAPTKRFSAAEKGKARQEGPGSPPPKRGCGRPHKHIATPVATPHGRGGASSHGG

SEQ ID NO: 197306 - protein, 194 aa, Triticum aestivum
  unsure (1)..(194): unsure at all Xaa locations
  Clone ID: PAT_TA_91724.pep
MAPTVMASSATSVAPFQGLKSTAGLPVSRRSNGASLGSVSNGGRIRCMQVWPIEGIKKFETLSYLPPLSTEASSKQVXDYLIRPKWVPCLRXSSKVGVIFREXNASPGYYDGRYWTMWXLPISGCTDAXQVINEVEEXKKGXLTVLRRVRQHRKCMRSCLKQRAARSGRLKVIQRAIMHAVPELLVPPLLLVSK

SEQ ID NO: 197307 - protein, 80 aa, Triticum aestivum
  unsure (1)..(80): unsure at all Xaa locations
  Clone ID: PAT_TA_91725.pep
RCXXPXPRQQQPXAXQQAPEPRHPLPPPPPRLPPERGTDAVTEREALAGRKAAVWRXGVLEGRRRRGSVXVSMDGARDDG

SEQ ID NO: 197308 - protein, 92 aa, Triticum aestivum
  unsure (1)..(92): unsure at all Xaa locations
  Clone ID: PAT_TA_91726.pep
IXCXTRARXGXIAXXKFVXMAANXGLQGNLKCFPTGYTHAXSAMCFXLVVMYNTDGKAGNMFTXKTWAQDIRGPFNFMLMQYPLLFPQRRSV

SEQ ID NO: 197309 - protein, 119 aa, Triticum aestivum
  unsure (1)..(119): unsure at all Xaa locations
  Clone ID: PAT_TA_91727.pep
MXXHAQNATXNFLXEKCVPDTXXEXYVIXTGRRRAGRPGEXHPSPLGLLFPGGGGGGAGPGPLVGDEVEVLVGVAVGALPGELAAAAALLGVAAHPGARLAVAALLRRLALPAALLPAV

SEQ ID NO: 197310 - protein, 140 aa, Triticum aestivum
  unsure (1)..(140): unsure at all Xaa locations
  Clone ID: PAT_TA_91728.pep
MAPTVMASSATSVAPFQGLKSTAGLPVSRRSNGASLGSVSNGGRIRCMQVWPIXEGIKNSETLSYLPPLXTEASSKQVDYLIRSXKWVLASESSKVGFIFPXETTIPGYYDGRYWDMWNXMFGCTDPHRCQRVEEXKKXT

SEQ ID NO: 197311 - protein, 96 aa, Triticum aestivum
  unsure (1)..(96): unsure at all Xaa locations
  Clone ID: PAT_TA_91729.pep
XHSCFPCFGFAGKGFKRXPNGINFMMIFFGPGRHPGGLEPKAKDHGVVAKGGGVPLGERPLPCAPSRDPLTYFFILYIHIYSRTLRESHENTFPPP

SEQ ID NO: 197312 - protein, 138 aa, Triticum aestivum
  unsure (1)..(138): unsure at all Xaa locations
  Clone ID: PAT_TA_91730.pep
MASTSCFLHQSTARLAASARPAPAVGRTQLFVCKAQKNDEAASDAAVVTSRRAALSLLAGAAAIAVKVSPAAAAYGEAATWFGKAKKNTAFLAYSGKGXKLXMIPAKWDPSKERXXPWXSVRYEEIXXPQHSXVIINP

SEQ ID NO: 197313 - protein, 140 aa, Triticum aestivum
  unsure (1)..(140): unsure at all Xaa locations
  Clone ID: PAT_TA_91731.pep
YFLRGWFFVCCFAFCSCYASRLMSSFALHRHHFLKTCICSSLPFLPFAFITFPRIALPALTVPDQSSFRFPLDRDHLTSLQPPTPSXMRPKNLPXTRTGLSXPMGPDHPLXSIKISVFLXGLPSLSSVRPITXXGQIXLS

SEQ ID NO: 197314 - protein, 132 aa, Triticum aestivum
  unsure (1)..(132): unsure at all Xaa locations
  Clone ID: PAT_TA_91732.pep
GAHPFLLPSSSPLHTRPRSRPLCSPTSSAPTASSSSPPPSLRFLRRGCAADRSRRATTMAAVXPRGTAAWVHDLMSSGVXXGIALXLLRFFXELAKXGVXDXKLNRKLXHITNGMXSWLFWALLXPXXMLFL

SEQ ID NO: 197315 - protein, 130 aa, Triticum aestivum
  unsure (1)..(130): unsure at all Xaa locations
  Clone ID: PAT_TA_91733.pep
MVLRYRDIARAVXRGRXVPFEQPKXTVEKCRVRAHACPREQDNVQACALADTYIDPGSSWVMLTQDADEDGSFYGXEHSPYTPTISCCIGGGKGAQQGTLPVPAGCTDQTAXKNFDPTARSDDGSCLYTF

SEQ ID NO: 197316 - protein, 109 aa, Triticum aestivum
  unsure (1)..(109): unsure at all Xaa locations
  Clone ID: PAT_TA_91734.pep
DTFSXLFSSCXLFFIYHFLHCXCSAFIXLXFKNLSHFYDTXLFXXKFTSCKYXKVVHXSKIVXVYDXKKXKMCSXLFSSLLICXLYLXVLFLXSXFLXAFXXMYIKKFA

SEQ ID NO: 197317 - protein, 64 aa, Triticum aestivum
  unsure (1)..(64): unsure at all Xaa locations
  Clone ID: PAT_TA_91735.pep
LXKXXRXXXPXXRXNEXDFPGGKXMEPLKKDKQSKXQLNQKKKKRAKXQXLTTVKWIGQVHRMN

SEQ ID NO: 197318 - protein, 112 aa, Triticum aestivum
  unsure (1)..(112): unsure at all Xaa locations
  Clone ID: PAT_TA_91736.pep
QSHVKFTGNFSMPLXENRTYGVPDLPGTEVNRHSGKXQGLSGYLQIITTRRASPRPSSSSGVSQDPVFLLNFFEQQSEQKIQHISIQQHCKDEEQFYRSPFIYNSIFGHTNF

SEQ ID NO: 197319 - protein, 71 aa, Triticum aestivum
  Clone ID: PAT_TA_91737.pep
CGSGCSCGSDCKCGKMYPDLTEQGSAAAQVAAVVVLGVAPENKAGQFEVAAGQSGEGCSCGDNCKCNPCNC

SEQ ID NO: 197320 - protein, 59 aa, Triticum aestivum
  Clone ID: PAT_TA_91738.pep
LHDIPNGRRLKVTILSSVLGSIATTAVMAVGLACYYNSRYRRWHKDLDQLARSMERLPG

SEQ ID NO: 197321 - protein, 158 aa, Triticum aestivum
  unsure (1)..(158): unsure at all Xaa locations
  Clone ID: PAT_TA_91739.pep
LRRAWRGGXCCGESLEGTLMLLEGHLVAGRRARAAALERGVVDVEPGEERAHDLVLPAAAGFPHRGQLARTPSCALARPGEREREGGREGGRGDGEERRSPNQEEEEGKRADFSGSPDRAAEHGGSGIRIGWGEISAGRGSGTEAEEGKSGGGGGGGG

SEQ ID NO: 197322 - protein, 139 aa, Triticum aestivum
  unsure (1)..(139): unsure at all Xaa locations
  Clone ID: PAT_TA_91740.pep
QRLLXXEQGVHPXSXSRELSTFGMKGPFNASXGXXATPPIVAQRXSXRAPLPFXARXSTTXFPWIGPVSXXESTAAPXRAPRPCXPXAGITGXRHAAARTATSSPXGAGRCNGELTSVEGREVWQANQRREEKGVCLNP

SEQ ID NO: 197323 - protein, 183 aa, Triticum aestivum
  Clone ID: PAT_TA_91741.pep
ILKASYFPDTSFLHAELGTRPSQIWWVILEGRYIMKQGIIRRIGNGQTTHIWDDNWIPKEASLRPIVSLVFDPPTLVSELLLPAMVTWNKPLIRATLLPIDVESILKLPVCTRNVNDFWAWHPDSKGRFTVSSTYKFLITTKIQMENWLEGRSGHPVSGKKILDPIWNCIPRQMSLVSCNTSN

SEQ ID NO: 197324 - protein, 115 aa, Triticum aestivum
  Clone ID: PAT_TA_91742.pep
RVPLPKISADCREVEHTGIVRTFKYNHGDCLLWKIAISRVPNRSWNYNNYEVVAIFDKLVAVLAGLTRWLLLKNQFLFTDEYCDAIEYEGLVFAATSRGTVFAWNHCFKYVCLPS

SEQ ID NO: 197325 - protein, 76 aa, Triticum aestivum
  unsure (1)..(76): unsure at all Xaa locations
  Clone ID: PAT_TA_91743.pep
GFXYFFTCXLXFXXVSIVXSCIFLVGISFCIFLXFHWVXVFFNFFXGFRCFSLFYGGFIWIFLFSFCWFSLFSFFI

SEQ ID NO: 197326 - protein, 186 aa, Triticum aestivum
  unsure (1)..(186): unsure at all Xaa locations
  Clone ID: PAT_TA_91744.pep
GTITGKECPVGLYGTFCTECPVGTYKNVAGSNSSLCTPCSLNALPNRADFIYVRGGVTQPSCPYKCISAKYKMPNCYTPLEEVIYTFGGPWPFAVFLFFAIILLALILSAVRVKIGESEVTYRATSAIHNDAYXSSPFLLXLAEVXGANKAEETQSHVHRSTQGTSNSLTPNQNWNGRSFKPFPWI

SEQ ID NO: 197327 - protein, 62 aa, Triticum aestivum
  unsure (1)..(62): unsure at all Xaa locations
  Clone ID: PAT_TA_91745.pep
KKIIKIPFINXLPXIEATAAPHFTASAPGFLHFPTLSIPXINKLRXHSLFPLAYFFXVFLST

SEQ ID NO: 197328 - protein, 82 aa, Triticum aestivum
  unsure (1)..(82): unsure at all Xaa locations
  Clone ID: PAT_TA_91746.pep
FHGHSISIPLHLDRYPTSPDPVHRPPPPTXPHPLDSPTQPPPPTPRTPPLLNRRRRPPHPSPTQPPPPNPRXXXTSPLNGLV

SEQ ID NO: 197329 - protein, 57 aa, Triticum aestivum
  unsure (1)..(57): unsure at all Xaa locations
  Clone ID: PAT_TA_91747.pep
FFNAAGRAVLPPSVRYFRPGDTTAMTRGTTAPPRAGEGQAGEGGVPTPPXPLXXPPT

SEQ ID NO: 197330 - protein, 79 aa, Triticum aestivum
  Clone ID: PAT_TA_91748.pep
SSRRGCRGVLRTRHRIPQGAPHLSFPRELASPLSAPSIQARLLPLRSTTIIGKQGSSGSIRQPRHAANLANGRSRPTGA

SEQ ID NO: 197331 - protein, 129 aa, Triticum aestivum
  Clone ID: PAT_TA_91749.pep
RDFKGSSTRNSKEKQKEEEQKPKFNLPRTMEVRPCECPFDDFLRRVGIYEDFYLLIEKASLTDFLCDQCHQYLVLTNTFVQNFYFSPKKSPPSVEFHLYDIVKDMPLAEFCEVCKIPFEGTLDEPHHNE

SEQ ID NO: 197332 - protein, 129 aa, Triticum aestivum
  unsure (1)..(129): unsure at all Xaa locations
  Clone ID: PAT_TA_91750.pep
TLPSPSGQRFDSALTCGTRWXRRPILFKTVARMACGTQQRAVEQKAVAGVLYKRATHSGGDHGDREHGGDTGERXXPXWELXLEGXRVESLRSXLQSLKSAHSLLGKLSXSYNXVVGXTYEXQXRXKXT

SEQ ID NO: 197333 - protein, 86 aa, Triticum aestivum
  unsure (1)..(86): unsure at all Xaa locations
  Clone ID: PAT_TA_91751.pep
RGAGRLLPSPSELCHKYNVRSARRTRCXSTATLSFRATPXIQRALCXEDXVQVDCYLLLQRYALKILPXEXQXLPLEGLSCNPMLA

SEQ ID NO: 197334 - protein, 105 aa, Triticum aestivum
  Clone ID: PAT_TA_91752.pep
QTCNNRHPAHQTVSNAWLNSQSNIVELVIEPERTHTFLPPQTIPPRRATESVRVNRASIDAISSIPEQMKPNMQEKRRNQSRENKECARQFVPSIKHVQVNRLGC

SEQ ID NO: 197335 - protein, 59 aa, Triticum aestivum
  Clone ID: PAT_TA_91753.pep
FFFLWELELIPVYLLLSMWGGKRRLYSATKFILYTAGGSIFFLIGVLGMGLYGSNEPGL

SEQ ID NO: 197336 - protein, 93 aa, Triticum aestivum
  unsure (1)..(93): unsure at all Xaa locations
  Clone ID: PAT_TA_91754.pep
SHPPPFPSLLRPQSDQSASDPNPCPLPSPPTSSKPPPQSPSSPPARPXSPRSPARPPPAARPRPPPPPAAGSGGRRPGDRIALLRGLGRGPGG

SEQ ID NO: 197337 - protein, 155 aa, Triticum aestivum
  unsure (1)..(155): unsure at all Xaa locations
  Clone ID: PAT_TA_91755.pep
DNRDPRQDWRDQPRRGPLAGPALRGPWRDSAHEDSSRVTFGSLRCLRTEEERLPPPRYXAKGSKDLRAIACILSGAHPCLPSHLQEXPPGSXPPPPTSRTFCQLAXXHQLXPNDTQXATLQXFXSLAPXIXIPLQXPSMGPGKFPSNFXXKAXTX

SEQ ID NO: 197338 - protein, 76 aa, Triticum aestivum
  unsure (1)..(76): unsure at all Xaa locations
  Clone ID: PAT_TA_91756.pep
XFSISSAERXEGCIHYSFGSLIKVFGHHRGCGPXTATVQIPQVSNSVTEHAVIILPEDSSDLVLTRMLARAPYQVP

SEQ ID NO: 197339 - protein, 64 aa, Triticum aestivum
  Clone ID: PAT_TA_91757.pep
THFRANLGTGPPLGFLNQTLLRWCWRRRRHFPSWTVQNRFLLNQKQRWIRRAWMILIREMYILF

SEQ ID NO: 197340 - protein, 90 aa, Triticum aestivum
  unsure (1)..(90): unsure at all Xaa locations
  Clone ID: PAT_TA_91758.pep
VLGVVNIRVCDTSILYHAFILIFIALWDVNRHLCHNTYAFSLLFYKGYMKRENAGSWEFWGWEKKQILRDLFLHNXQXPWKPHESXFGIY

SEQ ID NO: 197341 - protein, 63 aa, Triticum aestivum
  unsure (1)..(63): unsure at all Xaa locations
  Clone ID: PAT_TA_91759.pep
FDVHCLRYRMCKFDVHCLAISMCKFECSLTCAIRHPGWGMLTPHPSLSLXGQNSKRRKQKHVG

SEQ ID NO: 197342 - protein, 54 aa, Triticum aestivum
  Clone ID: PAT_TA_91760.pep
CRFLLQINLTEYLEVADVGNRVGTDVLRGAAENWLVHLGNFLNREGLKTRPEDD

SEQ ID NO: 197343 - protein, 74 aa, Triticum aestivum
  Clone ID: PAT_TA_91761.pep
MEPPEGSCISLLMTPWAHCITGCGDIDFTYPFGYRAGCFRQGFDLTCNHSTKHPKSFWGSSTVQTPHVLQLRIL

SEQ ID NO: 197344 - protein, 109 aa, Triticum aestivum
  unsure (1)..(109): unsure at all Xaa locations
  Clone ID: PAT_TA_91762.pep
LHSLXDNCHDIDXHYAYVCCELAVHSMYLTWVSCQISGKSFSNRRASGLDRVHIGVHVLWSSTSSSFRCRVVIVIEAHSCSLNNVHIVQLHCVCRLASLLDVISDLCFR

SEQ ID NO: 197345 - protein, 120 aa, Triticum aestivum
  unsure (1)..(120): unsure at all Xaa locations
  Clone ID: PAT_TA_91763.pep
XCYSXCLTPSVSVVCCCLSGFHDLSWCPVCVQIDVXDVSFERLLPLTGFEXAEFGVDCRVFGVVAVVPCLCLLRRGLPLFSRMFEVPECGVVLLRANQLSSLAQKRVISVVRAAMDLGFP

SEQ ID NO: 197346 - protein, 106 aa, Triticum aestivum
  Clone ID: PAT_TA_91764.pep
QTSLVLQKDARTCSLFTNNSLSLTISLISSPPHLEGHGKIWRDGILDEVLVGFLDKFTVVKKLADDLDVRLQPTRPGFAMPTTLHGLYGDNLFDALVALRLPAVAP

SEQ ID NO: 197347 - protein, 61 aa, Triticum aestivum
  Clone ID: PAT_TA_91765.pep
SAVVELEEHPPEKKSGHYHELHLRRRGRSCCRLERVKRQHTVLEVVGHGPARLQQAAQNGT

SEQ ID NO: 197348 - protein, 78 aa, Triticum aestivum
  unsure (1)..(78): unsure at all Xaa locations
  Clone ID: PAT_TA_91766.pep
RPSVQTXRXXXPNFTEGXXXEXDPQWIPFCXAXRMCQXEKSVXSYAWSXPGXLGKDITXNFVNHGXXQGFQQDKKKKK

SEQ ID NO: 197349 - protein, 90 aa, Triticum aestivum
  unsure (1)..(90): unsure at all Xaa locations
  Clone ID: PAT_TA_91767.pep
DLQISRHVXAAFSSYDPNRTVIQIDPSNMEEMAFWESNNANIAQMARSSPSGKPAVAHVCQEFKCSPPVTSPGALRELLSKTVAAAGSAV

SEQ ID NO: 197350 - protein, 84 aa, Triticum aestivum
  unsure (1)..(84): unsure at all Xaa locations
  Clone ID: PAT_TA_91768.pep
MAVSDLLPLPFPVPPYALHVAASLALAVAAHFLHVTSLLLYAVHTYIHPDAVPSTGXRVVVRPPGSXPLXGKRAGPSGAQVYRL

SEQ ID NO: 197351 - protein, 95 aa, Triticum aestivum
  unsure (1)..(95): unsure at all Xaa locations
  Clone ID: PAT_TA_91769.pep
MEXTAGTIPHLSLIHSIPSNGSNYLHVFLRQXPRNLRTFFXRXKTRXFXFKDSNLEXPAXKPPTVVXKGXFRHFXIXLPARITGEAMYXRVLKRX

SEQ ID NO: 197352 - protein, 96 aa, Triticum aestivum
  unsure (1)..(96): unsure at all Xaa locations
  Clone ID: PAT_TA_91770.pep
NHKPDSPIPPLTLNQAGCFTVCHSKAWDSKIVTSAWWVYPHQVSKTAPTGEYLTVGSFMIRGKKXFLPPHPLLWALVPLPFGMRLLGSHLNERRLG

SEQ ID NO: 197353 - protein, 104 aa, Triticum aestivum
  unsure (1)..(104): unsure at all Xaa locations
  Clone ID: PAT_TA_91771.pep
SFSSFGLRPSSGRRRAGRAPSRRGPGEARGRLIRRRVTRPPGRQPGRARSRHRPCKLXXAQICPFKAPKNXGYSRLLTTIPALRFRAXLRRVTKARRRWXHXAA

SEQ ID NO: 197354 - protein, 140 aa, Triticum aestivum
  unsure (1)..(140): unsure at all Xaa locations
  Clone ID: PAT_TA_91772.pep
MAPTVMASSATSVAPFQGLKSTAGLPVSRRSNGASLGSVSNGGRIRCMQVWPIEGIKXFETLSYLPPLSTEXLLKXVDYLXRSKWVPCLQFNKVGFIFPXAQPSPGYYGRIGQFGTAYVPGLKPHRYQVGGQEGYLTLFR

SEQ ID NO: 197355 - protein, 115 aa, Triticum aestivum
  unsure (1)..(115): unsure at all Xaa locations
  Clone ID: PAT_TA_91773.pep
LKPYIKCYSKYGEVVQTLTRFFRDKVCVDPKEMDSNDSVTPPADKCLPQEILSDSPATAVNXEXQGNYSSLNSTTQKNXXMEFTQLXXAXPXTFPXXKGFTFFKTPKFFQGGCFF

SEQ ID NO: 197356 - protein, 48 aa, Triticum aestivum
  Clone ID: PAT_TA_91774.pep
VPCNWLDGKHVVFGEVVEGMDVVKNIEKVGSRSGTCSKQVVIADCGQL

SEQ ID NO: 197357 - protein, 154 aa, Triticum aestivum
  unsure (1)..(154): unsure at all Xaa locations
  Clone ID: PAT_TA_91775.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDAXQVINEVEESRRSXPDAYVRSSDHNVGW

SEQ ID NO: 197358 - protein, 121 aa, Triticum aestivum
  unsure (1)..(121): unsure at all Xaa locations
  Clone ID: PAT_TA_91776.pep
AAPLHGALFHSPSSSSFNAAPGSNLPSNNCAAHVLGRSRLQVLARHATPLPRPPPPCSCCWAFPPRVPDLSPLLAPAASGXRRQXSRPLSRIGEFRAKAFRNXAFRRVPXFXGXKGXWLGX

SEQ ID NO: 197359 - protein, 110 aa, Triticum aestivum
  Clone ID: PAT_TA_91777.pep
SCVVHSMLLHGRWSRMKDVQHVGKTKLNCFWHCYQSFRICLYVRIILMKLYCDAMKVSTLVPAGKKGFNLGFMCLASRLSRYNIPSNTNETTMANASQWFTNQRQYSHHN

SEQ ID NO: 197360 - protein, 68 aa, Triticum aestivum
  unsure (1)..(68): unsure at all Xaa locations
  Clone ID: PAT_TA_91778.pep
FFFLMSFSVLFFHXIIIXXLSIXFFYSTLLFILCVTFDSYFILVFFFLLLFSRISRLISVSFSIFLFL

SEQ ID NO: 197361 - protein, 57 aa, Triticum aestivum
  Clone ID: PAT_TA_91779.pep
RKTHRLFFFIKRRRAKTLHTLLLLENVVVWTLDIDAQEATTPSAIICPVRRIVVVRE

SEQ ID NO: 197362 - protein, 57 aa, Triticum aestivum
  Clone ID: PAT_TA_91780.pep
PPFELASHVCIMFKFHLNLKWGFVKPLESFLEMTQIKIPPKWSKKMFMLLSENIGQR

SEQ ID NO: 197363 - protein, 46 aa, Triticum aestivum
  Clone ID: PAT_TA_91781.pep
SNNLSMQNVEHAEGSSDRSSVSVMPQNVYNFALDVYKKVKWVVQRN

SEQ ID NO: 197364 - protein, 97 aa, Triticum aestivum
  Clone ID: PAT_TA_91782.pep
RPSSPLGQPPSSARPRLHPHASTRGPPHWDIEGHHCHPCTYRWDRDYGCLATRDHPPHKQHYHSWTTIPILKLPQVDHNSSSKVAPSRYLPTATFID

SEQ ID NO: 197365 - protein, 82 aa, Triticum aestivum
  unsure (1)..(82): unsure at all Xaa locations
  Clone ID: PAT_TA_91783.pep
PPPPLFLPPAAASLPPSRAPPLLPPTSPPPPPTSPLPXPPSLAPPPRASPAPXPPASLPPPLPSRAPPLLPPTSPPPPPTAT

SEQ ID NO: 197366 - protein, 154 aa, Triticum aestivum
  unsure (1)..(154): unsure at all Xaa locations
  Clone ID: PAT_TA_91784.pep
MNVXKLNKMAXXVXNXGKGIMRRKNKAXHKXTXTXDKRLXSXLKRXGVNTIPGIEEVNIFKDDVVIQFLNPKVXASIGAXTWVVSGXPXTXXLQDXXXSIINQXGLTNXGQLRRXQSNSKAXPGGAAGSGGAXKGXQGDHKFRSKKFIALKKRN

SEQ ID NO: 197367 - protein, 89 aa, Triticum aestivum
  Clone ID: PAT_TA_91785.pep
RGHRLALEESHNDDHAKLKKDLDHALVVSRVLTSEKAKLGVDHARLKEEFDVLDKAHNVLKGAHANLKESHAQLQVKLTKGKATFLIWY

SEQ ID NO: 197368 - protein, 171 aa, Triticum aestivum
  unsure (1)..(171): unsure at all Xaa locations
  Clone ID: PAT_TA_91786.pep
PIHLTILSPPSPSPPLSSPPLHAPFPSSSTGHPRRAQVERGIEIDRRCRRSPATTCWTWRRSCPHPRSGSRGSWPAPPPPRRPRRPRPGHLAGSSSRTGSPSARPPTPRRRSGCASPSTRATSPNSSARACPPPPPCCSXXAAXPPPRPPRTRSTADFPAPSSPATHVYKV

SEQ ID NO: 197369 - protein, 122 aa, Triticum aestivum
  unsure (1)..(122): unsure at all Xaa locations
  Clone ID: PAT_TA_91787.pep
MAPTVMASSATSVAPFQGLKSTAGLPVSRRSNGASLGSVSNGGRIRCMQVWPIEGIKKFETLSYLPTXSTTEALLKQVXYLIRSKWVPCLXFNKVGFIFREHNASPWVLXWPYWXMWKLLSG

SEQ ID NO: 197370 - protein, 96 aa, Triticum aestivum
  unsure (1)..(96): unsure at all Xaa locations
  Clone ID: PAT_TA_91788.pep
MKGAKSKGAVKADTKLAVKSKGAEKPAAKGKKGKAGKDPNKPKRAPSAFFVFMGEFREEFKQKNPKNKSVAAVGKXAGEKWKXLSEXXKAPWQGNN

SEQ ID NO: 197371 - protein, 87 aa, Triticum aestivum
  Clone ID: PAT_TA_91789.pep
ESLMLEYGIGKTSKIRKMYKYEVGHNPQARDLKMNRHNLVEGRKLEEAMISLAHVSKEFMQKPDSCEEMIDVLLACRNQRSYPNPVR

SEQ ID NO: 197372 - protein, 195 aa, Triticum aestivum
  unsure (1)..(195): unsure at all Xaa locations
  Clone ID: PAT_TA_91790.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWTMWKLPMFGCTDATQVXNXVEESRKDYPDXYXRIIGFKTCSSXCVNFXANLQDPERLKIITQHNAIFKAWFLHYFNFQKKSS

SEQ ID NO: 197373 - protein, 89 aa, Triticum aestivum
  unsure (1)..(89): unsure at all Xaa locations
  Clone ID: PAT_TA_91791.pep
RVAALFLNKVISLNGTYTEYKTSFMDKKVVRSLYTMEPVCLVCRSXSTHXXWGGSSLNVGNDQPIRQRGKDXGALPQRGTIGDLPXEGG

SEQ ID NO: 197374 - protein, 87 aa, Triticum aestivum
  unsure (1)..(87): unsure at all Xaa locations
  Clone ID: PAT_TA_91792.pep
VXRDLPWQVALVVQXGSXVXMXSGXXVSSDXFGNWIXHLGCGTKPXXLSSTTLVLLLPKTRFXRFSCSPFRSPLLRDRFCFLFLLAT

SEQ ID NO: 197375 - protein, 108 aa, Triticum aestivum
  unsure (1)..(108): unsure at all Xaa locations
  Clone ID: PAT_TA_91793.pep
FFLRISSFLFFXVIKLXQLLDCKLHLXPSQSAXNQLQPRIIRLVHPKHMGNLLNYTLNVTDDCSFVYGRRTIANTEYMVTQQRVTTQVHIFLELMDTFPICISNICSK

SEQ ID NO: 197376 - protein, 57 aa, Triticum aestivum
  Clone ID: PAT_TA_91794.pep
HVHLGNALPKLRTIVCDFASGGAAKPSVCIHSTDLGFLHASKFLRVIDIHGSRGGPV

SEQ ID NO: 197377 - protein, 112 aa, Triticum aestivum
  unsure (1)..(112): unsure at all Xaa locations
  Clone ID: PAT_TA_91795.pep
SSSPRLLLLSNLDXIITLATLXFLPLNQXSLXSRARSTSADGEXRVRGRRPRGRASKXXAPPXXXVAAXXAXALXKEXXEGDDSSTCTFXKXKHVLXQXQGKXNDAYXXLIV

SEQ ID NO: 197378 - protein, 97 aa, Triticum aestivum
  unsure (1)..(97): unsure at all Xaa locations
  Clone ID: PAT_TA_91796.pep
WYWNFLAQHNIFQFDQTLENVVVNSEISFMVIYGNHLLGFAPKEFWVELVXRNHFFGPSMGVWPATWGIPPWGPSCSLVSLLGPCGRTSIMCILGFL

SEQ ID NO: 197379 - protein, 120 aa, Triticum aestivum
  unsure (1)..(120): unsure at all Xaa locations
  Clone ID: PAT_TA_91797.pep
KMFALSKNVRSTRKKFPFQLFGHVYKKCSPFQNCSQLKKIVLNLKSCPHFKILFTNSKKIVHKFQKXFLFSNFCSCMKNVLVFQIFQKMFLVFQIMFSLRSRKMFTYIKNVRTFKKCLKH

SEQ ID NO: 197380 - protein, 102 aa, Triticum aestivum
  Clone ID: PAT_TA_91798.pep
MSNIIHFRVKKEKSHVSKTTAEYKHSTVVSGTTPSGCTQRSPTNPVEDKVDQSTSKKRERERDVFFKTVINCKQSTTISGTTPSGCTQRAPTGLRNPVDIVD

SEQ ID NO: 197381 - protein, 60 aa, Triticum aestivum
  unsure (1)..(60): unsure at all Xaa locations
  Clone ID: PAT_TA_91799.pep
SFEKQLKKLPLSXGGTPXHVLIDSXELXXTWXRITXVXMAVTSSWTVCDXPVXXVIDQWL

SEQ ID NO: 197382 - protein, 172 aa, Triticum aestivum
  unsure (1)..(172): unsure at all Xaa locations
  Clone ID: PAT_TA_91800.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINKWRSQEGVPDAYXRIIGFTTSQVASAATGSRSGRLTVTHSI

SEQ ID NO: 197383 - protein, 92 aa, Triticum aestivum
  unsure (1)..(92): unsure at all Xaa locations
  Clone ID: PAT_TA_91801.pep
LKNXVEEIIMKGARPIIPGMPVIMLKMWYGCPKIVLMFHTQLPRWKIRLRGLTPILGKDLIARQPAQSTVCSKLSGLNARVCQVRTHDSSIY

SEQ ID NO: 197384 - protein, 70 aa, Triticum aestivum
  unsure (1)..(70): unsure at all Xaa locations
  Clone ID: PAT_TA_91802.pep
XFXCLVQSLVYVAKVXKEXVSNXGSCXXNPRNGSCNCKQNSSWXVNDIIKAXXTPRXREXGIXSFGQMIQ

SEQ ID NO: 197385 - protein, 118 aa, Triticum aestivum
  unsure (1)..(118): unsure at all Xaa locations
  Clone ID: PAT_TA_91803.pep
DQVSVXLKAPGXXGPFGDCTAPXGXFSLREEVSVSXIGRRRANVFALSXERRGCLQWRRGEARRLFWNGDXGEVGVFCNGEGGRGAWAAIYDWARGRRAVTGSKSKSIYPSIKKATPH

SEQ ID NO: 197386 - protein, 193 aa, Triticum aestivum
  unsure (1)..(193): unsure at all Xaa locations
  Clone ID: PAT_TA_91804.pep
QRLIFAGKQLEDGRTLADYNIQKESTLHLVLRLRGGMQIFVKTLTGKTITLEVESXSDTIDNVKAKIQDKEGIPPDQXQRLIFAGKQXEDGRTLADYNIQKESTLHLVLRLRGSMQIFVKDLTGKTHLEVGSXDTXXNSREVQDKEAPPGQQRSLASIQDGLPCDTRSTQLSRLGEITWKGGLGHQTQEKDPR

SEQ ID NO: 197387 - protein, 158 aa, Triticum aestivum
  unsure (1)..(158): unsure at all Xaa locations
  Clone ID: PAT_TA_91805.pep
LVALSNEALSISIPHKKSILEKNTIRLALHRQTWGLRAKVRSARDHGTLFYQIGGALVQNRLXLSNNPIESIYIKIKRQSCQEAGFSLAKRYFELGTSMKRLTRLLSLLSFSGGPAAQDLWVLPWEPMKKSGLPKYSLKMILTIVKANALPYDRKDSG

SEQ ID NO: 197388 - protein, 173 aa, Triticum aestivum
  unsure (1)..(173): unsure at all Xaa locations
  Clone ID: PAT_TA_91806.pep
LPPSAAVAARPSWRRASATSLLHQPLHPPAPHHPATTPSSPPSPWALHFVAAPGAPDQTGVWFPAPPAAALSLSAAPPLVSTSSALSSSPNPAVALLLLLXTLLXSFSLHPLXVVASTCCFFSNPXAAPXPLSLXGPLTEEKTGVSLLVADPVFXXTRXVXPQPFLXNIVXCR

SEQ ID NO: 197389 - protein, 84 aa, Triticum aestivum
  unsure (1)..(84): unsure at all Xaa locations
  Clone ID: PAT_TA_91807.pep
MGISRDSMHKRRATGGKQKAWRKKRKYELGRQPANTKLSXSNKTVRRSXFPGGXXNWRXPLXXTGIXXGXXRAXTPKTPGWGLI

SEQ ID NO: 197390 - protein, 95 aa, Triticum aestivum
  unsure (1)..(95): unsure at all Xaa locations
  Clone ID: PAT_TA_91808.pep
MATISAAAATTVVARAAIARPQALGLPQLRTKEREGEVQLLQGRQGXGTPAAAVRGAWRVPTRRGGRGDRVRGAGAGAGRRADVDGXGHRAXPGA

SEQ ID NO: 197391 - protein, 106 aa, Triticum aestivum
  Clone ID: PAT_TA_91809.pep
AGTVAPATPPAPTHQRTPQTQEEARGVRFLSLVKNVAAARIGGRRHRSNTRNGVNMVATPRRTPGAHASASQHSQLQQPAGTASALLRSRFRGGRFQVLPEPTVLR

SEQ ID NO: 197392 - protein, 82 aa, Triticum aestivum
  Clone ID: PAT_TA_91810.pep
SERKLSTRSKFVFVHYIFRHSSPSTLHRVPLPSLCDPRYLYLCQVYVILSIYLSRVVRPFPSLFSSAHAPEFGALVPTSHPP

SEQ ID NO: 197393 - protein, 170 aa, Triticum aestivum
  unsure (1)..(170): unsure at all Xaa locations
  Clone ID: PAT_TA_91811.pep
SCLLHPYPQPLPLPPSNPTSQRAHLKWPPCHRRRRRHLLRRVAVSALTLEEQLAPTNPRTVNPRRPFDGMQERTVATSNTXGQPVRRNASRERRRARAYVTRRGERPQGAARKTRVRRFWRWRTPSXTPEASSLLQDAAERLPVNKXMLPTSQTWRALQEAGXPGXHXLA

SEQ ID NO: 197394 - protein, 115 aa, Triticum aestivum
  unsure (1)..(115): unsure at all Xaa locations
  Clone ID: PAT_TA_91812.pep
RKDGRDSRFVSQLLFFHFGPQQEGAVQVATPTLPSPVKVHRHPNIFNMPARMIVKQAQSWYATPILKEHQHVKPNTFCTNTKNGNDNANMKRXNXASTPRCTNAXXNAKXTXLNL

SEQ ID NO: 197395 - protein, 75 aa, Triticum aestivum
  unsure (1)..(75): unsure at all Xaa locations
  Clone ID: PAT_TA_91813.pep
GLMGXXHXVGANWXXFXXXSCXAXKVDALXGKXXPEXDPEXYXXAAXKSLXXXPRLTXWXFTLGKRRLXVFLTPI

SEQ ID NO: 197396 - protein, 112 aa, Triticum aestivum
  unsure (1)..(112): unsure at all Xaa locations
  Clone ID: PAT_TA_91814.pep
KIKQIGKYVKMRKLKMTDKLERNTEKKNPDRNRPKTPQTASDSTTGNVLCGHPSKYMAAKMLEETGCSFXERPIVYXVSPYNWGTFFRCQTRDLCSKANACLPLCLGINXAX

SEQ ID NO: 197397 - protein, 143 aa, Triticum aestivum
  unsure (1)..(143): unsure at all Xaa locations
  Clone ID: PAT_TA_91815.pep
RAISSTMEEVRTLMEDDDSWAIELPRGGGDVHRNTRCMVDYIVSMKKARASTHNTALSHDPVYLDGLIDDTMDYLKDLLLRKSELFXDPRLRYLFLLNNSYFVAQVVSGPSPECEKYMDCHLDVSWGNAVSSLYCKPKSIFGT

SEQ ID NO: 197398 - protein, 128 aa, Triticum aestivum
  unsure (1)..(128): unsure at all Xaa locations
  Clone ID: PAT_TA_91816.pep
MAPTVMASSATSVAPFQWLKSTAGLPVSRRSNGASLGSVSNGGRIRCMQVWPIEGIKKFETLSYLPPLXTEALLKQVDYLIRSKWVPCLEFNKVGFIFREHNASPGYYDGXYWTMLXLPMFGCTDATK

SEQ ID NO: 197399 - protein, 44 aa, Triticum aestivum
  Clone ID: PAT_TA_91817.pep
LYVSVNCLGRLPYAPVSSRSHLYPLASLCHQPKSTDAPKKKKKT

SEQ ID NO: 197400 - protein, 47 aa, Triticum aestivum
  Clone ID: PAT_TA_91818.pep
FIGCLNCHILGFVFSPLYILETNFISGSDSRKVICNVYSILCMTRGK

SEQ ID NO: 197401 - protein, 124 aa, Triticum aestivum
  Clone ID: PAT_TA_91819.pep
PLLKLYLTENDFGCKKNDKDNVGIAGATNEVATLKEAVAAAERNAAAERTEREKQEARVAEVQQELQDLVKKHESLERDSKTRESELATALEGAKAAKAEAYKALQEIEAVKKIAAGKAFFMQS

SEQ ID NO: 197402 - protein, 59 aa, Triticum aestivum
  Clone ID: PAT_TA_91820.pep
RPATKGSPDTLSRKSRRPWHLLLHLWPAYVRAKIAGWLVEAIVPSDPGTSKAKDCNGKP

SEQ ID NO: 197403 - protein, 83 aa, Triticum aestivum
  unsure (1)..(83): unsure at all Xaa locations
  Clone ID: PAT_TA_91821.pep
SPKQAYWXYVFFAALWAHLAFAGLHPDQRQVGFLVVCRPLWPSRRAFFILFFALFIFVLFFFVYLEFLCEHFCFRYKKLQTFC

SEQ ID NO: 197404 - protein, 140 aa, Triticum aestivum
  unsure (1)..(140): unsure at all Xaa locations
  Clone ID: PAT_TA_91822.pep
GQRRRRRLPSSRRSRRTRAGRIASGGCTVVPSTRAAVSTGPCAAPYYFSSTRATIDGAAPRVAAAALLAGRGGVRGRCFLSMVLLADDEALRGDGSTAPSSSDLMLPPPWSNERHGSKCXRIRENETEEMLXQYSLQMKC

SEQ ID NO: 197405 - protein, 173 aa, Triticum aestivum
  unsure (1)..(173): unsure at all Xaa locations
  Clone ID: PAT_TA_91823.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWXTMWKLPMFGCXDATQVINXVEXVKKEYXDAYXRIIGFTTCASXCVSXXAXKXPAQDPEG

SEQ ID NO: 197406 - protein, 170 aa, Triticum aestivum
  unsure (1)..(170): unsure at all Xaa locations
  Clone ID: PAT_TA_91824.pep
FERQQPSSSKAPITQTGNEQGKEELATEWGSLLGGELVATNQALVXPIIXPXNXLXFXSPDXGPFPSSDQAPAMATTASRRHGRGAQRTXRQRFRXSQAPIRGRXKNLLKXXPLQVILXTTFTPXQQLLRXXKLRNXXGLLXFGAXQFQKXQXMGKNRDWLTGTXXXVAS

SEQ ID NO: 197407 - protein, 61 aa, Triticum aestivum
  unsure (1)..(61): unsure at all Xaa locations
  Clone ID: PAT_TA_91825.pep
RIDEINFLVQTELXXIPLGVQTXIXTXASKTTRXSKCQXLLNPNXPLXXNAXNXXGNPKXE

SEQ ID NO: 197408 - protein, 60 aa, Triticum aestivum
  unsure (1)..(60): unsure at all Xaa locations
  Clone ID: PAT_TA_91826.pep
FYVASVNKIRGEATYIVSRTKVTRSLSEPRGLLRESPVLQEAYTKTCPNSAKNYTYENXG

SEQ ID NO: 197409 - protein, 186 aa, Triticum aestivum
  unsure (1)..(186): unsure at all Xaa locations
  Clone ID: PAT_TA_91827.pep
TTHLLSARKVHSLRRGREEEARLVMAKIQGAAAAGALVDMTKLLGAFTNDIACRAVSGKFFREEGRNELFREAIDGNVAAFGGFNLLDYFPGLAKVGVLARLLFAKTNPLKRKWDXLLDXIIDDMSAKHXHKEQHTSTIKKMKLLHVLSGGSQTDRMDGFCVIIIFGGPFQFPKGLPASLNLETGF

SEQ ID NO: 197410 - protein, 119 aa, Triticum aestivum
  unsure (1)..(119): unsure at all Xaa locations
  Clone ID: PAT_TA_91828.pep
PPILXKWLVSEESHRNXSXGFGSPQIXRXSSNQFSFRQHVLEVYLSLVDGRHSGVHLLLASPTESLELVEVSAYSLKELVLLGDVVADARFINYLEPGSGEDLLIKYLPLDWRSGACRS

SEQ ID NO: 197411 - protein, 106 aa, Triticum aestivum
  unsure (1)..(106): unsure at all Xaa locations
  Clone ID: PAT_TA_91829.pep
WHRRLPAQSQSPPSISSSHLKYLSQFTQDAVTPGNWSMSPIKFTNALLHVTESFPFFPGLLVNGTYTRFQRIIPCNFSXMSVGTLDTLENVGNEHGHTHILRTTRR

SEQ ID NO: 197412 - protein, 138 aa, Triticum aestivum
  unsure (1)..(138): unsure at all Xaa locations
  Clone ID: PAT_TA_91830.pep
VHAQPXHLTSPCLCLXVLLFVARQDHPRDFPKYHYDSCATMRIHQVPLQQDRRLNKHTGSVDFGKSLDDRRLVPLRLPCTSTPRPDRQVPRRCVYHYRRPEDVGFIKYLSKNKREPLLPKRDRVPLPSPKSRVPLPSP

SEQ ID NO: 197413 - protein, 142 aa, Triticum aestivum
  unsure (1)..(142): unsure at all Xaa locations
  Clone ID: PAT_TA_91831.pep
MQIFVKTLTGKTITLEVESSDTIDNVKAKIQDKEGIPPDQQRLIFAGKQLEDGRTLADYNIQXKESTLHLXVLRLRGGAKKRKKKTYTKPKKQKHKHKKVKLAVLQFYKVDDPRQGDKLRKDAQRRRLMATLDAYAAHYLNR

SEQ ID NO: 197414 - protein, 60 aa, Triticum aestivum
  unsure (1)..(60): unsure at all Xaa locations
  Clone ID: PAT_TA_91832.pep
SXQSKPXQFIYTLEGHTVRLQGKETAHPNSNLAVHASRSPTRTQGMIPQFIFTAHQPSPY

SEQ ID NO: 197415 - protein, 119 aa, Triticum aestivum
  unsure (1)..(119): unsure at all Xaa locations
  Clone ID: PAT_TA_91833.pep
WRAMSRCAITXXLXMVHLXCGAPLVVLXXNIXXFVTNGAPLHSAPLLIDIVMAHHIYXCAISSFEKIVXXXYXSFCYXWCTMSRCXIXRXXXRNXALPLXPHYXXFFXXLSVXXLXPCN

SEQ ID NO: 197416 - protein, 191 aa, Triticum aestivum
  unsure (1)..(191): unsure at all Xaa locations
  Clone ID: PAT_TA_91834.pep
XFXDRPLLGGAGNSQEGLHHSFEYLEDHAGMPVPFYGXGXSXSVXERGEERTDRLVIIGXPRXPPEGXSGTPVYGENGDRRTDPTRESRLHSXRHLGTAAAEREGGGRRVLHPAASCQPRCGRGRLRECARGRPTIDAVPRSCGTRGVQRRSWTRVSRRGGTQSTPSSECGCRGRTLAVATPAIAETSGFT

SEQ ID NO: 197417 - protein, 147 aa, Triticum aestivum
  unsure (1)..(147): unsure at all Xaa locations
  Clone ID: PAT_TA_91835.pep
MAPAVMASSATTVAPFQGLKSTAGLPVSRRSSGSLGRVSNGGRIRCMQVWPIEGIKKFETLSYLPPLSTEALLKQVDYLIRSKWXVPCLXFNKVGFSFRXEHNSSPRVLRRPYWTMWELXMFXCTDAPSVKXVEEVKXGYLILSFQP

SEQ ID NO: 197418 - protein, 75 aa, Triticum aestivum
  Clone ID: PAT_TA_91836.pep
LVSTGLTNIYIPVRTRFGHWSSQHGLLLVPPLCHRSHHEHSPLLVPALMGQSHHEHSPLLHPVLPDHRCRMSRLI

SEQ ID NO: 197419 - protein, 175 aa, Triticum aestivum
  unsure (1)..(175): unsure at all Xaa locations
  Clone ID: PAT_TA_91837.pep
MAPTVMASSATSVAPFQGLKSTAGLPVSRRSNGASLGSVSNGGRIRCMQVWPIEGIKKFETLSYLPPLSTEALLKXVDYLIRSKWVPCLEFSKVGXIFREHNASPGYYDGRYWTMWXCLCSGCTDATQVIXXVEXVKKXYXDPYVRSSDSKHRVNAQILQRAARRKAKNYSHRHA

SEQ ID NO: 197420 - protein, 63 aa, Triticum aestivum
  unsure (1)..(63): unsure at all Xaa locations
  Clone ID: PAT_TA_91838.pep
GLTWCLVWCFQLSIYIYIYIYIYIYIYTSQAVHPHGLSSYITLSKXHGKTLIILASFENMQYV

SEQ ID NO: 197421 - protein, 92 aa, Triticum aestivum
  unsure (1)..(92): unsure at all Xaa locations
  Clone ID: PAT_TA_91839.pep
TTNRSSNDIHPASPGCRPGTYPLIEEESEEELHNKQTSLSRHDHRITCTCNFGVSNLWSHEDSSIPITMGYQRLANLMGKXKGKVVRVATXG

SEQ ID NO: 197422 - protein, 161 aa, Triticum aestivum
  unsure (1)..(161): unsure at all Xaa locations
  Clone ID: PAT_TA_91840.pep
LNSLRSLSLSGEPWPDYGQQDWDADDEEIRCPPTIHLVATVDDLTDMLDFDSEYIDGMDDDVGDEHEPAPIGHWEXTPHYDIYMVDTPNKXNGDKIRRIPSQRNNPSADVQXXRPXSRQNKXGVTXQGDYXXPIIPXDNXIPPNKXXSGGXRAXSLXKXTE

SEQ ID NO: 197423 - protein, 166 aa, Triticum aestivum
  unsure (1)..(166): unsure at all Xaa locations
  Clone ID: PAT_TA_91841.pep
RHTRRHTSIFCFLYKPQRSVRLIVRCANNRVRTTTVYSRSAVTRPPLQVSLVAAVTFAFLTARGTSRRPLRPKTSITSTGRSPRCGGSTRGTTASGRVXGAAAADGGGDHDHAAVVSAPCWXXXLLXGGVTRXNXRXXPXVRERPGWXXSQAVXXACXPXLXRGXA

SEQ ID NO: 197424 - protein, 85 aa, Triticum aestivum
  unsure (1)..(85): unsure at all Xaa locations
  Clone ID: PAT_TA_91842.pep
VCHCSILPGDLLLIFQAILVPLFRRLLLRVARALDCEPLNAPTDGFHSHYPVARCSPTLXRGRPXGGPVPIAYRIYTPPRRRLKV

SEQ ID NO: 197425 - protein, 164 aa, Triticum aestivum
  unsure (1)..(164): unsure at all Xaa locations
  Clone ID: PAT_TA_91843.pep
HKTLTSRMPLIQLQLASPTMKHTSFLQQFVFLFGLIVTTLVSGDDQFLFSGFSQPSLTLGRMCHGHRWWLLGSVQWARRSQGHASIPPSALPAXTRWEXQSFASMYPQHFTPYADFSADGRFLHAPTKFSDAREQXLAPQTRRTXDTXNTLKIEFTLQNLSPKT

SEQ ID NO: 197426 - protein, 61 aa, Triticum aestivum
  unsure (1)..(61): unsure at all Xaa locations
  Clone ID: PAT_TA_91844.pep
REXSXXGNFEIEVXXLGXNTTXSCXCSTYTSCWWRRSRELLAEKTTQQKTPTAAGVISSTS

SEQ ID NO: 197427 - protein, 111 aa, Triticum aestivum
  unsure (1)..(111): unsure at all Xaa locations
  Clone ID: PAT_TA_91845.pep
AAWDLAAVVRAVWCPAVVACQRGGGAELCWWTRGGGSGRPDLARSGRNVEGPGLGTLCPDAGFSDGAAASPFMLRPRWXERQVQIRWWVAPRAKSLALXQIFPDEILELTR

SEQ ID NO: 197428 - protein, 95 aa, Triticum aestivum
  Clone ID: PAT_TA_91846.pep
AFYKSTQVYLIPSWCIKRKMKIKCKRRSQDLHRSHERKRNPENIPILVEEREDAFQGIPKLRHFSLLEYLLGVPRASPSLSSCLSSFSSYRDILD

SEQ ID NO: 197429 - protein, 194 aa, Triticum aestivum
  unsure (1)..(194): unsure at all Xaa locations
  Clone ID: PAT_TA_91847.pep
AGYFPFGRDFTTAGLRFRCRIARAFALNRTRTGYFGSHTGSKHRCGTRSKINPPTHHNLYSPSNSAPPRYIRPDVCAAAAQGNVHTFGQILLVKNKSXRSGQDYFXFNIMXKRRNDPXRHNTXSXITMXTNHSMEHMEGKXNGPQLDQLRXGKEYTRXSXTTAMAGXKXYGQGXLXLXXPXXNMRXFEXXRPSN

SEQ ID NO: 197430 - protein, 139 aa, Triticum aestivum
  unsure (1)..(139): unsure at all Xaa locations
  Clone ID: PAT_TA_91848.pep
FDXGRRPASGRCPAXGGEQAWCPRTTPAELHPPPFVVPXRVSSNAGNNSPGVWRGTMIALPPXTQPSSTPVDXSNXXXYLHVXXATAXWVPTAQVMTQQXSXAXXREAXQSGAATRFLSSARLLSPXSHIPSTDXXTXX

SEQ ID NO: 197431 - protein, 77 aa, Triticum aestivum
  Clone ID: PAT_TA_91849.pep
MSCCGGNCGCGTACKCGNGCGGCNMYPEAEAAGATLLVSATATHKASSGGMEMAAENGGCGCTNASADQLRCSCCNC

SEQ ID NO: 197432 - protein, 82 aa, Triticum aestivum
  unsure (1)..(82): unsure at all Xaa locations
  Clone ID: PAT_TA_91850.pep
LXTXSHSRQXWGRLGDIWXSKGGGLLGCSCQEGSSSNVVNHRVPGSGLGGLPERVTEGNTINNRAIKESQSITWQYTVLEVI

SEQ ID NO: 197433 - protein, 134 aa, Triticum aestivum
  unsure (1)..(134): unsure at all Xaa locations
  Clone ID: PAT_TA_91851.pep
MKGAKSKGAAKADAKLAVKSKGAEKPAAKGKKGKAGKDPNKPKRAPSAFFVFMGEFREEFKQKNPKNKSVAAVGKAAGEKWKSLSESEKAPXVGKGNKLKGEYNKALLLXKGENAAAAAQKKXRQGVXEEDKRN

SEQ ID NO: 197434 - protein, 96 aa, Triticum aestivum
  unsure (1)..(96): unsure at all Xaa locations
  Clone ID: PAT_TA_91852.pep
ACPWAPFILGNNXMAANTIKGXWXHYLLWAPLPVQCNTFSYARIMRLXXPSPPNPQDRITTLDPAGFKGCMPNMNXSIXTVRSQYXGAXQRXTHXA

SEQ ID NO: 197435 - protein, 90 aa, Triticum aestivum
  unsure (1)..(90): unsure at all Xaa locations
  Clone ID: PAT_TA_91853.pep
VKIDILDDSIWTPQVFRNVSGTYQSTGEVTGTTRGKIWAIWAIGGKAHQPTRGGAPPPKGKGGRCKKEGGXXALLSFLPPLSLSPFSPSK

SEQ ID NO: 197436 - protein, 117 aa, Triticum aestivum
  unsure (1)..(117): unsure at all Xaa locations
  Clone ID: PAT_TA_91854.pep
SPLRLTTRLFPGSQVTTTXALTPSFDPCSIWTSYTGWCIPRSAFKXGNRTAXADNKGHFGQQAEKXXSNXTPATYXTCFKEGPNXPXFQXKXLPEXSEGATTXXHVIXXRMXKKEXR

SEQ ID NO: 197437 - protein, 165 aa, Triticum aestivum
  unsure (1)..(165): unsure at all Xaa locations
  Clone ID: PAT_TA_91855.pep
CADAAKMAGFALATSALLVSGASAEGAPKRLTFDEIQSKTYMEVKGTGTANQCPTIDGGVDSFPFKAGKYEMKNSAWEPTSFTVKGRGXIRKNEPPASXKTNSMTRLNYTXDEMEGRXKSXPTDLNSKEKDGXPLCGVNVXSPGXERVLLFNVKPNKKKGPSCAN

SEQ ID NO: 197438 - protein, 140 aa, Triticum aestivum
  unsure (1)..(140): unsure at all Xaa locations
  Clone ID: PAT_TA_91856.pep
SLSLSLSLSLSLSLSLSLSLSLSLSLSLXHSLXLSXSFFKXLXNLSQRNNIILXMXFSELXXGIAHSFQTKXHNPKVHNXFQNNSTHXXRXSDXKKTTXVFLXKYPXNTSQDTSXNFHFXFSVEKAXXCXEHSYNLFIWX

SEQ ID NO: 197439 - protein, 140 aa, Triticum aestivum
  unsure (1)..(140): unsure at all Xaa locations
  Clone ID: PAT_TA_91857.pep
TRKXLXIIKTRQPLGVLRINLGITTTTKQQFXLPSELVSLSNRNXTHVTHGTTKMSNLQLXALAPKLRLRXWRPYQNNPGDXWNIPXGPPLGARXSXVWTGCNGSPKEHRINSPGXPGXAPWVNAXXVNVXXLGPKDAVL

SEQ ID NO: 197440 - protein, 194 aa, Triticum aestivum
  unsure (1)..(194): unsure at all Xaa locations
  Clone ID: PAT_TA_91858.pep
IKIPLILGIWGGKGQGKSFQCELVFAKMGINPIMMSAGEPAKLIRQRYREAADMIKEGXKMCCLFINDLDAGAGXMGXGTTQLHRPTTKMVNATLNEHRPMPPTNVQLPKACSTRXENLPVAXLXTGXHFQSLYALSXPEWPMEXFTGVPTXKTFRVCKGPKTIGQSSKSKLPRQSSTFRASRCHNKCQMVTPR

SEQ ID NO: 197441 - protein, 82 aa, Triticum aestivum
  Clone ID: PAT_TA_91859.pep
WTRLCELFLDNQLQRHVFLQGEFFTLQQNDLSIDEYCTRPKVLADERRDVGMTIDDSVLLINLLRGLHPDLGSPPPTSPSSR

SEQ ID NO: 197442 - protein, 63 aa, Triticum aestivum
  Clone ID: PAT_TA_91860.pep
HFGQIVTRPKILHGSKSGSVVDSGYYLNHTGAVNSRRIGANPEGEWISVRASAEIPGRSTTNL

SEQ ID NO: 197443 - protein, 142 aa, Triticum aestivum
  unsure (1)..(142): unsure at all Xaa locations
  Clone ID: PAT_TA_91861.pep
MAPTVMASSATSVAPFQGLKSTAGLPVSRRSNGASLGSVSNGGRIRCMQVWPIEGIKXFETLSYLPPLNTEXLLKQVDYLIXRSKWVPCLEFNKSGHLPXEHNAXPGYNNGRYWXTMWKLPKFRXAPTQQVINKVEEXXKDT

SEQ ID NO: 197444 - protein, 97 aa, Triticum aestivum
  unsure (1)..(97): unsure at all Xaa locations
  Clone ID: PAT_TA_91862.pep
DRSTSARGFSAEAWCHNPPAHTSPLVASRESKLRASRGSKTVPLKEEKEKRKNIYIFSFPERHGPCISAEAKHPSQQELKKEEKQFFSISRXVEEKK

SEQ ID NO: 197445 - protein, 101 aa, Triticum aestivum
  unsure (1)..(101): unsure at all Xaa locations
  Clone ID: PAT_TA_91863.pep
YWVLIIXLVLXNFFHWFNYPPGYLPHWVPLKLSQTNTLVKXGMCPKNGEPVLLVNLVKLSLLLSFNLPKILGKFRDNRREICIIKSFXVKKIQNYFPIAPS

SEQ ID NO: 197446 - protein, 122 aa, Triticum aestivum
  unsure (1)..(122): unsure at all Xaa locations
  Clone ID: PAT_TA_91864.pep
SXNXALLNFGXPFLAFXCXLILIPXKSXXGVXPTKXLEQXXXDIPAXLYQSXLLNRXCRGCXRXCGCLHERWLVRCWRSWSGAAVHLPPRRSPACCLSPKEAGPSVWAPETRSIAELPARRL

SEQ ID NO: 197447 - protein, 118 aa, Triticum aestivum
  Clone ID: PAT_TA_91865.pep
SIVNRRLLCVSRIEHTIECSNYTLLAKGRASEFYTIFDNETSLPPSETPSPRPGIAIDVRIQSMAIMSSPFLRYKRIILSESIRSDPLFHRFRGKTKDLARPEKLKREREVCTVKEAL

SEQ ID NO: 197448 - protein, 154 aa, Triticum aestivum
  unsure (1)..(154): unsure at all Xaa locations
  Clone ID: PAT_TA_91866.pep
MPRAQSRARSTCRPTPRSHRSGLWQXRRKRWRTMGRPWPTPRVATDLARTAGRTSLMXMVGATHLARGVGEISLXRITHKAMRASQLCQHSRXXTKDHHXDEGLGASXSRARSLASWAALKPXLSRHLKQLPXSNESFQXXAKPLKWSSCLXXN

SEQ ID NO: 197449 - protein, 122 aa, Triticum aestivum
  unsure (1)..(122): unsure at all Xaa locations
  Clone ID: PAT_TA_91867.pep
MGIDLVAGGRNKRTKRVAPKSDDVYLKLLVKLYRFLVRRTKSKFNAVILKRLFMSKTNRPPLSMRRLSNRREXGGXKNIAVXLXXTITDDMRVQXVPAMKVTLXVXXTXXARXVNAGGECSL

SEQ ID NO: 197450 - protein, 140 aa, Triticum aestivum
  unsure (1)..(140): unsure at all Xaa locations
  Clone ID: PAT_TA_91868.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKLGSSSRXHNASPGYYDXRYWXTMWKLPISGAPTHTSDXQVEESRRIT

SEQ ID NO: 197451 - protein, 135 aa, Triticum aestivum
  unsure (1)..(135): unsure at all Xaa locations
  Clone ID: PAT_TA_91869.pep
SXLVRDFSLVXPYFXVAXSAILLFXRCILYHHIFSFFPVFHAQXLQSCVPXPGKQDSVYXAVEAWKFFVPMESILAXHHLVKVNALVDCLGTQVLQTFFQPKYVVDSSTQFHEDGFQEIAQRLSEGINVACIQEQ

SEQ ID NO: 197452 - protein, 94 aa, Triticum aestivum
  unsure (1)..(94): unsure at all Xaa locations
  Clone ID: PAT_TA_91870.pep
VHRPALAGRQQQPRGRCPPGGAPAPVRPSSKAAVSPSTPVLQGDGQHQEHGDFGGTXDSAIXAHKAGTGSLTILWXLSIYVPNFIWLHDIYQTX

SEQ ID NO: 197453 - protein, 138 aa, Triticum aestivum
  unsure (1)..(138): unsure at all Xaa locations
  Clone ID: PAT_TA_91871.pep
YSPKFEKSHRVVSNPPTRGLSCSPSTRLSLKHIPISKDDEVQVDYNLLLRSYATSRPTLHPHPQRMTKCRSELQLLLKSXATILNXSILNXQXXRRAGRXTXSSGAXHXXKXLXLIRKXTKXRQLDSSSKVXSSXKFP

SEQ ID NO: 197454 - protein, 84 aa, Triticum aestivum
  unsure (1)..(84): unsure at all Xaa locations
  Clone ID: PAT_TA_91872.pep
SFLHQHWVMGAIIIIARCFFTLSFQTIGVVEKHQRADGITSCCDYVPQQRFLCFVSGRGVHSFYXYLQHGNYYSNMXXLHLLCN

SEQ ID NO: 197455 - protein, 96 aa, Triticum aestivum
  unsure (1)..(96): unsure at all Xaa locations
  Clone ID: PAT_TA_91873.pep
LYSFPRLKCFPCSFASRQFILPECSRHLRRFVCVLINXRLSPHPNISTIPVHHLSVQQPFQWCFSLQVGPNHXSFPGSYLTLLIPREYPNXFKGGR

SEQ ID NO: 197456 - protein, 193 aa, Triticum aestivum
  unsure (1)..(193): unsure at all Xaa locations
  Clone ID: PAT_TA_91874.pep
AVLVKIAVMMMAXAALQRHRKQGGESPPSSSSSLTSSLDGRRVSPLFVGSHGWRGEXPLXDWDLSLYFCVLFSTPSPFPLYPXEIRNSDWGESFAQIFLNKIXFFAPKKKASTALRVGQQGKGHXGGGKRXPYSXTXRKLXXDLLPENHNIPKXPSILTWVGNGFLQKINQENGTVLSKIKIQLNKLMSNLFI

SEQ ID NO: 197457 - protein, 96 aa, Triticum aestivum
  unsure (1)..(96): unsure at all Xaa locations
  Clone ID: PAT_TA_91875.pep
MAASMITSPIVAPTSVPSLSRRGSSFAVVCSGGKKIKVDKPXGLGGGLTVDIDANGRKXARRGVQFVDXYGQRXTGYSXLNPGRANGTPGGNGFIG

SEQ ID NO: 197458 - protein, 62 aa, Triticum aestivum
  unsure (1)..(62): unsure at all Xaa locations
  Clone ID: PAT_TA_91876.pep
FKQQYXGXILXXXSKKTSKTXTCHVTGKLTMTPRYXXKGTLINFQKSXRXNXSGKXXXPXIW

SEQ ID NO: 197459 - protein, 209 aa, Triticum aestivum
  unsure (1)..(209): unsure at all Xaa locations
  Clone ID: PAT_TA_91877.pep
NXNXNFTTXLSIFSTXXLVQFAVEQDVVIPHVPSXANXFXLGNYDRXVFHXXTSXNCPSRTHQWKFRYPFVFPFSVRKVKYHHPVMSNPVDNLCGQTWGVTVVGMKEDXSKFFPIKRCQWQQSDTLRDHASPVFGGGASNNLAGTGLDDDVSHPCGWRRPAAGRSWRRRSRPWTRSGAHRCPTSPTILLSPGASGVVETRRSGSEGRMD

SEQ ID NO: 197460 - protein, 54 aa, Triticum aestivum
  Clone ID: PAT_TA_91878.pep
LEACVQARNEGRDLAREGNEIIRAACKWSPELAAACEVWKAIKFEFEPVDTIDK

SEQ ID NO: 197461 - protein, 98 aa, Triticum aestivum
  unsure (1)..(98): unsure at all Xaa locations
  Clone ID: PAT_TA_91879.pep
LKQGREVXTYRLKDVXTQGYSCVXTFAGTXQVDPKTGXLXLSGAGTLKERXGLELNRXXSCRLPASGAXCXEXDDWETXRLXDSXXGPCXRDWFXGXG

SEQ ID NO: 197462 - protein, 92 aa, Triticum aestivum
  unsure (1)..(92): unsure at all Xaa locations
  Clone ID: PAT_TA_91880.pep
SVSRYSEISETFYRDNCMHQGSLSPTXLSRXGXDPYRITTXAMVQNTVPXKGLKNRLVXXLPPTGGNXSKXXSFXLNGISXLXAXGKTKXEF

SEQ ID NO: 197463 - protein, 146 aa, Triticum aestivum
  unsure (1)..(146): unsure at all Xaa locations
  Clone ID: PAT_TA_91881.pep
LDVGASTSPHNLNNCQAGRPPIVSVELPSLLVVLALVSTSLPRTRNSSPRFDAGTNLSCRHGPSVEEGESCTPARTQPAWSCPERSMVXNKKVXARPSNPCRRSQMNGKERRLXPLPRAMXDWXPRNSXHFXSPGWLXPFPDLTKV

SEQ ID NO: 197464 - protein, 63 aa, Triticum aestivum
  unsure (1)..(63): unsure at all Xaa locations
  Clone ID: PAT_TA_91882.pep
KKERVXPLAXLXNEAEKRPVHQFRGQHIGEGLTTSYSQHEGSRVLSPXQVDPNTYPALFTEPK

SEQ ID NO: 197465 - protein, 54 aa, Triticum aestivum
  Clone ID: PAT_TA_91883.pep
CEVAFSGLHLQIRHGMVTILIKLMVSPLYIHYHHPRCFTASCRASTAPEGGPGT

SEQ ID NO: 197466 - protein, 138 aa, Triticum aestivum
  unsure (1)..(138): unsure at all Xaa locations
  Clone ID: PAT_TA_91884.pep
MAPTVMASSATSVAPFQGLKSTAGLPVSRRSNGASLGSVSNGGRIRCMQVXWPIXEGIKNSETLSYLPPLNXGASFXKVNTDSSNWCFLXFTRXGXLXLXXNXTPGYYXGVMXXWNCXFXCNQPTRYVGGQEGYLLRI

SEQ ID NO: 197467 - protein, 144 aa, Triticum aestivum
  unsure (1)..(144): unsure at all Xaa locations
  Clone ID: PAT_TA_91885.pep
LRPGRSPMPEFRRKRARVRPSNPNGCTAPLCSVRTPVQCAPSXXSQQCPHXRVAXPPLTDAVSSPGAVFQEXSRRAVXFPPLALXIQPLQASMXSQFNTQLPHAIXSRTRPXSSGGILXXSXXSKICPTSNPPXQGGRTIPNDL

SEQ ID NO: 197468 - protein, 66 aa, Triticum aestivum
  unsure (1)..(66): unsure at all Xaa locations
  Clone ID: PAT_TA_91886.pep
YHIYSPQDLYTLHFSXXYTDXPYQPXLXIHKYILMSNGKEIXXIAHTPXPQXYLSANHAHXAMADX

SEQ ID NO: 197469 - protein, 72 aa, Triticum aestivum
  unsure (1)..(72): unsure at all Xaa locations
  Clone ID: PAT_TA_91887.pep
MAAAFSSTVGAPASTPTNFLGKKLKKQVTSAVELPWQESKANRFTVMAAENIDEXKRNTDXWKXLPTXXPRT

SEQ ID NO: 197470 - protein, 119 aa, Triticum aestivum
  unsure (1)..(119): unsure at all Xaa locations
  Clone ID: PAT_TA_91888.pep
NRKQTXGNKRVRFSFTMPPTFASQTMAVPPLSSLCRGTGHCYPXGRLLPQRLPYXPAPXTLXDELXSXGISSHQLGNHHTYWDXLTXQICTASNPPQPSFXXRQFGITXEXIPHWDNXX

SEQ ID NO: 197471 - protein, 139 aa, Triticum aestivum
  unsure (1)..(139): unsure at all Xaa locations
  Clone ID: PAT_TA_91889.pep
TITLEVESSDTIDNVKAKIQDKEGIPPDQQRLIFAGKQLEDGRTLADYNIQKESTLHXVLRLRGGAKKRKKKTYTKPKKQKHKHKKVNSAXXXYKSDDATGKVTXLRKGCPNADCGPGLPWQHFDXHYCGXAHYSTTRG

SEQ ID NO: 197472 - protein, 190 aa, Triticum aestivum
  unsure (1)..(190): unsure at all Xaa locations
  Clone ID: PAT_TA_91890.pep
KRSFKYAWVLDKLKAERERGITIDIALWKFETTKYYCTVIDAPGHRDFIKNMITGTSQADCAVLIIDSTTXGFEAGISXDXQTREHALLAFTLGXVXXMICCCNKMXATTPXXSKARSXEIXXESFLPEEGXSTRXVXFVPSLGLRCNMIXRPLDQGQPRLVYDPATAAPPLMVHVLTLRWPRSSLAPRS

SEQ ID NO: 197473 - protein, 124 aa, Triticum aestivum
  unsure (1)..(124): unsure at all Xaa locations
  Clone ID: PAT_TA_91891.pep
MAPTVMASSATSVAPFQGLKSTAGLPVSRRSNGASLGSVSNGGRIRCMQVWPIXEGIKNSETLSYLPPLNTEASSKQVRLPGFRSKVXPCLRXNKLXHLPLXQRISLGYXDGXYWACXXCLFPH

SEQ ID NO: 197474 - protein, 101 aa, Triticum aestivum
  unsure (1)..(101): unsure at all Xaa locations
  Clone ID: PAT_TA_91892.pep
RCELYPRSSEADEGASAPLVSTFQTSSYVVSKSLLRVWCCAGTNSHRLKSRCWHGRIRRTSITWDYINKPDWACSPGTGMHLCNPVTYFPSPHDXPSLXRT

SEQ ID NO: 197475 - protein, 98 aa, Triticum aestivum
  unsure (1)..(98): unsure at all Xaa locations
  Clone ID: PAT_TA_91893.pep
FTKWPEVEVVRKVTTQSAVKFFKGLVCHFGVPNRVITDNDTQFTSHTFMQYIQDLGIRVCFASRAXSRSNGQAERANAECCXGLRTKTLTGCTRAELD

SEQ ID NO: 197476 - protein, 58 aa, Triticum aestivum
  Clone ID: PAT_TA_91894.pep
CFTVTVQTMYQDVSRLRMAVVFGHRILIAFITKVLHFGRFIKEKDNLSVLYCSSCREY

SEQ ID NO: 197477 - protein, 68 aa, Triticum aestivum
  unsure (1)..(68): unsure at all Xaa locations
  Clone ID: PAT_TA_91895.pep
DRHEFARGHDXSGGPEEGDVRGRRQSGQGSAPEHEETRGRVRRSSSKTPGFLXEYXPWTVTPKPRSST

SEQ ID NO: 197478 - protein, 126 aa, Triticum aestivum
  unsure (1)..(126): unsure at all Xaa locations
  Clone ID: PAT_TA_91896.pep
VRMNDAPSSVPRXTVFRXRPEAGTRRXYRXXQEQPVFMTASSGPGPDDDDDXVNAAAAPSPAPVMRTVRSSASTSHGAGAESRARARGLQHGAQDKQEIHGRQRSGHSGARGLEEAVHRLRADLAS

SEQ ID NO: 197479 - protein, 79 aa, Triticum aestivum
  unsure (1)..(79): unsure at all Xaa locations
  Clone ID: PAT_TA_91897.pep
PPXGEKPLSETYGPPGLFLILFNFVIYFICLLFSDLLNPKIQKYLATIYSYLFYLAFDLSIYYNLFTSVCQFLAPLPER

SEQ ID NO: 197480 - protein, 134 aa, Triticum aestivum
  Clone ID: PAT_TA_91898.pep
MGGGGGARPFLAVVMAVAVLAAMVAPARGRFVVEKSSVRVLAPEHIRGQHEAAIGNFGVPDYGGTLTASCSTGQEGTDARVPAKSINPAPVSPVDAKCNSAKEPRGPRVYSDVTCTWNRGSQQANRRWNPSDLC

SEQ ID NO: 197481 - protein, 111 aa, Triticum aestivum
  unsure (1)..(111): unsure at all Xaa locations
  Clone ID: PAT_TA_91899.pep
MSCCGGNCGCGTACKCGNGCGGCNMYPEAEAAGATLLVSATATHKASSGGMEMAAENGGCGCTQCKCGTXSCGCSCCSCIIDHRSCMQACSIDHIDLLTYHVATDRRYLCT

SEQ ID NO: 197482 - protein, 79 aa, Triticum aestivum
  unsure (1)..(79): unsure at all Xaa locations
  Clone ID: PAT_TA_91900.pep
GLCPLITGFSSTRAWVTRPCRLHIPWEQANFKAIAGEGGXRYSLXLSXXIIFXFLLXXXLPAFPFLSSXXQFIIXSHSX

SEQ ID NO: 197483 - protein, 111 aa, Triticum aestivum
  Clone ID: PAT_TA_91901.pep
MLTRHCRAQLCCGAANKLLELLALDDDNRTGLKVIPINGCAGVGKTTAARGMYHRHGGKFQCRAFVIVSRNPDMRRFLTSMLSQVKAPLLIGFPDVPDLIDAIRKHLQGKR

SEQ ID NO: 197484 - protein, 94 aa, Triticum aestivum
  Clone ID: PAT_TA_91902.pep
ERAIAGGISCIRGICNTSLLQGLAFGVSWGGGTWPNRHPAHRRRGRKPWLTASVRSNLDCRHRARQGTTYEESQQESNAACVGARRRRRRRRRV

SEQ ID NO: 197485 - protein, 74 aa, Triticum aestivum
  Clone ID: PAT_TA_91903.pep
NASPGYYDGRYWTMWKLPMFGCTDATQVINEVEEVKKEYPDAYVRIIGFDNMRQVQCVSFIAFKPPGCEESGKA

SEQ ID NO: 197486 - protein, 126 aa, Triticum aestivum
  unsure (1)..(126): unsure at all Xaa locations
  Clone ID: PAT_TA_91904.pep
RMSAGXVXLCDEENSLQMCPMXVSLDSXILGSTVLALQCQGMVHFIRSPLCKGCGILXLLLEGRIIGAGRSPRQTQWATDSSFTFREAVRPSSSASISSSFRRCSSARSKKHRVTFWRFFMDQKEP

SEQ ID NO: 197487 - protein, 82 aa, Triticum aestivum
  unsure (1)..(82): unsure at all Xaa locations
  Clone ID: PAT_TA_91905.pep
AVTXALLRIAFANGPVGSVPFNPTTAYESPAHSFNRHAVRDQLSPPNCWELSTVSRSISLPTGGSFHLSLTVLLRYRSPRSI

SEQ ID NO: 197488 - protein, 126 aa, Triticum aestivum
  Clone ID: PAT_TA_91906.pep
FETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPTGCEESGKAKQLTQHGHI

SEQ ID NO: 197489 - protein, 73 aa, Triticum aestivum
  unsure (1)..(73): unsure at all Xaa locations
  Clone ID: PAT_TA_91907.pep
PGVXXXLXSXFARFPLLSSXWVQWAHPRGSFTSLCISWXHXPSLFPWMSPRPQDLQVAPIQMLLWCPSFSYPH

SEQ ID NO: 197490 - protein, 126 aa, Triticum aestivum
  unsure (1)..(126): unsure at all Xaa locations
  Clone ID: PAT_TA_91908.pep
RLGSGCWTALPSPMICLSWNCRGLGNPEAVRELRNVVKQEGPALLFVMETKIRADRVENLKFSLGFSGCFAVDSVGXSGGLGLFWSKDVSVELKNYSTGHIDCVVRRVDTPSDIWRFTGFYGAPRV

SEQ ID NO: 197491 - protein, 59 aa, Triticum aestivum
  unsure (1)..(59): unsure at all Xaa locations
  Clone ID: PAT_TA_91909.pep
LLIDLPIXNXYSRYXYRESXWVLTVXYIIVPILXELRDLXCQGHLRPXPRGEYTHPMLE

SEQ ID NO: 197492 - protein, 163 aa, Triticum aestivum
  unsure (1)..(163): unsure at all Xaa locations
  Clone ID: PAT_TA_91910.pep
GNXSXKVXQRXFHSPLXCDGTXRLXLLAGERXYRXGYGLLPLFPSAAPGXSMSXLPHPYPRRPRSTTPXSSTTTQPQRWRRSHGSRTLARGHQAGGGDHAAMDLWGEAMEGPPPTAPMVMERRRRLDQAPCSTDQERSIPAACSTSGHQLTAKGKGWCATKGK

SEQ ID NO: 197493 - protein, 104 aa, Triticum aestivum
  unsure (1)..(104): unsure at all Xaa locations
  Clone ID: PAT_TA_91911.pep
DGXNFHIGNFGXFKCSGLCSIKWFYTICXKXLLKXGKHCSXPWXSNIIGRHHRYVYFPIIPVARSHCSRRXNLSHPAHEAWFASIQVIPKIPSARSFLMRFTST

SEQ ID NO: 197494 - protein, 127 aa, Triticum aestivum
  unsure (1)..(127): unsure at all Xaa locations
  Clone ID: PAT_TA_91912.pep
XXNWPGXPAGXGTXLXSGGIQAFCASIHRESGTIVRLXRSRXRDRGEDWECXYREQQXGSCGRKXGXKCIKNLNTGRVPKTFQVXLRAVGVCSRRILGASSRSKSSICSXRGXSYIREYTARLFATL

SEQ ID NO: 197495 - protein, 128 aa, Triticum aestivum
  unsure (1)..(128): unsure at all Xaa locations
  Clone ID: PAT_TA_91913.pep
RHFFFIIIRKHDDVSPELQRKKNIGFPADWTLNRLNEAWXEWLTTPEGARXXVPXPPXLSIXFIXXKVKAXKQGNLARXLYSXNKARNTTXRKGLTXLNNLXLEDNXRWDXRGRSPNVRLYWRSSAAX

SEQ ID NO: 197496 - protein, 83 aa, Triticum aestivum
  Clone ID: PAT_TA_91914.pep
LCLCVSTLHNTNSHAHVSLYPPHRDTKNLIIAPVSTHITHARYLSLAHTFNKYFPVNNSLSIHQLSVVVRRTRDMKKNKSTCA

SEQ ID NO: 197497 - protein, 153 aa, Triticum aestivum
  unsure (1)..(153): unsure at all Xaa locations
  Clone ID: PAT_TA_91915.pep
HSTPPHPPPSPPTTRPSSAVAATRDPPFPDDHAGGAGGRATRGRGQRLVPQEPPPPEEXSNANAAPWSLFRRRCRHADAALFDTSASLRRSALVPPPHXAVRPLRRILNEIPPTRSAXWGHRSGTWTAMNTMRTSTCXMXQXSGAETHHXVCX

SEQ ID NO: 197498 - protein, 108 aa, Triticum aestivum
  Clone ID: PAT_TA_91916.pep
SPVQQQQHQQDRGSAPASRLRFCLDLFGRFSNIAGGRGGRGKPGSAQRRDCKGEDQITQDKADLAAENTQDGYRAGRVGGSGLPAHAGSECVTWLHEEKIPVAPSAGL

SEQ ID NO: 197499 - protein, 134 aa, Triticum aestivum
  unsure (1)..(134): unsure at all Xaa locations
  Clone ID: PAT_TA_91917.pep
QARFQSCPPPPRPRRRHRRGDLAVPQPYNGAVKHRRVKVXGTKPKSPRLLKAISLFSQXGTAVXAADLILIDAVRLAVSRSGRRRRXASSLSLSRFLTRHTIVSXARVYPERTXRXRSLSGGGHGRIRRGXGXX

SEQ ID NO: 197500 - protein, 100 aa, Triticum aestivum
  unsure (1)..(100): unsure at all Xaa locations
  Clone ID: PAT_TA_91918.pep
MGNSRKAGGPPRPSGVPQXLQKYPSIKDAQFPVSCLRCKRFLGLAGYLQEFISHYGMLSKPLSNLLKIGVPYHWTDTKQQAFVLLKXALVLAHVLALPDF

SEQ ID NO: 197501 - protein, 56 aa, Triticum aestivum
  Clone ID: PAT_TA_91919.pep
MGHSNVWNSHPKNYGPGSRVCRVCGNSHGLIRKYGLMCCRQCFRSNAKDIGLIKYR

SEQ ID NO: 197502 - protein, 60 aa, Triticum aestivum
  unsure (1)..(60): unsure at all Xaa locations
  Clone ID: PAT_TA_91920.pep
SSLNSEESEISAQILQDRTRNTEANNNPTGVSDSRLDSVPSPKGGARYPIRPIVXPYYAR

SEQ ID NO: 197503 - protein, 90 aa, Triticum aestivum
  unsure (1)..(90): unsure at all Xaa locations
  Clone ID: PAT_TA_91921.pep
LXLPXVLQXPRXADXELENRPLKQIEPFIEPINXPNCPGYAYRVGVWMSISLVSYRSWVPVIWKLLSLSAVGHHHSLDQSVLQQGNRTER

SEQ ID NO: 197504 - protein, 95 aa, Triticum aestivum
  unsure (1)..(95): unsure at all Xaa locations
  Clone ID: PAT_TA_91922.pep
PPLGYPTLTGIFGXVCITFGGGXLGHPLGKCTLVQQLIGVALEACVQARNEGRDLAREGNEIIRAACKWSPELAAACEVWKAIKFEFEPVDTIDK

SEQ ID NO: 197505 - protein, 142 aa, Triticum aestivum
  unsure (1)..(142): unsure at all Xaa locations
  Clone ID: PAT_TA_91923.pep
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKFGFLFPLXNXPPGYYDGXRYWDMLXLPXFRXTGPTQVLNXVEESKKXT

SEQ ID NO: 197506 - protein, 84 aa, Triticum aestivum
  unsure (1)..(84): unsure at all Xaa locations
  Clone ID: PAT_TA_91924.pep
ELPVEAVYLPYXXVXVFXPCVWLCVELFRIIXQSWXPNNLMLLVLXLIFGDDNDVFSSIGGQRHAXLGRXCRMVVVQEIMVGEI

SEQ ID NO: 197507 - protein, 116 aa, Triticum aestivum
  unsure (1)..(116): unsure at all Xaa locations
  Clone ID: PAT_TA_91925.pep
SNPVPHPISPGNLRSKRSQGFLVLLLKMQIFVKTLTGKTITLEVESSDTIDNVKAKIQXDKEGIPPDXQRLIFXAGKQSEDGRTWLDYNIQKXSHPLLSSPXWMQFFLKTLTGKPS

SEQ ID NO: 197508 - protein, 123 aa, Triticum aestivum
  unsure (1)..(123): unsure at all Xaa locations
  Clone ID: PAT_TA_91926.pep
PPRRPSPPDSSGSQPPVSPSSTLLCRQSLKHLLAMAAAAISGGHLASXTPTSTRRPQSLPLHPPQVRPIRRIPRLRXRAGRRPRSVQXCAAPPLGKRCKXFLSFFNINDFGQRYNHEILKPTI

SEQ ID NO: 197509 - protein, 80 aa, Triticum aestivum
  unsure (1)..(80): unsure at all Xaa locations
  Clone ID: PAT_TA_91927.pep
SSVVRVIGTXXFRGGXLNRLXGRXXFELFFPKTPFKRLRLLXIWLAGYXGDAFAFFSSWYLRCFSSPRLSLACSWIQQAV

SEQ ID NO: 197510 - protein, 72 aa, Triticum aestivum
  unsure (1)..(72): unsure at all Xaa locations
  Clone ID: PAT_TA_91928.pep
AXXILYQQRGDMXXSSXLVRXKDXXEXPLHPEFGGPQPXPTVEMGILPKIYXVGESPFGGKPKSRVDXVTKT

SEQ ID NO: 197511 - protein, 172 aa, Triticum aestivum
  unsure (1)..(172): unsure at all Xaa locations
  Clone ID: PAT_TA_91929.pep
TGLSQGVRLPGPTGRRASXFTVRASSAEAEAAGRRAVLGLMASGVVGSAFAQVVHAGTXRXIKVXPTPPXXRXXPGKDNXEEXKEFTXPLKXXXXLQPXATAEGRXRPXXSXKXYSNXXPXITKKMXFYLLNXAXRXPYIYXTLNXXSXKXGGGXKXLRLTGXSXTSGQSTN

SEQ ID NO: 197512 - protein, 86 aa, Triticum aestivum
  unsure (1)..(86): unsure at all Xaa locations
  Clone ID: PAT_TA_91930.pep
SXPGXTXGXPXGXFLXCNLRQRXPLYXXWKGFSGLLVPRFXVXSLNDAXGAVYAHIGDWYRPPXGSNVEQFLMWMFLSCHIIIFSL

SEQ ID NO: 197513 - protein, 159 aa, Triticum aestivum
  unsure (1)..(159): unsure at all Xaa locations
  Clone ID: PAT_TA_91931.pep
MGKEKTHINIVVIGHVDSGKSTTTGHLIYKLGGIDKRVIERFEKEAAEMNKRSFKYAWVLDKLKAERERGITIDIALWEFETTXYYCTVIDAPGXHRDFIKEHDHRYSKLTCCLIIDQHGGFXAGSQRMANTXQPPCFILGEQISRCNKWSTXQXSKXV

SEQ ID NO: 197514 - protein, 139 aa, Triticum aestivum
  unsure (1)..(139): unsure at all Xaa locations
  Clone ID: PAT_TA_91932.pep
MAPTVMASSATSVAPFQGLKSTAGLPVSRRSNGASLGSVSNGGRIRCMQVWPIEGIKXFETLSYLPPLSTEXLLKQVDYXXRSKWVPCLXFNKVGSSSXNTCSPGYYXGRYWDNVELPKFRVQRXXQVFNXVXXVXKDT

SEQ ID NO: 197515 - protein, 164 aa, Triticum aestivum
  unsure (1)..(164): unsure at all Xaa locations
  Clone ID: PAT_TA_91933.pep
MAPTVMASSATSVAPFQGLKSTAGLPVSRRSNGASLGSVSNGGRIRCMQVWPIEGIKXFETLSYLPPLSTEASLXVDYLIRSKWVPCLXFXKVGFIFREHNXSPGYYXGRYGHVELPXFXCTDPPGNKWRQEGYLTLRITVKSQCMLTIPQRVKIGRLKYHTGI

SEQ ID NO: 197516 - protein, 103 aa, Triticum aestivum
  unsure (1)..(103): unsure at all Xaa locations
  Clone ID: PAT_TA_91934.pep
NXPFPXXGPRGKWVGVPLXIGXPXQKGELXSPGKXXCWVQXXKFLSLXIXRXRXPGXLFWSLLFWGTRNXSAGXFYXNFRDAAPADGEPRKQAESSAVNGSSE

SEQ ID NO: 197517 - protein, 134 aa, Triticum aestivum
  unsure (1)..(134): unsure at all Xaa locations
  Clone ID: PAT_TA_91935.pep
DVVDYHALNEXVKNKXPLPNDQCLFDQLQGAKFSPKIDIRSGYHQLKIREXDIPKTTFTTRYGLYEYTVMSFGLTNAPAYFMSMMNKVFMEFLDKFVVVFIDDILIYLKNEEEHKEHLHLVLEKLREHQLYAKF

SEQ ID NO: 197518 - protein, 145 aa, Triticum aestivum
  unsure (1)..(145): unsure at all Xaa locations
  Clone ID: PAT_TA_91936.pep
CXXXXIHLCLXTGXXCLSIQKKXPRPSRGAQPDRXRPRDSXMSCERHVCMXASXELPVSGATELQSSPGGIRCWQEREEATATAGPGDGRRRPGARTATEETRGEVLRRFVHGGASETFSKRRRCSREEERNHTVPDLFDRTVLV

SEQ ID NO: 197519 - protein, 177 aa, Triticum aestivum
  unsure (1)..(177): unsure at all Xaa locations
  Clone ID: PAT_TA_91937.pep
VXDXCVVAWXWRSLLLDDTVFSKLREVRXYXWCITLSXXRXTNASSRRSKKDFWRXLHGRXFGXXKTAQVPITXSSPXAFTXFAICXXFXTPPLHPCXFIRPLFPNXLXLWLALXFACVLDYLSQWRKIIPNCVISPIPIIMISLVXRLLLVNDVVSCESNAAXLNLVXKDQFSGLP

SEQ ID NO: 197520 - protein, 143 aa, Triticum aestivum
  unsure (1)..(143): unsure at all Xaa locations
  Clone ID: PAT_TA_91938.pep
VLSAPRPLPGAITRLAFVPEQGVGQLSTSRGRPHVPKVNGAENGARPRQPSHGRVXLDXDSRSQLQESEEDTGSLXGGDAVVVGRVASRHDPDCSRTSRRRTQAPTTTTTTTMSMTGRSIASVDSHGLTPSAVFSQIMHPDGR

SEQ ID NO: 197521 - protein, 113 aa, Triticum aestivum
  unsure (1)..(113): unsure at all Xaa locations
  Clone ID: PAT_TA_91939.pep
PXVSGTTIHTRTXDARXTPGHAXKXPXKSPNLPPPFDPLAHIKHPLVRQKAMVHRKITYYKMLTPERRAEIAAAVGATDLHSQARFAAGQSPSSLGPSYKEEEANPMFMAEVA

SEQ ID NO: 197522 - protein, 74 aa, Triticum aestivum
  unsure (1)..(74): unsure at all Xaa locations
  Clone ID: PAT_TA_91940.pep
RVWXRTDRSFSSRFCXHARXLXESSVXQRVFYITXPGXPSGCASAFAWPPTXLASWSTRLDWGYPXECLVAGRI

SEQ ID NO: 197523 - protein, 184 aa, Triticum aestivum
  unsure (1)..(184): unsure at all Xaa locations
  Clone ID: PAT_TA_91941.pep
MGKEKTHINIVVIGHVDSGKSTTTGHLIYKLGGIDKXRVIERFEKEAAEMNKRSFKYAWVLDKLKAERERGITIDIALWXKFETTKYYCTVIDAPGXHRDXIKNMITGYSQADCAVLINDSTRVGFXAGISKDGQTXNTPPCFNPGSXANVCCCNKMDATTPXTXGRYEEMQGIPPPEKVNLGS

SEQ ID NO: 197524 - protein, 82 aa, Triticum aestivum
  unsure (1)..(82): unsure at all Xaa locations
  Clone ID: PAT_TA_91942.pep
MDPILLSLTHSDHFSLAKNDLGYQRIEQPGSIYLXYLVGIDNKDLMNYEFNRSSLAERRIFLAHYQTITYSQTSCGTNRFHL

SEQ ID NO: 197525 - protein, 105 aa, Triticum aestivum
  unsure (1)..(105): unsure at all Xaa locations
  Clone ID: PAT_TA_91943.pep
XXPXVSFSXTIRKXANSPXXDXXLEXEGRSGPETRTGGNLXXGXCPRXXXALPXGNLFXXXEXXERERXGGXXPLSPGXEANRXHIGKAFTXILLVVRFNIRRCC

SEQ ID NO: 197526 - protein, 60 aa, Triticum aestivum
  Clone ID: PAT_TA_91944.pep
YIIFFHTGYLFYQLDLVSLYVQILAPSLFFHGTKSMEVFGSQSVKRYHTRSSLMMDQQPK

SEQ ID NO: 197527 - protein, 124 aa, Triticum aestivum
  Clone ID: PAT_TA_91945.pep
LWQEITLEMLSLNLKWCNIFFEAKKRKKNVIGRAQNKAYNQRQIRFDMIDTTIRCIHTKMAMIYKRSILHFVRLVVGFNRMKCPLSKNNYYIISDLYLIIKGLLLLVVRHRFAPKVAKYYHQYH

SEQ ID NO: 197528 - protein, 53 aa, Triticum aestivum
  unsure (1)..(53): unsure at all Xaa locations
  Clone ID: PAT_TA_91946.pep
TSTSSTAAAXTRXRLGSIDHDHDRSARLGAGAGARXSSYSVRGCLTGSIXGEL

SEQ ID NO: 197529 - protein, 68 aa, Triticum aestivum
  Clone ID: PAT_TA_91947.pep
HNKTKVLVVHLLEHLVASSLLFEKSTRTLYCAILLLNLLSIVFLQPLTHIPCISFHSLGFCNLVKKKK

SEQ ID NO: 197530 - protein, 106 aa, Triticum aestivum
  unsure (1)..(106): unsure at all Xaa locations
  Clone ID: PAT_TA_91948.pep
DAAKMAGFALATSALLVSGASAEGAPKRLTFDEIQSKTYMEVKGTGTANQCPTIDGGVDSFPFKAGKYEMKNSAWEPLLHRQAEGIQKNEPPXFQEDQLMTRLTNP

SEQ ID NO: 197531 - protein, 225 aa, Triticum aestivum
  unsure (1)..(225): unsure at all Xaa locations
  Clone ID: PAT_TA_91949.pep
CISGDHRHSTDEVSFPRGDDDDSAPMGSLRRRMGSASTATRERRWRGHVASGGWAKRTGWHDHVTTWRCQPRAATAWRCRSRREPGHPEVGGXXGRRPRGAEQARLRHHALQERXGPGNNQGSNPPAYGNXHKDTXVNHPAAPAALKACDSXRPSXAXWXXQXIRPNGXXLRKXNPGQPSMGEXVAYLTPTVXKKGTGGXPGEXLSQFRFFPTENXKIIXPKXKF

SEQ ID NO: 197532 - protein, 112 aa, Triticum aestivum
  unsure (1)..(112): unsure at all Xaa locations
  Clone ID: PAT_TA_91950.pep
TXGLYXXRGVRVTQVXYKXXLHXRNVKLPSNAQGESLPDTGRSLQSCIFIVPTVQPKGYSPAVRGSPNQGLPLTIIVHGSRKIALECEEGNASYAESVCATEELKFYKDNVD

SEQ ID NO: 197533 - protein, 122 aa, Triticum aestivum
  unsure (1)..(122): unsure at all Xaa locations
  Clone ID: PAT_TA_91951.pep
RTHLLGTLLIGAMPKPLGGYMIVFRTXFQPLLGTFTDRIPINYLANIXPFFGLIPFWGTPQFXXNFFPXGXNYNMIFVPGXIXIXXPPAXTXLISRVPNMVXXPYGRLYNRXAIVKFTXWVL

SEQ ID NO: 197534 - protein, 123 aa, Triticum aestivum
  unsure (1)..(123): unsure at all Xaa locations
  Clone ID: PAT_TA_91952.pep
MLVYQDKLSGDELLSDSFPYRELENGVLWEVDGHWVXVQGAVDVDIGSQPSAEGGGDDSXFXDQAVKWFDIVEXRLQGQLLFDKXHLLSXMKRYIKNSXQLXRDDLDXFXXKVESAXNTSLTQ

SEQ ID NO: 197535 - protein, 158 aa, Triticum aestivum
  unsure (1)..(158): unsure at all Xaa locations
  Clone ID: PAT_TA_91953.pep
TVTLEVESSDTIDNVKAKIQDKEGIPPDQQRLIFAGKQLEDGRTLADYNIQXKESTLHLVLRLRGGMQFSVKTLTGKTITLSGSSDTIRQRQGKIQDKEGFPPDQQRLTSARQXLGGWPHLADYNIQEGXTXQLFLPRXCGIIFXKTSTXKTSHRWIL

SEQ ID NO: 197536 - protein, 183 aa, Triticum aestivum
  unsure (1)..(183): unsure at all Xaa locations
  Clone ID: PAT_TA_91954.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXTMWKLPMFGCTDATQVINEVEEVKKEYLTRIPHIGFDNMXQVXCVSLTPNGLQDRAKQSHRHIKCNF

SEQ ID NO: 197537 - protein, 49 aa, Triticum aestivum
  Clone ID: PAT_TA_91955.pep
TQVINEVEEVKKEYPDAYVRIIGFDNMRQVQCVSFIAFKPPGCEESGKA

SEQ ID NO: 197538 - protein, 130 aa, Triticum aestivum
  Clone ID: PAT_TA_91956.pep
NTPNTTVPSDQKWTKVTNKKTRLPLTKPAQQPPPSSTAATTPKTVNNAPDADTLLVLVLTKGASIPAYNAISVRDNINRLLGKKAVARVHTSPRNNLVLTCFDSTPDELLSSQDKWIMLFGKWLLTPFKK

SEQ ID NO: 197539 - protein, 149 aa, Triticum aestivum
  unsure (1)..(149): unsure at all Xaa locations
  Clone ID: PAT_TA_91957.pep
MAAAFSSTVGAPASTPTNFLGKKLKKQVTSAVNYHGKSSKANRFTVMAAENIDEKRNTDKWXXLAYDISDDQAGIPRXKGIRGSSSKAPTGDGPTRPPQLLYSADQRQFHNTWRFMSFGNLLSKYLPNQVSLGTGEVRKPHGTVSDNNI

SEQ ID NO: 197540 - protein, 175 aa, Triticum aestivum
  unsure (1)..(175): unsure at all Xaa locations
  Clone ID: PAT_TA_91958.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATXVINEVEXVKKEYXDAYXRIIGFDNMRQVQCVSSMPATGCKIKAKQY

SEQ ID NO: 197541 - protein, 132 aa, Triticum aestivum
  unsure (1)..(132): unsure at all Xaa locations
  Clone ID: PAT_TA_91959.pep
ESLFVAVDKFTKWVEAXPVSKCDAATAVQFMKRVIFRFGXPHSIITDNGTQXSKGAMEEFCQREHIXLDVSSVAHPQFNGQAERANQEILKGIKPRLLVPLQRTPGCWVEELPSVLWSINTTPNRSTGYTPF

SEQ ID NO: 197542 - protein, 67 aa, Triticum aestivum
  unsure (1)..(67): unsure at all Xaa locations
  Clone ID: PAT_TA_91960.pep
CSSSLIYSMLWTVXVSDLPTPNLPPKCGSPGRLYLHGYLMCGWAARTVSNTYYTRGIRRFNRVILAA

SEQ ID NO: 197543 - protein, 152 aa, Triticum aestivum
  unsure (1)..(152): unsure at all Xaa locations
  Clone ID: PAT_TA_91961.pep
MSEAEAEAASTRRRTLVLVNLTSMLEKADEVLLPAVYRSXGAALAVSPTALGXLTLCRASVQGLSFPLAAYASARHDRAXIXRSGFLWAAALLVAFPHYSHSPGLNDRSPGIHNPADKHNGPVGWILNSCGGGCLRLKFSVPVGQEPSCQPI

SEQ ID NO: 197544 - protein, 179 aa, Triticum aestivum
  unsure (1)..(179): unsure at all Xaa locations
  Clone ID: PAT_TA_91962.pep
MPVXIXVTFXLTFPDVGTXGYXCSFVKXRGAXFPXRKPLAXRYNXIXILTPPXFXXSVFVLTFCTVTFTWPINPXNYLTGTLNSLTVLATQIIWKXXSTVNVFEEPEFTGKYNLGSELVLGDLRFSSSCRCGAHYGGLSSISFTVFLWSSSLHMEFSMIWMRELHCGLGRGIQSHGLGC

SEQ ID NO: 197545 - protein, 112 aa, Triticum aestivum
  unsure (1)..(112): unsure at all Xaa locations
  Clone ID: PAT_TA_91963.pep
FTCXPIXPLLXVKXSIXTSHCXLLSFFERNFCXWLGTKFQIRLHGRXLGSTLSGLXKGKNPSALXKGKXPSVTSGRAPYYRPLSKGKDPSVTTWSVSQGPCSFHGNEPICDK

SEQ ID NO: 197546 - protein, 65 aa, Triticum aestivum
  unsure (1)..(65): unsure at all Xaa locations
  Clone ID: PAT_TA_91964.pep
HARDNGNDSQALRNAEIDEGRNREKHQVLMVDKTTSFKKRAXRKKGNSKKNSKQXLLKVEEANLS

SEQ ID NO: 197547 - protein, 119 aa, Triticum aestivum
  unsure (1)..(119): unsure at all Xaa locations
  Clone ID: PAT_TA_91965.pep
YPEHVNCQISRYRXPASSWXQESNXGLARVAATTPRPRASARAIASIRRIPAAAVAQGGCGXRPKVVMTNARHRDPLNRFLXRDPPWSNXRIPGVWAFLTTSXVIXPXVPXQKLNPGPX

SEQ ID NO: 197548 - protein, 98 aa, Triticum aestivum
  unsure (1)..(98): unsure at all Xaa locations
  Clone ID: PAT_TA_91966.pep
AVRKAGTFQLCFHPSTPFLPACFLPWKTNGGTTSXNTTEGMXXRSGGPLLAPSICNGRRSNCQWRRCRAYNXDEXPNGPVRMPSRLXWGXXALRVTLR

SEQ ID NO: 197549 - protein, 107 aa, Triticum aestivum
  unsure (1)..(107): unsure at all Xaa locations
  Clone ID: PAT_TA_91967.pep
PLSVITNPHHFSIYPLITLIIPNHLTSRTVTILPLPQPGARLTRSPTPRWTFLAGETPRHXRNRRSAPEEEVXTRKERHAGXHEXSXDSNLRRXTRLIRDXXTGXKV

SEQ ID NO: 197550 - protein, 175 aa, Triticum aestivum
  unsure (1)..(175): unsure at all Xaa locations
  Clone ID: PAT_TA_91968.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPKFGXCTDATQVINEVEXVKEGVPDAYSAYRNIASARKNALKQRAARSRLNSHTGI

SEQ ID NO: 197551 - protein, 177 aa, Triticum aestivum
  unsure (1)..(177): unsure at all Xaa locations
  Clone ID: PAT_TA_91969.pep
ALKSAIAQYGTSFTKLVAGISVGSEDLYRISPQGVESKSNVGAEPSAIANYMSQVRSALAGTALSGTTIRDNVDTWTAWVNGSNQEVVDASDWIGVDAYPYFESTQANGVENGATLFNKSXWDATRNAAKGKHFGLLETSXPLXSEIGRCRNGITNAKSYWDXIGCQNLXRNTWXYT

SEQ ID NO: 197552 - protein, 52 aa, Triticum aestivum
  Clone ID: PAT_TA_91970.pep
LHRHGSTDITYKMLSHSKNEEGSGFVGLIKLGEEAGVWFEAPQLHYFLLLRL

SEQ ID NO: 197553 - protein, 81 aa, Triticum aestivum
  unsure (1)..(81): unsure at all Xaa locations
  Clone ID: PAT_TA_91971.pep
LSPGYLIAINDXKHPKPVILLAWTIKIIDTLETYQAPPPTKDGCTIAPLNRYVSGGICSKSVWESSHRRDKTGSRTEQWPD

SEQ ID NO: 197554 - protein, 52 aa, Triticum aestivum
  unsure (1)..(52): unsure at all Xaa locations
  Clone ID: PAT_TA_91972.pep
CVNMRXSFXNXLSTXIAXXLXFSQDFGCXSXLLYYSXANEKCIKPTKMGXSN

SEQ ID NO: 197555 - protein, 89 aa, Triticum aestivum
  Clone ID: PAT_TA_91973.pep
FIFREHNASPGYYDGRYWTMWKLPMFGCTDATQVINEVEEVKKEYPDAYVRIIGFDNMRQVQCVSFIAFKPPGCEDPARPKQSLTTGHI

SEQ ID NO: 197556 - protein, 62 aa, Triticum aestivum
  unsure (1)..(62): unsure at all Xaa locations
  Clone ID: PAT_TA_91974.pep
IIGCHMQYXGFRKGSNAEELVGPKHNCVSIYICVQFLIVPFLVHFLLAIILRFTGHGLQETE

SEQ ID NO: 197557 - protein, 138 aa, Triticum aestivum
  unsure (1)..(138): unsure at all Xaa locations
  Clone ID: PAT_TA_91975.pep
YLLSTMPGPHPRRRLVRDDVLLQRTHVRDWAPPGWHWEVLPSGARRLVRNPAPGPVVDPHLLSVAFAWALSVRREPARRSGTRXXREEDXTPSLHGCYGRSSPILASSWEITDYINDGPSLGCQPPKYXQYQLYNYYY

SEQ ID NO: 197558 - protein, 78 aa, Triticum aestivum
  Clone ID: PAT_TA_91976.pep
LVAFESVHTMRRKKKGKNYTCAVKLDMMKAYDRVEWHYLEAVMQRLGFSHNFIELIMTCVTSVRFTVKVNGELLPVFH

SEQ ID NO: 197559 - protein, 114 aa, Triticum aestivum
  unsure (1)..(114): unsure at all Xaa locations
  Clone ID: PAT_TA_91977.pep
LSEELSSAQQSDDMSSAGRQPWSNIAELVSHLHDDEDDLRGHLKIYGHVFKNNAQYSRRESSKKVVITFIKRHESGRSVFAHKTVPKMGHHRKVLGVEPRFXSNLEVVRYGNPQ

SEQ ID NO: 197560 - protein, 113 aa, Triticum aestivum
  unsure (1)..(113): unsure at all Xaa locations
  Clone ID: PAT_TA_91978.pep
MAPTVMXSSXTSVAPFQGLXXTAGLPVXRRSNGASLXSVSNGGRIRCMXVWPXEGITXFXTLSXLPXLXTXALLKXVDXXSAPRWXXCLEFSXVGFIFRXHXASPXYXXGRYW

SEQ ID NO: 197561 - protein, 117 aa, Triticum aestivum
  unsure (1)..(117): unsure at all Xaa locations
  Clone ID: PAT_TA_91979.pep
MAPTVMASSATSVAPFQGLKSTAGLPVSRRSNGASLGSVSNGGRIRCMQVWPIEGIKXFETLSYLPPLNTEASSSSRLLXVQWVPCLXFNKVGFIFRXEHNASPGXYNGXXWXXWXC

SEQ ID NO: 197562 - protein, 113 aa, Triticum aestivum
  unsure (1)..(113): unsure at all Xaa locations
  Clone ID: PAT_TA_91980.pep
CPFQSLYGRXCRTPLLWDEXGDRQLFRPDLIKESKEKVKLIRERLKVAQSRQKSYADSKRKETVYEVGDRVYLRVSPLRGVKRFGVKGKLAPHFMGPYKVLEHMGEVAYKLEL

SEQ ID NO: 197563 - protein, 101 aa, Triticum aestivum
  unsure (1)..(101): unsure at all Xaa locations
  Clone ID: PAT_TA_91981.pep
CMRCPCLHRVLVVACTFLLVCHAVEPWEPGCRDHPTIFYTFHKSTLLHRYLNELSDHQNVAVAHFRCRCRGTLLFRHADKAHNSSSFQKMHKWXXSASDTQ

SEQ ID NO: 197564 - protein, 134 aa, Triticum aestivum
  unsure (1)..(134): unsure at all Xaa locations
  Clone ID: PAT_TA_91982.pep
CSLKVLQTLRSVRASDVFIAKLSNLCQLRLLSINGVRSIHCAQLCDSLSKMHQLSTLEIVASNEDEVLQLETLTLPNLFESHFAGRFPEXTXKLHFLQTKGDXFTRYTYXGPTWVTPRFLSLDPNMLTRAYTQD

SEQ ID NO: 197565 - protein, 74 aa, Triticum aestivum
  Clone ID: PAT_TA_91983.pep
QPPPYYYPPPPPHGGHHHHGHHHHDHHAEDHHHHHGHHHHHHHNDDDCCLGLPQRMVPLYAAAAVWEECCCCFW

SEQ ID NO: 197566 - protein, 157 aa, Triticum aestivum
  unsure (1)..(157): unsure at all Xaa locations
  Clone ID: PAT_TA_91984.pep
LLXXGXVXXPGXXXIXGSMXVNXIXFXGETVEIXXXSGSXWXVGSFALGRXMGRERRPVXRXPQVAQRLRPGXGEVPATEVXVGTKRLQSTPSRPGCRCTWSNGAARPTWTPPAARRPIPGSPSPRPPASRAPPTRSRRAKPSLPKNQSKNLPETAK

SEQ ID NO: 197567 - protein, 120 aa, Triticum aestivum
  unsure (1)..(120): unsure at all Xaa locations
  Clone ID: PAT_TA_91985.pep
CSHPLLPPXTMHAXGLSNGRPITPWRXRHIRNAAEVGQHQPXQXSNXFRXKXKSNSASAXGALSAVNFRQFFLKSLSXIXKDLMVRXIYPPTKPYISXXKPIGWNGSTYPQRRITXXNLG

SEQ ID NO: 197568 - protein, 102 aa, Triticum aestivum
  unsure (1)..(102): unsure at all Xaa locations
  Clone ID: PAT_TA_91986.pep
MEGKEEDVRLGANRYSEHQPIGTAAQGGGADEKDYKEPPPAPFFEAGELTSWXSFYRAGIAXFLAXFLFLYISVLTXMALWGNPSGSKXPXVGSKDLDFGYF

SEQ ID NO: 197569 - protein, 134 aa, Triticum aestivum
  unsure (1)..(134): unsure at all Xaa locations
  Clone ID: PAT_TA_91987.pep
QSSRYIKIVQYQEHRERERERERDQTHSYWYIXSAPRVNYSLLIMESTGMTKMATCDGYPLRQGAGTGSRLVFGWLQRLAAVELPIYGAPGCFRGIWVYIXGRSXXVELQXAXXVXGXPGGXAPSCLVAPLFLL

SEQ ID NO: 197570 - protein, 114 aa, Triticum aestivum
  unsure (1)..(114): unsure at all Xaa locations
  Clone ID: PAT_TA_91988.pep
DRVRENRRHRLRSSRASNRVEPPDRLAIELIFTTYFTGRHRRLPRLQPVPDHLDLTFGIATLRLMSLLPSTTTVLTIPLSFQEQSDVGSKEQTHRRRRSYYLEVPATTVXADDT

SEQ ID NO: 197571 - protein, 54 aa, Triticum aestivum
  Clone ID: PAT_TA_91989.pep
LGPRSGAGVVNALLIRVCNGACDRLARQLAMFFLGRYQEKKQLAAVHNTCFASR

SEQ ID NO: 197572 - protein, 102 aa, Triticum aestivum
  Clone ID: PAT_TA_91990.pep
NTGSKLPKFSQSQSKQLINSMDFLGINYYTFLYVKDDPHHAPSNKRNFRADMAAKSIFSSNSTSGFYVPGYGIQQVLEHLKQFYGNPPIYIHENGISNASRC

SEQ ID NO: 197573 - protein, 50 aa, Triticum aestivum
  unsure (1)..(50): unsure at all Xaa locations
  Clone ID: PAT_TA_91991.pep
HLIRYACECLKSSIIVRIIPLGSDVTPDMSRCSANQTLIDCQSSQSTYLX

SEQ ID NO: 197574 - protein, 94 aa, Triticum aestivum
  unsure (1)..(94): unsure at all Xaa locations
  Clone ID: PAT_TA_91992.pep
CGYPQXSLLVGTIINLPESQVXSMLASFLQGIMDRRSESPXXSFRQQDMDTYQRDSLTCLAMPKNILLLTHIDMKSSVKDIKLYQAHAPCSSLC

SEQ ID NO: 197575 - protein, 88 aa, Triticum aestivum
  unsure (1)..(88): unsure at all Xaa locations
  Clone ID: PAT_TA_91993.pep
MSSSEVACTLAALILHDDGIPITSEKIATVVKAAGIKVEAYWPALFAKLLXEKKSVXDXILSXDXGGRGCSXLLAAAAPGCRWCCCKK

SEQ ID NO: 197576 - protein, 60 aa, Triticum aestivum
  unsure (1)..(60): unsure at all Xaa locations
  Clone ID: PAT_TA_91994.pep
QXEXPMFXCXTPHSYQRVGGVKEGYXEAYVXIXGFGQLRQVQCVSFIXFXATGCEESGKA

SEQ ID NO: 197577 - protein, 84 aa, Triticum aestivum
  unsure (1)..(84): unsure at all Xaa locations
  Clone ID: PAT_TA_91995.pep
PTRPLPSPSSLPFPLXPTXSHSHSSSSLTLLPHYSSSSTYLSLSALLXPNYTISINASXFSFSFRLHYVEXVSSXXXYXGXCXX

SEQ ID NO: 197578 - protein, 139 aa, Triticum aestivum
  unsure (1)..(139): unsure at all Xaa locations
  Clone ID: PAT_TA_91996.pep
MXSTFXGXXTAPFFXFLXAAXALVFSCMGAAYGTAKSGVGVASMGVMRXELVMKSIXPVVMAEVLGIYGXIIAVIISIGINPKAKPYFLFDGYAHLSSGLXCXSGARRRMASDXRRPGVRAXAQQPSVLGGLILLCLYG

SEQ ID NO: 197579 - protein, 71 aa, Triticum aestivum
  unsure (1)..(71): unsure at all Xaa locations
  Clone ID: PAT_TA_91997.pep
PQXXQAXLDQXXSSEAGKRXARRXIAXXSIKVDXHXMLWMXQIXYLNXRSSHIYVRQXYLPIXGSCTXHNL

SEQ ID NO: 197580 - protein, 177 aa, Triticum aestivum
  unsure (1)..(177): unsure at all Xaa locations
  Clone ID: PAT_TA_91998.pep
MQIFVKTLTGKTITLEVESSDTIDNVKAKIQDKEGIPPDQQRLIFAGKQLEDGRTLADYNIQKESTLHLVLXRLRGGMQIFVKTLTGKTITLEVESSDTSTTSRQDQDKEGIPGQQRLNFAGKQXXDGRTLADYNIKKGSNSTGVRSVDESQDLTRHHLESLHQASQAGSRQKLCGT

SEQ ID NO: 197581 - protein, 126 aa, Triticum aestivum
  unsure (1)..(126): unsure at all Xaa locations
  Clone ID: PAT_TA_91999.pep
LTSXSLIRNDGAENNIVENLRFEVFLPNEQVXTGTLKHYSLHYNVALLGVEXXRVVRPPKIQLXCXKSRVXXIGRCFXSGTLMAAXGQLVSWSGTLDCXFVVRSSCKIAKAGIXXPLVXMDGXLLX

SEQ ID NO: 197582 - protein, 89 aa, Triticum aestivum
  Clone ID: PAT_TA_92000.pep
SDVLLRGGRQLSPRPRSSSSMLGFPKTCENTYYHNQVLCHFRLKKYINSKISLINTSSPHYICHFFTELHGHPHPHHHPLMADVCVYFT

SEQ ID NO: 197583 - protein, 99 aa, Triticum aestivum
  unsure (1)..(99): unsure at all Xaa locations
  Clone ID: PAT_TA_92001.pep
VIRRGGYLVTSHQPSAFLGQSHLWSCPYNPXYLTSXVXLTESRTWATLQFXRMLNNXYXNXDAXKRRQYHGGXRDGXEVVLXXKCCEXDNQXWKLQPYY

SEQ ID NO: 197584 - protein, 84 aa, Triticum aestivum
  unsure (1)..(84): unsure at all Xaa locations
  Clone ID: PAT_TA_92002.pep
HRGFDISAGPGASPSLHQPTPDTSASLXDQLRHVSWAEGFASASQLYQHCHAVVLSPIXQWVCGAGPILGITFXGLLXQINRCY

SEQ ID NO: 197585 - protein, 88 aa, Triticum aestivum
  Clone ID: PAT_TA_92003.pep
LDEYGDVVRELLEDGELVAGGKDHLVQLRVVVGIDGGHPPAGLQHRLETILGAMPQAGIMDHLAQPLAARVHHRHWSGVSSFALSVGA

SEQ ID NO: 197586 - protein, 178 aa, Triticum aestivum
  unsure (1)..(178): unsure at all Xaa locations
  Clone ID: PAT_TA_92004.pep
EQLRLSKGYPSQSRGICIFLAKRCSLRMCIDYRRLIEVTIKIXYPLPRIDDLFDQLSGXKVFSKIYLRTGYHQLKIKKEDIPNTAFTTRYGLYEYTMMSFGLTNXPAFFMHMMNKVFMDFLDKFVVVFIDDILIYSKGEXEHKDHLRAALQRLRDHQLYAKFSKCEFWLKKVGFLGHV

SEQ ID NO: 197587 - protein, 127 aa, Triticum aestivum
  unsure (1)..(127): unsure at all Xaa locations
  Clone ID: PAT_TA_92005.pep
XHXLNXXFXXCEFWLPXVTXXGHVXSKDXIAVTXXTXFXLVXSWNPXXNVKQVXSFLGLXXYCRRXFXENFSXIDRPXTNXLHKGVKFQXXXTHXRXISKAXIDKLTSAXVLXPXDTKKXFVIYCDX

SEQ ID NO: 197588 - protein, 53 aa, Triticum aestivum
  Clone ID: PAT_TA_92006.pep
KLRTKSLSYVCSGLFCKPILCFVLSCGIRVASKSNVDSIPFPKRCSHVNTNPS

SEQ ID NO: 197589 - protein, 77 aa, Triticum aestivum
  unsure (1)..(77): unsure at all Xaa locations
  Clone ID: PAT_TA_92007.pep
QHCTVPATPTSRAEPSATTDKRVXWAKFSAXQQQSTTCSIPESSXXFNSILEXTVIHVRHXMXSXNXGYXXDTFXVX

SEQ ID NO: 197590 - protein, 139 aa, Triticum aestivum
  unsure (1)..(139): unsure at all Xaa locations
  Clone ID: PAT_TA_92008.pep
MAAAFSSTVGAPASTPTNFLGKKLKKQVTSAVNYHGKSSKANRFTVMAAENIDEKRNTDKWKGLAYDISDDQQDITXRGKGIVDSLFQAPTGDGTTXPSSSSYEVRQQGLKKYDFDNTMGSFYIAPXFMDKLFHLSKNS

SEQ ID NO: 197591 - protein, 196 aa, Triticum aestivum
  unsure (1)..(196): unsure at all Xaa locations
  Clone ID: PAT_TA_92009.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCXDATQVXNKWRSQEGXPDAYVRIIGKHRKCMRNFPTTGCKIRKAKHHGILMHFNAWFLQYSVQKFNSNGKTA

SEQ ID NO: 197592 - protein, 93 aa, Triticum aestivum
  unsure (1)..(93): unsure at all Xaa locations
  Clone ID: PAT_TA_92010.pep
FFFFFFFFFFFLGGKFAVLFPXINGSXXYXRILHXRFNKXVATTCTAMXMVXQSLXCTXEGLXXRAADGXGTAXDXRXXVXQGCPHGLPLNKG

SEQ ID NO: 197593 - protein, 80 aa, Triticum aestivum
  Clone ID: PAT_TA_92011.pep
RSLNGALTHARRPSRSIRRSPSPPQQSGRQAVARPISHPASGTDRKSRSQEVKKYGKKYRDISLPYYQRRSKSRVLKKKK

SEQ ID NO: 197594 - protein, 139 aa, Triticum aestivum
  Clone ID: PAT_TA_92012.pep
KGNNSNFKLTKICSTTDGLMSWQPKNTASSSQPRSYLKRKLLPQFDEEALELIPHSRNTADRSQRGRDNAAGRPQLGRDKAIIQAEQQPAPPPRKNRNNTAWGDKYNLWQTLDSRAGYTRSIYRSRGRSSTRDDGYLFG

SEQ ID NO: 197595 - protein, 111 aa, Triticum aestivum
  unsure (1)..(111): unsure at all Xaa locations
  Clone ID: PAT_TA_92013.pep
GLYGPPWKAIPRXEVKEGXLRLGWGLXXLRQYEPXLSGGSSGIYPGARDQTPCMVRTRPIMSTRERVXVHKPQPSSXSVRHRHXRCHASHSIDLSREVLLNELLTQLGFSA

SEQ ID NO: 197596 - protein, 140 aa, Triticum aestivum
  unsure (1)..(140): unsure at all Xaa locations
  Clone ID: PAT_TA_92014.pep
SEVQRXXLVPXWVEPPENQLHVFFDTLEESMSAPSHDLSRTPPRRSWIISPPGRWRRSSPRRPAAPVAWMTRPRQRRRRRSSPSGRRPLGRPAVPAPGPISSKMWSTSRRRRRPRLSSLRSREEGESYGGPPLASRSGPA

SEQ ID NO: 197597 - protein, 190 aa, Triticum aestivum
  unsure (1)..(190): unsure at all Xaa locations
  Clone ID: PAT_TA_92015.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATXXNKVEEVKKEYLTLCPHIGSTHAQVHASLASSNCKIRKAKHSRRHLMHAPECLVPPLLLFPK

SEQ ID NO: 197598 - protein, 147 aa, Triticum aestivum
  unsure (1)..(147): unsure at all Xaa locations
  Clone ID: PAT_TA_92016.pep
FFNASIIXTXLTSPCNTEIXRKFSELNXFLRDTFIYVNPKFSPGRTVQGCLRRGNTMYAPSLPTATIKDWTYSTHGARPDISHPMPPPLLAKAKMSYVPFLTTPNTNQTSICILHAPTTTCTRTMSYVTSTWGTPGPGKSMSFAASQ

SEQ ID NO: 197599 - protein, 96 aa, Triticum aestivum
  unsure (1)..(96): unsure at all Xaa locations
  Clone ID: PAT_TA_92017.pep
VRLTALLGSKRKLASRHLIVIXLVRSLPFGLKTQNWFAIPFLKLSSXIPQLLNFKSIFTCVIFLINFPXKQVQLDISTHLKSXKAIGLDNCQXKKK

SEQ ID NO: 197600 - protein, 142 aa, Triticum aestivum
  unsure (1)..(142): unsure at all Xaa locations
  Clone ID: PAT_TA_92018.pep
QDWLKKAAQAICPAPLPEDPADVRLTGLLAPAPHVVLEKKAKKKATGTRKSSRFLVLSDDESXADSSQQGXEEKKKASPXRGEGRKXRAPXXGRPKVQXGKIFPGCPQSMTHRXAQXQXLANXXRXQXLRFXXQIVFNXXNL

SEQ ID NO: 197601 - protein, 111 aa, Triticum aestivum
  unsure (1)..(111): unsure at all Xaa locations
  Clone ID: PAT_TA_92019.pep
XWXXXCHXRXWRRXLVTRXARGXSXFGSXECEQGXCXSEHGCHXXRPGRTXCHVRVXXRVXCRAGAGAVLPAGEGLHISPTPTANFLVCTLPRLGSRKPPWRISSTDHLSA

SEQ ID NO: 197602 - protein, 152 aa, Triticum aestivum
  unsure (1)..(152): unsure at all Xaa locations
  Clone ID: PAT_TA_92020.pep
HDEGLLLVKVYFKRAGEPLDLKDHERRLERIRRAFQGLEGSHVWPFQVWFQTDKAAYLLRQYSYSNLHDRLSTRPFLSQIEKKWLAFQLIHAVEQSHSKGVCHGDIKCENVLVTSWNWVYXTDFASFXPTYIPDDDRXIFVLLXXWRKQNAS

SEQ ID NO: 197603 - protein, 80 aa, Triticum aestivum
  Clone ID: PAT_TA_92021.pep
EHANCAGKRNKMKAKMRNKREECYDLMIMSATSQRPQEYTYRRSKGTSMLANECHMLCLICNAWFPKVLACLPMNVTCSA

SEQ ID NO: 197604 - protein, 186 aa, Triticum aestivum
  unsure (1)..(186): unsure at all Xaa locations
  Clone ID: PAT_TA_92022.pep
VGKGRDVGLNQISMFEAKVAGGNGEQTLSRDVYRLGHGLDFFRMLSFFYTTIGFYLNTMMVVLTVYAFVWGRFYLALSGLEDYITNNTSSTDNAALWAVLNQQFFIQFGLFTALPMIIENSLEHGFLIAVWDFIVMQLQCASVFXPSHGDKTHYYGRXTLHGGAKYVRPWLLVEQRENIVAVQLTG

SEQ ID NO: 197605 - protein, 163 aa, Triticum aestivum
  unsure (1)..(163): unsure at all Xaa locations
  Clone ID: PAT_TA_92023.pep
MAPSSQLLTLVLVLLASSAAVPRGAPLHGTNLKRIRAYMHXTLTGPNATEVTSVQSPLGGDATFGQITVLDNELRDGPDRWCSSPLGRFQGLVAXAGLEGTPGLLSAANVVFTAGRQRGSTLAMLGTYRTYGQRQRNVSGGRRMAAVNSWLMAGNSKHSILSQ

SEQ ID NO: 197606 - protein, 66 aa, Triticum aestivum
  Clone ID: PAT_TA_92024.pep
QLTSEPCYDVVEWLCHHFAGCLKPLSIYSRYAVRVILSFLNNLKHCKTLPPQFDVPWGKINTLILD

SEQ ID NO: 197607 - protein, 161 aa, Triticum aestivum
  unsure (1)..(161): unsure at all Xaa locations
  Clone ID: PAT_TA_92025.pep
DPYLILRSSASASFNSLSRHASSGYKKLGHFYIFHLDHVNKLPNKIRGSLDPIHTIFPKRGIIRACPKKPLQHGRRSQSSSRSREHQAGAIGEKCTISHGRLVKLHTQGYLLLHIYPRSNRIGSLNGGEQRENLPTNPRGLNKPRSYLLRVXXFQSTVPRX

SEQ ID NO: 197608 - protein, 76 aa, Triticum aestivum
  unsure (1)..(76): unsure at all Xaa locations
  Clone ID: PAT_TA_92026.pep
MSCCGGNCGCGSGCKCGNGCGGCKMYPEMDEGVNTASQTLIMGVAPSKGXPSFEAAAENGGCKCXPNCTCNPCTCK

SEQ ID NO: 197609 - protein, 88 aa, Triticum aestivum
  unsure (1)..(88): unsure at all Xaa locations
  Clone ID: PAT_TA_92027.pep
RXCPPFASPAPLNPSERPLPXASSPXTPWSSWSGRCPSLASIFFIYRLFFLYMLVFYIYVLLCIYMFMYICNSFLEKIGFFSVHRFFW

SEQ ID NO: 197610 - protein, 160 aa, Triticum aestivum
  unsure (1)..(160): unsure at all Xaa locations
  Clone ID: PAT_TA_92028.pep
FYAAAHLVKLGGFPVFPTKXFXANAFQTIPIICPFGXWGLDIVXXPXKREGPLGKXTCWSLLVKFTQWXEPXPVKTAGIRDPVIDFISGVVHHYGVPHSIITDNGSQLHSRRGKNLVRQHXIKLDYASVYHPXTNDQVERANDLIMSGIKPRLVRSLKES

SEQ ID NO: 197611 - protein, 148 aa, Triticum aestivum
  unsure (1)..(148): unsure at all Xaa locations
  Clone ID: PAT_TA_92029.pep
MASTSCFLHQSTARLAASARPAPAVGRTQLFVCKAQKNDEAAPDAAVXVTSRRAALSLLXAGAAAVAVKVSPAASAYGRSSERVPARRRKNTXSVEKPGRGFKLMIPGKFEPKQGRXFPWQVSRYEDNFXTPTTLSRFINPTTKKHNR

SEQ ID NO: 197612 - protein, 66 aa, Triticum aestivum
  unsure (1)..(66): unsure at all Xaa locations
  Clone ID: PAT_TA_92030.pep
YPPVSVSGTGTLLLKVVRAFPGSMASVTYFSAVAPGYELVEKQXAIHGAHTSSACSAWYRAQGGGG

SEQ ID NO: 197613 - protein, 100 aa, Triticum aestivum
  unsure (1)..(100): unsure at all Xaa locations
  Clone ID: PAT_TA_92031.pep
MAPTVMASSATSVAPFQGLKSTAGLPVXSRRSNGASLGSVXSNGGRXRCMQVFGHPKGIKNSETLSYLPPLNTXASSKQVXYLIRSKVGACLXXNKVGTS

SEQ ID NO: 197614 - protein, 123 aa, Triticum aestivum
  unsure (1)..(123): unsure at all Xaa locations
  Clone ID: PAT_TA_92032.pep
MAPTVMASSATSVAPFQGLKSTAGLPVSRRSNGASLGSVSNGGRIRCMQVLAHRGHQEFETLSYLPPLSTEALLKXVDYLIRSKWVPCLQXNKVXFIFREXNASPGXYNGRIGMWKLLMFGVH

SEQ ID NO: 197615 - protein, 164 aa, Triticum aestivum
  unsure (1)..(164): unsure at all Xaa locations
  Clone ID: PAT_TA_92033.pep
LEMAQTMASMTGLSQGVRLPGPTGRRASRFTVRASSAEAEGRRPPRGPWSHGQRSPSGSAFAQXGARPAPSRHQGFGHRRRLRLDSPRNGQSERSKDFHLPLEKPVYLAAAATGGRRXVXGQRSPAQESFNXXAVXXTRTXXLLHXHSASRLLTTLXLKTSLLP

SEQ ID NO: 197616 - protein, 83 aa, Triticum aestivum
  unsure (1)..(83): unsure at all Xaa locations
  Clone ID: PAT_TA_92034.pep
MAQKDAANGNGATTRPPPTPSPIRFSNSSKANMRFLVTGGAGFXGSNFVRQVHGRNEXTKXNFCXKFFXXVKRKLXKWVXKXK

SEQ ID NO: 197617 - protein, 92 aa, Triticum aestivum
  unsure (1)..(92): unsure at all Xaa locations
  Clone ID: PAT_TA_92035.pep
HHSTISWXRXGLSSLGEERTVLLGSVVVTAAIACPSCILPQPILPIRDRAAPGKGESGPPRRGGERAVGRPRARRRRHGGRGALGGVGRGAA

SEQ ID NO: 197618 - protein, 154 aa, Triticum aestivum
  unsure (1)..(154): unsure at all Xaa locations
  Clone ID: PAT_TA_92036.pep
CXLEIGGVNHNLYIFELRSSLVCXXGNSYGFFXLIVHGPGAXYPIGWPILDLLSGSFFLHSYYFYSKMPSLKLSFRLGQTWHDLELKFLQWFDLQFPISVTWPDLHNSFYRYALKIFYMSYVIIIVGYSYSIVNLSGKLQCTVHSCILFKYNAV

SEQ ID NO: 197619 - protein, 78 aa, Triticum aestivum
  Clone ID: PAT_TA_92037.pep
RNVFSANMQVFFARNFQSIHQLVVQRTPEVKITSMFVDHLATTISTGASRRAPPSSPLHHQERGKPCCSKTIKKVRPR

SEQ ID NO: 197620 - protein, 74 aa, Triticum aestivum
  unsure (1)..(74): unsure at all Xaa locations
  Clone ID: PAT_TA_92038.pep
EHNHDRVKNVLHVPGHMHLEQRIXXEILSCSMXLPLQTYGHQARFLQTHDYEQCANLVALSLVKDGMNLHKQGL

SEQ ID NO: 197621 - protein, 133 aa, Triticum aestivum
  unsure (1)..(133): unsure at all Xaa locations
  Clone ID: PAT_TA_92039.pep
ELLSKPLPSPRQESRVREERERESETRAKIISRPTVIPRLHPSHIPLYIFVSRWLGLSLRAPLGHSAFRLPKQHHLFXQAPWAPYQHSTGFFKEQIPRRGPXGXYVRGLXKRELWXSYARXKPXKAPSSXSTL

SEQ ID NO: 197622 - protein, 71 aa, Triticum aestivum
  unsure (1)..(71): unsure at all Xaa locations
  Clone ID: PAT_TA_92040.pep
MEHKETGCQSREGPILCVNNCGFFGSAATMNMCSKCHKEMXLKXEQAKLAALFRQIVNGGNAAKEILLLRR

SEQ ID NO: 197623 - protein, 155 aa, Triticum aestivum
  unsure (1)..(155): unsure at all Xaa locations
  Clone ID: PAT_TA_92041.pep
FXSSXGICSRLXXSFVXXTEXYCQKKLXPLMSXVLGVXXLSGAXPVDXGDELGTXTLARLLGRPFENLALPGSAFLHNRLTFGNRQEPVXLLGRRRSPACSARRSRCRSPASPPAEISQETEQLLPFLPXNSKADQTTQLRISGSKNRSGSASIA

SEQ ID NO: 197624 - protein, 33 aa, Triticum aestivum
  Clone ID: PAT_TA_92042.pep
QFGLFLDKGCSLLLPLFIYIRHWDGSSWRPGTS

SEQ ID NO: 197625 - protein, 116 aa, Triticum aestivum
  unsure (1)..(116): unsure at all Xaa locations
  Clone ID: PAT_TA_92043.pep
KSTWDKINTARANKIPPKKQAWNXTSFQFHIGKHLKQXLFLXGCYMFYYTRFYIIYIPETRIFPCPSXEPVXAEAXRGKALSXSXIRGIXYXVXXNLXPSYTXLPWXNLHTXVFKF

SEQ ID NO: 197626 - protein, 132 aa, Triticum aestivum
  unsure (1)..(132): unsure at all Xaa locations
  Clone ID: PAT_TA_92044.pep
RPPLSTDTPTPPPHDPLSSLCLPPIQIGGNVPVAAPSRLPPPPRRHLASAAPPGLLPPPPCTASSSPSSACTASXPPRPRLPEHVASPEAPXRTATRSSSPASPSSLTLSRIFAGSFPGLPFRQQLQGGARP

SEQ ID NO: 197627 - protein, 92 aa, Triticum aestivum
  unsure (1)..(92): unsure at all Xaa locations
  Clone ID: PAT_TA_92045.pep
HDPDGWWKQLNLLLPRIQYXRWDYPSTNPNQQRHFLRXQXRXXKGPLVRLNXPGGGFRFXRXISXXXSLTFXNXXFXKXFTXTGSKXRFANF

SEQ ID NO: 197628 - protein, 93 aa, Triticum aestivum
  unsure (1)..(93): unsure at all Xaa locations
  Clone ID: PAT_TA_92046.pep
HCWESLRSPRKDDKELPEIKEKMXEGKPKGFREDEHGHHMVRRTVFMCPNNTKIRKLILQEAHDSPYLIHPRNTKMYLDLKERFGWTGMKKNI

SEQ ID NO: 197629 - protein, 82 aa, Triticum aestivum
  unsure (1)..(82): unsure at all Xaa locations
  Clone ID: PAT_TA_92047.pep
RXIPRXLWGMXSXWKXAXGSXPXTXWWXEALSIMVVGANRLIQQYGLARNCNLDFLGLLGNPRIHLLTXNGVCCRSSVICKL

SEQ ID NO: 197630 - protein, 57 aa, Triticum aestivum
  unsure (1)..(57): unsure at all Xaa locations
  Clone ID: PAT_TA_92048.pep
EDEXPXFHCADPGGGGAVAGPPRWQGSIRLRSGLRRRAWLRRRGAFHGGGQTWRRRG

SEQ ID NO: 197631 - protein, 62 aa, Triticum aestivum
  Clone ID: PAT_TA_92049.pep
FFFLSKRLSRYLMLKSAYKMTANATLRHDGTATLLQPVQMTKNHTLIKQTKNSSSTSQCLQE

SEQ ID NO: 197632 - protein, 57 aa, Triticum aestivum
  Clone ID: PAT_TA_92050.pep
MSSASPFALKLAYSQGLCKRHGWVTHARIDENPVIRGHDLFFNKTCQWQPCLETWSG

SEQ ID NO: 197633 - protein, 120 aa, Triticum aestivum
  unsure (1)..(120): unsure at all Xaa locations
  Clone ID: PAT_TA_92051.pep
PPLEXCVTAAPVPSVCPLAGVVGEPGQEAMASPSPGMVHPSRAYREEVIAFGGILNPVSEGRRLSSRLQDHPEVDDIQQRCAMRAAKLRDVEVTTGMSVNTSNSILHFSNDEIVNNANKL

SEQ ID NO: 197634 - protein, 103 aa, Triticum aestivum
  unsure (1)..(103): unsure at all Xaa locations
  Clone ID: PAT_TA_92052.pep
MASSLLTTPSQTLALTPAAARARRSSPAADQVSFSSPRLPSRRALRXCARRVAIXEKXVPENEAPTXFLXEDGPGPVRSXREXFEGMIRRVQGNLRLEAAEPS

SEQ ID NO: 197635 - protein, 61 aa, Triticum aestivum
  Clone ID: PAT_TA_92053.pep
SGIYDPRVYFLITYFQIYIAICLFYLFTSFISRSILPKTQKYLTGFYLHLPIFYPRGIDNP

SEQ ID NO: 197636 - protein, 56 aa, Triticum aestivum
  unsure (1)..(56): unsure at all Xaa locations
  Clone ID: PAT_TA_92054.pep
IQNYVNHSRDATCLGFNGCRRCRADSCLTLTEWEACKCRQVRXLTERRASXSKGGG

SEQ ID NO: 197637 - protein, 62 aa, Triticum aestivum
  Clone ID: PAT_TA_92055.pep
VWLREGENAKSLQYNALSETLQTRKVGGGVTHRIGSIRPRHGAQLSWRSEVKFHVNIFTLRV

SEQ ID NO: 197638 - protein, 145 aa, Triticum aestivum
  unsure (1)..(145): unsure at all Xaa locations
  Clone ID: PAT_TA_92056.pep
MAASMITSPIVAPTSVPSLSRRGSSFAVVCSGGKKIKVDKPLGLGGGLTVDIDANGRKVGKKGVYQFVDKYGANVHGYSPIYTPEEWSESGDRYXXGTNGLLXWGVNLARLLXRGRLLVXNTTLSPGKHLLKAGLCFKSCIILLL

SEQ ID NO: 197639 - protein, 121 aa, Triticum aestivum
  unsure (1)..(121): unsure at all Xaa locations
  Clone ID: PAT_TA_92057.pep
RVRAPCAVECRPRPLPASPPASARVRSSPSVSGHRAAPWSVRLPTGATPCQENRARCGLAAGLWSSSPVHPSPLSVKLSVKNVVAEFCKSIMGNIDVKFVNLLCKSIINNVVXXKTIQNGW

SEQ ID NO: 197640 - protein, 57 aa, Triticum aestivum
  Clone ID: PAT_TA_92058.pep
SLSHPIIMWCLSTMNYRNRAYSGRTLIPWNFSEGSSYNATAVLRKIRCIKDKHHIQS

SEQ ID NO: 197641 - protein, 93 aa, Triticum aestivum
  Clone ID: PAT_TA_92059.pep
RCACVVIDVVVGYIFLCLWPPHRFLSSSATWYQLLSPVTVGPVVVSIAVSVNNTDLSDYEGGFYGKDNQCGSRNDHELLLVSYDFNSYILKNS

SEQ ID NO: 197642 - protein, 133 aa, Triticum aestivum
  unsure (1)..(133): unsure at all Xaa locations
  Clone ID: PAT_TA_92060.pep
MAPTVMASSATSVAPFQGLKSTAGLPVSRRSNGASLGSVSNGGRIRCMXVWPIXGIXKFETXSXXXPLNTGGLLKQXTTWIRPKWVPCLQLTKLGHXREHNDPXYXDAVWDKLXLLMSGAPHKNKWRQGYLFR

SEQ ID NO: 197643 - protein, 177 aa, Triticum aestivum
  Clone ID: PAT_TA_92061.pep
CSGTRLYVRDARRLSDSMETNPEYLKNDATDSGEVTDLKDMQVGVGRRFRGLKLWMVMRTYGTAKLQEHIRSDIAMAKMFEGLVRADHRFEIVVPRNFAMVCFRIKASGAMTEEHADEANRVLMKNLNKTGKAYIAHTVVGHRIVLRFAVGSSLQEERHVRSAWGLIKSTTNKVMME

SEQ ID NO: 197644 - protein, 170 aa, Triticum aestivum
  unsure (1)..(170): unsure at all Xaa locations
  Clone ID: PAT_TA_92062.pep
RNTEQEDKREAKLEMAQTMASMTGLSQGVRLPGPAGRRASRFTVRASSGGGRGRRPPRGPLAHGQRILRERFAQXGCTPGTVSASRLAPRRRLPVDPPGXDNSXPSKDFDFPPEDRSTCSRCNRXEAAVRPXIRPRILNLXRXXTRHGLLHDTPLKLLLRXLKLFLQXRR

SEQ ID NO: 197645 - protein, 77 aa, Triticum aestivum
  unsure (1)..(77): unsure at all Xaa locations
  Clone ID: PAT_TA_92063.pep
SLAXSPXVVLTGXGGFVSPILAAMGMHLVGRTGATPLLVTHVPXAGNNDAPXRRHSRHXXTHYACCMVKHLXVVVLH

SEQ ID NO: 197646 - protein, 113 aa, Triticum aestivum
  unsure (1)..(113): unsure at all Xaa locations
  Clone ID: PAT_TA_92064.pep
PPRRRRXASAKRGQPGKKXIXPALTGRTXGFFAPAASXLCYFGGGHRSXTNVGFFGSRMQQRGASCAGKGLDAAPPHPASVHASVTMGTIRSTERERALGSPGRLAGSCGRRR

SEQ ID NO: 197647 - protein, 157 aa, Triticum aestivum
  unsure (1)..(157): unsure at all Xaa locations
  Clone ID: PAT_TA_92065.pep
AECIDPDCSWVEQWVHRAGPRKDIYYEPNEVKAAIVTCGGLCPGLNDVIRQVVFTLXETYGVKNIVGIPFGFXXFEKGLKEXPSRNQWENINLAGGXFXDXSRGXAKTNEIXDNIQARXXXLFVLGGNGTHARTNXPMMMPLKTKHSKQSFMAKFVL

SEQ ID NO: 197648 - protein, 106 aa, Triticum aestivum
  unsure (1)..(106): unsure at all Xaa locations
  Clone ID: PAT_TA_92066.pep
TEIHKWXTRRPTXRKENRDPSYLKLAXKXFIXXNTGEKXVTHFLWDKLLKVYGSTXFXKXXLXXMSXIXAXGXXAXLGXKXXTXAXVTXPYGRPXPPXXTXXAXNW

SEQ ID NO: 197649 - protein, 66 aa, Triticum aestivum
  unsure (1)..(66): unsure at all Xaa locations
  Clone ID: PAT_TA_92067.pep
TPQKTLXLNXXRKGRGKXXXFRFKXEXQXKIXAKKKFKXKXQAGXXAXQPXQEPSTXIHPPPSLAG

SEQ ID NO: 197650 - protein, 96 aa, Triticum aestivum
  unsure (1)..(96): unsure at all Xaa locations
  Clone ID: PAT_TA_92068.pep
DFXXRRSXVXFNLIXGLKVXLENVVNPLGKTLSXAGTHXGAMYQMIFQVNKRRQGALYKMWLGVRGGAQTCQDSYRTQVAQHLSISLHVFSFSTHT

SEQ ID NO: 197651 - protein, 99 aa, Triticum aestivum
  unsure (1)..(99): unsure at all Xaa locations
  Clone ID: PAT_TA_92069.pep
MAASLQAAATLMPAKIGGRASSARPSXPHVARAFGVXDAGAKDXLAPCNPDIKEVPKQFADAXPKXAGXALATLPPXFPGATPEGGAXKATFHXFXKQT

SEQ ID NO: 197652 - protein, 78 aa, Triticum aestivum
  unsure (1)..(78): unsure at all Xaa locations
  Clone ID: PAT_TA_92070.pep
FGDXFVTYWAPPMXXXLXANGNPVESXARXKKGCHWGXQSMRQQXXXQMKXFXQAXXEYXLXMXVLGKCTGRTSXLCQ

SEQ ID NO: 197653 - protein, 132 aa, Triticum aestivum
  unsure (1)..(132): unsure at all Xaa locations
  Clone ID: PAT_TA_92071.pep
SDFGLAKYXGGXNQEDVIRRIAGTYGIHVARSMPMHGQYSAKSDAFSFGVLVLEIVTGRRNNGSCNSEQYVYLVNLVWEYWTRGKVIELIDPSLSDHPSHVDQVLKCIQIGLLCVQNRPEDRPTMLVPNSAR

SEQ ID NO: 197654 - protein, 75 aa, Triticum aestivum
  unsure (1)..(75): unsure at all Xaa locations
  Clone ID: PAT_TA_92072.pep
MGFRSSERRERERSMXXXXYRCFVGXLXXAXDDHNLXQXFXQYGEILDAKIINXRXDGXVWLRARFGSEGVCKAI

SEQ ID NO: 197655 - protein, 166 aa, Triticum aestivum
  unsure (1)..(166): unsure at all Xaa locations
  Clone ID: PAT_TA_92073.pep
KAVAVLTGSEGVKGTIFFTQEGDGPTTVTGSVTGLKEGLHGFHVHALGDTTNGCMSTGTTLQPCWHVHGAPEDEIRHAGDXLGNVTAGADGVANINLXDCHTPLTGTNSIVGXSVSSHXDADILGKGGHDLTRHLEPGPLFPDRSKLSSPPATLFGTFQDQHSKYN

SEQ ID NO: 197656 - protein, 191 aa, Triticum aestivum
  unsure (1)..(191): unsure at all Xaa locations
  Clone ID: PAT_TA_92074.pep
FVTSTHASLIYFFVISYPYHRYAASNSKSVHSSAQQYRASSQTNPFWRLKNHQTTRSRSKKRKACLACPVYHATREENSLLQTDKCATKRIQISESIHTHXSSRSAVLLIQQIKGILEVQGTDAHPRHPHTXRNGELDLKLEVXTRLPIWACIVFALPPMVKXNXXSTPPIXDWRLRXGXYKGTIXGIXXX

SEQ ID NO: 197657 - protein, 97 aa, Triticum aestivum
  Clone ID: PAT_TA_92075.pep
CLEFSKVGFIFREHNASPGYYDGRYWTMWKLPMFGCTDATQVINEVEEVKKEYPDAYVRIIGFDNMRQVQCVSFIAFKPPGCEDPARPKQLTHDRHI

SEQ ID NO: 197658 - protein, 107 aa, Triticum aestivum
  unsure (1)..(107): unsure at all Xaa locations
  Clone ID: PAT_TA_92076.pep
SRHRSPXGKIREHHXSSPSGXYRXIXLPVSDSGSLAESSTIKGQAVVYXIXCLKAARDDTXRDARGNRQCEGRRRKLTPXEAHXKREAYAASRXAPXPAXGMRSESV

SEQ ID NO: 197659 - protein, 51 aa, Triticum aestivum
  unsure (1)..(51): unsure at all Xaa locations
  Clone ID: PAT_TA_92077.pep
AAAGASWAHXVKXALRDKLRWAPAXGTTGTGGHRAXRPPTXSXAVTXEXAA

SEQ ID NO: 197660 - protein, 70 aa, Triticum aestivum
  unsure (1)..(70): unsure at all Xaa locations
  Clone ID: PAT_TA_92078.pep
THDLGHEGVCAQPMHQECFHFLPKIPIIYVPYTLKRTGHLLLTFLLKIGNYMXXICVLKIIIGXIKIIFI

SEQ ID NO: 197661 - protein, 124 aa, Triticum aestivum
  Clone ID: PAT_TA_92079.pep
MRRSLRKLSAAQPSRYLESGAPTGITGLLTHASPRATLMYTYASTLDALAQLPESSLYRQSTEAITKHRMSIVSAVRASRLSGIRGKDQEILAANLAFTTTMAIHTMFEKAGKNLLSSSQTGTG

SEQ ID NO: 197662 - protein, 79 aa, Triticum aestivum
  Clone ID: PAT_TA_92080.pep
FFFLPFTQQWDKCFILTTKVLTYKTLWQQKKVVTGSCRKWISLHFLHHVLFCLHLNHHNTLFQPCSRANNVSTQIANNT

SEQ ID NO: 197663 - protein, 52 aa, Triticum aestivum
  Clone ID: PAT_TA_92081.pep
TGPPLEFFYLCVRFLSFFLFSYAPFQLRRDIHSQLSVMQQHLYNTISLYFRK

SEQ ID NO: 197664 - protein, 62 aa, Triticum aestivum
  unsure (1)..(62): unsure at all Xaa locations
  Clone ID: PAT_TA_92082.pep
STIPHRLKKPITSSIWDAYPRIFWAKALQGCSSYAQEXFXPLXSLITXXQVQTSXPNFDXWD

SEQ ID NO: 197665 - protein, 76 aa, Triticum aestivum
  unsure (1)..(76): unsure at all Xaa locations
  Clone ID: PAT_TA_92083.pep
XXKXSKXRLWKYXVFAQDTGRMQLXNSIEXXECVXDQHXXKKRCPKXHHHIIDFFLDFSNASILKKVITPRAQTCN

SEQ ID NO: 197666 - protein, 64 aa, Triticum aestivum
  Clone ID: PAT_TA_92084.pep
FFFFLDLFIFKLEALPLYLIILGYIRVQSIKKYKLRHRILVMHSSVLQSSLVPNSARARAEFGT

SEQ ID NO: 197667 - protein, 96 aa, Triticum aestivum
  unsure (1)..(96): unsure at all Xaa locations
  Clone ID: PAT_TA_92085.pep
FLVDQRIDITMATGAPLTAETPCNKIIGITQQQRDKLPKLEPRKRVQQDSSPIPETPCLPAPPKLQSLDFKXHPRRSYRLMTMPFSWINSLQXLLL

SEQ ID NO: 197668 - protein, 120 aa, Triticum aestivum
  unsure (1)..(120): unsure at all Xaa locations
  Clone ID: PAT_TA_92086.pep
SCRIRHEGSTVTSWNSVPGLPISSHGGELQQKNEEAAVIESKISQIRDLLPHYGKGFLAACLEAYNQNPEEVIQRILDGTLHQDLPSFXDLPLQEMPQQKSAPKCXAKDKGKGVLSGKLS

SEQ ID NO: 197669 - protein, 87 aa, Triticum aestivum
  unsure (1)..(87): unsure at all Xaa locations
  Clone ID: PAT_TA_92087.pep
KEYRLSQRKLSLRSGRPGIERSQWVFLGMIWACAKGSPGIVWWSIYKFYLGVASITSMILHKEFKPVLKTDGYGXPIHSSWAKHXLE

SEQ ID NO: 197670 - protein, 80 aa, Triticum aestivum
  unsure (1)..(80): unsure at all Xaa locations
  Clone ID: PAT_TA_92088.pep
LVPNSARGFILLSPSYIVLLLLLLLPLFLSFSPXLSPQSAKLYRSRAPGXTARRXRVGCXTCCRLAAPXSNAXRGXRRWG

SEQ ID NO: 197671 - protein, 94 aa, Triticum aestivum
  unsure (1)..(94): unsure at all Xaa locations
  Clone ID: PAT_TA_92089.pep
YLSWRHVITHHXFPPXKVXKXXSRCPRIHGQKEXYKSAAXQVHXXXCXNXHTQCLNXXQLXRXXREMHTVIPYXXILXXXHTHXFHSXFGSPXV

SEQ ID NO: 197672 - protein, 102 aa, Triticum aestivum
  unsure (1)..(102): unsure at all Xaa locations
  Clone ID: PAT_TA_92090.pep
RQXHRNLPXSRRRWYITSLRSRLLMPPSXASXPPTXYNPRKMFTTNLPGYAREISQVDHYNXXXSGXYIXSWXWGISAYDTILTFKXXLCRXSXIGHIDIRF

SEQ ID NO: 197673 - protein, 141 aa, Triticum aestivum
  unsure (1)..(141): unsure at all Xaa locations
  Clone ID: PAT_TA_92091.pep
EQPPSXVXDQNHSRASTHELVSGVSEXMQXVETAPRPNGSWAPINASSPPLDDERXKYTPHGQHPYXIPCLSAPVTAPASPISRESHRLISGXIALASGTHLAKXLXNPSIXXKSIRASVWEXCGXXXAXYXXFQKXETXD

SEQ ID NO: 197674 - protein, 76 aa, Triticum aestivum
  unsure (1)..(76): unsure at all Xaa locations
  Clone ID: PAT_TA_92092.pep
MVKAVAVLTGSEGVKGTIFFTQEGDGPTTVTGSVTGLKEGLHGFHVHAXLGDTTNGCMSTGPHFNPRWHXHGEXKD

SEQ ID NO: 197675 - protein, 122 aa, Triticum aestivum
  unsure (1)..(122): unsure at all Xaa locations
  Clone ID: PAT_TA_92093.pep
RAEFGTRISKKXKFVSDGVFYAELNEMLTRELAEDGYSGVXVRVTPMRTEIIIRATRTXNVLGXKGRRIXELNSVLQKRFXXXRXXGXEXYXRRVXKRWLXGIXXXAESIRXRXLGXFXXXR

SEQ ID NO: 197676 - protein, 83 aa, Triticum aestivum
  Clone ID: PAT_TA_92094.pep
LVPNSARASFFFFFFHVKLQINLGLLNLVMRSIGYGMKIPPLVIVSSFTISPKIVPRRIKAPTSRYFDLLHLLFWGRGEDISP

SEQ ID NO: 197677 - protein, 132 aa, Triticum aestivum
  unsure (1)..(132): unsure at all Xaa locations
  Clone ID: PAT_TA_92095.pep
LVPNSARARAEFGTXATPRPGXGAAAHPXXVPRXPLTIXPXXXRRRLLRPPRPRAAXXXPAPGLRMXXXSPTXLAALRXPPXSPSXSGLRPGVSVARSAXALSVVXRXPSXQVSAALXAASXAQLXSXVQXS

SEQ ID NO: 197678 - protein, 156 aa, Triticum aestivum
  unsure (1)..(156): unsure at all Xaa locations
  Clone ID: PAT_TA_92096.pep
MALPNQNTVDYPSFKLVIVGDGGTGXKTTFVKRHLTGRXXEKKYDPLWVFEXTHLVSTTNWWKXXSYWLGTLAGARNFGXGFKDGTISXVQCSISCFDXLXKLTYXNVPNLEXDXSGVNTPLPRTVLKQQFRQQEFPEDYPCQTYITPYFRTAGSK

SEQ ID NO: 197679 - protein, 117 aa, Triticum aestivum
  unsure (1)..(117): unsure at all Xaa locations
  Clone ID: PAT_TA_92097.pep
VDDVVKGFXXLPXXHXRRXGIYXPSDXXQKQTAXEQRIGRISXSXPQNVRENASPTGRAXGXPSXXPPPXIRRRAAAAAWTGGIXAGEXWAAPDPSAXATARRRXXRXLGTXXDSTX

SEQ ID NO: 197680 - protein, 46 aa, Triticum aestivum
  Clone ID: PAT_TA_92098.pep
YMHFSYLAVIAGRSWGKWLLWELEIFCTNNALEFSAKHIEHIILFY

SEQ ID NO: 197681 - protein, 109 aa, Triticum aestivum
  unsure (1)..(109): unsure at all Xaa locations
  Clone ID: PAT_TA_92099.pep
RHDCGYLFLGPSTRFVPNFFRSTRYSRCILTTHCLFIFRTLLSFILSPAKTNKHLSIYTXKDPLSPVLPGQXRFCQPXKDGTRRPKFMGXVLLTYTXTXGGALGIXKKX

SEQ ID NO: 197682 - protein, 52 aa, Triticum aestivum
  Clone ID: PAT_TA_92100.pep
SCRIRHEVTTTGNGTGRGQLACAERVQWRSGSSRSILFVVRKIKVCISSHLE

SEQ ID NO: 197683 - protein, 39 aa, Triticum aestivum
  Clone ID: PAT_TA_92101.pep
FFFLVNELFQQSQVNISIVPKQPTILHTNDWLIISHSNS

SEQ ID NO: 197684 - protein, 89 aa, Triticum aestivum
  unsure (1)..(89): unsure at all Xaa locations
  Clone ID: PAT_TA_92102.pep
LVPNSARAVVLYPGVGVGHLVPMVEVAKLFLKHGLAVTVVLIDPQGRSTDFSSAVARARPPTLRRLPLLPPPPAXPTPTPPQTRPNFGP

SEQ ID NO: 197685 - protein, 49 aa, Triticum aestivum
  Clone ID: PAT_TA_92103.pep
DVVRCRRNIYFSHGSIFRSFSYKPLLHPSLVDIDCCWVFNSYSLFVVCH

SEQ ID NO: 197686 - protein, 152 aa, Triticum aestivum
  unsure (1)..(152): unsure at all Xaa locations
  Clone ID: PAT_TA_92104.pep
LVPNSARARAEFGTSEYDFLFKVLIGDSGVGKSNLLSRFTRNEFNLDSKSTIGVEFATXDLSKLDAKTIKGSRSGDTAGQGEISGVLHPAYYPRGXLGALLVXRYQXNTKPYXERLQRWLKXLRIHADPXILIGLGTKFIFEPAYGSQPKYH

SEQ ID NO: 197687 - protein, 67 aa, Triticum aestivum
  unsure (1)..(67): unsure at all Xaa locations
  Clone ID: PAT_TA_92105.pep
FFSSPIDKFGIVVFYXMXFLPXXNGNPKFIQEVPPRGWSPSPAAPGHPLVASHGMSPTLDTNATQYT

SEQ ID NO: 197688 - protein, 121 aa, Triticum aestivum
  unsure (1)..(121): unsure at all Xaa locations
  Clone ID: PAT_TA_92106.pep
STWNLXXLSMXMXAXXXVSXCLVCXVXECPSXREELCVMCAVXLCRPXRYCCSVVXHXPAEXXVCXVVMSVXRAVSGGSGRWTGSKGXPLGWCNRCWDQLIAHCFEXGGDGVMEILRSLVG

SEQ ID NO: 197689 - protein, 173 aa, Triticum aestivum
  unsure (1)..(173): unsure at all Xaa locations
  Clone ID: PAT_TA_92107.pep
LIWELRYRIAFGIARGLAYLHEECEDCIIHCDMKPDNVLLDAHFCPKIADFGMAKLLGRDFNRALTTMRGTIGYLAPEWISGLPITHKSDVYSYGMTLLEIISGRRNAEKIKEGRFTYFPIFAAVKVXERDVMCLLDNWLDGLYQCRAXELSXKIXCWCIQDDETGNDGQSSI

SEQ ID NO: 197690 - protein, 157 aa, Triticum aestivum
  unsure (1)..(157): unsure at all Xaa locations
  Clone ID: PAT_TA_92108.pep
MAPTVMASSATSVAPFQGLKSTAGLPVSRRSNGASLGSVSNGGRIRCMQVWPIEGIKKFETLSYLPPLKHGGLLKQVDYLIRXKWVPCLRFSKLXYLXVRQRTPGYYDGXYWDMWXCLVRCTDXPGXNEVEESRRIPDPIPHQVNIACLSHGLDPAK

SEQ ID NO: 197691 - protein, 73 aa, Triticum aestivum
  unsure (1)..(73): unsure at all Xaa locations
  Clone ID: PAT_TA_92109.pep
QRSKLCYTGRKAXQWRHLYXEIQVNSYIGLALKHLQTRQGXIYKXTXQNVQAGGPKEWSRXXTAMXTSGLXXG

SEQ ID NO: 197692 - protein, 119 aa, Triticum aestivum
  Clone ID: PAT_TA_92110.pep
RAEFGTSTHHLTSTTDRSAVPTANRSLPHLLPTIIDFEITTLRIPARSKYIGEEKVAQEWKEIWKRPLVGMMKPIFASFFDLGNVCRHQDRDYGKLGRWISIVNESTAITKTTERRQRS

SEQ ID NO: 197693 - protein, 120 aa, Triticum aestivum
  unsure (1)..(120): unsure at all Xaa locations
  Clone ID: PAT_TA_92111.pep
RAEFGTRPSFRFTSAQARATFKPGAFKKQFGRQEQRWQSSASFESPPPNWFKRMWESPIGVKTVHFWAPVMKWSLVLAGISDLYRPAEKLSLTQNLASPLLGLXLXXWCFVIQTKXYTTN

SEQ ID NO: 197694 - protein, 161 aa, Triticum aestivum
  unsure (1)..(161): unsure at all Xaa locations
  Clone ID: PAT_TA_92112.pep
VQRIKISDIKLACLKGVKAAAVRHSSAVGVEVLASGRCILPAQAKYLCCAPLLLPMQARMWVCMENFLTVXRTSSXHPGXHTQSAXSSXCQQLTPLISCSLTHSRIQXSXALGCQRXASXXKTSAKSQTVXTXXTXXNXXXAXKSWXPEXXIXQGXXNAPK

SEQ ID NO: 197695 - protein, 60 aa, Triticum aestivum
  Clone ID: PAT_TA_92113.pep
KPGNCSRWHSCGSISTESWMKGHNHTERSSGSIFLFDRVSGSISFVRECTLRPSEKKKKK

SEQ ID NO: 197696 - protein, 170 aa, Triticum aestivum
  unsure (1)..(170): unsure at all Xaa locations
  Clone ID: PAT_TA_92114.pep
RAEFGTRFDVTKGRSHYGPGGGYHHFSGRDASRAFVSGNFTGDGLTDSLQGLSSMEVNSIVDWRKFYVERYIFAGKIVGRYYDSEGNPTQYLKGVEMXAKRGAQLLXEAERXRKIXYPAVIQKWSXAEGEEXWCETGXPXVMRKPGDIXLXGSQPPVQEGNAGAKVYIQS

SEQ ID NO: 197697 - protein, 145 aa, Triticum aestivum
  unsure (1)..(145): unsure at all Xaa locations
  Clone ID: PAT_TA_92115.pep
SCXIRHEVFFFXFSHCYXVSXSLVLFPLVXFFLTTLPLTLTXGIRKPLILLSQVVTHLXQHVLLHSKQLTKIPPYLXDCFGXKPGIPEGSGYXIXRXFGIXRTYWRWWCFICXXXQEXXYKSSNXGNYXWKEXCXXFPXSLXRXL

SEQ ID NO: 197698 - protein, 127 aa, Triticum aestivum
  unsure (1)..(127): unsure at all Xaa locations
  Clone ID: PAT_TA_92116.pep
LVPNSARDLFXALIYKFMPNGNLDTWXHHQGGGKAPXRLGLXQRINIXVNIXDALDYLHNDIGSSTIIHCDVKPSNILLDDDMNAHLGDFXIASFYQGASSTPTGDSXTVSXGVKGTVGYIGPRYIY

SEQ ID NO: 197699 - protein, 69 aa, Triticum aestivum
  unsure (1)..(69): unsure at all Xaa locations
  Clone ID: PAT_TA_92117.pep
SSVLGSQSLRRNRKCXANRQPTDLRGVFEQGEDVEVSGKLMTQAHFSVLFGSYNIFLFFSHAHVFLFFP

SEQ ID NO: 197700 - protein, 54 aa, Triticum aestivum
  Clone ID: PAT_TA_92118.pep
HLIDDNEQLSEPSKVGSTGDVDKENYEASFMSESIYDKLPSSNITAKKKKKRHE

SEQ ID NO: 197701 - protein, 174 aa, Triticum aestivum
  unsure (1)..(174): unsure at all Xaa locations
  Clone ID: PAT_TA_92119.pep
MQIFVKTLTGKTITLEVESSDTIDNVKAKIQDKEGIPPDQQRLIFAGQAAGRTAAPWADYNIQERXTLHLGAPPPVVGMQXLVKPSTGKTITLXEFEXPDTFDNVXAKXQDKEXSPGQHADLCWXQLEDGAPGRYNXKKXHLNWPLVVDEICETSRTYSTRHMKVRQQESRHYF

SEQ ID NO: 197702 - protein, 113 aa, Triticum aestivum
  unsure (1)..(113): unsure at all Xaa locations
  Clone ID: PAT_TA_92120.pep
AARILQRDHGINVNLTLMFSQVQAIAAAEAGTFLISPFVGRILDWYKAKTGKTYSKEEDPGVELLRKYSDYYKKLGYKTIRHGCLIQEILGEITELAXGCDYLTSLPNLLEEF

SEQ ID NO: 197703 - protein, 83 aa, Triticum aestivum
  Clone ID: PAT_TA_92121.pep
GNNRSVMPLDVLGRTRATLTEPTEFPPWSKDLGNLVKLCRAGDRALQLLLFNEEFLVSASHQLALITSLPFVHTAQKKKKKNS

SEQ ID NO: 197704 - protein, 56 aa, Triticum aestivum
  Clone ID: PAT_TA_92122.pep
YMALCLPNTNSLGLVCYISAHLLLCSRLLVALGARWFRAGPSHCGVLLASCRIRHE

SEQ ID NO: 197705 - protein, 205 aa, Triticum aestivum
  unsure (1)..(205): unsure at all Xaa locations
  Clone ID: PAT_TA_92123.pep
AIPYFTKSLLSSTVTNRPPSTSRQIIISRTRDTHTTRATLCSVCHDSAGRFEATSLLSFLGFGWTSPFPTWSSLLAYPSRRLPPAALILVFRGAFLPWSWSXXASEQASASRALRLGRIRTRHVRRRHSSRATXSDXPNXGAVTRGIPATLXAXTHRTQWQSSXARXXRSTFKWXVGXKIXXRRAKPHNXSXXXQGPXXXRPXPX

SEQ ID NO: 197706 - protein, 145 aa, Triticum aestivum
  unsure (1)..(145): unsure at all Xaa locations
  Clone ID: PAT_TA_92124.pep
PYGNQIDSKHGTFILQLPKGRPPAPDPQPEALLGGLRHHHRLHRAAPPPAATSAVXXLRRRDSXPTXKRLNXTDPGSPDFCQXPCRNFKDDTKXPVXXAPGYSLXLLSLXPXSGCLLFAAFSXYPXKDTRTWLWAPLGKPRQLXA

SEQ ID NO: 197707 - protein, 81 aa, Triticum aestivum
  unsure (1)..(81): unsure at all Xaa locations
  Clone ID: PAT_TA_92125.pep
SHPSTSSGWRQLTGFNIMLGQVPTLPPXLEXNLXGXCQPTXLKAIPVFNRTVFXLPLGXXNKLPLKQVSGIPLDFGXLYAN

SEQ ID NO: 197708 - protein, 149 aa, Triticum aestivum
  unsure (1)..(149): unsure at all Xaa locations
  Clone ID: PAT_TA_92126.pep
MNEADECVNKLETFKSFKILGFIPTDQHKKYLAMGESCITVAQPVNDRSQLAISSLVHALLELESYAIARIVLKNGAEPGIVLLAPYVEQGXXGGSCHVPFPFSEDSYLSISQFEKEQAQAEFKNRGNHLIARDKEQFKIRHLGFRLFK

SEQ ID NO: 197709 - protein, 91 aa, Triticum aestivum
  unsure (1)..(91): unsure at all Xaa locations
  Clone ID: PAT_TA_92127.pep
NHTQLRISVVTALISPSSGSLRDKPITXITVKGXAFFQGDXRFYIRGIDYQPGGSSKLVDPIADETSCKRDIAKFKELGVNTVRIYLXPNS

SEQ ID NO: 197710 - protein, 125 aa, Triticum aestivum
  Clone ID: PAT_TA_92128.pep
TIEIMCGRYVLALKPPEIREVFRNNGMNIELAPEDTVGHTPEITYNLAPGNHGLVLVPWKHYSSKDDPSSKKNLFVQGDASMNKEVSESNKVNYHLQTMKWGFRPNVVIKEFCNWVRVLHSINCR

SEQ ID NO: 197711 - protein, 73 aa, Triticum aestivum
  unsure (1)..(73): unsure at all Xaa locations
  Clone ID: PAT_TA_92129.pep
WITFPPRDHYQXSLTKAGSDRRLESLSTPHWVQFGLACLDFRILHSYESTLLSRLKIIFSWSSSIDSCNLWPD

SEQ ID NO: 197712 - protein, 67 aa, Triticum aestivum
  Clone ID: PAT_TA_92130.pep
FKRIPSKVSLDEMERSQSYIGVGETELKNPTSYALNTTRTLSSDSGREVAALCAVGAAVLFAAALVC

SEQ ID NO: 197713 - protein, 110 aa, Triticum aestivum
  unsure (1)..(110): unsure at all Xaa locations
  Clone ID: PAT_TA_92131.pep
ERTSLQDRDPHQTMSGRIIPIRRTSQSGXQDFIIDXNPTSXPGSPXIITHTASINSKNXSNMNXTMSXXXTXXTTEQIXTGXHRITKSFXSGTGTXPTKKPPKPXWPNLE

SEQ ID NO: 197714 - protein, 53 aa, Triticum aestivum
  Clone ID: PAT_TA_92132.pep
RPTPRCQQKLISSRVFYNSSLHTYIFYVRRSATFNRHLINLCRIIQSDVPLKP

SEQ ID NO: 197715 - protein, 113 aa, Triticum aestivum
  unsure (1)..(113): unsure at all Xaa locations
  Clone ID: PAT_TA_92133.pep
RAEFGTRFREEFKQKNPKNKSVAAVGKAAGERWKSLSESEKAPYVAKANKLKGEYNKAIAAYNKGESAAAAAPKKAAAKEVEEEDEEESDKSKSEINDDDDDXGSDXDXDDDE

SEQ ID NO: 197716 - protein, 118 aa, Triticum aestivum
  unsure (1)..(118): unsure at all Xaa locations
  Clone ID: PAT_TA_92134.pep
MIMTSGKLLVGLSLAFSAVTAGTFNTAIEQRVQRTTISNQWRNNVEISSPLYPANYLSVPIDHFHNDSLYEPHTEEMFNLRYWFDATYYKARWSCYRLQAGETDGSGRLQYLXKGSTS

SEQ ID NO: 197717 - protein, 151 aa, Triticum aestivum
  unsure (1)..(151): unsure at all Xaa locations
  Clone ID: PAT_TA_92135.pep
MSLSLLNLSACRPLITSSGGTARAATATLSADRVLLCPRIIWRGVKAGWYTGPKRGAKPLNYNLGSGLPQLTQSPDAALARLDHSLPRRXGVLAIKKAXSLHNPETSRRTTCTCCKWXGQVXAHKTREQHGYYAVQSXVVEAADKSALLGT

SEQ ID NO: 197718 - protein, 156 aa, Triticum aestivum
  unsure (1)..(156): unsure at all Xaa locations
  Clone ID: PAT_TA_92136.pep
RAEFGTSSDPPGPQSNGRRSGSRRGILPCPLHFPAPSPLPSHPHPPTPPSRQQDPDALPEATPPPASPXASSSSPPPPEDAXQPTPSSSPSPAPPRTRXRXTNPTPKPPPPPPSPSPPRQPSAKESGSKEAFNGWSKGTETGKDWVPGFNRSAKLQ

SEQ ID NO: 197719 - protein, 96 aa, Triticum aestivum
  unsure (1)..(96): unsure at all Xaa locations
  Clone ID: PAT_TA_92137.pep
MMPYSSRPLPSHLRHVSNTSNFTLSGQSPKLLARIEEKKLELANLKQLRDLSASLAQQMQSLXEKLATLTDGXTEAVATVLSNWXYVLKAINMASE

SEQ ID NO: 197720 - protein, 127 aa, Triticum aestivum
  unsure (1)..(127): unsure at all Xaa locations
  Clone ID: PAT_TA_92138.pep
NQLLFSARLETVSGGYXATATXWAGSVDXRVRKYDXAMXKVVTDVIGSXVTSLKKTKDGRGXLVGSLDNQIRLMDAETGGLLKSYRAEGWKNDQFRMRGCFGARERWVMCGNEEVEGPDGQVIVWDT

SEQ ID NO: 197721 - protein, 185 aa, Triticum aestivum
  unsure (1)..(185): unsure at all Xaa locations
  Clone ID: PAT_TA_92139.pep
RQSLRGQAVVLMGKNTMVRRAIKGFISDAPEYECLLPYVKGNVGFVFTNSDLKEIRDKILANKVAAPARAGAVAPADVFVPAGNTGMEPGKTSFFQALGVPTKIARGTIEITTELKLVEAGNKVGASEATLLNMLNISPFTYGMGISXYDKXNTFPPNVLDIGEXNLKPCCSHSCTALRIHCIIL

SEQ ID NO: 197722 - protein, 89 aa, Triticum aestivum; identical to SEQ ID NO: 130083
  Clone ID: PAT_TA_92140.pep

SEQ ID NO: 197723 - protein, 63 aa, Triticum aestivum
  unsure (1)..(63): unsure at all Xaa locations
  Clone ID: PAT_TA_92141.pep
NLLLWLCWMGDEMLMSKWDGHYNWASTLVHMRIHISXENVCGDXIPWIXTYINSGXPXXLPWG

SEQ ID NO: 197724 - protein, 125 aa, Triticum aestivum
  unsure (1)..(125): unsure at all Xaa locations
  Clone ID: PAT_TA_92142.pep
IRLVALFVPLEGIAPRSPTDLKHGACAALPQACGRSLLQLPRAIRASPLQRLNRFQRPHWNXSLPLPGFCNRPWALRHGGXLTXIWXNSDXLWGXXWLXPTLGXLXMEGVXGXXGRNXHWIXKGR

SEQ ID NO: 197725 - protein, 55 aa, Triticum aestivum
  Clone ID: PAT_TA_92143.pep
LVPNSARVNSSYKKNNYEENNDPSVNDVVERIDSGNYQSKSKYRFCSHVYLNNLT

SEQ ID NO: 197726 - protein, 59 aa, Triticum aestivum
  Clone ID: PAT_TA_92144.pep
FFFCTLQYIFSTVSVITEPECFKKKPLSLSGLSDCRSNHCQPLTQSVRRRIYHVCLGVE

SEQ ID NO: 197727 - protein, 168 aa, Triticum aestivum
  unsure (1)..(168): unsure at all Xaa locations
  Clone ID: PAT_TA_92145.pep
MRLIDLSALSVLVNDRPGTICWIVLCFEGSRISIPGCITTKELGTVMRSLGQNPTEAELQDMINEVDADGNGTIXDFPEFLNLMARKMKDTDXEEELKEAFRVFDKDQNXFISAAELRHVMTNLGEKLTDEXVDEMVREADVDGDGXINYDELLKHDGNKFITSEGTQ

SEQ ID NO: 197728 - protein, 69 aa, Triticum aestivum
  Clone ID: PAT_TA_92146.pep
QIMRELRAENVLFFHPHSAHVISWLEIASYIESGESSGAMYVYEASWMFSSSQIRKIIELNLTTAKKKK

SEQ ID NO: 197729 - protein, 61 aa, Triticum aestivum
  unsure (1)..(61): unsure at all Xaa locations
  Clone ID: PAT_TA_92147.pep
GTKCGESKSSTYPIRKLISLXARMNLSSGLTNYSFNERWRIQDGRHVLIILRXXAMCSKFR

SEQ ID NO: 197730 - protein, 60 aa, Triticum aestivum
  unsure (1)..(60): unsure at all Xaa locations
  Clone ID: PAT_TA_92148.pep
WKXPKXPXHXXAIAPSARCRLIYPHXRFSPVFETEVVSLVSLEAPTFAFAIRSGALVVFR

SEQ ID NO: 197731 - protein, 84 aa, Triticum aestivum
  unsure (1)..(84): unsure at all Xaa locations
  Clone ID: PAT_TA_92149.pep
LVPNSARDRKQKKSTEGSTLCANISSDSAHEGLQKPPIKNMYEGSDPKQKGFTGGQSCFKGTEQRNEPXEAAVTPQGLQPQHAI

SEQ ID NO: 197732 - protein, 65 aa, Triticum aestivum
  unsure (1)..(65): unsure at all Xaa locations
  Clone ID: PAT_TA_92150.pep
NIWKNNFEKQFDPITXILXKSKLNFCETSNSLKLXLEXLKASWXQGQVKQGXXWCIXHGCTXNDL

SEQ ID NO: 197733 - protein, 158 aa, Triticum aestivum
  unsure (1)..(158): unsure at all Xaa locations
  Clone ID: PAT_TA_92151.pep
MAPTVMASSXTSVAPFQGLKSTAXLPVSRRSNGASLGSVSNGGRIRCMQVWPIEGIKKFETLSYLPPLXTEALLKQVDYLIRSXWVPCLXFXKXGXIFREXXASPGXQRMXGLENWNLXFWXEXAPKRXNXVEEXKRVPXAFSHRFNKVSRLSTGARA

SEQ ID NO: 197734 - protein, 147 aa, Triticum aestivum
  unsure (1)..(147): unsure at all Xaa locations
  Clone ID: PAT_TA_92152.pep
MPARPPAPAASQQLAPQKSLTLDFTKPSKAPAAAAAASVTSTSFFSSVTAGGEGSVSKGPGQLVSSGKPPLAAGTKRKQQQQQTPCASGAHSDVAAAAAGGRCHCSKKRKHRVKYTRXPAVSSRTXESPGKTLVGKYGKHQGSLTRT

SEQ ID NO: 197735 - protein, 62 aa, Triticum aestivum
  unsure (1)..(62): unsure at all Xaa locations
  Clone ID: PAT_TA_92153.pep
LVPNSARARAEFGTSTNTSTDRSRFKATGSNGXXXGAGAAXLXGXPVRAXREHXAGREGPXL

SEQ ID NO: 197736 - protein, 127 aa, Triticum aestivum
  unsure (1)..(127): unsure at all Xaa locations
  Clone ID: PAT_TA_92154.pep
MDMLKIKIPMESTDHLLFLPINTLGYTAIETKMNPHPTSSNPYRPVGDFLSNISSFKIIESTLREGEQFANAFFDTXEKIEIAKVSDDFGVDYIELTSPAXSEQSRADCEXICKLGLKAKIYNIAAG

SEQ ID NO: 197737 - protein, 81 aa, Triticum aestivum
  unsure (1)..(81): unsure at all Xaa locations
  Clone ID: PAT_TA_92155.pep
IDXNLXKIKNVXAVXEAHLXXSKXLXGXSXSLADLNHVSVTLXLXXTPYXSXFDAXXHXXAWXTDLLARPSVXNVAELMKT

SEQ ID NO: 197738 - protein, 109 aa, Triticum aestivum
  unsure (1)..(109): unsure at all Xaa locations
  Clone ID: PAT_TA_92156.pep
ESFSANFACSLRRKGDDTRALGDELCLKLAXELXLLLXRVKQGXNMRSLPCRYXTXGEVGLGXNXPXPPXXXAFLXXNXFTXARXLXAXSXXKPRGRYNXXRTITAKAC

SEQ ID NO: 197739 - protein, 94 aa, Triticum aestivum
  unsure (1)..(94): unsure at all Xaa locations
  Clone ID: PAT_TA_92157.pep
MVVNTVTSLDEYRKLTKNHEHIIIRFTAAWCGPCRMIAPDFESLSNDXKDIHFISVDXDXSPELSTEFGXHSHANVCVXXDGXQHXEFRERTVF

SEQ ID NO: 197740 - protein, 83 aa, Triticum aestivum
  unsure (1)..(83): unsure at all Xaa locations
  Clone ID: PAT_TA_92158.pep
RLLSRLQILAQXSKQSLIIANMVTVNIRSDIKDPFYRXKMRETSSPKXKAXVXXIKTVIRQPSVVLHXHLXRPGSICDXVLWV

SEQ ID NO: 197741 - protein, 167 aa, Triticum aestivum
  unsure (1)..(167): unsure at all Xaa locations
  Clone ID: PAT_TA_92159.pep
SCRIRHEISSIPAIPIEKQAFYVHTIFDPLFSEIEKNLAQAKSGNLQAVQQIHHVIMALGTFSHGFSESLPKNTVIANHVPXRSLSEQFGRAAEAILIALEALXSSFEIRTAAKASAFXRLKGVLGADMLPFLPRWSMAPNMVSGMPYPKLTSQLIWVQERLTCLGK

SEQ ID NO: 197742 - protein, 113 aa, Triticum aestivum
  unsure (1)..(113): unsure at all Xaa locations
  Clone ID: PAT_TA_92160.pep
MARTXQTARKSTGGXAXXKQLATKAARXSXPTTGXVXKPHRYRPGXVXLREIRXYQKSXXLXIXKLPFQHLVCEIAXDFXTXLXXSXXNAVAGLQXXXEAYXXGLFXDXNLWH

SEQ ID NO: 197743 - protein, 85 aa, Triticum aestivum
  unsure (1)..(85): unsure at all Xaa locations
  Clone ID: PAT_TA_92161.pep
SYPPCLTCRXXPLVXWVXXVFXISXICTAXAARXXTXFTPRXPVNCXAXTAFRGDPASSWVXSGISPLTTTHPLILQHQSVRTSA

SEQ ID NO: 197744 - protein, 128 aa, Triticum aestivum
  unsure (1)..(128): unsure at all Xaa locations
  Clone ID: PAT_TA_92162.pep
PATDCLEPKLPPDEKKISNEVTEDEEELFKFSPEKEASLLEETNVLKLRANDLFAQNAFTQAIEIYDQAVSICPNYRHYEVSVLKSNTAACHLKXEKWKEAAKLATDSLXAVRKVLISGGEESASEPW

SEQ ID NO: 197745 - protein, 72 aa, Triticum aestivum
  unsure (1)..(72): unsure at all Xaa locations
  Clone ID: PAT_TA_92163.pep
SCRIRHESMRGQLFSYAILGFAFVEAIGLVDLMVAMMCXYVILRWNFPCLIYSRLVASGIGTVTDIGCVIYC

SEQ ID NO: 197746 - protein, 46 aa, Triticum aestivum
  unsure (1)..(46): unsure at all Xaa locations
  Clone ID: PAT_TA_92164.pep
SEFFFFFFFFFFFFFFFFFFFFFFFWXKPVFSFFXXPXXARQQKSE

SEQ ID NO: 197747 - protein, 106 aa, Triticum aestivum
  unsure (1)..(106): unsure at all Xaa locations
  Clone ID: PAT_TA_92165.pep
MVVGQYRRLCHPFPPRSLARPDXFSRRVPRGDSNASADAPXFFPFGLGPRVCIGQTSRCWSQDGLAIIXRRFSFQLSXXYTHAPFPVGLLQPQHGAQLRLKTLAQM

SEQ ID NO: 197748 - protein, 123 aa, Triticum aestivum
  unsure (1)..(123): unsure at all Xaa locations
  Clone ID: PAT_TA_92166.pep
KDPKXKXGTTYLGGSNTHIXIHIYASIKNGCIXFFEQXRVXTGALPLSCDATNTVFFRITFYPPLYARFGCLPSPSSSSHQRYISTARRRRRRHRSSSARRNWEEKPAALQLQFPGGPLVGLV

SEQ ID NO: 197749 - protein, 95 aa, Triticum aestivum
  unsure (1)..(95): unsure at all Xaa locations
  Clone ID: PAT_TA_92167.pep
ISDLFXPSDAKLAIGSFFXXKXKKGGPVPIALKGAIXAPWPXLXXRTGNLGYQLXPEKPLRNAYTXGEXSSXXQLRKGXXXEXXGVXSXVLNSAW

SEQ ID NO: 197750 - protein, 147 aa, Triticum aestivum
  unsure (1)..(147): unsure at all Xaa locations
  Clone ID: PAT_TA_92168.pep
SLPLLAPSLSPRLQGWPSSPAASSLPPVPPRCGFPLPPSIVDAPHAKVPAERRQLFSASFLARLRELLVAESVPLQAWQHCDLLAPPSPXAGRWSGTLIPKDYSRTSIQILEDVSTHSISNTXNIRTQDMLSGCLKVSVKXLGLHVA

SEQ ID NO: 197751 - protein, 74 aa, Triticum aestivum
  Clone ID: PAT_TA_92169.pep
QSPKLYQASVIAPVNIAVVKYWGKRDSVLNLPCNSSISVTLSQDDLRTHTTASCSPAYDTKDNLVLNSAQEDIT

SEQ ID NO: 197752 - protein, 146 aa, Triticum aestivum
  unsure (1)..(146): unsure at all Xaa locations
  Clone ID: PAT_TA_92170.pep
NDASYFMLVLALFPLVYIIRFYYLASSRCHNRGLRLPPGPWQLPVFGSLHHLFGALPHRALRDLSRRHGPLMLLMFGXTSGIVVSTAEAAKEMMKXTHDTTFCARQLTSXLKGISNMAGLLPRTVTLGGNAFPTAANDRSGQSGRG

SEQ ID NO: 197753 - protein, 169 aa, Triticum aestivum
  unsure (1)..(169): unsure at all Xaa locations
  Clone ID: PAT_TA_92171.pep
ATSKRTNNPQVKERQAKITAEMYNRQSEFPVRIAAQQKSLNLPLFPTTTIGSFPQTSEIRIQRNKFAKGQITKAEYEKFIEKEIEEVVRVQEESDLDVLVHGEPXERNDMVXYXGXQXXGYAFTTHGMXQPYGLVASPPXLVGXIRPXTMTVXGQNTCSPTTKAFAGQY

SEQ ID NO: 197754 - protein, 131 aa, Triticum aestivum
  Clone ID: PAT_TA_92172.pep
KNSQILEREFQKLQDTGMKNSVKFDLDKTELIHFAKTKEAKECQMALPSGGKLSPSTVIKWLGVWFDQKLTFKQHITARVAQAKAAFQRMARLTNTERGLSHIAMRQLYLACVITISDYASPVWVEKAAVF

SEQ ID NO: 197755 - protein, 82 aa, Triticum aestivum
  unsure (1)..(82): unsure at all Xaa locations
  Clone ID: PAT_TA_92173.pep
XRCXSFPSLLLXIXEGLAAHGRSSPSSPPTPPRTKKPREPWXRSTPWSPRASASPLRSXXPXXPPPPQXGSPSTGRXFLFIR

SEQ ID NO: 197756 - protein, 75 aa, Triticum aestivum
  unsure (1)..(75): unsure at all Xaa locations
  Clone ID: PAT_TA_92174.pep
HLATRLLPQKSRLKQHNYLLLVSALLXLSLKMWIXALHKMCNFYCFSRPRHXXRFEAXMGDQSKLXASELVKLAL

SEQ ID NO: 197757 - protein, 137 aa, Triticum aestivum
  Clone ID: PAT_TA_92175.pep
GRLRRFRRPPLWRRGHPPHRTAPGTASPLDQGLEVAGPSYFFPDVDRHCRCTELVALLCPTLPLTSWFFIVSIESGNEGYYEFDPQLHQDVDQEDIDECKRSEDYGCFGQCTNTVGSFQCHCQQGTSGDPIPWWLLQ

SEQ ID NO: 197758 - protein, 129 aa, Triticum aestivum
  unsure (1)..(129): unsure at all Xaa locations
  Clone ID: PAT_TA_92176.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYXLIDITDDGYVSLLTESGXTKDDLKLPLMMFAWIKDC

SEQ ID NO: 197759 - protein, 89 aa, Triticum aestivum
  unsure (1)..(89): unsure at all Xaa locations
  Clone ID: PAT_TA_92177.pep
RLTQYTWNKXXKNXLKXXXKKTPGGAGTNSPIVIXLXRSRPRLNSDXKXXYQLXLQKPLPTGYXKADVASXXPLCMXPXRITGLVPLLF

SEQ ID NO: 197760 - protein, 127 aa, Triticum aestivum
  unsure (1)..(127): unsure at all Xaa locations
  Clone ID: PAT_TA_92178.pep
LVPNSARARAEFGTSRNSADTTIYSIEKSVSEYKDXVPAEVVTEIQSAVSDLRAAXAGDDSDAIKQKLEAANKAVSKIGQHMQGGGGAAGGDSGSSGGGDQTPGLNRTPRPRCRFGLHQSSFFAYPV

SEQ ID NO: 197761 - protein, 116 aa, Triticum aestivum
  unsure (1)..(116): unsure at all Xaa locations
  Clone ID: PAT_TA_92179.pep
MSHLLQKLLPETLPRAWLFLFLFFLVVSVQYWITEKFGAKRRQRLPPSPPALPIIGHLHLIGSLPHVSLRSLXRKHXPDVMLLHLGXVPNLVVSSSXAAEAVLRTHDNSXINGPIP

SEQ ID NO: 197762 - protein, 86 aa, Triticum aestivum
  unsure (1)..(86): unsure at all Xaa locations
  Clone ID: PAT_TA_92180.pep
ADQPVILHMLDIEFAAEALKGVKMELIDAAFPLLKGVVATTDVVEGXCLGVNVAVMVGGIPQGGKEWEXXXVMTKNXSILQAQXNR

SEQ ID NO: 197763 - protein, 209 aa, Triticum aestivum
  unsure (1)..(209): unsure at all Xaa locations
  Clone ID: PAT_TA_92181.pep
LAGDSRLXSVCXLSCATVXWPLVLVRRFSXWNPSPGXXVXXXPVLDAGVAHLPGGHVHLRWGVHPLSRRSSWSCHLRHXAAARRRAVPIEETCLLFDKHWYWKRVVTQGPKYPGHHQRQEMAAAASRRQARRHVGIDRYMMRVLIRFTMHWCIGRARNCLCVFLSKDLIRVLTSYASSIRIRSVGRCNWWQRSDAKACKFMCDKKKKKK

SEQ ID NO: 197764 - protein, 86 aa, Triticum aestivum
  unsure (1)..(86): unsure at all Xaa locations
  Clone ID: PAT_TA_92182.pep
FFFFFFFFEFYYFIINHILXPXXRLLFGYSSEPPAGKYLPNPAPSSSDFNPLTQPLKPAXSPSQVXPVXELEXQGDDPTFXXVVGS

SEQ ID NO: 197765 - protein, 68 aa, Triticum aestivum
  unsure (1)..(68): unsure at all Xaa locations
  Clone ID: PAT_TA_92183.pep
SLSCPSXRNVSHFSVDMXEKKEXRIALLGWEWLXPSXDXRXLRXNPLIXGXLSSRRXXAXVRIHVAYS

SEQ ID NO: 197766 - protein, 108 aa, Triticum aestivum
  unsure (1)..(108): unsure at all Xaa locations
  Clone ID: PAT_TA_92184.pep
MGLIKFIMNHPISSKLILGMRQLAPLSTSTRAMAAGDTGSPKVGGSASADAFTQREKSNEDFHIRSREREKLLELQKTYLKTHDHYVDXEEHLDELFNMDPGQGGGKS

SEQ ID NO: 197767 - protein, 139 aa, Triticum aestivum
  unsure (1)..(139): unsure at all Xaa locations
  Clone ID: PAT_TA_92185.pep
MVSLKLQKRLASSVLKCGKGKVWLDPNEVNEISMANSRQNIRKLVKDGFIIRKPQKIHSRSRARRAHEAKQNGRHSXGYGKRRGTXREAXLPTKILWMRRMRVLRRLLRKYREXXXIDXHVHDMYXKGKGNMFKNXRAS

SEQ ID NO: 197768 - protein, 97 aa, Triticum aestivum
  unsure (1)..(97): unsure at all Xaa locations
  Clone ID: PAT_TA_92186.pep
RRGRTRLRLLVFLLVIIASSAGIAAYWGTTPERWEGYVVLVPAWLLGTLGIQLMVPAARAPKVWGVPLVPWLPSLXIATNLFXMGSLGSEAFVRFGV

SEQ ID NO: 197769 - protein, 105 aa, Triticum aestivum
  unsure (1)..(105): unsure at all Xaa locations
  Clone ID: PAT_TA_92187.pep
MDAAVERLKXGFEKFKTEVYDKKPDFFEPLKXGQXAPKYMVFACADSRVCPSVTLGLXPGEAFTICNIANMVXVILQGTSTLXVGSXIXYPSVSCHRGDWHRAVR

SEQ ID NO: 197770 - protein, 81 aa, Triticum aestivum
  unsure (1)..(81): unsure at all Xaa locations
  Clone ID: PAT_TA_92188.pep
MAMTAASSRHHLLLLLWLCADAXTAWAHGGGGDDDXDSGXXDADGGEKPDLRAPGLLAVXLXCLXLVFXXTLAGGVSPYFM

SEQ ID NO: 197771 - protein, 51 aa, Triticum aestivum
  unsure (1)..(51): unsure at all Xaa locations
  Clone ID: PAT_TA_92189.pep
SVNPLMSQSDDTHTSRQXLXASGLPXWRSXPXLEFRXGXRXLXVSXFXPXX

SEQ ID NO: 197772 - protein, 120 aa, Triticum aestivum
  unsure (1)..(120): unsure at all Xaa locations
  Clone ID: PAT_TA_92190.pep
FFFFFFYKVGAGKPDPPKQHEIIDTGGGSTTRNEVPHSFTLCNDPSAGSPTETLLRLLLPLNDQVWTTFRXQGECYHSPRASPKASLSHSIGXSSDGRCVXRAGTXSAQXDDLRLLXIPR

SEQ ID NO: 197773 - protein, 143 aa, Triticum aestivum
  unsure (1)..(143): unsure at all Xaa locations
  Clone ID: PAT_TA_92191.pep
MVLXYSIPPLPYAYDALXPHIXGXIMXIHHTKHHQTYVNNLNNALETLDALTXSSDIVSHLHLQAAIXFNAGGHIXHTLFWENLSPSTSTTAXVSSSPXXSXXALAVXWGXSVXRFXXRLLXVLLGLXGSGWXWXLRHRGLKS

SEQ ID NO: 197774 - protein, 128 aa, Triticum aestivum
  Clone ID: PAT_TA_92192.pep
MGSGHFPEEGFGKASYIKNIHVVDSFDNLEPLSDVQVIATQKNCYNAENGFSSDMGTYIYYGGAGWERTPIAHEDHPLSNVTLFLHYYWAKYVLLRVYTIAIICVAMYGLVCSSVVWYDALKSENGHI

SEQ ID NO: 197775 - protein, 49 aa, Triticum aestivum
  Clone ID: PAT_TA_92193.pep
RAEFGTSLKATFVAVSNTYGYLTPNLWKETKLIRSPLEEFGDVLRASKR

SEQ ID NO: 197776 - protein, 95 aa, Triticum aestivum
  unsure (1)..(95): unsure at all Xaa locations
  Clone ID: PAT_TA_92194.pep
KSPQFCPPSKECPSACFMLLPIFLIXHLATSFLWTVNDFXDPXKXXQGXXXGSYHSIPXEXXIPLSQSXTRXKQFXVCQGYLNYLIXQRXXQXIX

SEQ ID NO: 197777 - protein, 114 aa, Triticum aestivum
  unsure (1)..(114): unsure at all Xaa locations
  Clone ID: PAT_TA_92195.pep
NILPXPRSSRESGWDEFYLTDFGLEGVALDILVEKSVGRDFTAGTKLHRSSSPLTYDSRXGFRFIWWSVFKHPTSLKLXLYLRXXIXQSILXLRPTXIPVRXLTYTXPNDHXHM

SEQ ID NO: 197778 - protein, 127 aa, Triticum aestivum
  unsure (1)..(127): unsure at all Xaa locations
  Clone ID: PAT_TA_92196.pep
LTPGATPVLPPSPWRTPRXPPRPPPPPRRWPPXPRRPSTSSFSASSFSCSRLRLRRRPSPTRRRSSCRXRPCPASRPXSXXXPLXPXNXIXXXQTXXSQAXNPXQXHSEGXRXXXRPXXXRAXXXSR

SEQ ID NO: 197779 - protein, 138 aa, Triticum aestivum
  unsure (1)..(138): unsure at all Xaa locations
  Clone ID: PAT_TA_92197.pep
MSLSNKLSITDVDLKGKRVLIRVDFNVPLDSALKVTNTQRIAGATPTIKYAIENGCKSVILMSHLGRPDGKVQPKYSLKPVVPELEALLGRSVEFASDCVGPXVEDIVNKAQXGQVVLLENXRFHLKEEGSTRTRWNK

SEQ ID NO: 197780 - protein, 82 aa, Triticum aestivum
  unsure (1)..(82): unsure at all Xaa locations
  Clone ID: PAT_TA_92198.pep
MSFMPINPRPMLQNLVNEEVIIRLKWGQTEYKGRLVSTDSYMNIQLSGAEEWIDQQMTSVLGQVLIXCNNVLWIQGVNQNSG

SEQ ID NO: 197781 - protein, 150 aa, Triticum aestivum
  unsure (1)..(150): unsure at all Xaa locations
  Clone ID: PAT_TA_92199.pep
PRPPPDFPHLPQAIQAASPPSRRPDPHRPETPTPLPEQEAPPVRNRAAVRXYREKKKEHTAVLQEEAARLRAMNEQLTKKVQDHAALEAEAARLRCLLVDVRGRIEGEIGAFPYQRRPAKGDGPGSAGPVMMSSCGFVRTCEQPPVCFHH

SEQ ID NO: 197782 - protein, 142 aa, Triticum aestivum
  unsure (1)..(142): unsure at all Xaa locations
  Clone ID: PAT_TA_92200.pep
MAPTVMASSATSVAPFQGLKSTAGLPVSRRSNGASLGSVSNGGRIRCMQVWPIEGIKKFETLSYLPPLSTEALLKQVDYLIRSKWVPCLXFSKVGXXFREHNASPGYYDGRYWTMWXXPMFGCTDPXGXNEVEEVXKEYLCR

SEQ ID NO: 197783 - protein, 122 aa, Triticum aestivum
  Clone ID: PAT_TA_92201.pep
SCRIRHELSFSTTKPWQRENESYTSINAAAQVGNPTSVYEYWASLLRLRKTYKDVLVYGDFQLIDSDNDNIFAYLRTSTDKKVLVLANFRPFNVTWKKPDGLGALGPILIENETTRYQKASA

SEQ ID NO: 197784 - protein, 71 aa, Triticum aestivum
  unsure (1)..(71): unsure at all Xaa locations
  Clone ID: PAT_TA_92202.pep
SCRIRXEXSCSLXSLIHLXLXXAXXXAVRNSVMSLLCIFXFVLHXVPLPXCDGNXNLXHSXRRILSXHLXL

SEQ ID NO: 197785 - protein, 174 aa, Triticum aestivum
  unsure (1)..(174): unsure at all Xaa locations
  Clone ID: PAT_TA_92203.pep
MRRSQELYFILELFQKMVQQGVRPNVVTFSAILNACSRCNNFEDAALLLEQLRLFDNFVYGVAYGLLMGYQEIGSASTALFNQLXDAWDLQTSSAFYNALTXDMLWHFGQEARTQLXAPKGXRRVWENTWSXLLGLHLCHGCNSNNGQHGPKSCSKTHPIQHRWEQMRKLHYKI

SEQ ID NO: 197786 - protein, 141 aa, Triticum aestivum
  unsure (1)..(141): unsure at all Xaa locations
  Clone ID: PAT_TA_92204.pep
MAPTVMASSATSVAPFQGLKSTAGLPVSRRSNGASLGSVSNGGRIRCMQVWPIEGIKKFETLSYLPPLKHXGLLKXVDYLXSAPKWVPCLEFKQGGXTSREHNASPGVYDGRYWAMWKLPMFRCTDPTRXXQVEEARGYLT

SEQ ID NO: 197787 - protein, 96 aa, Triticum aestivum
  unsure (1)..(96): unsure at all Xaa locations
  Clone ID: PAT_TA_92205.pep
ARSTXHTXRFXEVXHLNXQXSTTSGNLSAXASQSITAXPTEXTXGXFYKHQGVXXTXFXRPKXXSXQLXGLFAKXXXSXETSQVPXXRIHXXXKKF

SEQ ID NO: 197788 - protein, 80 aa, Triticum aestivum
  unsure (1)..(80): unsure at all Xaa locations
  Clone ID: PAT_TA_92206.pep
GHPVEXQXITDXGGXXVXAXXDSXCXALLCIXXTMPXXXAKLSYATRTXTKMLNKANATAHVDXXIPLVSTFCLLTXYVN

SEQ ID NO: 197789 - protein, 78 aa, Triticum aestivum
  unsure (1)..(78): unsure at all Xaa locations
  Clone ID: PAT_TA_92207.pep
SXRTXXSSPXPXPWPATLTGXSXXPLXLYXIRXPAVDGSTNWPTXRSTXETGCXGRRRRGRRRXGERTEELAGGRLVG

SEQ ID NO: 197790 - protein, 147 aa, Triticum aestivum
  unsure (1)..(147): unsure at all Xaa locations
  Clone ID: PAT_TA_92208.pep
MLLLMETAHSPCNAPGSSIDFSETPFXXPXALXQKELEALRDXWTKTFEGFIRISKSPAXAPVLFVKKSNGDLRFCIDYRGLNAISVRNRCSLPLITETLCQLSRAKXYTKLDIISAFNKLRIKEGDEWKAAFTCRYGLFEPLVLSL

SEQ ID NO: 197791 - protein, 43 aa, Triticum aestivum
  unsure (1)..(43): unsure at all Xaa locations
  Clone ID: PAT_TA_92209.pep
SCRIRHEAASLSLPLSXTHPSISCXXYPLLXVXIIVXIAHIFA

SEQ ID NO: 197792 - protein, 87 aa, Triticum aestivum
  unsure (1)..(87): unsure at all Xaa locations
  Clone ID: PAT_TA_92210.pep
SCRIRHERISTSGDVYSFGIVLLEMLTGKRPTDPMFMDGLDIXXFXGNRFPXXIHEVIDIYLXGRVRVFSSASVSLLVSSCTHSIPR

SEQ ID NO: 197793 - protein, 116 aa, Triticum aestivum
  unsure (1)..(116): unsure at all Xaa locations
  Clone ID: PAT_TA_92211.pep
MAPKAEKKPAAKKPVEEEPAAEKAEKAPAGKKPKAEKRLPAAGKTSAKDGDKKAKKKSKKSVETYKIYIFKVLKQVHPDIGISSKGMSIMNSFINDIFXKLXGXAXKIARYNXKPX

SEQ ID NO: 197794 - protein, 145 aa, Triticum aestivum
  unsure (1)..(145): unsure at all Xaa locations
  Clone ID: PAT_TA_92212.pep
XSPAXRCVGEGGSRDEXDQXTXXGEDQXXLXGGIXSSXSLRLXPRSAAGXHRRWREAVDRAPXPISRRPLLPFSPFDRGSSARSPQSPASIWWWLSGGRQRGXGEQQVGDQGRQQGGMASDLLFFFLPSIPLFLPDSISCRIRHE

SEQ ID NO: 197795 - protein, 50 aa, Triticum aestivum
  unsure (1)..(50): unsure at all Xaa locations
  Clone ID: PAT_TA_92213.pep
QDCGLHYEVVHXHLXXLHNSNNGRRVLYSSEPLMNDWAAKSAXAAKINDY

SEQ ID NO: 197796 - protein, 148 aa, Triticum aestivum
  unsure (1)..(148): unsure at all Xaa locations
  Clone ID: PAT_TA_92214.pep
IASTKSNEPSKLNCVSTPTSPPPAQNQSNTQTKKKRSNGKPKKPPPSGFEEFYADTPITPSDYAVERDLYDPEPXFKDRMQTCIQRXGKRKLDQLRANXFTKYLSLGGVRNKXQAFTGGLRQRDNENQQLMSRRIKLQTLFRTNKIQL

SEQ ID NO: 197797 - protein, 76 aa, Triticum aestivum
  Clone ID: PAT_TA_92215.pep
YSNEIKLDGYPGHDHLFRLIFLKMLIIHVVLPSPRGMMCCVSFDRLSSHLLLSVRLKVNSGNKVDFHAIHRYQVAH

SEQ ID NO: 197798 - protein, 120 aa, Triticum aestivum
  unsure (1)..(120): unsure at all Xaa locations
  Clone ID: PAT_TA_92216.pep
MQIFVKTLTGKTITLEVESSDTIDNVKAKIQDKEGIPPDQXQRLIFRWQASWEDGXTSADYNIQEGXTXTVLRLLCGMQIFVXKTSTGKTSPLEGPDSRHIDNVXGKFQDKXGFPPDQHA

SEQ ID NO: 197799 - protein, 143 aa, Triticum aestivum
  unsure (1)..(143): unsure at all Xaa locations
  Clone ID: PAT_TA_92217.pep
MANPRVFFDMTVGGAPXGRIVMELYKDAVPRTVENFRALCTXXXKGVXKSGKPLHYKGXSXFHXVIXPDFMXQXGRLHXXGNGXGXXSIYGENXPREFCQKXTXXGILLHXKXGPTVHSHLHVPAEHWSPSQMSKEGGSHHKI

SEQ ID NO: 197800 - protein, 191 aa, Triticum aestivum
  unsure (1)..(191): unsure at all Xaa locations
  Clone ID: PAT_TA_92218.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWTNVXXPXFGCTDATQVINXVEESKKEYXDAYVASSXIDNMRQCRHSSPTTGCKIRKAKHSSHRHIKCMFIMLGSSITS

SEQ ID NO: 197801 - protein, 60 aa, Triticum aestivum
  unsure (1)..(60): unsure at all Xaa locations
  Clone ID: PAT_TA_92219.pep
XLLXNLXPTRIHVYIKQIVPICXIKXSFXSKLLLPKXLNSPRXMSPVKQHQAXSNPGNXT

SEQ ID NO: 197802 - protein, 71 aa, Triticum aestivum
  unsure (1)..(71): unsure at all Xaa locations
  Clone ID: PAT_TA_92220.pep
PPLEXSFLXXVKXPNCRXFSRKWXKXEXELPHSLXXIFPKIIXRYISCLIXETTKNFXDSTTSYEXPFPXF

SEQ ID NO: 197803 - protein, 144 aa, Triticum aestivum
  unsure (1)..(144): unsure at all Xaa locations
  Clone ID: PAT_TA_92221.pep
MGGKMEIERSSWSDDGNLVQDAVDYRGCPANRSSTGSWLGAASVVGIELCERLATMGIAVNLVTYLTDTMHLPGAASANVVTDFMGTSFLFAPRRLLADAFSALLTSHLRACQALGTDLACQHVRISARTXGPXXQXARXXMGL

SEQ ID NO: 197804 - protein, 68 aa, Triticum aestivum
  unsure (1)..(68): unsure at all Xaa locations
  Clone ID: PAT_TA_92222.pep
GDXGGVXXHCXHHRRHLXCPGRXHRGRGGXRAGGXEARWRGILLXGFLWXRGVERXDGXGCHLVAXXG

SEQ ID NO: 197805 - protein, 81 aa, Triticum aestivum
  unsure (1)..(81): unsure at all Xaa locations
  Clone ID: PAT_TA_92223.pep
FFFFFFFLIRYGSSIVRILXDLERSIXKTILPPIIINYKGLLXRSFFXVRLLNLLRCHXLPQLLXXLPLXWPHNLCLXXAX

SEQ ID NO: 197806 - protein, 172 aa, Triticum aestivum
  unsure (1)..(172): unsure at all Xaa locations
  Clone ID: PAT_TA_92224.pep
MATTAMALSPSSFAGKAVKDLPSSALFGEARVTMRKTAAKAKPVSSGXPWYGSDRVLYSGRYPATPELLNGXFPGDYGWDTAGSRRPENFAXNGNWXVIHCRWXMLGALGASSRTARRKXXXFASLWLKAVXFXQXGLILGTKLVIQSPLAQVCKGKVPPGPSEFTVTGLPG

SEQ ID NO: 197807 - protein, 89 aa, Triticum aestivum
  unsure (1)..(89): unsure at all Xaa locations
  Clone ID: PAT_TA_92225.pep
YLDTAQSLTDFYLNLHAIQSYKLLRSIHXXQLNSNSTXKIXLIXSNVTGLNFLKAYGCSHGFCXIKSEYDNVXNLXRYNXIXSLKCNTI

SEQ ID NO: 197808 - protein, 42 aa, Triticum aestivum
  Clone ID: PAT_TA_92226.pep
RAEFGTRSNTLFASLASLFSRQDENFLIISHISFLRIFQFCY

SEQ ID NO: 197809 - protein, 107 aa, Triticum aestivum
  Clone ID: PAT_TA_92227.pep
ARRVFTRITSFDNHIKCYSNCIHKKKPNYTFTIEYCVRRCNLAPETLILPLKNQSNTLFTTRRASDIQIKSNILPMLKYLLQHHTTSPPTTNFVPLDYLGPGDFLYS

SEQ ID NO: 197810 - protein, 62 aa, Triticum aestivum
  unsure (1)..(62): unsure at all Xaa locations
  Clone ID: PAT_TA_92228.pep
HXXPXXYTNSSVLGVXPXVPMXIPXDPTYXSCSSVYKHLHSVDNYVRHLGYKAIRDELMDLR

SEQ ID NO: 197811 - protein, 81 aa, Triticum aestivum
  Clone ID: PAT_TA_92229.pep
NCGGGLRDIQLLPHVFFTPCIRFVSSQNLLKFDQFMLKLSTSTMPNQYVNLHNFFKEVPGNFKMLTGLKNIHDSFKVQLLL

SEQ ID NO: 197812 - protein, 85 aa, Triticum aestivum
  unsure (1)..(85): unsure at all Xaa locations
  Clone ID: PAT_TA_92230.pep
MRKANGXTXFKASGKNKTATGGVAKPKRAPTPFFAFLAXFRPQYMEKHPEAKGVAGVTKAAGEXWRNISDXEKQIWRQEANAQQA

SEQ ID NO: 197813 - protein, 99 aa, Triticum aestivum
  unsure (1)..(99): unsure at all Xaa locations
  Clone ID: PAT_TA_92231.pep
SCRIRXELHYGRLNXRXQXLKNLRFXPSNHHQIMAEIPRKLSYRRDGAWWKDLLTDCPPQRAHSKRPSATSFQKQLXRFQSWAGXNXXXRFGITVGQKD

SEQ ID NO: 197814 - protein, 118 aa, Triticum aestivum
  unsure (1)..(118): unsure at all Xaa locations
  Clone ID: PAT_TA_92232.pep
MQIFVKTLTGKTITLEVESSDTIDNVKAKFXDKEGIPPDQQRLIFAGXALRRMGAPLQTNNIQEGXNLHFGLRSLGGXXXXGXDLTGKTSPGGLSPGTIETGFKTRRIPPKLIFPGTL

SEQ ID NO: 197815 - protein, 144 aa, Triticum aestivum
  unsure (1)..(144): unsure at all Xaa locations
  Clone ID: PAT_TA_92233.pep
MAGEKGLVLLDFWVSPFGQRVRIALAEKGXLPYDNAEEXDLMAGKSDRSSAPTPVHKKISGVLXRRRPVNDSFIFFHYLEXPFXDAPXLSPFDPXXRXXGPXXADXXKXKKNGVPPFGKNKKPPNSGSPKPSRASGKFWGKWST

SEQ ID NO: 197816 - protein, 117 aa, Triticum aestivum
  unsure (1)..(117): unsure at all Xaa locations
  Clone ID: PAT_TA_92234.pep
RAEFXTRGVCPSRIVLXMPLYGRAFENTDGLGKSYLGLGEGTWENGIYDYKVLPLPGSKELYDDSHXATYSYNPGTRNFIHMILXHGVFEKPSGFKREGLSGAMXWEXSARWNPESK

SEQ ID NO: 197817 - protein, 96 aa, Triticum aestivum
  unsure (1)..(96): unsure at all Xaa locations
  Clone ID: PAT_TA_92235.pep
DWPXISGIXNVFQVYRXXKESXXSAXGGYSQASXTWFSTXXSQSLVIFIVWVPCXLSVLVALEHLGSMSRXRALHWSSFIEICIPRKGNYAXWKRS

SEQ ID NO: 197818 - protein, 130 aa, Triticum aestivum
  unsure (1)..(130): unsure at all Xaa locations
  Clone ID: PAT_TA_92236.pep
SHANNCWPAPNLQKPFFHRYRTPNSLTRYYGAKWIWTWIWIWDMTIMAIPMPMASRLYGYGTWGSMNMSFLQVARQLISTLKMFAXKYVAAYQACXILISXATFXAAXRLQGXXGTXLVNAXXNSHSPWW

SEQ ID NO: 197819 - protein, 47 aa, Triticum aestivum
  unsure (1)..(47): unsure at all Xaa locations
  Clone ID: PAT_TA_92237.pep
FFFFFFNLEPREYXXYFXVRLLVQSLTKTTLIIMLNTLTGQVLPATV

SEQ ID NO: 197820 - protein, 72 aa, Triticum aestivum
  unsure (1)..(72): unsure at all Xaa locations
  Clone ID: PAT_TA_92238.pep
RELXXSFFFFFFFFCCNVICIRTSYIVSLTRFALXXXVTNVXDIXVXEXNLSLPQKSXRNKGEKKXKGGARX

SEQ ID NO: 197821 - protein, 196 aa, Triticum aestivum
  unsure (1)..(196): unsure at all Xaa locations
  Clone ID: PAT_TA_92239.pep
LVPNSARGQVLDRLERYTQESEKITGLLGREDVVTGLRSDKVANLEFLKKEHGVTIEEXNVLYDLGLYQYSCGNYXQAAEXSYQFPAVFNRQLTRAQLATLGKIXAKYPTTNWESXAMEEXSKXEXPIDTXLYPVLPTNRLSTGPSSIMTTLTYRFPLIQSSVDPVIDGAYTNVTPKRKAAIRYKSNSFIEGTFPL

SEQ ID NO: 197822 - protein, 113 aa, Triticum aestivum
  unsure (1)..(113): unsure at all Xaa locations
  Clone ID: PAT_TA_92240.pep
IKVVDLLAPYARGGKIGLFGGAGVGKTVFIQELINNIAKAHGGYSXVFTGVGERTREGNDLYXEMQETKLYNLMGXSKGCXIFXQMNXPLDPAXVALTGXTLXXFPQKGQKSP

SEQ ID NO: 197823 - protein, 75 aa, Triticum aestivum
  unsure (1)..(75): unsure at all Xaa locations
  Clone ID: PAT_TA_92241.pep
TSDNFLAXATXXFEXSRRTTSATRLEEXPGVGHAPCLVALRGLLTNYFSHIYSYTPRPLGGATKMLFHRRNLMYP

SEQ ID NO: 197824 - protein, 113 aa, Triticum aestivum
  Clone ID: PAT_TA_92242.pep
ALPGGSLIPSTPLVPNRRHPIPHARTRESPARSPSSSRLSSSSHRDFASPSAPIAPAPSPIGRRPARAIRAAPPSSASSPPMAPRPASRTRRHHLPSSAPLHHNLQVSMIPCK

SEQ ID NO: 197825 - protein, 78 aa, Triticum aestivum
  unsure (1)..(78): unsure at all Xaa locations
  Clone ID: PAT_TA_92243.pep
AAPPFXSSNPRPFDRHANPTTIRLPAPGESGGRSRRARHESRARAVKPAPRRDAXAAGVLGFASAAVAGGSGCSIGRG

SEQ ID NO: 197826 - protein, 120 aa, Triticum aestivum
  unsure (1)..(120): unsure at all Xaa locations
  Clone ID: PAT_TA_92244.pep
MSVVSLLGVNVLQNPARFGDPYEFEITFECLETLQKDLEWKLTYVGSATSNDHDQELDSLLVGPIPVGVNKFIFVADPPDTNKIPXAEILGVTVILLTCAYDVENFRVGYYVNNEYDQMN

SEQ ID NO: 197827 - protein, 177 aa, Triticum aestivum
  unsure (1)..(177): unsure at all Xaa locations
  Clone ID: PAT_TA_92245.pep
CSINENQLLLSNHFFTLHVXSXRSAESDREHRRKGKMGRKGPASLASAIARFLQERETSLSAQPSPTCCKVAVAVKDWRKEWASPPLFRLEQTPKPPPWVSKPKXTPAPLANTTVHKLDLXPATLQTSWASXXSGVPMIIYDXPPHRLTSSXDGPGXNGHLXKKXPXNXALARRXNG

SEQ ID NO: 197828 - protein, 38 aa, Triticum aestivum
  Clone ID: PAT_TA_92246.pep
ILGMLMDAFSLSFVVKKIFRCCSSCNIHYCNPTILSNI

SEQ ID NO: 197829 - protein, 129 aa, Triticum aestivum
  unsure (1)..(129): unsure at all Xaa locations
  Clone ID: PAT_TA_92247.pep
MLRKGTEEGASLGNEFIRFVFPGKTPXADGIFRPPFGWKYNFFLSEAVEEVPEYVVPWEMFRAIAEDFNLELQYHKTFDEIWKAEKDDETLGLLSERMGVRERGGGPLLVSDEEMEAANFYTAFCFYKV

SEQ ID NO: 197830 - protein, 59 aa, Triticum aestivum
  unsure (1)..(59): unsure at all Xaa locations
  Clone ID: PAT_TA_92248.pep
KIFHITHLATTEXLQSXAYSKSXXTWNYLSXGXRVNSSRQPXSHTSKNIITXQXHXFXX

SEQ ID NO: 197831 - protein, 91 aa, Triticum aestivum
  unsure (1)..(91): unsure at all Xaa locations
  Clone ID: PAT_TA_92249.pep
SCRIRHESSHPTPCPPYHLPPPARPPPPAXNHHQRSLRRPAPQDLSPRPRPPEPRPXPPSPAAPSSXRPLGPRLPPPLPLALPAAPPRVLP

SEQ ID NO: 197832 - protein, 126 aa, Triticum aestivum
  unsure (1)..(126): unsure at all Xaa locations
  Clone ID: PAT_TA_92250.pep
MAASMITSPIVAPTSLPSLSRRGSSFAVVCSGGKKIKVDKPLGLGGGLTVDIDANGRKVGKKGVYQFVDKYGANVDGYSPIYTPEEWSESGDRYAGGTNGLXIWAVTSXLLGGGVLLVYNNNALAG

SEQ ID NO: 197833 - protein, 104 aa, Triticum aestivum
  Clone ID: PAT_TA_92251.pep
ELCMEKWYLHVSQFREAPISPKDLKEVDPVTSSSPFPRSRPYEKFYQGEMSNNYAAFDHGCNFSGVVYLHYLQGKLGPEVKDWQVENCERGYNTKEFEKLSPWS

SEQ ID NO: 197834 - protein, 147 aa, Triticum aestivum
  unsure (1)..(147): unsure at all Xaa locations
  Clone ID: PAT_TA_92252.pep
MTDKKENESIDHSMIDPDTLTKYKSAAQISQKVLEAVTALCIAGEKIVSICAKGDQLLEEEISKVYRGKKIAKGISHPTTVSPSSFITPYTPLLSDEAEAAVTLRXGEXLXQLGAQIDXLGLYMRYNRISSIENQIGPLDFWILNFF

SEQ ID NO: 197835 - protein, 146 aa, Triticum aestivum
  unsure (1)..(146): unsure at all Xaa locations
  Clone ID: PAT_TA_92253.pep
CQQXXLGFPPKRARLGVPCCRXCIGLRLAHVKVKLQKGWCQLISSTTLLPNGNPNQFISSIRETVFTTWREWFAISKKSQQLINCSGCVWQALFTELDLSTSTAHRHGVHKLFFTSLFTFYFNISILLIECIKFRCMVPEIFFELL

SEQ ID NO: 197836 - protein, 86 aa, Triticum aestivum
  Clone ID: PAT_TA_92254.pep
KTYKTAVPKFRKLRCAPHHQSATTLNLLELGWSLSCSHCTFPLPRLPFLPRDLASLRFSQVLYTDNTYLIVLGGKKIHYKCLELCH

SEQ ID NO: 197837 - protein, 134 aa, Triticum aestivum
  unsure (1)..(134): unsure at all Xaa locations
  Clone ID: PAT_TA_92255.pep
LPPRSPWRPPRPRCSSPPTRPSPPAAASFSSLLGPRGHGGAPRPAGARGRPSARTPRRAAPAPASGNGLAGNNNGGYTVGDFMTKRXDLHVVKTSTPVDEXLEMLVQNXXSGFPVIDXXWXLVGVSKYDXITLD

SEQ ID NO: 197838 - protein, 134 aa, Triticum aestivum
  unsure (1)..(134): unsure at all Xaa locations
  Clone ID: PAT_TA_92256.pep
LVPNSARAHSSPAPAPAPTTLSSPLPTPPRFGFFRRPPPSRCCVWCAQRAVSTXPSPLQPGGGPALSXHHPQRFLLLLLLVRPSVRPSDPHTRRLLLPPCSSKALSCGGGTTRCQCXXXCXXXXFGEXXWPXVA

SEQ ID NO: 197839 - protein, 128 aa, Triticum aestivum
  unsure (1)..(128): unsure at all Xaa locations
  Clone ID: PAT_TA_92257.pep
VSWGLGFGVPCVIMLLALVVFLLGTRTYRFYDSGHGEGASAFSRVGKAVKAWCKKSPEGXCPGXQHGDCAGGQLLNEEVXRXXRGFPIWANFLPXAXVFSQTXKXFNKQGGTLTNWGPPLAPPRKILG

SEQ ID NO: 197840 - protein, 123 aa, Triticum aestivum
  unsure (1)..(123): unsure at all Xaa locations
  Clone ID: PAT_TA_92258.pep
LEFFFFFFFFFFFFLTFRKMSNNKXCVAETXEGLSSXTSXMLRGATTGGGVIHQSXRRGYDXRXFSXDVGXTKSSXSVDXGATKMDSLXXXQAXXLFNNXXXKYRVHKLPPXQMXAFEXAXXV

SEQ ID NO: 197841 - protein, 127 aa, Triticum aestivum
  unsure (1)..(127): unsure at all Xaa locations
  Clone ID: PAT_TA_92259.pep
SRHPKELSLARPLLSRLYASPLKDMVTLQEYQRRFKSTKGANLPLVDAEQSFAPLVLSXEAAYPTTVPFXVPHLPSIPXDIWLRALGRILRCTNGXLSGFQHKICPKNPILGXNSLQSCSTFXLACG

SEQ ID NO: 197842 - protein, 129 aa, Triticum aestivum
  unsure (1)..(129): unsure at all Xaa locations
  Clone ID: PAT_TA_92260.pep
SCRIRHEEDGRTLADYNIQKESTLHLVLRLRGGMQIFVKTLTGKTITLEVESSXTPSDNVKAKIQXDKEGIPPXDQQRLIFXAGKQLEDGRTLADYNIQKESTLHLGCSASAVVSNCRGVLWWVPLSSM

SEQ ID NO: 197843 - protein, 190 aa, Triticum aestivum
  unsure (1)..(190): unsure at all Xaa locations
  Clone ID: PAT_TA_92261.pep
ASHTLFFDHSHKSSEMAFVCAKAVLLAAVMLASAAQLCMGARRRMELYRPDPADMLSYHNGAVAPRRHRGVRPLVRQLQAGAEAVILDSSSRSPPTSSRLAVXRAVVGAHRQHTLPASANPTGGREIVPARGQSPTXVLKGXSXTLTINALARRXPRKXVPWSHGQDCMEXRMAVNXGXXVGQQLVEPEH

SEQ ID NO: 197844 - protein, 63 aa, Triticum aestivum
  unsure (1)..(63): unsure at all Xaa locations
  Clone ID: PAT_TA_92262.pep
ARWXVLXXTSKRSXXGIXXSLAAAXAGKAXWXPPXLMXWFKMFXVEASSRAEFGTSSCRIRHE

SEQ ID NO: 197845 - protein, 163 aa, Triticum aestivum
  unsure (1)..(163): unsure at all Xaa locations
  Clone ID: PAT_TA_92263.pep
SCRIRHELSLPRPLQCRRPWXSPSPSPSPPPPRPSPRATASPRPVASPAPPAPSPRATPRASTEXRRPRPAPAXATRRRSGTRTGRXXGSAGCRPXXRQWRWRXARCRPARPASASXRHGRAPPXHVXGGAPGPHLQAVVAGGACLSVQQKGIHWPKDQEKDP

SEQ ID NO: 197846 - protein, 90 aa, Triticum aestivum
  unsure (1)..(90): unsure at all Xaa locations
  Clone ID: PAT_TA_92264.pep
XENXLTXVRGIMAHNXAQAKYLLKSSICWDCXRMKGGNVAKEGVNSGWHARMFWRLLGEPFRNHTICGTRHLASHGFLCYHHSIRSLVKW

SEQ ID NO: 197847 - protein, 50 aa, Triticum aestivum
  Clone ID: PAT_TA_92265.pep
RTMQRFRAFITFTFYKCSRPGHSPPSQMMLIKITTNIHNDYLFNPLSKLR

SEQ ID NO: 197848 - protein, 77 aa, Triticum aestivum
  unsure (1)..(77): unsure at all Xaa locations
  Clone ID: PAT_TA_92266.pep
LVPNSARXIPEXXFALXXXNAPISPFXSRCSTPGAXXHRSAHRPIHRSRSSXSDXAAAXSRXQDGGRFPXHDLVPRX

SEQ ID NO: 197849 - protein, 106 aa, Triticum aestivum
  unsure (1)..(106): unsure at all Xaa locations
  Clone ID: PAT_TA_92267.pep
HHXXEXDTDCSAKGTXSDHHAWXXQCCXGKHTSVRMQLLPEXXEVXGYGVTHGPVSNNTCLFEHQIXLINELSERWSQTEIRESSWTNYQRYTQIMVLMDGGSNLN

SEQ ID NO: 197850 - protein, 105 aa, Triticum aestivum
  unsure (1)..(105): unsure at all Xaa locations
  Clone ID: PAT_TA_92268.pep
MAAETFLFTSESVNEGHPDKLCDQVSDAVLDACLAQDADSKVACETXPKTNMVMVFGRNLPLXAPFDYEKFXRDTCRNIAYLICLAPTTVSRARQIRHPLTLPSV

SEQ ID NO: 197851 - protein, 103 aa, Triticum aestivum
  unsure (1)..(103): unsure at all Xaa locations
  Clone ID: PAT_TA_92269.pep
SSYIVERSQHLASTSRSLAEEDLVEVDGNRKKLEQWLAGDELERSVIVLHGMGGLGKTTWLQMFYKKKVKIFDXTXWAPXPQTYFKFFKKFTQGFSKIKHCST

SEQ ID NO: 197852 - protein, 150 aa, Triticum aestivum
  unsure (1)..(150): unsure at all Xaa locations
  Clone ID: PAT_TA_92270.pep
LVPNSAXGXCXIRHXLVPQTIQIXRPRPTDXPTTGDSGDGGGVRVCGMQXXPEPXXLXPLPXGDLLLGXEQXHAVLHLGGQFXAAVRXGRRIRPFFQNVDYWGIQAGXQRVXCXPCXSPXAXLKQQPPSXRXKQLGMXQQXXPAGQXXLN

SEQ ID NO: 197853 - protein, 89 aa, Triticum aestivum
  unsure (1)..(89): unsure at all Xaa locations
  Clone ID: PAT_TA_92271.pep
RAEFGTSRDFIKNMITGTSQADCAVLIIDSTTGGFEAGISKDGQXTREHALLAFTLGVKQMICCCNKMDATLPXYSKAVMRKQESTKGR

SEQ ID NO: 197854 - protein, 144 aa, Triticum aestivum
  unsure (1)..(144): unsure at all Xaa locations
  Clone ID: PAT_TA_92272.pep
MASATLLKSSFLPKKAEWGVARQVAAPRVSMVVRAGAYDDEXVKTAKTXAFPGRGFLGIDDSNATWGXXLXPFGLEKXKXNGFRNWWSFPSISGQPEYINFTNFQPVGRLSKGFPQRQHILARRVPPEALYKRAVMELQKASLA

SEQ ID NO: 197855 - protein, 113 aa, Triticum aestivum
  unsure (1)..(113): unsure at all Xaa locations
  Clone ID: PAT_TA_92273.pep
MAAAGDAGEKKMITLKSSDGEXFEVEEAVAMESQTIRHMIXEDDCAXDNXIPLPKVNXKFSXKGTHXXXSNFKPSPWVPGPEPGSEPPPRPAGDPSSRATSNIKPATTEICGL

SEQ ID NO: 197856 - protein, 69 aa, Triticum aestivum
  unsure (1)..(69): unsure at all Xaa locations
  Clone ID: PAT_TA_92274.pep
MAASLQAAATLMPAKIGGRASSARPSSHVARAFGFDAGARXTCSLQSDIKEVASXXADAAXMAGSPSQF

SEQ ID NO: 197857 - protein, 110 aa, Triticum aestivum
  unsure (1)..(110): unsure at all Xaa locations
  Clone ID: PAT_TA_92275.pep
KTITLEVESSDTIDNVKAKIQDKEGIPPDQQRLIFAGKQLEDGRTLADYNIQKESTLHLVLRLRGGMQXFVKTLTGKTITLEVDLRNXRQXKXNSKDKEXIPXDXKFXLP

SEQ ID NO: 197858 - protein, 141 aa, Triticum aestivum
  unsure (1)..(141): unsure at all Xaa locations
  Clone ID: PAT_TA_92276.pep
MAPAVMASSATTVAPFQGLKSTAGLPVGRRSSGSLSSVSNGGRIRCMQVWPIEGIKXFETLSYLPPLSTGGLLKQVDYLDSLKVXXCXRXNKVGSSPVEHNXXPGYXDGRYWDKLELXXFRVEXXTQGAEQXEEXKKDTLP

SEQ ID NO: 197859 - protein, 97 aa, Triticum aestivum
  unsure (1)..(97): unsure at all Xaa locations
  Clone ID: PAT_TA_92277.pep
VSGRGRGRRAKNGDAPSCSPPPARRAAPRGRLHRPGRRAGLCVPDPGAXGRWSQLIVLTXQGTXKXRXGIXFXRXXPGEIXRGXGXGGFFKPGNFPG

SEQ ID NO: 197860 - protein, 92 aa, Triticum aestivum
  unsure (1)..(92): unsure at all Xaa locations
  Clone ID: PAT_TA_92278.pep
TVEGLQQGYVLCDSDKRFLLLFSFLKRNLKKKIIVFFSSCACVKYHAELLNYIDLPVLDLHGKXKQEXRTKTSLXFCNAKQGNXMGFSNLAP

SEQ ID NO: 197861 - protein, 94 aa, Triticum aestivum
  Clone ID: PAT_TA_92279.pep
KSWSMLVFIQGPPPAEASAMVSGESQIRWRRKFTRSSAWKKASASTCAFTQTRWRHSSVPRLELPARHPAAASHATNCGRGARARRPLVPNSAR

SEQ ID NO: 197862 - protein, 93 aa, Triticum aestivum
  unsure (1)..(93): unsure at all Xaa locations
  Clone ID: PAT_TA_92280.pep
MKGTKLAAILILQAVLVMGVLSHVNADYFPKCCNNCRSFSGVDVCDDAXPKCPKGWXAXRVVSTXPXNLRCXGYETNVDGTSVGPARSTDNPT

SEQ ID NO: 197863 - protein, 73 aa, Triticum aestivum
  unsure (1)..(73): unsure at all Xaa locations
  Clone ID: PAT_TA_92281.pep
VNCSYFQQSKNLYRQFTPSGFVASMRPPMFEGIHYKRWRVRAVLWFQIMSCYDATLDKPKGELDAQQDKXFKK

SEQ ID NO: 197864 - protein, 92 aa, Triticum aestivum
  unsure (1)..(92): unsure at all Xaa locations
  Clone ID: PAT_TA_92282.pep
MASNPLITFKAGTCVVDQSSRPYKVIPNPTLGFLYLYAEENLIHFCWRERGKSVHDEXNLDLVILPADCRFIPYNDAAMSGSSLIPPRVLFW

SEQ ID NO: 197865 - protein, 114 aa, Triticum aestivum
  unsure (1)..(114): unsure at all Xaa locations
  Clone ID: PAT_TA_92283.pep
MKFMDKFVVVFIXDILVYSRTPEEHAEHLKIVLGELRKHQLYAKFSKCEFWLRQVGFMGHILNXEGVAVDPEKVKAILDWKPPANVTDVRSFLGMAGYYRRFIEGFSLVPNSAR

SEQ ID NO: 197866 - protein, 140 aa, Triticum aestivum
  unsure (1)..(140): unsure at all Xaa locations
  Clone ID: PAT_TA_92284.pep
IGIIHLLSIDRGDVCVGEHLAEPDQGCVVRCVMXLGMGNPHASVLPQQSSHPLXVNCGSKAIADXTCQYLRFAEFGLGQLSRHCLTXDTEQHVCLIXCTSXSXSXRHDGQLFNXTTPCSILXXTGXRSHXEKNIXTXNGR

SEQ ID NO: 197867 - protein, 103 aa, Triticum aestivum
  unsure (1)..(103): unsure at all Xaa locations
  Clone ID: PAT_TA_92285.pep
SPLTQNLNLSLLATYSKVFFLKAKMKIARMMRLEVNQTQMNLATAMTWALIGDNKDNELKKXIISPKTAYFKTLIMKIIMKIRPNYSSNRGCQWWRKDTSTMK

SEQ ID NO: 197868 - protein, 110 aa, Triticum aestivum
  Clone ID: PAT_TA_92286.pep
PPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCDESGKG

SEQ ID NO: 197869 - protein, 77 aa, Triticum aestivum
  Clone ID: PAT_TA_92287.pep
PIAIGFIVGANILAGGAFDGASMNPAVSFGPAVVSGVWENHWVYWLGPFAGAAIAALVYDICFIGQRPHEQLPTADY

SEQ ID NO: 197870 - protein, 134 aa, Triticum aestivum
  unsure (1)..(134): unsure at all Xaa locations
  Clone ID: PAT_TA_92288.pep
KTLFLQIVVRGNFPKVTVIMKFLYSAISASMLGLFATASSHIMFSCPSGYQILESDVLAAARNIDPKAKIYESSAXSTGDAQYKFSXGSKTYNNVLYLISSYNLITRYDSQGITRLDINLERKIRHLXKXXEXN

SEQ ID NO: 197871 - protein, 103 aa, Triticum aestivum
  unsure (1)..(103): unsure at all Xaa locations
  Clone ID: PAT_TA_92289.pep
IFFTEEKSRRSRLSKCPHQQKRRQILPQNRLLRKKERRRPKPRQXKEAEKARKAAEREAATASANSTEVQDTAKDNYGSITNATQLASNSVHLRALSEENVGX

SEQ ID NO: 197872 - protein, 112 aa, Triticum aestivum
  unsure (1)..(112): unsure at all Xaa locations
  Clone ID: PAT_TA_92290.pep
HHFESKADSGASKTYPQQAGAIRKGGHIVIKARPCKVVEVSTSKTGKHGHAKCHFVAIDIFNGKKXXDIVPSSHNCXVPHVDRQDYKLXDITYDXYSXSNLEWNTKDDXNXX

SEQ ID NO: 197873 - protein, 67 aa, Triticum aestivum
  unsure (1)..(67): unsure at all Xaa locations
  Clone ID: PAT_TA_92291.pep
TQLXIXGTGLSSXVXINMCSYSQDMSGXQKYSYLSYVDXEFESLERKRDPVHEIRLSDEETKQMFPQ

SEQ ID NO: 197874 - protein, 126 aa, Triticum aestivum
  unsure (1)..(126): unsure at all Xaa locations
  Clone ID: PAT_TA_92292.pep
MASPAASTGSTKIDAAIKKLAPDTPEKLSGVALYSRFALAGAVCCSITHGGLTPVDVVKTXRYSLIPATYNKGLIXGGFRXVISXEGAGALLTGXGPTFAGYFXLQGAFKXFGXYXFFKQQSINYL

SEQ ID NO: 197875 - protein, 69 aa, Triticum aestivum
  unsure (1)..(69): unsure at all Xaa locations
  Clone ID: PAT_TA_92293.pep
HCRSKVSESEIKKXNDXXDXXXEXXDETGXEIXXIELLMXQXNVSXKKXVKAVKEXDNDIVNSIMALSL

SEQ ID NO: 197876 - protein, 118 aa, Triticum aestivum
  unsure (1)..(118): unsure at all Xaa locations
  Clone ID: PAT_TA_92294.pep
SVEPSAAPPSALSFLLRXXMKFIAAYLXAYLSGNAXPSAXDLTSILESVXCEIDNEXMXLMLSQSERAMDITELLGCRVGRNFAAGSTWWWXSXLXKXLPXVAGSTAXPXTNSTKEXK

SEQ ID NO: 197877 - protein, 113 aa, Triticum aestivum
  Clone ID: PAT_TA_92295.pep
MAQGIFKSKPAKATTTSSRRPNVLGPKKGARTIVPRKPGLVRQNKLTKKYSAGLTASTERTLGARVGHLELLGRRQGKEDTQSEREPREEVGHNPRTPPKTHDIDIQLRMKGS

SEQ ID NO: 197878 - protein, 79 aa, Triticum aestivum
  Clone ID: PAT_TA_92296.pep
ILLAMNVIASVTQSRVIHATPSIMARLASTTLPCMNCWGSMMRLKGPSKLYPRFLTTYHKAVSFSKVQLPASGSTYTAC

SEQ ID NO: 197879 - protein, 123 aa, Triticum aestivum
  unsure (1)..(123): unsure at all Xaa locations
  Clone ID: PAT_TA_92297.pep
RVQRPHCQGLSSDSVNWYHLGCGTKTASPSSKTLVCSXPVFXGLGCSPFRSPLLTGNRFCFLFLXGYLRCFSSPGCLLPAHGFSRQFKRLTYLGISGSMLIFNSPKHFVACYALPRLWVPRYP

SEQ ID NO: 197880 - protein, 83 aa, Triticum aestivum
  unsure (1)..(83): unsure at all Xaa locations
  Clone ID: PAT_TA_92298.pep
AHVHAKDLQWSYILLIQPKTGPPNPSEMAMLSTRRCQEPGVEFKTLSTVPNRPSXPENFRXXGRAISXPMEPSXRXSPGVXAA

SEQ ID NO: 197881 - protein, 117 aa, Triticum aestivum
  unsure (1)..(117): unsure at all Xaa locations
  Clone ID: PAT_TA_92299.pep
DESTALPSALDGTKEVRLSYYTAITLCQDFSDISARPSGRSWKEARKAEGEFPEVHTSLQRPAGWPLRTLQKGQYVFRIYSLMSVLXRAPHPVVFANFPGCHTPRKWHRFLGWRRGR

SEQ ID NO: 197882 - protein, 118 aa, Triticum aestivum
  unsure (1)..(118): unsure at all Xaa locations
  Clone ID: PAT_TA_92300.pep
MKLIAAYLLAYLGGNSSPSAADVKNILXSVGAEADEEKLEFLLAELKGKDITEVIASGRENLXALPSSXGSIXVGTPTADLVVAQHCSIKXKEEKVEEKEESDETWVQSVRLTNPPLS

SEQ ID NO: 197883 - protein, 143 aa, Triticum aestivum
  unsure (1)..(143): unsure at all Xaa locations
  Clone ID: PAT_TA_92301.pep
LVPNSXRASLLSLFHFXXXSASAIAXSPLLPLXRLLPLXPXRHHPVPTLYCXTAHPPPLGSGXGRPVXAGGGXXLXGKXRQXRXWPPWTPAAMTNPLLXGHHGXXSRXRLAXPPVXLDXPGFRVXRIXRFPEXQAGXXXGLWG

SEQ ID NO: 197884 - protein, 67 aa, Triticum aestivum
  unsure (1)..(67): unsure at all Xaa locations
  Clone ID: PAT_TA_92302.pep
HLIRRSHTTVQLYQFVGSPSSPSSDSIMLIASSSRLGFCWALXKAXFDXXXIXXXXAKTXXNPFHFP

SEQ ID NO: 197885 - protein, 69 aa, Triticum aestivum
  Clone ID: PAT_TA_92303.pep
FFSKILFDGSFHCKTNKTVISYCCLRYHNSRRKTLSLTNIQQCNHLSKNEKYWGLPLVVLILAQDERTP

SEQ ID NO: 197886 - protein, 152 aa, Triticum aestivum
  unsure (1)..(152): unsure at all Xaa locations
  Clone ID: PAT_TA_92304.pep
WVQSYGSRCVKPPIIYGDVSRPNPMTVFWSKMAQSMTARPMKGMLTGPVTILNWSFVRNDQPRFXETCYQXIALAIKKEVXGPXRLGGIQVIXQIDEAAXREGLPLRXPEHAFLLLTGPXSLQGXTNCGXQDTPNSHHMFYXTSNDSSIHQH

SEQ ID NO: 197887 - protein, 165 aa, Triticum aestivum
  unsure (1)..(165): unsure at all Xaa locations
  Clone ID: PAT_TA_92305.pep
LLRAHYSGKIKRRRRGEKETRAARHRPASSSASSLRRLLTPASSATRPPPSDDSSLRRLLTPASSAVRPPPSDDSSLRRLLTPASSVGGTARXVSTRRCLLPLMIHLPGSYFGENXGGAARAVTHASHPXALSSRHNXGGPDTGRXQLVLRSLIRXTRRALSSXL

SEQ ID NO: 197888 - protein, 78 aa, Triticum aestivum
  Clone ID: PAT_TA_92306.pep
PPSKKASQLPPPKPLTDHKWLKRADLPFHKRPALLTARVIQPEDEGGREEEKLWCELAAWWYKRGERGRGLLLLVRRT

SEQ ID NO: 197889 - protein, 55 aa, Triticum aestivum
  unsure (1)..(55): unsure at all Xaa locations
  Clone ID: PAT_TA_92307.pep
VLXRYKASLXISTSTQVYILIXTRDIYIYIYIYIYIYIYIYIYIYIYLCMYVWKK

SEQ ID NO: 197890 - protein, 73 aa, Triticum aestivum
  Clone ID: PAT_TA_92308.pep
AISTACYLKNRLPHSGLPTHTTPYEALLGTKPTIHHLQSFGKNCFVHIHKDSRPAGTKYCNLFARPGGVAYHS

SEQ ID NO: 197891 - protein, 79 aa, Triticum aestivum; identical to SEQ ID NO: 185883
  unsure (1)..(79): unsure at all Xaa locations
  Clone ID: PAT_TA_92309.pep

SEQ ID NO: 197892 - protein, 101 aa, Triticum aestivum
  unsure (1)..(101): unsure at all Xaa locations
  Clone ID: PAT_TA_92310.pep
SASKTMSVAKVEEKTRRASPSPQPSAPFDLAKYQRLNRSIWVLCPRKTAKHTNRRAQCDSSRWMDGSNTATHFEVFXQDIVLSTHTHASLLSRQHMGTCSL

SEQ ID NO: 197893 - protein, 93 aa, Triticum aestivum
  unsure (1)..(93): unsure at all Xaa locations
  Clone ID: PAT_TA_92311.pep
NHFIFKGLIAVVPKVITFRLIYSHYPQEVTCRLVRSAKSSCFGVPMASTYLLRLFARTXFFDSFRSIVGGGPNTCKRSSFRKKCLLNKTLLVD

SEQ ID NO: 197894 - protein, 170 aa, Triticum aestivum
  unsure (1)..(170): unsure at all Xaa locations
  Clone ID: PAT_TA_92312.pep
KIQDKEGIPPDQQRLIFAGKQLEDGRTLADYNIQKESTLHLVLRLRGGMQIFVKTLTGKTITLEVESSDTIDNVKAKIQXDKEGIPPDQATXLSLAGKQLEDGRTLADYNIQEGXTSNWCSAFVGGMQXLSKTSNGQDITXEVXPLTXIXNVXXXXKDKXGIPRTTTPFG

SEQ ID NO: 197895 - protein, 108 aa, Triticum aestivum
  unsure (1)..(108): unsure at all Xaa locations
  Clone ID: PAT_TA_92313.pep
GKLYGASSLAWKTNAVLKEVATGCKKKYSRLSAXLALLRFKATNGLSNKGFTEMLGIFKEILPEDNVLPRSTNEAKKLVCPLELEVQKIHACVNDCILYHGSCRIRHE

SEQ ID NO: 197896 - protein, 66 aa, Triticum aestivum
  Clone ID: PAT_TA_92314.pep
IKYKYYAREILGSPNILKDSRLAILIGARGFFYAHFNFSTIELCTINIDTGVHSVPRYDLVPNSAR

SEQ ID NO: 197897 - protein, 94 aa, Triticum aestivum
  unsure (1)..(94): unsure at all Xaa locations
  Clone ID: PAT_TA_92315.pep
XVLSCAFAHSLASFLNSFQFLIFNFSRPPQXLXGIWRFFKPFNSGKSXYLGLKPMDSRDGXXKTXSSXLXXGXQKLSXSSDQRDKLXRATXEXP

SEQ ID NO: 197898 - protein, 160 aa, Triticum aestivum
  unsure (1)..(160): unsure at all Xaa locations
  Clone ID: PAT_TA_92316.pep
YGSRCVRPPILVGDVSRPSPMTVKESKYAASLTKRPMKGMLTGPITCLRWSFPRDDVHQSVQAEQLALALRDEVVDLEAAGXSVIQVDEPALREGXPLRSGSRERGYFKWGRGTFRLSSPGVKRRTKSSQFCYSESKILQXIXTLEQIPLDXEXKQDANV

SEQ ID NO: 197899 - protein, 112 aa, Triticum aestivum
  unsure (1)..(112): unsure at all Xaa locations
  Clone ID: PAT_TA_92317.pep
SCRIRHEIFNIFRQVPGYTEDIIIDTYAPGYSERRQLLERVTGKPAVPVIKSPKYIPKTTQINKPSIEFQTDIKPGVLRKERSSQNIGVTEXNYATPRNKKVLKRRILTLPH

SEQ ID NO: 197900 - protein, 175 aa, Triticum aestivum
  unsure (1)..(175): unsure at all Xaa locations
  Clone ID: PAT_TA_92318.pep
MQIFVKTLTGKTITLEVESSDTIDNVKAKIQDKEGIPPDQQRLIFAGKQLEDGRTLADYNIQXKESTLHLVLRLRGGXMQIFRQDLTGKTSPGVXSSDTSTTSRQVQDKEGIPPDKQRXIFAGKQLEDGAPWRIHIKKHLNWYQAGGTCKTSWKTIPGGESRHITGKLDKRIPNK

SEQ ID NO: 197901 - protein, 115 aa, Triticum aestivum
  unsure (1)..(115): unsure at all Xaa locations
  Clone ID: PAT_TA_92319.pep
PPPLXGFFLXYLPATTRGTQYSNLAKPTVARSRREIDQAILRLRQRTSHCGCFDTITPPRRSHAVALRWWSSTGRSASSESVDEDGVCGLLPEQSVALSRLLLWLRLLPPFPPPP

SEQ ID NO: 197902 - protein, 199 aa, Triticum aestivum
  unsure (1)..(199): unsure at all Xaa locations
  Clone ID: PAT_TA_92320.pep
TITLEVESSDTIDNVKAKIQDKEGIPPDQQRLIFAGKQLEDGRTLADYNIQKESTLHLXVLRLRGGMQXFVKDLTGKTSHWSLXLRNIDKLKQDXRTRRXIPPGXARLXIFAWXQLEDGXYLADYNIQEGXTLHWGGPWWMQIVKTSPARHHEWIIHIDTQGKFKTRRDSPDNSNLELRMATFKKRPHLRDEICNLRKH

SEQ ID NO: 197903 - protein, 134 aa, Triticum aestivum
  unsure (1)..(134): unsure at all Xaa locations
  Clone ID: PAT_TA_92321.pep
FIAYYXRXIXLXRRXVXSXXLPXXLSRSATEFTNXFRPGXETVLXEIRYLLGIDHFRKISPDXLCRTXFRPERDXILGRLLLRXXKRTCSGKSTQGRRNRWWTQGLYKRAQTHSAKPSARDQWPSLNAASLARR

SEQ ID NO: 197904 - protein, 124 aa, Triticum aestivum
  unsure (1)..(124): unsure at all Xaa locations
  Clone ID: PAT_TA_92322.pep
TLPSIRASPGMRFGQXSLLVCLRGAQNXEXYTLNFQTTFDFPSPDDRVXGQTXYAPSMIHNLTFRNXLNRTPGTVSCDTIAXEITPQXERXXQVXQLLKYNRLTEXRILMITWXKKATXTTXPS

SEQ ID NO: 197905 - protein, 68 aa, Triticum aestivum
  unsure (1)..(68): unsure at all Xaa locations
  Clone ID: PAT_TA_92323.pep
DGRYWTMWKLPMFGCTDATQVINEXVEEVKKEYPDAYVRIIGFDNMRQVQCVSFIAFKPPGCEESGKA

SEQ ID NO: 197906 - protein, 152 aa, Triticum aestivum
  unsure (1)..(152): unsure at all Xaa locations
  Clone ID: PAT_TA_92324.pep
LVPNSARARAEFGTSSCRTAPRSLILVEDLDRYLRGGDGEXSAARAARVLGFMDGLSSCCGXXRVMVFTMXXGXXGXDPDVLRPGRLDVHIXFTMCDSEGSKAXGQQLXGLKDNKXPKLEGKGFQARXPADPAXSXNYLANXGPPAERACNG

SEQ ID NO: 197907 - protein, 102 aa, Triticum aestivum
  Clone ID: PAT_TA_92325.pep
TVYASPHPGVFLAKLSSLFRVPHTHNMHSNCLLSCLGIWIISIIGVVQCISEYRCGNNHVISNDEVQRVYNQARPVVLGQVRQRTPLSNAKYTGNLVPNSAR

SEQ ID NO: 197908 - protein, 194 aa, Triticum aestivum
  unsure (1)..(194): unsure at all Xaa locations
  Clone ID: PAT_TA_92326.pep
VPRTHPVXRXDLGQGSRVXRXQIXVXGXTPXDRXXLLHHVTTXRSVAQXRVSGYSPRLVHFALRHACXRRRGADERRRDVVGDAADPDERPAALAALPDLCSRRSQDGLPAQATPTPRTEEWAAILRRPAGGDDVDVGGGGGAAGGGPCRCLRHVVLRIARSDCGGEGRKEEEEKRRMGEISGKCRGVRVVLVS

SEQ ID NO: 197909 - protein, 191 aa, Triticum aestivum
  unsure (1)..(191): unsure at all Xaa locations
  Clone ID: PAT_TA_92327.pep
SCRIRHEVDAGARITCSLQSDIREVASKCADAAKMAGFALATSALLVSGASAEGAPKRLTFDEIQXSKTYMEVXKGTGTANQXCPTIDGGVHSFPFKXAGXYEMKNFCPGXTPLTVQXRRIQKERAXASKKTQYPLNYTFYKWKPPRTLEKGRINSGPIPGMPLSRQQLSYGNSGLLCGSLPTRAWVKTLA

SEQ ID NO: 197910 - protein, 176 aa, Triticum aestivum
  unsure (1)..(176): unsure at all Xaa locations
  Clone ID: PAT_TA_92328.pep
MPAGHGLRSRTRDLFARPFRKKGYIPLTTYLRTYXVGXHVYVKVNXAVHKGMXHKFYHGRTGRVCNVTXRSIGVEINKHVGNRIIKKRXMSXXEHXQPSKCNEDSPRXNQQRQLKRXQGXGXVITPXXTSMAQTGXMFXGTHLDVTHPYSQRVLQSLLLTESLTVQWTILLHVIPC

SEQ ID NO: 197911 - protein, 156 aa, Triticum aestivum
  unsure (1)..(156): unsure at all Xaa locations
  Clone ID: PAT_TA_92329.pep
MAPTVMASSATSVAPFQGLKSTAGLPVSRRSNGASLGSVSNGGRIRCMQVWPIEGIKXFETLSYLPPLSTEXLLKXVDYXIRSKWVPCLEFNKVGFIFRXHKHLLGYYDGRYXWTMWKLPKFRCNXAXQVXNXVEEXKKDYXTLFPINRIKSSGHG

SEQ ID NO: 197912 - protein, 103 aa, Triticum aestivum
  unsure (1)..(103): unsure at all Xaa locations
  Clone ID: PAT_TA_92330.pep
MSCCGGSCGCGSACKCGNGCGGCNMYPEVEGAGRHPPVRRPPPPTRRVRRMENARRNGGCGCTQCKCGNNCXCSCFXCRLIDRLMHRAHDTIFDSIHPTRLPP

SEQ ID NO: 197913 - protein, 76 aa, Triticum aestivum
  Clone ID: PAT_TA_92331.pep
RNPQSNSPNPNPNQAGGKRDVGPEDADGRRLRGLSPHPIVPGGQGAGGGGVGRQGHQGKGGGGVVDPQGGVRLQEK

SEQ ID NO: 197914 - protein, 77 aa, Triticum aestivum
  unsure (1)..(77): unsure at all Xaa locations
  Clone ID: PAT_TA_92332.pep
IXSTGAARAATTRRAARSDGKRRAAGTRRRPRAAVAPGAWGDGANRDTALRDATPAMARGSVRFACSSSSATVFLFF

SEQ ID NO: 197915 - protein, 102 aa, Triticum aestivum
  unsure (1)..(102): unsure at all Xaa locations
  Clone ID: PAT_TA_92333.pep
TXKGKLLPSLMPTWTGQENLTSYQWPQHLAGHDGQIFGGQKHXQRTHFNGHKXKNPQXDXEDWRVGXTXDKXGKXPIPGXXDGLXKMAWAHKLRPXKGRRSA

SEQ ID NO: 197916 - protein, 79 aa, Triticum aestivum
  unsure (1)..(79): unsure at all Xaa locations
  Clone ID: PAT_TA_92334.pep
MSCCGGNCGCGTACKCGNGCGGCNMYPEVEXAAGATLLVSATATHKASSGGMEXAXPENGGCGCTQCKSDQLRCSCCSC

SEQ ID NO: 197917 - protein, 158 aa, Triticum aestivum
  unsure (1)..(158): unsure at all Xaa locations
  Clone ID: PAT_TA_92335.pep
MALPNQNTVDYPSFKLVIVGDGGTGKTTFVKRHLTGEFEKKYEPTIGVEVHPLXFTTNCGKIRFYCWDTAXQENLGALRDGYISXGKCAITFWXPFKXLTYKKVXTXWKRIFKVCXKIPXPXXGKVIXXKAVKASNSQEEYNLPYTNLLTAGMVQIAG

SEQ ID NO: 197918 - protein, 93 aa, Triticum aestivum
  unsure (1)..(93): unsure at all Xaa locations
  Clone ID: PAT_TA_92336.pep
FAQVVHAGTVAAIKVGPPPPLSGGLPGTDNSDEARDFDLPLKNRFYLQPLPPAGGXRSRAKESAKDILNLKPLIXDKKQWXYVMKRLRSKAPN

SEQ ID NO: 197919 - protein, 109 aa, Triticum aestivum
  unsure (1)..(109): unsure at all Xaa locations
  Clone ID: PAT_TA_92337.pep
DGGAHHHYKSTELQDSLGKGAHESPVLECDDHAHWAWIDYFVCGAGEQHESLRASRSPKTFITTLIANSSKHTRGLAYQHCAMDSRQAXGXTHPXGVNHACXLXGLSPP

SEQ ID NO: 197920 - protein, 83 aa, Triticum aestivum
  Clone ID: PAT_TA_92338.pep
SCRIRHEISLQPMQDPVTAPTGISYDRRAIERWLANGHATCPVTGRPLSLTDLTPNHTLLRLILSWHPASKVAPDVAPTFGAR

SEQ ID NO: 197921 - protein, 143 aa, Triticum aestivum
  unsure (1)..(143): unsure at all Xaa locations
  Clone ID: PAT_TA_92339.pep
SCRIRHEARSVNPMDQPVIVRRELDAWTVSRALSGEVTFNFVPVADPAYIFSEFHSLAFPGVAERNLEYDTASISLDPQDKTFGGSVYEIAESTLEMLRNLSCFIIPKLRRLMCQKRQQDATXLIPAINARNCSDPKDCVTAR

SEQ ID NO: 197922 - protein, 144 aa, Triticum aestivum
  unsure (1)..(144): unsure at all Xaa locations
  Clone ID: PAT_TA_92340.pep
MAPTVMASSATSVAPFQGLKSTAGLPVSRRSNGASLGSVSNGGRIRCMQVWPIEGIKKFETLSYLPPLSTEALLKQVDYLIRSKWVPCLXVQQVGFIFREHNASPGYYEGRYWXMWKLPKFGVTDAXQVINKVEEARRIPDRFR

SEQ ID NO: 197923 - protein, 153 aa, Triticum aestivum
  Clone ID: PAT_TA_92341.pep
AAYVLTDTLLDSSLPIASTSRALPSSATRGQPGSSTLLPAASTGAGTAVVCAVHGQDTTIQDQGSRWKPTVCVLLGELINTGTILLGKVAVDGGMFIFSLLCYRSILSVIFIMPFALLLEKREVERIYKALVWSPSKLLSGYRCLWECILWAT

SEQ ID NO: 197924 - protein, 191 aa, Triticum aestivum
  unsure (1)..(191): unsure at all Xaa locations
  Clone ID: PAT_TA_92342.pep
SCRIRHEGTPPPSPHRPQVRSMAITRNYFWHAAALASPRPAHHRPRLAAHRSEAWPSRAPPAAGLDAPVEMAHTPPAACSSCSPLPLLHAGAAPTWASSGRARRXHGPARTGGAGGDDAGAPDDVGSSAGGRRTQGWVXAAQGTVXGPGRGXEPGKGGQSRLXRRXGASLTRRXNRTXDPXGXEKCXQAYK

SEQ ID NO: 197925 - protein, 58 aa, Triticum aestivum
  unsure (1)..(58): unsure at all Xaa locations
  Clone ID: PAT_TA_92343.pep
MXMAXQASAATRXLIXXVWSXSAKPRSATLXMPSSXXGPXPLCAXXSEXPXXXAPPXE

SEQ ID NO: 197926 - protein, 93 aa, Triticum aestivum
  unsure (1)..(93): unsure at all Xaa locations
  Clone ID: PAT_TA_92344.pep
MGGWYSKLSALVWSKKEIRILILGLDNAGKTTLLYRLKIGEXWVTTIPTIXGFNVESIVFKNLNFNVLGTGWANSIRPYWRCYYPNXTTVILV

SEQ ID NO: 197927 - protein, 102 aa, Triticum aestivum
  unsure (1)..(102): unsure at all Xaa locations
  Clone ID: PAT_TA_92345.pep
KLPYLQISIIPMTEETAPASPMSVEDNEEQLMKVVESQDIQPECTNDLNFENRFQANRHRTKHLFQDGFSDASFPKRAEELADKIKIQAEYGTAWVYHLTCX

SEQ ID NO: 197928 - protein, 146 aa, Triticum aestivum
  unsure (1)..(146): unsure at all Xaa locations
  Clone ID: PAT_TA_92346.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGPYWTMLEAAXFRVNXXTXXXNXVEEXXRIPSHHGHR

SEQ ID NO: 197929 - protein, 155 aa, Triticum aestivum
  Clone ID: PAT_TA_92347.pep
SCRIRHEIDDNQTFQSEPKLPRLDDKFEMKCLSAQAYRAKHIRKFAKEAYSQYMRGELQAGTFTRFPGVTVYKYVVGNHYVPDVGYAYHNILIDEIGTFLAGMLEYPAYREMAYSPCKFSIYTGYESYANSRQLHTEDDEVYDVSKYDHIFSNRQ

SEQ ID NO: 197930 - protein, 126 aa, Triticum aestivum
  unsure (1)..(126): unsure at all Xaa locations
  Clone ID: PAT_TA_92348.pep
RAEFGTSSCRIRHXNSSAXAHVYSNQILSRHHQPLQRNKSLRREISLLKENRKSPCQRHHXDEAPTXGSRHCIFEPSHYSFCYETLCLSIFGSVYGGRNQSVPERSNWKGERLLCKSMVCMMAHTX

SEQ ID NO: 197931 - protein, 188 aa, Triticum aestivum
  unsure (1)..(188): unsure at all Xaa locations
  Clone ID: PAT_TA_92349.pep
SCRIRHEAFLDFSSHVDAVAGFLKLQKRDLFLGTDVRAQISFSNTISQDDKVMEKVKSVFLDGLPPHWDEDDVREKFGKXGEIDNIXLARNMFTAKRKDFGFISFTTRQAXLDCIXMVNKGALGEXSGKIPQEGTLQRXKPTFXKLQXKGIXHXGAGGFIGKIMGQRTHLTIKAGKTLIKTTRDKSGR

SEQ ID NO: 197932 - protein, 156 aa, Triticum aestivum
  unsure (1)..(156): unsure at all Xaa locations
  Clone ID: PAT_TA_92350.pep
TIENENKCNQNIPLFKEAIVLRDEAARLLGYPDHATFRIEDKMAKTPATVNEFLGDLRSRLAAGGVKEMKHLLDIKKEDLTQRGLETTFDGNFYLWDSRFYSRMMIEKESXSDEQKIAEYXPLQSTIEGMLKILKNPWAWXNXVVGEDRAKISIEG

SEQ ID NO: 197933 - protein, 77 aa, Triticum aestivum
  unsure (1)..(77): unsure at all Xaa locations
  Clone ID: PAT_TA_92351.pep
RSKTXLSIYVXDRGIPXLXLTVDLRXVXXLXRSGRXKINELLVVDILXSGFNLRKGKVHWIXFPFPXFPXIALDHXH

SEQ ID NO: 197934 - protein, 113 aa, Triticum aestivum
  unsure (1)..(113): unsure at all Xaa locations
  Clone ID: PAT_TA_92352.pep
MANPRVFFDMTVGGAPAGRIVMELYKDXVPRTVENFRALCTGEEGRRQERQALHYKGSRSXRVIPDFMXKGXDXTKGNGTGAXPSTGKXXDEXLXXTQPDLSMASGPQRPFLI

SEQ ID NO: 197935 - protein, 65 aa, Triticum aestivum
  unsure (1)..(65): unsure at all Xaa locations
  Clone ID: PAT_TA_92353.pep
VHXLXLXMXXCXEDKXDTVXXIQXTSSXXFXYXXXREXAXEWQACFDNNNNEKAVLEPAQRLVRS

SEQ ID NO: 197936 - protein, 93 aa, Triticum aestivum
  unsure (1)..(93): unsure at all Xaa locations
  Clone ID: PAT_TA_92354.pep
RAEFGTSESVYLLGTSLARPVIARAQIRVAQKEGCIAVSXGCTGKGNDQVRFELAFYALQPTIKVIAPWRLPEFSDRFACRNDLLSYAGASHT

SEQ ID NO: 197937 - protein, 100 aa, Triticum aestivum
  unsure (1)..(100): unsure at all Xaa locations
  Clone ID: PAT_TA_92355.pep
RAEFGTRALGRKRQQKTAQEVAEPTKKSKSVEKKHSDRLATQGKVDPALEKQFEAGRLFAVVSSRPGQSGRCDGYILXEGEKLAFYQEAIKEVRNIHTLL

SEQ ID NO: 197938 - protein, 107 aa, Triticum aestivum
  unsure (1)..(107): unsure at all Xaa locations
  Clone ID: PAT_TA_92356.pep
RAEFGTRMASSATSVAPFQGLKSTAGLPVSRRSNGASLGSVSNGGRIRCMQVWPIEGIKNSRPVLLANAQQGGLLKQVDXXIRSKLGALLXFNKGWFNFREXKPNAR

SEQ ID NO: 197939 - protein, 123 aa, Triticum aestivum
  unsure (1)..(123): unsure at all Xaa locations
  Clone ID: PAT_TA_92357.pep
RAEFXTSSCRIRXXATSHSLSLSLSLSLXXGTLLRRVLLSLXLLAAAAXXXAAAGXGQAVDVVLQPQLPPRGADXLGXGRRQXAXQPVHGGXHAXXLLPXXASSXXATLXSXSXLXSXXSPXR

SEQ ID NO: 197940 - protein, 73 aa, Triticum aestivum
  unsure (1)..(73): unsure at all Xaa locations
  Clone ID: PAT_TA_92358.pep
MHIGDWSILAHTGDVGFVDXDDEIFIVDRLKELIKYKGFQVAPAELXAMLIXHPGXXDAXVFXXXDDAXXXVP

SEQ ID NO: 197941 - protein, 196 aa, Triticum aestivum
  unsure (1)..(196): unsure at all Xaa locations
  Clone ID: PAT_TA_92359.pep
NYISMGNQECSMHYYKENYRKFYSAIKASYPDIKIISSCDRSTISPVEPADLYDVHVYTSSXDMFSKSSMFDSTXRGGPKAIVXSEYAVTGKXDAGRGTLVXLAEXAFLIGFRKKQDAXXMEVVLHPXVNDNDRKWXPNAXLNQWEHYXCPNYXMLHSQRXQXGNTXPXTIXFXLYQRSIXTLGKSRWNTTKIRSN

SEQ ID NO: 197942 - protein, 134 aa, Triticum aestivum
  unsure (1)..(134): unsure at all Xaa locations
  Clone ID: PAT_TA_92360.pep
MAAQGLLSGRQLLGRPLQSSISRSSSSRKSAFVVRASSSPPAKQNDNRQLWFASKHPSPTWDGTLPGDLVRPLGLSDPEGHRRVIEPXWLAYGRFSNGXTDMXXWHXAPEGLEXXACAPERCPSRAFATTLWAT

SEQ ID NO: 197943 - protein, 145 aa, Triticum aestivum
  Clone ID: PAT_TA_92361.pep
MHVFLQLGLGLILLGAHCASGAAVPSSQCRRRCGKVEIPYPFGIDPNCSLMADVFDLSCELRDGILKPFRGIFEVLDISLTHSTARVLNNIEASCYNNTNRSMEHLAIKRARTGLLRPTALGRPQSRHGCSSPPCRSRATRDRTF

SEQ ID NO: 197944 - protein, 83 aa, Triticum aestivum
  unsure (1)..(83): unsure at all Xaa locations
  Clone ID: PAT_TA_92362.pep
AFPTIHNHMPQSVFQVPNLKRDAFKTHLGKADRESRSYGCACKSGELQSSELKSKDPISSSLPTFPKLKNDXSMYDNFHELIR

SEQ ID NO: 197945 - protein, 126 aa, Triticum aestivum
  unsure (1)..(126): unsure at all Xaa locations
  Clone ID: PAT_TA_92363.pep
QAPCKPLIKGFIQFMSTYGGSTEIPLLDSVIANAVIPGSGVSTALSLEDREDISLLFLKFVDLYGSVQELXRKAWARHSKXFPHNTRNLSQXHCTTDCNKRRITEXLKVXQDGPXXGKITFKHHLK

SEQ ID NO: 197946 - protein, 166 aa, Triticum aestivum
  unsure (1)..(166): unsure at all Xaa locations
  Clone ID: PAT_TA_92364.pep
MQIFVKTLTGKTITLEVESSDTIDNVKAKIQDKEGIPPDQQRLIFAGKQLEDGRTLXADYNIXKESTLHLGAQTPVGGMQFSVXKTLTGKTINLGXLXLRTPXDNVKASSRQGGIPRTTXSHFAXXNSXMAQLPDYNIQEGPPLVPRSVDSRQDLTRHTWRSVSHH

SEQ ID NO: 197947 - protein, 87 aa, Triticum aestivum
  unsure (1)..(87): unsure at all Xaa locations
  Clone ID: PAT_TA_92365.pep
AIFILHNSCKMRTFSLVSLAAILNYLTLPSAVGSGPVANASSYKCHDRVIGPVTLNDQIEXAYREALEAGTSPKRTKERTEFGSKIL

SEQ ID NO: 197948 - protein, 91 aa, Triticum aestivum
  unsure (1)..(91): unsure at all Xaa locations
  Clone ID: PAT_TA_92366.pep
MAAAAFSIRGYAASMRSEAAAEGRRPLGIEHLPPIKAPRFRWWADELASAVAAAAAAAAPSLRRSPRXAKPPKKKXISXLFAAXPPWTSPR

SEQ ID NO: 197949 - protein, 99 aa, Triticum aestivum
  unsure (1)..(99): unsure at all Xaa locations
  Clone ID: PAT_TA_92367.pep
RTRTGASVRRTPSRQPWPSTSSLPPTSTTPRAGPRRAGMSAIRSSLIDPDGXALXXLVAPPGSRAVLXAEAEALXRVRLXAVDXEWXXVLAXGWASPXR

SEQ ID NO: 197950 - protein, 61 aa, Triticum aestivum
  unsure (1)..(61): unsure at all Xaa locations
  Clone ID: PAT_TA_92368.pep
SVEASTLVLSDHKNLEHFTTTKKLNRRQAHWSELXQYDFKIVFRPGKQSGKPDAKIPRIKS

SEQ ID NO: 197951 - protein, 54 aa, Triticum aestivum
  unsure (1)..(54): unsure at all Xaa locations
  Clone ID: PAT_TA_92369.pep
KKSTKIKVRKSMKMEERKKKAKKKXENKKLVKKQIKNQVKWRKINKENRSYIKE

SEQ ID NO: 197952 - protein, 97 aa, Triticum aestivum
  unsure (1)..(97): unsure at all Xaa locations
  Clone ID: PAT_TA_92370.pep
MASKRILKELKDLQKDPPTSCSAGPVGEDMFHWQATIMGPSDSPFTGGLFLVNIHFPPDYPFKPPKVSFRTKVFHPNINSNGSICLDILKEQWSPVX

SEQ ID NO: 197953 - protein, 50 aa, Triticum aestivum
  unsure (1)..(50): unsure at all Xaa locations
  Clone ID: PAT_TA_92371.pep
MPVXXIAVGSHREVYXVGALKAXLAEFIXTLXFXFXGQGSGMAFSKLSPD

SEQ ID NO: 197954 - protein, 134 aa, Triticum aestivum
  unsure (1)..(134): unsure at all Xaa locations
  Clone ID: PAT_TA_92372.pep
MAQTMASMTGLSQGVRLPGPAGRRASRFIVRASSAEAEAAGRRAVLGLMASGVVGSAFAQVVHAGTVAAIKXGPPPPLSGGLPGTXNPNKXRNFNLPLKNRFYLQPLHRRKAAVRAKESXQDILNLKPLIXKKQ

SEQ ID NO: 197955 - protein, 77 aa, Triticum aestivum
  Clone ID: PAT_TA_92373.pep
KYVESMWGMGVRLRKSETGALRSAEVERCVREVMDGEKKDEYQRNATKWMKKAKKAMREGGTSDKHIIEFVAKYSSI

SEQ ID NO: 197956 - protein, 101 aa, Triticum aestivum
  unsure (1)..(101): unsure at all Xaa locations
  Clone ID: PAT_TA_92374.pep
XARPLLGEEWGAGEATSXESVVGFIRQVXFPEXPGXSPXVLNLGPKRRVLISMQKLATKLLINGVAQPKTGQYIFWFVNSVVKQQTDAVKKFQLFFQDLLW

SEQ ID NO: 197957 - protein, 110 aa, Triticum aestivum
  unsure (1)..(110): unsure at all Xaa locations
  Clone ID: PAT_TA_92375.pep
SLFXMPFCREFPGSPXTXFLTKLXHVNXKAEVLMDXLXXXLXXXGXEXXPNSARDIXPRQMVVRMSSXNLGSXELWFHXFXTKYXPYFILNLGNPILMTGNIPLNRFSLA

SEQ ID NO: 197958 - protein, 154 aa, Triticum aestivum
  unsure (1)..(154): unsure at all Xaa locations
  Clone ID: PAT_TA_92376.pep
YPWLLTTGSKFVAKPDQLIKRRGKSGLLALNKTWPEAKACIAARAGKPQKVETTVGVLRQFLVEPFVPHPEGTEYYININSQREGDWILFTHEGGVDVGDVDAKAEKLLXPVDLSEYXSNEAIATGLLGXXPKVFXMFWXFXTRLRYLTSIYYL

SEQ ID NO: 197959 - protein, 73 aa, Triticum aestivum
  unsure (1)..(73): unsure at all Xaa locations
  Clone ID: PAT_TA_92377.pep
MVKAVAVLTGSEGVKGTIFFTQEGDGPTTGDGXVSLGLKEGLHGFHVHALGDNNNGCMSTGPHFPAGHVMGRR

SEQ ID NO: 197960 - protein, 125 aa, Triticum aestivum
  unsure (1)..(125): unsure at all Xaa locations
  Clone ID: PAT_TA_92378.pep
MADQLTDEQIAEFKEAFSLFDKDGDGCITTKELGTVMRSLGQNPTEAELQDMINEVDADGNGNIDFPEFLNLMAKKMKDTDXXEELXEAFRVFDKGQXNXFIXGGGXRTYDKLNLRPRSGQIFGG

SEQ ID NO: 197961 - protein, 85 aa, Triticum aestivum
  Clone ID: PAT_TA_92379.pep
TSNLSQKCGKEKRELILIGPRFREQHHFNDERSTSKVWRTSLTFLASDASLHLGHFSTQTLLVSIWKCPAGVMAPCMTFCCTGSG

SEQ ID NO: 197962 - protein, 85 aa, Triticum aestivum
  unsure (1)..(85): unsure at all Xaa locations
  Clone ID: PAT_TA_92380.pep
TXLXVMXXXSXGIFYKGXXWVXCCHQGKLIXSXGSXFRRXPVVXLFIRIRXIKFXTPIHNXLETRTTVQHFNYCSCELLWFHVCF

SEQ ID NO: 197963 - protein, 70 aa, Triticum aestivum
  Clone ID: PAT_TA_92381.pep
WHARSQDFIARCPEQVIDTVVRAAKCRPFCKSISQILKGQSRLNYRFKARRTTLVQRGQSIKIVVVNKLV

SEQ ID NO: 197964 - protein, 143 aa, Triticum aestivum
  unsure (1)..(143): unsure at all Xaa locations
  Clone ID: PAT_TA_92382.pep
IKPADFHAAQTAWNARQVSSPTRRSQPPQPDLLRVHTFAPLLPTLCCHAPEKEAWRCSTKEEAGAWRRWSPVLQHNTGRPEAGAVHRRRKSRPRGXRHSDGATIQHKRRPDPLSSPGHTAWCKELSRGSXVACNVPRCXSTCQ

SEQ ID NO: 197965 - protein, 71 aa, Triticum aestivum
  unsure (1)..(71): unsure at all Xaa locations
  Clone ID: PAT_TA_92383.pep
AIGAAQDAARMARVVSFYEKLPRGPAPEIKPXGMLGRYQAXYFGKNSSAXTIIQSCIMLXLGXAQNYYFNX

SEQ ID NO: 197966 - protein, 110 aa, Triticum aestivum
  unsure (1)..(110): unsure at all Xaa locations
  Clone ID: PAT_TA_92384.pep
SCRIRHELGSIPLVHINDVCEAHIFCMERSFDVAGGRYLCTTAHTNMHDVLEHYAGKHPELEIVDKEVVGEGVRVHVNTNKLVELGFKYKXGAKEVLDGSVDCGKRLGVL

SEQ ID NO: 197967 - protein, 51 aa, Triticum aestivum
  unsure (1)..(51): unsure at all Xaa locations
  Clone ID: PAT_TA_92385.pep
PSLGFPXRGGGEEXRDXWXXRXIAAXWXAXXWVIDDNNLQXCXQSVCEXSS

SEQ ID NO: 197968 - protein, 142 aa, Triticum aestivum
  unsure (1)..(142): unsure at all Xaa locations
  Clone ID: PAT_TA_92386.pep
VDVKNRQVKAKQVTFHRKKNLQYYEISAKSNYNFEKPFLYLARKLAXDPNIHFXSEAVALTPGMTFRPGPCKQQHEADXAAASGTPLPXDDDDILIRVERGMILVPQIQYFKPKTQSLSKLDFGVIPDFFPSALPFGAAFGL

SEQ ID NO: 197969 - protein, 97 aa, Triticum aestivum
  unsure (1)..(97): unsure at all Xaa locations
  Clone ID: PAT_TA_92387.pep
DLFIFFDSSILQKDLKQGLLVLFGLAEEVFAVSRVVICLGRSIDNLSRNSLMKNLRWVGFEPTTLSPWAXRLSITSDKWPFSGLEMLVRRLSISLWL

SEQ ID NO: 197970 - protein, 69 aa, Triticum aestivum
  unsure (1)..(69): unsure at all Xaa locations
  Clone ID: PAT_TA_92388.pep
XXMPSNRLDAMRYLGXKDKTSDXKXXCLXXVKAXXVXXPHRWVXXLGSLVGEXCXYRXQYLAVPLYXXL

SEQ ID NO: 197971 - protein, 73 aa, Triticum aestivum
  unsure (1)..(73): unsure at all Xaa locations
  Clone ID: PAT_TA_92389.pep
EQVGFEGIAXAVXGGRRTXGGAXSSAXRSVXLVRKLATALSEGRMXRXAXGIWSAXNDPEXLXDVLSFSLQXL

SEQ ID NO: 197972 - protein, 116 aa, Triticum aestivum
  unsure (1)..(116): unsure at all Xaa locations
  Clone ID: PAT_TA_92390.pep
XKTSGLDMLVYXPQSNALRLVESKKCNATXYLYTXESRLLXLASGMXCTLFTGYQFSAGGIXKLPXFXMXMXKSXANNKPVLXAADVHXXTVXXXIYCLXXGRXRMGLXPXRFPVM

SEQ ID NO: 197973 - protein, 82 aa, Triticum aestivum
  unsure (1)..(82): unsure at all Xaa locations
  Clone ID: PAT_TA_92391.pep
RGRSXLQSXLGLGIVAHLTSNFTWXVWQPILPXQPHIXFSPXEDWWRHKSXFLETQSLAFXXSCXXYIIPGXVAXXQTXLSV

SEQ ID NO: 197974 - protein, 151 aa, Triticum aestivum
  unsure (1)..(151): unsure at all Xaa locations
  Clone ID: PAT_TA_92392.pep
LVPNSARARAEFGTRHNLTWYQTRASSILLSLFASAMNRLLRRTRSVDLDSPATEPFAAVPLATAALPLATAAVPATRRAPLRRPRQDARPQRRWGLRPRLTQPSHPTTRGHPPDRGAXRRSPASRWAXRRAVLPHAAXXPRCGLLRXRLR

SEQ ID NO: 197975 - protein, 79 aa, Triticum aestivum
  unsure (1)..(79): unsure at all Xaa locations
  Clone ID: PAT_TA_92393.pep
HXLXQCNXXINGDXNGHSLVAAXCTNSXERLAGGLRXWXGGMGRREEWLTYNYKGXDSKALFXXXQTXYWYAGRVDMLV

SEQ ID NO: 197976 - protein, 131 aa, Triticum aestivum
  unsure (1)..(131): unsure at all Xaa locations
  Clone ID: PAT_TA_92394.pep
QIIXXIKLSISILXLMITPMIRCLRPIKCNLPKHILRKNXTFTQAVTNPANRTQIYISQSXNPYVNLSIXTYFLLNTPVXLXNLISXLKPXKYYPXVPTKIHXTXXNXRXXALXXPKHSXFXPLCXXGLYS

SEQ ID NO: 197977 - protein, 122 aa, Triticum aestivum
  unsure (1)..(122): unsure at all Xaa locations
  Clone ID: PAT_TA_92395.pep
MAASMITSPIVAPTSVPSLSRRGSSFAVVCSGGKKIKVDKPLGLGGGLTVXDIDANGRKVGXEGVYXSVDXYGAXVDGYXXIYTPKNGXSGNAXPXXNXVLNXRNXAGSXGGPRLKNKFSVK

SEQ ID NO: 197978 - protein, 58 aa, Triticum aestivum
  unsure (1)..(58): unsure at all Xaa locations
  Clone ID: PAT_TA_92396.pep
MLPRRMLPQSIFLAAQGLXFFVGESMHDDGGVVFAYYQGGTADPXFLYFAHGLKEVKX

SEQ ID NO: 197979 - protein, 76 aa, Triticum aestivum
  unsure (1)..(76): unsure at all Xaa locations
  Clone ID: PAT_TA_92397.pep
VIEYSEPTGYRKIPGDTCTTNGYPGMDESTLHPCPGKEEEFRKKHSASGVGIFFAVIASFAIAGAAXWWVWKNWGP

SEQ ID NO: 197980 - protein, 88 aa, Triticum aestivum
  unsure (1)..(88): unsure at all Xaa locations
  Clone ID: PAT_TA_92398.pep
MDDAGLXIAAALTGGIFVVLLVLLVVVLVRXRWLDREGVASGRGFVLFGVCCQDGTQGRFVRTSSLARXRQRAARGGEEXDDEPDXGD

SEQ ID NO: 197981 - protein, 60 aa, Triticum aestivum
  unsure (1)..(60): unsure at all Xaa locations
  Clone ID: PAT_TA_92399.pep
XXIHLTXFGDIWAHTCRXMNSNIXKXQNFCXKDPSNFQFFYTLVXCCLQEVHXHXYVQCX

SEQ ID NO: 197982 - protein, 123 aa, Triticum aestivum
  unsure (1)..(123): unsure at all Xaa locations
  Clone ID: PAT_TA_92400.pep
MAAMKIALLAVAAMAVLLGTASAVTYNVGDQGGWTLSTDYSSWVSGKXXNXGDEFVFKYSNPTHNVGQRSTKAXYNPXXIDGASKPWLREINLKATEPFKRGPNNTQRRRRGISSPLPCNKAA

SEQ ID NO: 197983 - protein, 150 aa, Triticum aestivum
  unsure (1)..(150): unsure at all Xaa locations
  Clone ID: PAT_TA_92401.pep
AVRDERHCDTGAPGHHRGKSHVRHSQDATGRRARPDAGGSGVRPRDRDRAPSNLVRIGARHGLCSLAANHASRSAGARATVLHFPLLRRTRXLESTIQALSIRNKDXXPEXPPSGSXXPSXRVKVGDPXQXESLPXGGXRRCXQGDXQXF

SEQ ID NO: 197984 - protein, 111 aa, Triticum aestivum
  unsure (1)..(111): unsure at all Xaa locations
  Clone ID: PAT_TA_92402.pep
CDETLWSYGKSRGYMAGGKAWVLDSGCTDHMTRDKDMFRELAENDDLENIHSWVITQXERLLXXVKXASHMILPYKXXXVEPWGTITSXPNFRFGSRLXPSNAMFXKNLXG

SEQ ID NO: 197985 - protein, 97 aa, Triticum aestivum
  unsure (1)..(97): unsure at all Xaa locations
  Clone ID: PAT_TA_92403.pep
HFRLQEHLLLTGAFISXHERYIKTSLPKLEGDXLDAFXXNVESATKXYLLSKLQGLQFFVGXESMHDDGGVVFAYYKEGAADPTFLYFAHGLKEVKC

SEQ ID NO: 197986 - protein, 96 aa, Triticum aestivum
  unsure (1)..(96): unsure at all Xaa locations
  Clone ID: PAT_TA_92404.pep
LVPNSXRSRTPPXSTPTXLSPPSLAWPTTAATATAKDTRPPPPRRTATARDTARATATRPPPRRTGQRPXDTXRATATRPRRLSRPRSPPXRTGIX

SEQ ID NO: 197987 - protein, 168 aa, Triticum aestivum
  unsure (1)..(168): unsure at all Xaa locations
  Clone ID: PAT_TA_92405.pep
LVPNSARAARAPIGKGHVSLNLTLRRTFNLFANVRPCRSIAGYKTPYDGVETVIIRENTEGEYSGIEHVVVDGVVQSIXLITREASERVLRFAFXMLRILGKPKVRVVHKATIMKMSDGLFLATAXRVXKDFPDXIEFDXXLLXXNTCPKKXSPDSVPYNDXGFGLIP

SEQ ID NO: 197988 - protein, 25 aa, Triticum aestivum
  unsure (1)..(25): unsure at all Xaa locations
  Clone ID: PAT_TA_92406.pep
XFFFFFFFFFFFFFFFFFFFFFRNE

SEQ ID NO: 197989 - protein, 95 aa, Triticum aestivum
  Clone ID: PAT_TA_92407.pep
DMVISSADVRAAHERAISRINNPSTDNKFPINIQYRGNITPTANPAYYWYVTQLTDSQGRAGMKYYLLTSASGDILGMISTGWGRDLGTSDTWCT

SEQ ID NO: 197990 - protein, 136 aa, Triticum aestivum
  Clone ID: PAT_TA_92408.pep
PPFLPNSGTSNMKFLNTLATLAISTIAAAHCMKKGQQISASFISNPSDEMLPGANLVYYCTDEDIDSSISITNLDVFPGIPTAEDSTEISISGIFLKPIDPNSYVLLRDVVTGEQLNSQQILICPFLESVGYSCPS

SEQ ID NO: 197991 - protein, 125 aa, Triticum aestivum
  Clone ID: PAT_TA_92409.pep
PNLFGYQFLLQVTSLQSLATTTVPFQPAATASGSSFPEVSQSYSNGLSGGAIAGIVIGVTAGIALIILLCFCCLVKSGFKRILAKFCFWKRKGRSDRVSENQSRINSQTSPSDRREKTGFKDKLT

SEQ ID NO: 197992 - protein, 67 aa, Triticum aestivum
  Clone ID: PAT_TA_92410.pep
PPPRAEFGTSSFGVLVLEIVTGRRNDGSYNIEQDIDLVNLVWEHWNRGNVIEMIDPSLSNPRAEFGT

SEQ ID NO: 197993 - protein, 78 aa, Triticum aestivum
  unsure (1)..(78): unsure at all Xaa locations
  Clone ID: PAT_TA_92411.pep
WIPNRGXXFRQACLRRSTGXGXMXRXTXGIIGKRAADGPXEMLEXXRPEGSYGXXXNACXLLICARAQCSRAGRTVAX

SEQ ID NO: 197994 - protein, 173 aa, Triticum aestivum
  unsure (1)..(173): unsure at all Xaa locations
  Clone ID: PAT_TA_92412.pep
GGSIDMATTSGPGSKARNSHRLRDLCCDLQAQRHSRSLLKCLLFILPGLAVLAAGVLLLLRFAVTPQLKAYIEDARLTSFVPTGIPSPSGSAATYNVSISVALTVRNPNGAMDIKYTKPLVSAFLFXDRAPVQRHRXQAQGHKQQGRSKKGRCTSSNNXAGKVPVLSGTPRXP

SEQ ID NO: 197995 - protein, 53 aa, Triticum aestivum
  Clone ID: PAT_TA_92413.pep
SPPEYYNRILEWNQIIAHLSNNTKATEMWFQGACLSTKPTSRSTILKTSIFKR

SEQ ID NO: 197996 - protein, 134 aa, Triticum aestivum
  unsure (1)..(134): unsure at all Xaa locations
  Clone ID: PAT_TA_92414.pep
MAPTVMASSATSVAPFQGLKSTAGLPVSRRSNGASLGSVSNGGRIRCMQVWPIEGIKKFETLSYLPPLSTEALLKQVDYLIRSKWVPCLEXFSKVGFIFREXHNASPGVLTIGRVLGQWEACLCGMQPTPTQGD

SEQ ID NO: 197997 - protein, 123 aa, Triticum aestivum
  Clone ID: PAT_TA_92415.pep
SVIMRFSSIVIIFQSASIFLTVLAVYTKSHIPEERKKFLCGGRSITYSEYSWSALVETTNVSGNRISWSWANQLSHLMSDSSNQNFVLFGPESEVSKFYILQDLTTGGSSDNHNHVFEYIVPC

SEQ ID NO: 197998 - protein, 37 aa, Triticum aestivum
  unsure (1)..(37): unsure at all Xaa locations
  Clone ID: PAT_TA_92416.pep
SCRIRHEGLYIFIYRYMLDLALTFINRGAEXMKTWLH

SEQ ID NO: 197999 - protein, 148 aa, Triticum aestivum
  unsure (1)..(148): unsure at all Xaa locations
  Clone ID: PAT_TA_92417.pep
HWLARAQXPEKGFWXQSQHTXPLNCPSSCNXSXFKRREFPMKLAHCLSVXPSLASRPPTDPVSRARRRGQPSRAEPIVDLAAASPSLSASRPSNLPVKHGAVELPVDPGASRSRSASVFGGGSRSGAVAWFEVSRVEPERGRECFFFF

SEQ ID NO: 198000 - protein, 166 aa, Triticum aestivum
  Clone ID: PAT_TA_92418.pep
RSKSDLTKLDVQSESSTWCGKAYQTENTAIPPSGQFKYPEAKPIKSLYLDVKPRYTIFLDSDPTIELLIDASFSNLFGTPLPENATTSFETLSIDLQCSEMNMTLSQIMVTVGKEINKISLSTGFLPARLQPYLITVIGYPPNSEQLYNTKYGCLCSTFSKDREVL

SEQ ID NO: 198001 - protein, 139 aa, Triticum aestivum
  Clone ID: PAT_TA_92419.pep
ALPLISDGLFPQARISIPWNHFPEMKFISTVTAAALAGLLLLVPAACGNRHYICDRGDPIDEVVALRAMNNAFMIEHSHEHPAIPTGEPQWSFFFTKSLNAHRLGIACYLLQVYGDPPNYQLSQSFKKEWRLCSLEDKS

SEQ ID NO: 198002 - protein, 88 aa, Triticum aestivum
  unsure (1)..(88): unsure at all Xaa locations
  Clone ID: PAT_TA_92420.pep
SRVFFFFFFFFFFFFFFFFFFFDESGTGXXKQXKXGSGIVVIKSNFNLXSEXXETHPRXAGAGFRRSLLGKLDNXXGPTPSPTLPLPT

SEQ ID NO: 198003 - protein, 171 aa, Triticum aestivum
  Clone ID: PAT_TA_92421.pep
RRRTKKRTHVGSNNGPATKLASSKSSKTPKTMVIRIGAGEVGPSVSQLVKDVRLMMSPDTAARLKERRANRLRDYITMAGPLSVTHLMLFSRSESGNTNLRVAITPRGPTLNFQVEKYSLCKDVRKAYKRPRGRGKEYITAPLLVMNNFTTPSSADTKAENKVPKHLEVSR

SEQ ID NO: 198004 - protein, 163 aa, Triticum aestivum
  unsure (1)..(163): unsure at all Xaa locations
  Clone ID: PAT_TA_92422.pep
MXPTVMAXSXTSVAPFQGLKSTXGLPVXRRSNGASLXSVSNGGRIRCMXVWXIXGIKXFETLXYLPPLSTXALLKQVDYLIRSKWVXCLEFXKVGFIFREHNASPGYYDXRYWXMWXLPMFGCTDATQVINXVXEVTKXYPDSYVXIIGFDNIRQVQLRQASP

SEQ ID NO: 198005 - protein, 95 aa, Triticum aestivum
  Clone ID: PAT_TA_92423.pep
ARFTELKHAACHAPPDIHSIAVSLAVKFRDVRFLLASYQRKENVRFSGLFLFSFSFCVGSKQSVNETGISLLRRHVDKPLVRPKKKKKKKKKKKK

SEQ ID NO: 198006 - protein, 169 aa, Triticum aestivum
  unsure (1)..(169): unsure at all Xaa locations
  Clone ID: PAT_TA_92424.pep
WPGLFRDVVNPAEIYPWICTNFAPRLNFPDIITYKITEDASGAIAGWTALQIPWKYLHPSVMTDELKAQVTKKELPPPLPGMDVESLADAYRTMGGSKLYGYDPENDYHRRGTMIRPDMQRKGFGSFLTQYCNQIVDHTGDRLWTRSRPSSQKMFRQNEFVEVGRLDSX

SEQ ID NO: 198007 - protein, 163 aa, Triticum aestivum
  unsure (1)..(163): unsure at all Xaa locations
  Clone ID: PAT_TA_92425.pep
MDSEATPRILTVGVLALQGAFSEHFTLLRQAARNLTTPCSWTFREVRTEPDLAACDALILPGGESTTMALVAQRSGLLEPLRHFVKIAQKPTWGTCAGLILLADAVVXXSGEGGQDLIGGLHVQAARNHFGRQTESFEADLHLPFLAANSPPDASTEAPATTA

SEQ ID NO: 198008 - protein, 122 aa, Triticum aestivum
  unsure (1)..(122): unsure at all Xaa locations
  Clone ID: PAT_TA_92426.pep
RDXYLHSLQRPRKAGTTSSFSSCCSSRRASLNLNRPSHQHPRDPPGEAPLSLGSAVKAVAEPGICSFDGAMEAGLPEVETCRGGRLQPYRASRARETGGQRRTCPWPWRQGGRRRPEAGGRE

SEQ ID NO: 198009 - protein, 80 aa, Triticum aestivum
  Clone ID: PAT_TA_92427.pep
MHPTTAVKMFKTTNRMRSIPKEEQSAHTISQRLRNLKKIPPELIPLGMVVGVAVGFAGYSLLKKFWVDKTMRLSRQNRKD

SEQ ID NO: 198010 - protein, 49 aa, Triticum aestivum
  unsure (1)..(49): unsure at all Xaa locations
  Clone ID: PAT_TA_92428.pep
KSSXDAGXQXIAKEGVXSLXKGAGXNXXRGVAGAGVLSXYDQLQXLLFG

SEQ ID NO: 198011 - protein, 109 aa, Triticum aestivum
  unsure (1)..(109): unsure at all Xaa locations
  Clone ID: PAT_TA_92429.pep
FXXXGGPXTSKVSGLXDQSLXLPPLTPQGXGAQPLESTPRGRVISSAFPPSVFRSCLANRPSHPQDSNLCLPVRLTGRRMLLGFVQTFGFSRIXATDCTPIPPSITSDT

SEQ ID NO: 198012 - protein, 110 aa, Triticum aestivum
  Clone ID: PAT_TA_92430.pep
ETPYYSGSDLNNLAVAAALACVREESLIVDKPAHSSPRILEKRHFDQALGEISASIDEDMHSLVAIKKFDEKYGDRKGRRKKGPGLGFGSSLLVERDSNAARVRPPLSPK

SEQ ID NO: 198013 - protein, 146 aa, Triticum aestivum
  unsure (1)..(146): unsure at all Xaa locations
  Clone ID: PAT_TA_92431.pep
TIEDMACPIKHPTLLIPGPIEYDEAVLQSMSHYSESHISSSFIETFSETLSMLRKLFQTEDPSSQPFVISGSGTLGWDLVAANLTKPGXDVLVLHSGYFADSFANWFWRYMGFRATXLKGPIGSMSWIKKSEERPKEEKDQNGWTG

SEQ ID NO: 198014 - protein, 107 aa, Triticum aestivum
  Clone ID: PAT_TA_92432.pep
CYWPFFIYDSTEHPTPLCPQAKDKEKILCGLLQSLPLHWFKLTRALSLPVLPRISNTHDTVITSSLLTEPEYCLRYEMIRKQCNRCSPSPVTLQEINLSYSCIGSLL

SEQ ID NO: 198015 - protein, 72 aa, Triticum aestivum
  unsure (1)..(72): unsure at all Xaa locations
  Clone ID: PAT_TA_92433.pep
RVFFFFFFFFFFYFXFHHEYVFHTFPIPYTKQVXTKWRVLXLILLMXKCTVHPNNKREDLXFLKXWXNPGLA

SEQ ID NO: 198016 - protein, 54 aa, Triticum aestivum
  Clone ID: PAT_TA_92434.pep
PEIGKSAGLYSFVGRSLVSKVQFMYGHEFLTSYLLFSGSCGGIKLGLSEIGSWL

SEQ ID NO: 198017 - protein, 122 aa, Triticum aestivum
  unsure (1)..(122): unsure at all Xaa locations
  Clone ID: PAT_TA_92435.pep
TPFRRRLRGPAIHQPAPPLQSARAGGAPWPAGSPPSSRPRKPSSTKSTSRRRSRSASPPPPPTSPPSSSPPPPRSSTPPRRAGRRRRPRXPPSXSASPPGATPSLFSVPSAXRSASADFSVA

SEQ ID NO: 198018 - protein, 88 aa, Triticum aestivum
  unsure (1)..(88): unsure at all Xaa locations
  Clone ID: PAT_TA_92436.pep
MMSGEAWLYLLSVXINAVNLFLQVFFTIMYSDLXECDYINPXIXLXNRLXTYIIPEAAVXGXLTALFLINGXRDTHSSTPLVNNQLNS

SEQ ID NO: 198019 - protein, 107 aa, Triticum aestivum
  unsure (1)..(107): unsure at all Xaa locations
  Clone ID: PAT_TA_92437.pep
LQVVSRREGMAASXPWVARSPWSNSMPANTIKPTTSDKLIFTTVLRCSLSQSRGEFLVRTWLSSYVVENLRHAHMRILVNMEHKLGSRCGALMRVSDADVDDARRRA

SEQ ID NO: 198020 - protein, 178 aa, Triticum aestivum
  unsure (1)..(178): unsure at all Xaa locations
  Clone ID: PAT_TA_92438.pep
LEGKNSAGSTLNGADGTINWSVIDRWPVHTGLIEAIAQNIKKKLLEYSEDQRDKVILLFSAHSLPMSVVNRGDPYPAEVAATVNAVMQRLEHSNPYRLVWQSQVGPSAWLGAQTSDTVTNYISKGNYNMILVPVAFTSDHIETLYELDQEVIGESGQQDXXKRSESLNGHPGFNQALG

SEQ ID NO: 198021 - protein, 76 aa, Triticum aestivum
  unsure (1)..(76): unsure at all Xaa locations
  Clone ID: PAT_TA_92439.pep
TPLXLLWARVCEKIPHALSHCGKXLLHGIHIYLGSRATSKAHSGCGAPTRISQHLNSTKSSSSFRSVLTFTEVYRQ

SEQ ID NO: 198022 - protein, 139 aa, Triticum aestivum
  unsure (1)..(139): unsure at all Xaa locations
  Clone ID: PAT_TA_92440.pep
QHLSEGRLTCVLPSRTHLSSPLHRAVEVASELPFPSGAVLPAIATEGSLEINPPCTLHAAVRPPSMRRTRRRVERCPGPGAEPHVDAHHEPDVRVRGRPSRYPGRRGRQARAGTAAQGIAGGRXGRMPSSSPLPRSRRP

SEQ ID NO: 198023 - protein, 48 aa, Triticum aestivum
  Clone ID: PAT_TA_92441.pep
SRTQSYTLSSELTTTSHCLALYVSLMALTFSCHDIYTDSLICRFIIAR

SEQ ID NO: 198024 - protein, 116 aa, Triticum aestivum
  Clone ID: PAT_TA_92442.pep
LVPNSARALSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 198025 - protein, 69 aa, Triticum aestivum
  unsure (1)..(69): unsure at all Xaa locations
  Clone ID: PAT_TA_92443.pep
SLXGXRXRITSSVXEPNLXCGKQRXQDXXRNFVKEAWXSVXSENLXXLIQSMPARCQAVVDADGGPTRN

SEQ ID NO: 198026 - protein, 181 aa, Triticum aestivum
  unsure (1)..(181): unsure at all Xaa locations
  Clone ID: PAT_TA_92444.pep
MDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASNSXKDXPAXEAANFNAQVII

SEQ ID NO: 198027 - protein, 65 aa, Triticum aestivum
  Clone ID: PAT_TA_92445.pep
RYWTMWKLPMFGCTDATQVINEVEEVKKEYPDAYVRIIGFDNMRQVQCVSFIAFKPPGCEESGKA

SEQ ID NO: 198028 - protein, 159 aa, Triticum aestivum
  unsure (1)..(159): unsure at all Xaa locations
  Clone ID: PAT_TA_92446.pep
MAQVSGLGAFFIIIFLLVLGCTGWIIYTNVQARRLGLPQPTLSSHLPFRNQSSSPGSGGFGEKVVGWVHDKVHVFRRRKTQAGAEGYAEPLSRSGRGGVNNRGFGPLDPXDDAWDTRVGTKADLYGPSGYXEEHELNAHHTSGSQHAMKKGASPISSAP

SEQ ID NO: 198029 - protein, 53 aa, Triticum aestivum
  unsure (1)..(53): unsure at all Xaa locations
  Clone ID: PAT_TA_92447.pep
IGRPGSXXGMXXTTERXRMRSXXVDEGAXDEPPALTXGACXXXVXWGWSXLAA

SEQ ID NO: 198030 - protein, 66 aa, Triticum aestivum
  Clone ID: PAT_TA_92448.pep
ANYGSVKKVYVVAMEDVAFSEDMQRWMVDLSPGTEAVEIAGADHMAMFSKPRELCDVLLGIASKHD

SEQ ID NO: 198031 - protein, 127 aa, Triticum aestivum
  unsure (1)..(127): unsure at all Xaa locations
  Clone ID: PAT_TA_92449.pep
MNSQTSNLFDYALKSNDAWANYKGHQNPAFFQKAEAGQXSPSILWLGCSDSRXCRETTVLGLQPGDVFVHRNIANIISPTGYXTSMAVIEXYAVEHLKVNHIMLCGXTCCGGAXAALDDVRVRGVNX

SEQ ID NO: 198032 - protein, 143 aa, Triticum aestivum
  unsure (1)..(143): unsure at all Xaa locations
  Clone ID: PAT_TA_92450.pep
KPEXIRHLXAAAKELLLKQPTLLQLSAPVNICGDIHGQYPDLLRLFREIGPPSAANRYLFLGDYVDRGTQSIETICLLLAYKLKYPDAFFLXXGNHECAAVNKQYGFYSECASRGRRIVRLWEELNAVFACLPLAAPRAEFGT

SEQ ID NO: 198033 - protein, 177 aa, Triticum aestivum
  unsure (1)..(177): unsure at all Xaa locations
  Clone ID: PAT_TA_92451.pep
CLWLTSLXXKVGHSHCQLXHELPXPPPAPIPVDVXPAXFAAXLGTRLVAPLTGEPIALGGTXRLRRRXFRXGKPQAEVLPXCPLPALRRQVAVLKLANSAAAPGSNLPLPISRHRRPVDVDRNMSDDAAFHGRPFTRSSVSSSCHHGRLLISSHAMVSSMDQYLINDLRNLGLCGKK

SEQ ID NO: 198034 - protein, 111 aa, Triticum aestivum
  Clone ID: PAT_TA_92452.pep
RAEFGTRFVQALASPLYLNHLASQKYFENPAFIAYLQYLQYWSRPPYSQFLTYPGPTLKNLELLQQERFRTDILSPEIVKMMVEEGIKICAEGPSASCETTKGTQENPKIP

SEQ ID NO: 198035 - protein, 106 aa, Triticum aestivum
  Clone ID: PAT_TA_92453.pep
FFFFFFGWERRAFARADGFVFIDRVATSLIAYKSLGLQSWRTRDRLEIDIQDNKNINYNKLLVYPKLQSSVAKSSGAYNSVMLFNRENIRHICTFLEVGSCRIRHE

SEQ ID NO: 198036 - protein, 83 aa, Triticum aestivum
  unsure (1)..(83): unsure at all Xaa locations
  Clone ID: PAT_TA_92454.pep
LGKXLEXSMAXACGAMCXCANRYTLSXNCSWVSSKRREEEAESHRRAGXAPXAXRRSAGSRRCXAAATVRSLXRSPSCRIRHE

SEQ ID NO: 198037 - protein, 138 aa, Triticum aestivum
  unsure (1)..(138): unsure at all Xaa locations
  Clone ID: PAT_TA_92455.pep
MAPGGPPGSGRGRGGKFKKFTRGGGKNFSKNLRPLDAEGNEMAKPDADNNSEKEEDSSDEDSLEEEESXKSNLNREERRAAAKAKKEAAIFKKKAGCLRLVIYRLISERRKSRLKLCNLIQNHTKGSAGSKQWPSAGD

SEQ ID NO: 198038 - protein, 124 aa, Triticum aestivum
  unsure (1)..(124): unsure at all Xaa locations
  Clone ID: PAT_TA_92456.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSGVPGKXCGVSVPFPIKQCPXTATNVN

SEQ ID NO: 198039 - protein, 84 aa, Triticum aestivum
  Clone ID: PAT_TA_92457.pep
KPAESQFAFARVWANDKGSLAEYQNEDDQSATPNFSAWDKILEQREADAAIEAAKNMETFGRGKRARQMKHHELEADSCRIRHE

SEQ ID NO: 198040 - protein, 176 aa, Triticum aestivum
  unsure (1)..(176): unsure at all Xaa locations
  Clone ID: PAT_TA_92458.pep
LVPNSARAGTEMNFTTDEKYASICDDKNMYVDYKNITKVIEPGRIIYVDDGVLAFDVLKIVDEQTIHVRCRNNGKISSKKGVNLPNTDVDLPALSEKDQADLRFGVKNNVDMIFASFIRRGEDIKHIREILGEEGKHIQIIAKIENRQGLNNFAEILKETDRVMGAKGDXGIEITX

SEQ ID NO: 198041 - protein, 87 aa, Triticum aestivum
  Clone ID: PAT_TA_92459.pep
LCVRASMEIDYQCNALGLSCSYDLDGIIGKRPHNFHLDFYLVANSKFREGREYLFYRNPILGENPVTPANLKELSHLYSCPVALACL

SEQ ID NO: 198042 - protein, 78 aa, Triticum aestivum
  Clone ID: PAT_TA_92460.pep
PLVVFRHQRYKISPTSFKEIFIGYFDFDFIILIWRPMCYGKTFCNQCLWGKLKVKRLTWGEGKATITSEWYSQMKSEA

SEQ ID NO: 198043 - protein, 162 aa, Triticum aestivum
  unsure (1)..(162): unsure at all Xaa locations
  Clone ID: PAT_TA_92461.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTXGGFXGXVSPKDGQTREQRXLALILGVKQIDLLVEDWAIPNF

SEQ ID NO: 198044 - protein, 83 aa, Triticum aestivum
  Clone ID: PAT_TA_92462.pep
ACCKMKFLSIATMALFVVMSASIHITDEGQIFSNGARRPVLNSNFSMSCLQNTIYTETEIVDFAAKAYQELERSVSSLGKMQI

SEQ ID NO: 198045 - protein, 144 aa, Triticum aestivum
  Clone ID: PAT_TA_92463.pep
RTYAAVFSAAADDSYKKTVNRNTVASFLGALRGLAAVSHILLQGALESLCHGHPRVAVSEYAFNSDVENMYREFVQGMRDVEDEIRSASAVKTCRLVVPVILASTELTGSFVGLMLDRRRRALEKARSEIGGSMTFVSRFALMY

SEQ ID NO: 198046 - protein, 99 aa, Triticum aestivum
  unsure (1)..(99): unsure at all Xaa locations
  Clone ID: PAT_TA_92464.pep
LSYQHSESQGANSWQIHTVCQLQPQLRVQIXXFXXTNXENWTALDTLVKPCTIKRMDDGGYMLREGGNAGEAVLRFLRMFLILSFYMLGHWPRLDSSSA

SEQ ID NO: 198047 - protein, 90 aa, Triticum aestivum
  Clone ID: PAT_TA_92465.pep
RAEFGTSSCRIRHEVLATGGAKIDAKGAAYLAGTTRFFLTASSRANILSSKGNFSVCISFHSLLCILNALTAYAMSSVVIVMMPSSSSSE

SEQ ID NO: 198048 - protein, 180 aa, Triticum aestivum
  unsure (1)..(180): unsure at all Xaa locations
  Clone ID: PAT_TA_92466.pep
LAGKSPPTDRSEGHLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVEXSSDTIDNVKXRRFKDKEGIPPGPTSALNFAGQSSFEGWPERSADYNIQERSPTLQLGAAPLVMQI

SEQ ID NO: 198049 - protein, 89 aa, Triticum aestivum
  Clone ID: PAT_TA_92467.pep
AGGWTCAGRNFEGDEVRAQAEHWAREGIDKVSDFVNDEGGQLYYFEVGRETQLTESCTGCRAYTNKSGKIYNLRFLDYDDGQWKLCTPY

SEQ ID NO: 198050 - protein, 131 aa, Triticum aestivum
  unsure (1)..(131): unsure at all Xaa locations
  Clone ID: PAT_TA_92468.pep
MPSYNLEDSPLGLFRNNALSRVLVDTYNSFAERRTQLGLSNPGCVENISREVQXRDVLLNNYTFSGPENGILNKKXFSISXLFQGPPQFNFQSSLKRXLTTNXHXAAAFPXTNKVILXGEMRESNQGQLRG

SEQ ID NO: 198051 - protein, 69 aa, Triticum aestivum
  Clone ID: PAT_TA_92469.pep
FFFFFFFFFFMNFKQVKLSNYGISSYTSFLLLGGSKKSLGTCSEICFFSAQLRMASKFLHSCSVLKKKK

SEQ ID NO: 198052 - protein, 152 aa, Triticum aestivum
  unsure (1)..(152): unsure at all Xaa locations
  Clone ID: PAT_TA_92470.pep
MALPNQNTVDYPSFKLVIVGDGGTGKTTFVKRHLTGEFEKKYEPTIGVEVHPLXFTTNCGKIRFYCWDTAGQEKFGGLRDGYYIHXQCAIIMFDVTSRLTYKNVPTWHRDLCKVCENIPIVLCGNKGDVKNKQVXGXQVTXHXRXKXLQFXX

SEQ ID NO: 198053 - protein, 52 aa, Triticum aestivum
  Clone ID: PAT_TA_92471.pep
YDIVIIYQKTYAIIKSDLKTQNLDTGLSRLLNLGKSSGLESQKISAHFLSCC

SEQ ID NO: 198054 - protein, 113 aa, Triticum aestivum
  Clone ID: PAT_TA_92472.pep
MRPRKRRQDSSQPAITSYFTADCTSPTEAESTPNTISQPIIPASIQSSLLNVGMRIRKAVPEGYKTKHNNQSPKSIVEQIAPYERGAKNATESKFVYDNWQSSMHHKPPTPVS

SEQ ID NO: 198055 - protein, 145 aa, Triticum aestivum
  unsure (1)..(145): unsure at all Xaa locations
  Clone ID: PAT_TA_92473.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVXSSDTIDNVKXKIQDKEGIPPDXXRLILAGXSLRDWSQPPTTTIQVQPPTWL

SEQ ID NO: 198056 - protein, 174 aa, Triticum aestivum
  unsure (1)..(174): unsure at all Xaa locations
  Clone ID: PAT_TA_92474.pep
RAEFGTSCRIRHELVPNSARDLHVLVLRSNQFYGSIGDLVRDQQSKEYFSSLQIIDLASNNFSGNLSSEWFGRLKSLMANLNSSGETIVGQNISAAPRGFYQDSIEITYKGSVVTFERILTTFTAIDFSNNRLEGTIPESVGQLXSLHVLNMSHNAFKGKIPAQLGHLTDLEXL

SEQ ID NO: 198057 - protein, 96 aa, Triticum aestivum
  Clone ID: PAT_TA_92475.pep
SINLHPCADYVSPKIRFSRLATASLHPRTCSRESKSVLHIRLHYKKASCIFDPPARHPKMNSISLASVIAFFGILALQPALVNSDGKNALFLCNGC

SEQ ID NO: 198058 - protein, 62 aa, Triticum aestivum
  Clone ID: PAT_TA_92476.pep
FPHTIGPEYAPRLKKKLYIPWINRKHQTFSENYWMMILCTFRNNPRTSFHHACTNTTQPQNE

SEQ ID NO: 198059 - protein, 174 aa, Triticum aestivum
  unsure (1)..(174): unsure at all Xaa locations
  Clone ID: PAT_TA_92477.pep
VGGXNHLSFVRRFIILLRYWQWQHLLFAPGIWLLTTNKRQVLVIVIPLPDETRRLTELQTINLRVWKEQKERCRTHAKITSSWKKSIANALTRRLCRRYGGADERRGGAMFSVNPGPWNCSTSSLGFERPRGARGLWPRWWRRRQVSGFREAGDVVGGTVERIGWGWIAAGAGM

SEQ ID NO: 198060 - protein, 64 aa, Triticum aestivum
  Clone ID: PAT_TA_92478.pep
IISVYNLISHQNLINLTGPLNGLPSNTPSFAVPSSRQSISKYSVVICRLDSSTSKLLQISIKTC

SEQ ID NO: 198061 - protein, 112 aa, Triticum aestivum
  unsure (1)..(112): unsure at all Xaa locations
  Clone ID: PAT_TA_92479.pep
QGAAGRARXRLGXRXWRGAAXEDARPARWTEERGEXDGFVVHGGSGNRPTGAKGFWSRVSDTMLRRGERLGFNTHRLCSEAGFKYRLLSSAEPRSWVCHYLRTCTTSYTTAA

SEQ ID NO: 198062 - protein, 62 aa, Triticum aestivum
  unsure (1)..(62): unsure at all Xaa locations
  Clone ID: PAT_TA_92480.pep
KCIFCVEYYLLLLGQWSRLDRRKKTKKIKSNILGRLAILQCKSQSIWSLSNYFETQSLLPXT

SEQ ID NO: 198063 - protein, 94 aa, Triticum aestivum
  unsure (1)..(94): unsure at all Xaa locations
  Clone ID: PAT_TA_92481.pep
RSIHAICHCYTIIYPFFYFKAVRAKVGRMKLALWDVGSYSSGVXFLHLQHXRDLXGRFEXSLLHXCSKTMNPDLGKRVCRDGGCKXNSNXWGRL

SEQ ID NO: 198064 - protein, 57 aa, Triticum aestivum
  unsure (1)..(57): unsure at all Xaa locations
  Clone ID: PAT_TA_92482.pep
NGNFMXKAKSSVTITSFPWVXGIVANXXVKKXEISKSYSKLRQEXGIISKSPNXKXW

SEQ ID NO: 198065 - protein, 173 aa, Triticum aestivum
  unsure (1)..(173): unsure at all Xaa locations
  Clone ID: PAT_TA_92483.pep
NNSGEKRLQGGCPMTPREAAVFLKAMGYPSSTKIYIVAGEIYGAHSMDALKAEYPNIYTHYSLATVDELEPLELYQNRLAAVDYIVALQSDVFVYTYDGNMARAVQGHRRFEGFRKTINPDRLKFVELIDKLDDGSMPWDEFQSEVRXHHEXRLGGPYDRLLVRVQRKEEYFY

SEQ ID NO: 198066 - protein, 103 aa, Triticum aestivum; identical to SEQ ID NO: 107316
  Clone ID: PAT_TA_92484.pep

SEQ ID NO: 198067 - protein, 64 aa, Triticum aestivum
  unsure (1)..(64): unsure at all Xaa locations
  Clone ID: PAT_TA_92485.pep
XGFXGTGGFXPLNXVWXPXXLGKXRPXNXEPEXXPLLPXXXGKKGXGIALSXPLLKXGGFQFSN

SEQ ID NO: 198068 - protein, 137 aa, Triticum aestivum
  unsure (1)..(137): unsure at all Xaa locations
  Clone ID: PAT_TA_92486.pep
MRPLRAVALLLVAAAAAAAAATPWAGSGQESGSISKDDFPGDFSFGASTSAYQWEGAAAXTXGTPSVWDTFAHAHAHAHAGDDSVNGDVXADGYHXSRRDIXLMKXTGXXSXXSPTXWXRLIPKGRXESXQKGXVLQ

SEQ ID NO: 198069 - protein, 131 aa, Triticum aestivum
  Clone ID: PAT_TA_92487.pep
KITDNLVEYVKHIHANYNNISLIFEAKVAAETHKLFNFPIYTTESLNLFSTKVDLVTTLGGDGTILHASSLFNTTSHVPPILSFSMGTLGFLGEWKFDEYKRAFREVYMSGAAAGSPLLQGQSHAQIQAPR

SEQ ID NO: 198070 - protein, 59 aa, Triticum aestivum
  Clone ID: PAT_TA_92488.pep
MPVMVHVMVVMGWPMWLYHYPKFRTRDDMCIIRTGDDTPCTVRKTYVALYFFVKKKKKK

SEQ ID NO: 198071 - protein, 147 aa, Triticum aestivum
  Clone ID: PAT_TA_92489.pep
SCRIRHEPLNYLCHTMKLYTVFSSIAILTIASAHCVLPAPPNPSYQEQIVVEESLFVPGSRILAFCSHEDKKNEISITKIETYPDVPATGDTVHGRIIGRQRGVFGQGAYVIFRDSKTRRKLNIEPVDFCKFLKTTGRDWHYPTGRI

SEQ ID NO: 198072 - protein, 137 aa, Triticum aestivum
  unsure (1)..(137): unsure at all Xaa locations
  Clone ID: PAT_TA_92490.pep
PPPTHQPPEPPPQSPVTPRATPRAGIVPSXSSPAAPRRSPSAAAPPSPPSPPSTTXPPTAPTSQPPSQPTPERLNRVAAARVPTPNHWIPLPPSPKPXRPPPPLVHQPPTTRPLMHTATKPRAPAPPARSTSATISV

SEQ ID NO: 198073 - protein, 91 aa, Triticum aestivum
  Clone ID: PAT_TA_92491.pep
SFSQRDLTHIHRPQRSIRLFKVGASRPTYTTRRAWTTIDFYIQPFPTRGKVFLYERIYFYRQLKFHLTRPSFCKKPFCSGKKPPDPIRLSV

SEQ ID NO: 198074 - protein, 67 aa, Triticum aestivum
  unsure (1)..(67): unsure at all Xaa locations
  Clone ID: PAT_TA_92492.pep
MASEGEHAAXAGEXTPLKKAGXAEQGEELQAPSGWTKXLNXTRXGKFEVAFVAPXGDEVXXTRVLTT

SEQ ID NO: 198075 - protein, 50 aa, Triticum aestivum
  Clone ID: PAT_TA_92493.pep
FFFFFWYISELYDVYVYLCRHIICIAKGRVKYGLTGLSCRHMLPRAEFGT

SEQ ID NO: 198076 - protein, 59 aa, Triticum aestivum
  Clone ID: PAT_TA_92494.pep
FVKELHSGFQLLNLKNDSLRRRCDSIKYNVKKIEDIVYDLSLRNLIPSTVPMETEGQAN

SEQ ID NO: 198077 - protein, 144 aa, Triticum aestivum
  unsure (1)..(144): unsure at all Xaa locations
  Clone ID: PAT_TA_92495.pep
AFSVTVLGMLPYAGISXFLTHDTAGDILRSPILAPYTVQTKYNHSLSTKPPPLHSWAQLLAGGLAGLISQTCAYPLEIMRRRMQVGGAVGDGHRLRINETFSLIFKENGIRGFWVGLTIGYVKVVPMAAASFYVYERAKTWFGI

SEQ ID NO: 198078 - protein, 120 aa, Triticum aestivum
  Clone ID: PAT_TA_92496.pep
FWMEQTLVGYEPYTGIPITEFIQANNAQVRNFMKAFTKWKCAKRCVPDCLRIRKIASLGLNACRKYRYEHLRVKVEKLVPVAAVGVLYGVKIRRPTKWPEEGFSSRLYHEFLERGDMERD

SEQ ID NO: 198079 - protein, 129 aa, Triticum aestivum
  Clone ID: PAT_TA_92497.pep
MSERGNHRGSRRGGRGGAGRGSHEGGRGAHGGQGAERAKKENILDLSKYLDQKIAVKFTGGREVTGTLKGYDALMNLVLDDVEEMMHDEENKITTRPLGLIVARGTLLVLISPMDGSEEIPNPFVQPED

SEQ ID NO: 198080 - protein, 148 aa, Triticum aestivum
  Clone ID: PAT_TA_92498.pep
CSLAFPILSFPCFDHVGFQVHKRGFSRSSSEALALAVTYSVDRPASSHLVLCSMKPWYLLRPIHTSDRIDGTVDLSWFCSFAGHFSYSTKEQAPSGGEERWLHFFNYNLYSYRSEAIDSISCTFVMRSEQVSRIGLAAFPLINSICKI

SEQ ID NO: 198081 - protein, 184 aa, Triticum aestivum
  unsure (1)..(184): unsure at all Xaa locations
  Clone ID: PAT_TA_92499.pep
LVPNSARAGESLKAVTKSPFLDSLKEKNFEVLFLVDPIDEYAMTQLKEFDGKKLVDITKDFDLEETEDEKKVREAEEKEYESLTKALKNVLGDKVEKVVVSHKLVGXPCAIRTGQFGWSANMERXIMKXQALRDTXMSSYMSSXKKTFRDISSASQLSKELKEKPRKIGERKNNGSPITQLPVR

SEQ ID NO: 198082 - protein, 173 aa, Triticum aestivum
  unsure (1)..(173): unsure at all Xaa locations
  Clone ID: PAT_TA_92500.pep
QLISTAVXHTLXDXYVRSVXDRXRLDEVXPDADIPVVDXANPXRADVXXQIGAACRSXGFFRVLNXGLPLEVMLXAMXVAHDFFRLSXEDXAXLYXDXPAIXMRLSXSFNVXXXTVHNWRHXLXXHCXPFEXFXPKXXGXSPXFXVCQQYKGCSGSFLRYDIKLGGARHHPRK

SEQ ID NO: 198083 - protein, 159 aa, Triticum aestivum
  unsure (1)..(159): unsure at all Xaa locations
  Clone ID: PAT_TA_92501.pep
MVFRISSSTLCLTRGWLRPLASLTSSNPRLISYRSVSALAVLELKDGKLIQSSLSAVSAGQKLGGSLTGFIAGGNISESMRETAKIRGIHKIISIENHAYDKGLPENFAPLLVANIKKRRIXHILAGHTTFGKKLMPRXAALLDVAQDIKILRRLRTKI

SEQ ID NO: 198084 - protein, 86 aa, Triticum aestivum
  Clone ID: PAT_TA_92502.pep
RQILSLPSARRKAHSKGAPDSKLADSRSGSRPGQAQNGLVKLPSPPCSRPATVSAIPRTSRTSVRQRRHRLDLARPTLTLMGPKRA

SEQ ID NO: 198085 - protein, 88 aa, Triticum aestivum
  unsure (1)..(88): unsure at all Xaa locations
  Clone ID: PAT_TA_92503.pep
MVKDTKLYDTLGISPTCTEAELKKAYKIGALKHHPDKNASNPAAAEKFKEISHAYEVLSDPQKRHIYDQYGEEGLEGGGGAAGGMNAX

SEQ ID NO: 198086 - protein, 69 aa, Triticum aestivum
  unsure (1)..(69): unsure at all Xaa locations
  Clone ID: PAT_TA_92504.pep
MLVYQDKLSGDELLSDSFPYRELENGVLWEVDGHWVVQGAVDVDIGANPSAEXGGGDDEGVDDQAVKVV

SEQ ID NO: 198087 - protein, 69 aa, Triticum aestivum
  Clone ID: PAT_TA_92505.pep
NLTFFGAKHQTKSIEKLTIYTSCKDVVAILHKLMQENLGKDFSNKSGDLPMMEAIDNVAVDDEAYNTRS

SEQ ID NO: 198088 - protein, 150 aa, Triticum aestivum
  unsure (1)..(150): unsure at all Xaa locations
  Clone ID: PAT_TA_92506.pep
GKRGRKLAIEMAAEALVSVSTGVMNSVLEKLATLMGEEYTKHKSMQREVAFLKDELSSIDAVLKKLENMEEELDPQTREWKNQVMEMAFHIEDCIDDFMHESGEDSNRGGVGFVGKIAQYINALRTRHQFANQIQQLKTWVXDVXERRKK

SEQ ID NO: 198089 - protein, 130 aa, Triticum aestivum
  unsure (1)..(130): unsure at all Xaa locations
  Clone ID: PAT_TA_92507.pep
RAEFGTRPSLAGGSGSIRRGGPRGNAGLALTLPAGRRGREWRAPVSSFSSFLPSFFTGSKKKEEEDAXKAATLKEELLAAIAPLDRGAXAXPEDXXRVDQIAXQLEXVNPTKXXLKXSDLXNGNWEXLXT

SEQ ID NO: 198090 - protein, 157 aa, Triticum aestivum
  unsure (1)..(157): unsure at all Xaa locations
  Clone ID: PAT_TA_92508.pep
FRCLKDAIAAQLRHTCELLGEKDAGTSSGLTKGETPRLRAIDQSLRQQRAFHHMGMMEQEAWRPQRGLPERSVSILRSWLFEHFLHPYPSDADXHLLARQTGLSXRNQVSNWFINARVRLWKPMIEEMYQQETKELEGSSAGGRPSNDPPTTFTPQR

SEQ ID NO: 198091 - protein, 62 aa, Triticum aestivum
  unsure (1)..(62): unsure at all Xaa locations
  Clone ID: PAT_TA_92509.pep
MSLYSEPPSARSFRDDKPTLLVCWWCTIFAMVIILFRVCGRYVRTXKLFREDWIXFSCIIPL

SEQ ID NO: 198092 - protein, 74 aa, Triticum aestivum
  Clone ID: PAT_TA_92510.pep
TALVKGQLATDEEGYIITKPGTSYTDVEGVFAAGDVQDKRYRQAITSAGSGCIAALEAEKFLAEHEDVRKNDNC

SEQ ID NO: 198093 - protein, 59 aa, Triticum aestivum
  unsure (1)..(59): unsure at all Xaa locations
  Clone ID: PAT_TA_92511.pep
MPPVRTTASRAGKSERTHEENVERAFIAASRRCDRTLEGRLESARRASEIHKXRXGRGL

SEQ ID NO: 198094 - protein, 157 aa, Triticum aestivum
  unsure (1)..(157): unsure at all Xaa locations
  Clone ID: PAT_TA_92512.pep
MFKVIRSHPFASTIKCFKSGSVYNAQQKRALSIHEYLSVDLLSKYGIGVPRGSVATSGIEAEAVAKQIGSNDMVIKAQVLAGGRGKGTFDSGFKGGVRLIYSPAEAKTLAEQMIGHKLITKQTGAAGRLCNSVLICERKFVRRXEFYLAILMDRASQ

SEQ ID NO: 198095 - protein, 134 aa, Triticum aestivum
  Clone ID: PAT_TA_92513.pep
SLPLVAHTNYLYRMTTCFAITTLATVVSLDVISRSILPMMDKLVEDEIPNIRFNVAKSYAELISVLKKLPDEGTIYSLEKTGAVGIPSAKADALIQEKILPNLEKLQNDEDVDVRFFATTAASSIIGEPMVTSP

SEQ ID NO: 198096 - protein, 171 aa, Triticum aestivum
  unsure (1)..(171): unsure at all Xaa locations
  Clone ID: PAT_TA_92514.pep
VLDRLHTGLVFGLDARIHLLVVEPASPCKPLESRIVVKSPQFLEAQWGYDARCHGNKCGVIVSPLESSPTPATVRNLFIETTLTYVLTYIAELCPQLHSFHADITILADADYYSNPPYPSTVYPRFSNFSVPLAGAHKTGLGSSAALVTALTAALLNHYLTXFCLDIVANR

SEQ ID NO: 198097 - protein, 99 aa, Triticum aestivum
  Clone ID: PAT_TA_92515.pep
MSGEKAEMNVKEKLEAQIKSVDMTEEMQHESIEVAQEAMSKYSVEKDIAMHIKKTFDERKGPTWHCIVGRNFGSFVTHETKHFIYFYLGHCAILLFKTQ

SEQ ID NO: 198098 - protein, 96 aa, Triticum aestivum
  unsure (1)..(96): unsure at all Xaa locations
  Clone ID: PAT_TA_92516.pep
QHPVCGCKSSHHHXSXXXNCTSTCXFXIXPKSPKPNPXIVXXSXXGXSCPARRLASVMKLPFQPPYLHPXLRPWHFXXXPGSRVSXREXXCCQVXR

SEQ ID NO: 198099 - protein, 163 aa, Triticum aestivum
  unsure (1)..(163): unsure at all Xaa locations
  Clone ID: PAT_TA_92517.pep
EKARKVSHTGYKRIYNEYPPTKILVQDVARVMQEATQSGGVRPYGVSLLVAGWDEGTEPEVNQAENSDGKSGQEESSNKTGGDVKGNPMLYQVDPSGSYFPWKATAIGKSATSAKTFLEKRYTEGLELEDAVHIALLTLKETIEGEMNGETVEIGIIGPXAHH

SEQ ID NO: 198100 - protein, 165 aa, Triticum aestivum
  unsure (1)..(165): unsure at all Xaa locations
  Clone ID: PAT_TA_92518.pep
MAKPGVYPCSISLQALTVFSVLVVLLEYVQGGDKCPSFSCGHLRDVRYPFRRPGDPPGCGAEGYELVCSSSKATIYINTGTYYVTGINYTDSSFWVVDANFNANXASCPLPRWNQGPYTYGFIDSHYYLDLAIEANWACFTNCSRAITNNSMYKAVTCLSASNSH

SEQ ID NO: 198101 - protein, 40 aa, Triticum aestivum
  unsure (1)..(40): unsure at all Xaa locations
  Clone ID: PAT_TA_92519.pep
TLIACDTMAKKPKSRTIAVRLISMALTGYYKTMVRPRXXR

SEQ ID NO: 198102 - protein, 50 aa, Triticum aestivum
  Clone ID: PAT_TA_92520.pep
SCRIRHERVVMGCVVLCSSEWGVGVTPLLNILLYHTLLRVLFLSRVSLVL

SEQ ID NO: 198103 - protein, 144 aa, Triticum aestivum
  unsure (1)..(144): unsure at all Xaa locations
  Clone ID: PAT_TA_92521.pep
SPRRLWRRRACRPSPAGAPPSPSSCNXGKKIKGXXPLRLREAVXNSTXTQTEGRXERKGFYKFVEKYXANVXXLQPNLNPRGMGXXPGDRXRPAGTTGASXXGAVNLRPGFXXGGVLLVXKKQTLSPGVKKAXXXFTQRXRSPG

SEQ ID NO: 198104 - protein, 68 aa, Triticum aestivum
  unsure (1)..(68): unsure at all Xaa locations
  Clone ID: PAT_TA_92522.pep
MARGREGEVRNLVLGKYELGRMLGXGSFAKVYYGRDLRDGQXVAIKVIDKXRLRQTDGMVEQLRREXS

SEQ ID NO: 198105 - protein, 142 aa, Triticum aestivum
  Clone ID: PAT_TA_92523.pep
YQGFPDSGMTCGEWTITKAGVDKAAENACKEFNSRKHHMWIRTRKVRGLYYNPKGKSRIFKKRHYMYPLQNQQSIKKSEEKPIPVIFIDNSCKLYAVYIRSRVKTRRFALFSKTKFGSCWDARTGIVKKTDRTDSTAGITKD

SEQ ID NO: 198106 - protein, 87 aa, Triticum aestivum
  unsure (1)..(87): unsure at all Xaa locations
  Clone ID: PAT_TA_92524.pep
SCRIRHELKRINVGVSISGSKSYPTPWRPXKFMSAFAFIPRYLEVRQSXCAGVYLRHPVXRPXLSEVPSPYPMEXXXLAYNWYLRRR

SEQ ID NO: 198107 - protein, 85 aa, Triticum aestivum
  Clone ID: PAT_TA_92525.pep
FLVMEKYPNNSLSTDCPSHVYDCGWRPPWASMPPILRMRLLTSLKVLWRLQTPGTHLRGVASQLTDGAAAGTWRGEMDASGLHGG

SEQ ID NO: 198108 - protein, 130 aa, Triticum aestivum
  unsure (1)..(130): unsure at all Xaa locations
  Clone ID: PAT_TA_92526.pep
SARYHANSEGAAHHARGKSAPQRANPFLAARADRGSCRNISLVTPFLFLVSSHPAPLLHAAAAASPLPLGRLSPPPAGAAPRVAFLSSSCAAASRHQQATAHPQAPTLASPIPSSRMNPKQREKIERXXR

SEQ ID NO: 198109 - protein, 170 aa, Triticum aestivum
  unsure (1)..(170): unsure at all Xaa locations
  Clone ID: PAT_TA_92527.pep
YRHLGRKSSHRQALLRNLVTSLFTHESISTTWPKAKEAQRLAEKLITLGKKNTESSRRSALSIFYKPHDLLPKLFGPLRERYALRPGGYTRVLRIEPLKPDQAPSAILELVDGPKDIRFAMTAKTVSRTRKEGKPINEITDFFRKKVTRFXRPNGEAEFDQMVEKLNKLR

SEQ ID NO: 198110 - protein, 127 aa, Triticum aestivum
  unsure (1)..(127): unsure at all Xaa locations
  Clone ID: PAT_TA_92528.pep
SCRIRHELPTKILWMRRMRVLRRLLRKYREAKKIDKHMYHDMYLKVKGNMFKNKRVLMESIHKSKAEKAREKTLSDQFEAKRAKSKASRERKIARRXETLAQGPRDHAXAPAXAAPAAAPXXGEELT

SEQ ID NO: 198111 - protein, 137 aa, Triticum aestivum
  Clone ID: PAT_TA_92529.pep
FFFFISFARVTVLLPREARLCFRKSHGRASRKRRKTRFLVFPPFVRVIILLPRETRLCFRESHGRASWKRKKNYIFCFFPFARVTILLPRESRPCLSETKKTCFLFFFFHESHSFASARGSAFARVMAVPSCRIRHE

SEQ ID NO: 198112 - protein, 183 aa, Triticum aestivum
  unsure (1)..(183): unsure at all Xaa locations
  Clone ID: PAT_TA_92530.pep
SCRIRHEDSWKRVVRPDGSSSETPTQTSEPALVLGKDGKPCRSCSSSAAFSSWVTQTKKVTDGARPRQPSSGCPPDVEALGRSSWTLLHTMTANYPTHPTHNQQRNMSHFLHLFAQFYPCWVCAADFEKYIEVNGVRSASRDDLGRWMCXAHNAVNKKLGKPSFDCGKWEERWRTGWKDGSCD

SEQ ID NO: 198113 - protein, 168 aa, Triticum aestivum
  unsure (1)..(168): unsure at all Xaa locations
  Clone ID: PAT_TA_92531.pep
MTASQEEAVAYKNEGNKAFSAHDWAKAIENYTKAIELDNKQAAYYANRAQANIKSEAYGYAIDDATKAIEIDPNFIKAYYRRALAYTAILRPKDALKDFRXCCKKVPSDKDAKLKLAECEKIVRRVAFLAAIEVGDEPSATXGLDLDSMKIEDEYDGIRLENEDDKNY

SEQ ID NO: 198114 - protein, 45 aa, Triticum aestivum
  Clone ID: PAT_TA_92532.pep
FFFFFFFFFFFFFFFFFFFFFFAILKYTHENCCEIKHTEDSTTEN

SEQ ID NO: 198115 - protein, 109 aa, Triticum aestivum
  unsure (1)..(109): unsure at all Xaa locations
  Clone ID: PAT_TA_92533.pep
LRPAALFELLLTLPREYPFXPPKLXXLKLRXYHPNITFDDKGSMCIGILKPDIWKPSSQIINVLIATQQLLVEPLPDDAIETEVAEKYKHDRKAFEAEATKYTQKYAAN

SEQ ID NO: 198116 - protein, 89 aa, Triticum aestivum
  Clone ID: PAT_TA_92534.pep
YLILYPQPSKQLTFNPSIRISIWLELMWSNMSFTSFDIFPSFMNPKFRASFRLNGKLTKLRDNCQLKSTYLNDISYHLSADMSLILINL

SEQ ID NO: 198117 - protein, 104 aa, Triticum aestivum
  Clone ID: PAT_TA_92535.pep
MSLGAQAIRSARGGGNSGLSGGLNVSEQFKYRAESAVSQAYQSPLSSSPNFGQNTRKPHHRANSVSEMMPAPVNTASAPVPVGPVRRSPDAFQERILKGDFYMD

SEQ ID NO: 198118 - protein, 131 aa, Triticum aestivum
  unsure (1)..(131): unsure at all Xaa locations
  Clone ID: PAT_TA_92536.pep
AWRRRRPRPRRGPPPPPXPRPPHPPPRHSQPPRPPLRLPRPRPHPGPPPPTAPPPSPSPVRAAWEPLSSLIIRANKLDESRQNRDVGPQRGTSAGRWNLSLRTANLSKPKASPAAKRSSQGATARTHGSNP

SEQ ID NO: 198119 - protein, 110 aa, Triticum aestivum
  unsure (1)..(110): unsure at all Xaa locations
  Clone ID: PAT_TA_92537.pep
MDLLSTIRKEGSRXGVEFSWXDVTTSQHRENYLGHSVMAPVGRWXKGKDLTWYAKGSXISSAGDQTVEERNLRERKXEIXKIQEAEEDALAKALGLPVKXXNTLKALPSH

SEQ ID NO: 198120 - protein, 167 aa, Triticum aestivum
  unsure (1)..(167): unsure at all Xaa locations
  Clone ID: PAT_TA_92538.pep
MLKVISATRPILELTGRIFSGRSRSSLSGMTSIRDPNTLSNYDCWKTKHTIVNFAIDFPQKGLSGKVKLELESLTDRESREIILDTSFLNISSVLLEGTVHDDWSVKDRTEPYGSPLTIKLXEGVCKGAIVAVEIILSTTERCTALQWXTPAQTSNKEIPXMFSQCQ

SEQ ID NO: 198121 - protein, 121 aa, Triticum aestivum
  unsure (1)..(121): unsure at all Xaa locations
  Clone ID: PAT_TA_92539.pep
MXATXXRCFXGGLAWATDDHNLQQAFSQYGEILDAKIIXDRETGRXRGFGFVTFXSXEXMRXAIXXMNXKXLDGRNITVNXAQXSRRSGGXGGGXGYXGXRGXXXGYGXGWLRRRLLPVRG

SEQ ID NO: 198122 - protein, 163 aa, Triticum aestivum
  Clone ID: PAT_TA_92540.pep
RAEFGTSNDNLPLRPGVLTRFHSRTPPAISVAEYLQRLAKHATLTPPLLLSIVYYIDQLCLLYPPFTINSLTVHRFLITAGTVAAKGLSDSFWNNATYARVGGIKVAELGLLELDFLYRLDWKIVPNPEALVNYYQGLIARNPSYRLKEDEKSSVCDEDGNQD

SEQ ID NO: 198123 - protein, 142 aa, Triticum aestivum
  Clone ID: PAT_TA_92541.pep
YEPHQQIGKKSHQAEFERAYAPNRSVPLAGPLYGRQRARTNTKLTSTLALEKMCSTESNAPISKIRKIDTASLLEPNGPVFQTSGIPENREGSIIDSFTRHLGIGWSSLSDTDPETQAATRGWIKFIRKSFSTIKCKDTTTE

SEQ ID NO: 198124 - protein, 161 aa, Triticum aestivum
  Clone ID: PAT_TA_92542.pep
PGNKVNLCEVIGSKKALIIGVPAAFSPSCSNSHIPAYIKHPKLKNAGKVFVVSVNDPFVTKAWADQLDPTKTSSIRFLGDPTARFTEAIEMNFDGSAIFGGQRSKRYALKIEDGKVSKVYCEPDNTGLDVTTAEEGTRLSFPMINYSCPGLQSSSRFGLGY

SEQ ID NO: 198125 - protein, 55 aa, Triticum aestivum
  unsure (1)..(55): unsure at all Xaa locations
  Clone ID: PAT_TA_92543.pep
EVSKMNATFVTLARNSDVWQIARSIRQVEDRFNRKYNXDWVFLNDELFXENFKEN

SEQ ID NO: 198126 - protein, 80 aa, Triticum aestivum
  unsure (1)..(80): unsure at all Xaa locations
  Clone ID: PAT_TA_92544.pep
SESVHVPGGIWAQVLFMGVWSFLFQSTIGSVSWPIISEVSKSSLRGHTQSLATVTQGVVGAIGGVLLPFAVNPDAGNLXX

SEQ ID NO: 198127 - protein, 116 aa, Triticum aestivum
  unsure (1)..(116): unsure at all Xaa locations
  Clone ID: PAT_TA_92545.pep
ILKLSWFGKGGDVLIRREQKRNKVRFXTEXDGVRVQKRKDVHLQRVIISEKKVKKNGKYLATSLPHPFETRLQYERSLRLPIGQEWTTXKETFQDATKPRILLKQGIIAPMSKPLL

SEQ ID NO: 198128 - protein, 66 aa, Triticum aestivum
  Clone ID: PAT_TA_92546.pep
PIIVGEERWDAYQGIPKLRCLRLLEILSWDALGIPMLELLCLLNSFYITVSLNLKNLIHTKLNKTS

SEQ ID NO: 198129 - protein, 99 aa, Triticum aestivum
  unsure (1)..(99): unsure at all Xaa locations
  Clone ID: PAT_TA_92547.pep
RXVXIISSSMSLQHVFSSXRCCXPPTVFLXPASATVAGVSQNGSNIGAYFVRKSRRPALQGEEPATADAWHCHGCPSLLSDGTAQTVIPRSSSESSELI

SEQ ID NO: 198130 - protein, 139 aa, Triticum aestivum
  unsure (1)..(139): unsure at all Xaa locations
  Clone ID: PAT_TA_92548.pep
MTIAEELATRNFSIYGQWTGDLXFLCFALGISNLFHVNIMILFGALCLTSSFLIIFIEIPLLLRICPTSSKFDTFMRRFSTNYMRSRXYLAMGTAQWLSLIGQPSSLIAAAIMLTLAGTFYALAGVKGQGFVXSKTLXW

SEQ ID NO: 198131 - protein, 57 aa, Triticum aestivum
  Clone ID: PAT_TA_92549.pep
TGRSQLTLKFLDLCLNILREPGGSCSIIYPQTIHAISLQPALKTRTANCSIFVGRGT

SEQ ID NO: 198132 - protein, 73 aa, Triticum aestivum
  unsure (1)..(73): unsure at all Xaa locations
  Clone ID: PAT_TA_92550.pep
SCRIRHELVPLVPNGFFLYAGIXALGWVFFFTFIPETRGLPLEEIXKLFGMXDXPVXXEXTAXKDXAKVMEMN

SEQ ID NO: 198133 - protein, 181 aa, Triticum aestivum
  unsure (1)..(181): unsure at all Xaa locations
  Clone ID: PAT_TA_92551.pep
LVRPVRRPAPTPPYVHRIPLPPPTRDRASPVVSSLDAIAGLLLRQCHRGRATSAHLSVSPSPTPHRPPCVPFDATHRRPPPASPSTPCAGGHHPTSTVPTCIHLQLEEGLTCSKRTTRPAARWXHPAEKDRGGWVMDLARRLRARXFRTAGSTVXKQXQGRPFXXPVQKXQTNAGXXQAPP

SEQ ID NO: 198134 - protein, 94 aa, Triticum aestivum
  unsure (1)..(94): unsure at all Xaa locations
  Clone ID: PAT_TA_92552.pep
MSSRIASGLNESVTVTQVHKATKNCVSIVSSDKPDSDAKTILSTPTAPTIKPXEADEPLLQENPNRFVLFPIKYHXVWAXCTRRXXAXSFWXAE

SEQ ID NO: 198135 - protein, 62 aa, Triticum aestivum
  unsure (1)..(62): unsure at all Xaa locations
  Clone ID: PAT_TA_92553.pep
MCDTQRPIDPNIYRADKSPKPVTYXLSXHRXPXNXHXQXGHFLIXLAXLSXXHXXXEGXSTH

SEQ ID NO: 198136 - protein, 166 aa, Triticum aestivum
  Clone ID: PAT_TA_92554.pep
LVPNSARVDIEDLKTQGKIRSDMGRLQYFDDLSVSRAALDRKKEYEGPYDPDLREANIQENVAAVLEAAEKVLSKVPEGSGEEQPKVGQNYLQSSSDESDEKFKPIISRMNVWKIQDTMSLAMGKDGPISRDHGQMQDFTAPGLPRKFLPRERKAQKEEENDSEIL

SEQ ID NO: 198137 - protein, 106 aa, Triticum aestivum
  Clone ID: PAT_TA_92555.pep
IISTYYGGINRLQQIQSHELDALYTGVWGRTKMMYHDDGSTVKHYLCEMDVKQDNLNKYKYTLVVDNKARACAVLEHIIRFDSEIGDYEDSYLGNTIAGSKLCAIR

SEQ ID NO: 198138 - protein, 119 aa, Triticum aestivum
  Clone ID: PAT_TA_92556.pep
MSLTNCRFYEEKYPEIDSFVMVNVKQIAEMGAYVKLLEYDNIDGMILLSELSRRRIRSIQKLIRVGRNEVVVVLRVDKEKGYIDLSKRRVSPEDIIKCEERYNKGKMVHSIMRHVAEKT

SEQ ID NO: 198139 - protein, 90 aa, Triticum aestivum
  Clone ID: PAT_TA_92557.pep
RRKKSREYLPHSVNNFDYLLFIFHCHLAYSVIYSQLRSLIHASNEVKSRLTLCQSKLFEKSSGSPIRFRDTAELWRPILLAIARLTVQNI

SEQ ID NO: 198140 - protein, 131 aa, Triticum aestivum
  Clone ID: PAT_TA_92558.pep
SQPSRRPSFTPPPFSLFSLAFIYSFSSPRPRLLPNPPRLRRFRSEFSRRYAEKRIASDGVPGAASLRLRPLRPRPRPRPLLLRPHAPPRGFSGQQAAEVIGLSMRDQENHSKEIITEAIEKLHEQTSKKIW

SEQ ID NO: 198141 - protein, 164 aa, Triticum aestivum
  unsure (1)..(164): unsure at all Xaa locations
  Clone ID: PAT_TA_92559.pep
WEEKCNRGHFENLKQMEYSRENSTGNRSTTDTADRQSRHVYDDESPVEDSADTTRRILNAKQTMVQNNTSAIESSSSNWLVELSSENDLLRSSSQCPFDPTFLKVNEIKNRXIAPLEHEDSLATFSVENPSHHDLHCTNQKIRXTXNSQQSLSKFPNPVDENCT

SEQ ID NO: 198142 - protein, 160 aa, Triticum aestivum
  unsure (1)..(160): unsure at all Xaa locations
  Clone ID: PAT_TA_92560.pep
RAEFGTSTVPLLPAPDFGIDVASILERISSPESTSIKIIFICSPGNPTGNLIKKDDIKQILEQPTWNGIIVVDEAYIDFAPEVTSLAEWVAEWPNLVVIQTLSKAFGLAGIRLGVAFASPPVAAILNKVXXPYNISSPTSAFAIMSLHPAGLEIMGNNXK

SEQ ID NO: 198143 - protein, 55 aa, Triticum aestivum
  Clone ID: PAT_TA_92561.pep
ALGHRVDIHRGFGGSRTVWHDCHFIPRPLILSGLPLIHPFLSECNKLSQLFEQKK

SEQ ID NO: 198144 - protein, 69 aa, Triticum aestivum
  Clone ID: PAT_TA_92562.pep
GSLTSTHITMSSSRFYFTQHSISTSCYTSSSTLLSTIKVGDTHKTTRVNDSSKVIKSEYSQFFYVEHEN

SEQ ID NO: 198145 - protein, 144 aa, Triticum aestivum
  Clone ID: PAT_TA_92563.pep
MAQTMASMTGLSQGVRLPGPTGRRASRFTVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRL

SEQ ID NO: 198146 - protein, 172 aa, Triticum aestivum
  Clone ID: PAT_TA_92564.pep
RQAVYDLYNKRGAEGAAREQEWCKLFEKYCSTYESEAKDLKRRLSGELPEGWEKNLPTYSPKDPAIATRKLSETVLQKIYSSVPELVGGSADLTGSNLTRWKEAVDFQPPSLGIGNWSGRYIRYGVREHAMGAIMNGLAAYGLFIPYAGTFLNFVSYASGAVRLSALSQVRT

SEQ ID NO: 198147 - protein, 124 aa, Triticum aestivum
  Clone ID: PAT_TA_92565.pep
MTVGSGKFLLITTKNSSDSTAGTTSHDRRAAYSPQSDSSTYQALTASKDNSTTPAGAFDIPAKDQPLPTNWYVQSLHVNGVLWNRSWLSHDDFRNGGTLEFELGPLPKKWDTGEVPPSPGHVVL

SEQ ID NO: 198148 - protein, 56 aa, Triticum aestivum
  Clone ID: PAT_TA_92566.pep
RAEFGTRTNELAAGMEDRVQLVTYAIGVTRLPEDVNNPETRGWRLIELQKSGRDYI

SEQ ID NO: 198149 - protein, 157 aa, Triticum aestivum
  Clone ID: PAT_TA_92567.pep
REREGPRIPFTARLKIAHQTAEALSYLHSWASPPILHGDVKTSNILLDEDYTAKVSDFGASTLAPTDEAQFVTFVQGTCGYLDPEYMRTCKLTDKSDVYSFGVVLLELLTCRKALNLEELEEEKYLSSQFLLVLGENRLEEMLDPQIKREQSIEVLE

SEQ ID NO: 198150 - protein, 79 aa, Triticum aestivum
  unsure (1)..(79): unsure at all Xaa locations
  Clone ID: PAT_TA_92568.pep
MGAGASDLAAPAEAAGSGLGDMPELCAGEVLLRLGAPDICRLARLNRAFRSAAGADFVWEGKLPENYGYLMGFVRGXAG

SEQ ID NO: 198151 - protein, 57 aa, Triticum aestivum
  unsure (1)..(57): unsure at all Xaa locations
  Clone ID: PAT_TA_92569.pep
RPPXXPPPAPQQPPSCSSPPPPDSPPPAPQQPPPWSPPSYDNRTLRGLKLTRGGFLV

SEQ ID NO: 198152 - protein, 39 aa, Triticum aestivum
  Clone ID: PAT_TA_92570.pep
VLSVRGFSVMNFTIVSKYGSGSIYTCFGIVDQSSPRFLF

SEQ ID NO: 198153 - protein, 153 aa, Triticum aestivum
  unsure (1)..(153): unsure at all Xaa locations
  Clone ID: PAT_TA_92571.pep
PPXGKVPGTPVXLCPAXCALLGLPILXINVVFNGXIPQFATIGWXGGYAVPIFARMVMREEDFRPGPFYLRGASRPVCLVAFLWICYTCSVFLLPTVYPIKMDTFNYAPIALGVVLGLIMLWWVVDARKWFTGPVRNIDEQIDHNDGNGNVKV

SEQ ID NO: 198154 - protein, 136 aa, Triticum aestivum
  unsure (1)..(136): unsure at all Xaa locations
  Clone ID: PAT_TA_92572.pep
MPTTPSARTTSTTFLNHANMNGAAKFLQPITAVEYDPIEHLNQIFSNPSTLDHVQEAVHALDHHQKNISLDISFLSAQQALKNDASLKRMQXSTKNELAELFXRFESVRTRAIETEQDXITSXTVDIKRXRWSKPF

SEQ ID NO: 198155 - protein, 180 aa, Triticum aestivum
  unsure (1)..(180): unsure at all Xaa locations
  Clone ID: PAT_TA_92573.pep
RAEFGTRPPLPWSTRLSVAVDVARGLAFLHSRDVIFRDLKSSNVLLGPDHRAKLSDFGLARAGPTGGKTHVSTRVVGTRGYAAPEYVATGHLSAKSDVYGFGVVLLELMTGRRALDEARGVASELLVDWAMPMLQGERXKVIRVMDTKLGGXQXPKEAXAXTMGALALRWPQKEPKXPAL

SEQ ID NO: 198156 - protein, 57 aa, Triticum aestivum
  Clone ID: PAT_TA_92574.pep
IKHCSMITTSHLYHWALRVADWFDLRLSTIHSIRLLCSTRTPVKLTLAKLYKAGKSR

SEQ ID NO: 198157 - protein, 123 aa, Triticum aestivum
  Clone ID: PAT_TA_92575.pep
MEDKPAASTARRSPFEPRSDAAAVGHPAVRRRLLVGPGRRRPAPRRPSRRPIPPPARPYTAPPPHPAPERGVPAKVPRPRRSRSGEEEGDPRRRQRRPGFARRRALAAARGRWGSEGAGLAAR

SEQ ID NO: 198158 - protein, 118 aa, Triticum aestivum
  unsure (1)..(118): unsure at all Xaa locations
  Clone ID: PAT_TA_92576.pep
TIDIYHTLNIMSNSRNTNDYEHHRRRSSVTPLPLNSLLNRAKCTPGAPSSPFPIPTTTTATNDQHRRMSLSTLGLSGTPPSHSPSQYFLGWSTSQRLVLPTLRXSTKNAIXDNDAXPP

SEQ ID NO: 198159 - protein, 70 aa, Triticum aestivum
  Clone ID: PAT_TA_92577.pep
MTNQFQEVMDIPRDFVKDGTQFVNRCTKPDFEEFIKISQAVGIGFLVMGAVGYLVKLIHIPVNNILVGGA

SEQ ID NO: 198160 - protein, 160 aa, Triticum aestivum
  unsure (1)..(160): unsure at all Xaa locations
  Clone ID: PAT_TA_92578.pep
VGGYHLTVCPPAIMALAEEAATKNKTFIFSLSAPFISQFFKGPLDETSPYWDYVIGNETEALAYAESHDLNTKDIKEIAKALAALPKXNTQRKRTAIITQGTDPTIVAVDGEEPLTFPVHVIDKNLINDTTGAGDAFATGFVAGLVSKTIPSSDLTKDNG

SEQ ID NO: 198161 - protein, 54 aa, Triticum aestivum
  unsure (1)..(54): unsure at all Xaa locations
  Clone ID: PAT_TA_92579.pep
YRSLAMERLXPXKGLXKVXQWVKDHXVQTCRSNQCPXDQCXAXXQTSWAXKXLP

SEQ ID NO: 198162 - protein, 170 aa, Triticum aestivum
  unsure (1)..(170): unsure at all Xaa locations
  Clone ID: PAT_TA_92580.pep
AARDPIGITSFYQGRSSTLPGAIFFASELKCLSSVCDEIIAFPPGHVYDSKTNETTRYFKPSWWDPHRQPAAPVDYRLLRTTLEKSVKKRLMAEVPFGVLLSGGLDSSLIASIAQRETLRLKAASLEQSSKLFDSKGTVXKQCRGKGKQLVGIDEDNNLSTLANYSAKPF

SEQ ID NO: 198163 - protein, 139 aa, Triticum aestivum
  unsure (1)..(139): unsure at all Xaa locations
  Clone ID: PAT_TA_92581.pep
MTGTKPEEKMLWGGRFTGGLDPLMAAYNTSIHFDQIFHTQDILGSIAWARANHKAGILTSEEFVAIESGLXKVEEEWLSNXFKIIPEVDEDIHTAXERRLGELIGTELGGKLHTGRSRNXQIATDMRLWXRDEPRKIEH

SEQ ID NO: 198164 - protein, 139 aa, Triticum aestivum
  Clone ID: PAT_TA_92582.pep
QKEKGFPPHFYSLKLKLVVMTPLKYLTLIAFTIMHEVNGAWTIEKGLNCGGAKYSGQNLVQFRNTHCSNERHGFYALNQYSHPRESFEDETGISLYFLRLPTVSQSGTMLYSTPSDHYLAVNDRCVFYYGATITGIGSR

SEQ ID NO: 198165 - protein, 138 aa, Triticum aestivum
  Clone ID: PAT_TA_92583.pep
MKPETLATSKLVETNRPNGAVSVLLGHITAVMTDNLTTIENSFDFPGDWASKSSEPSIFGHREAGRTIVLQSVAVLPEFRGRGIGKILVTAYKQQMNSAGIADDLAVLCHENTVAWFEKFGFINQGLSNSQARKRRLV

SEQ ID NO: 198166 - protein, 178 aa, Triticum aestivum
  unsure (1)..(178): unsure at all Xaa locations
  Clone ID: PAT_TA_92584.pep
RAEFGTSSCRIRHEKLFSVNLLDDSGEIKATGFNDQCDQLYEIFQEGSVYYVSSPCKVQLAKKQYSTLSNDYELLFDKDTAVEKAEDQESAPQIRYSFSTIADIQNVEKDSIIDVIGVLKDVSECTQIIXKTTQKSFDKRELSIVDDSCYMIXITIWGKTAITFDASPRVLXVAPKGW

SEQ ID NO: 198167 - protein, 94 aa, Triticum aestivum
  unsure (1)..(94): unsure at all Xaa locations
  Clone ID: PAT_TA_92585.pep
GSPMRLLSACNRTLCYQNLTXFTEQKGRILAEHILYVIEQWYEDCMRANSRLFGSDEVASNVTQLLEKLVDSDLTAADLDVCAELRRRIQRAFQ

SEQ ID NO: 198168 - protein, 112 aa, Triticum aestivum
  unsure (1)..(112): unsure at all Xaa locations
  Clone ID: PAT_TA_92586.pep
RQPSQEVQSPSHQLFIGSIGRKSTWSLGWRACVQRSLLASPTDLVGLKPXRARQPIRQKAMVFPTKAASATALRERIVLDFERGEDKQRWWQKVSSLIKEQLCCRKTELARF

SEQ ID NO: 198169 - protein, 152 aa, Triticum aestivum
  unsure (1)..(152): unsure at all Xaa locations
  Clone ID: PAT_TA_92587.pep
GAXEXELEESKRKDYXIKSXGVDKGADSXQIKKAYRKAAIVXHHPDKNPDDXNAXLERFKDIGEAYETLSDPEKRARYDSGEDLMDPMESFGGGMHGGGMRGGIDPEILMQMFGAQMGGSQSSAGGFHSFTGTGMPGGGARSRGSHHGFQFQ

SEQ ID NO: 198170 - protein, 62 aa, Triticum aestivum
  unsure (1)..(62): unsure at all Xaa locations
  Clone ID: PAT_TA_92588.pep
GRSAIYILLDNSAVVKALLTGTRSSSFWRIQKFVKLAAGSATPVKIGWIPGHEGLAXNEIAD

SEQ ID NO: 198171 - protein, 50 aa, Triticum aestivum
  Clone ID: PAT_TA_92589.pep
PYISLQPYFSQLADRTKTDNIRAKRDIAVSFDGSRAEFRCISIKRILGNI

SEQ ID NO: 198172 - protein, 123 aa, Triticum aestivum
  Clone ID: PAT_TA_92590.pep
VQSSIFSFGFNSFDSAPSPIRCNSPSIDRFCRTLTSTFFVDYRLSKSFTLFRRNFPSIRSQLFAYLYLLSVVEEEFLGLGIFFVGGAVALSRHLSSSKSSRVFNRVCLLSGLAEEFLGEGYFY

SEQ ID NO: 198173 - protein, 86 aa, Triticum aestivum
  Clone ID: PAT_TA_92591.pep
VNSRLVPNSARALANVVASYDVFVTGKHGAQGSLGKPSMAVLENEFGTSIKEEIIKKIIEKGTIQESDGIRKYSSKNDSIGPRAGH

SEQ ID NO: 198174 - protein, 112 aa, Triticum aestivum
  Clone ID: PAT_TA_92592.pep
DLSLLWGVHNAEDISSAGVSGVELVSNKCGRIRSGRVKLSGIRYFPGAKVNLISGGILGSLGCEIIMNAKGCKIMKDGQVIGGGRMLPNRTYSVDFLDDKLLGGGICHHCRH

SEQ ID NO: 198175 - protein, 124 aa, Triticum aestivum
  Clone ID: PAT_TA_92593.pep
LVPNSARAGNGDCDGLTVINFDKHTRTAKIINDLQRFQIPYSLTEIPELQDWIHSQIRRVKHSSENEHVQQLYRKSLLLEPRETQNMCRNHSDVSFPLLPKEKFDLFSWAYKDRSNSITPSTHL

SEQ ID NO: 198176 - protein, 103 aa, Triticum aestivum
  unsure (1)..(103): unsure at all Xaa locations
  Clone ID: PAT_TA_92594.pep
TLLGCCSLNSNTMEKEPFSESEKRFVVTQILKASSIPLERLVLLLSDCHQEPHWEHIYLPPGRTLQECKDAFEALISSHFSPYPGTSNHTSXKYCYQKRKPGN

SEQ ID NO: 198177 - protein, 94 aa, Triticum aestivum
  unsure (1)..(94): unsure at all Xaa locations
  Clone ID: PAT_TA_92595.pep
MADVEYRCFVGGLAWATDDQSLQNAFSKYGDVIDSKIITDRETGRSRGFXFVTFVSDEXMXQXIXAMNGQXLXXXTITXNEAXSRRXGGXXGGF

SEQ ID NO: 198178 - protein, 55 aa, Triticum aestivum
  Clone ID: PAT_TA_92596.pep
FPAIERRTQLLQVAFSRGLENYPDLAHDTADACEGLSLEERRALEISKRKVLEKG

SEQ ID NO: 198179 - protein, 142 aa, Triticum aestivum
  Clone ID: PAT_TA_92597.pep
MLRNQALHHGKYARKNLWACKSYGSFQPSRGLAIVADGKTVSRQSEIDPRAPPYAKLTEKLSLVRRLLGDARKLTLAEKILFSHLGDPEESLLSNSDNGRNIRGNAVLKLKPDRVAMQDASAQMALLQFMTCRIPTTAVPTS

SEQ ID NO: 198180 - protein, 91 aa, Triticum aestivum
  unsure (1)..(91): unsure at all Xaa locations
  Clone ID: PAT_TA_92598.pep
MMGLGLGDPPADYGSIMAVGLFVALMCICIIVGHLLEENRWMNESTTALLLGLGAGTVILFASSGKNSRLMXVFXEDLFFIYLLPTINFNX

SEQ ID NO: 198181 - protein, 131 aa, Triticum aestivum
  unsure (1)..(131): unsure at all Xaa locations
  Clone ID: PAT_TA_92599.pep
MVKTSVLNDALNAINNAEKSGKRQVLIRPSSKVIVKFLSVMQKHGYIGEFEEVDDHRSGKIVIQLNGRLNKTGVISXPRYNVRLGDLEKWVVKLLPSRQFGYMVLTTSAGIMDHEEARRKHVAXKIXGFFY

SEQ ID NO: 198182 - protein, 44 aa, Triticum aestivum
  Clone ID: PAT_TA_92600.pep
LELQSAVTQRLGLHSKDCEPIRWPLFPPFQRINFEHHEQLAGGG

SEQ ID NO: 198183 - protein, 114 aa, Triticum aestivum
  Clone ID: PAT_TA_92601.pep
EAKAHAQKLRQKEKEQVRKQRREAKILALGNDTDDEASASESSDSTAEESEDEESDKEHSRGFGRNKFGNAFQEVIDETNARVRIDSFEHCVVEVKKEDLAGFLESLSMKSVVG

SEQ ID NO: 198184 - protein, 63 aa, Triticum aestivum
  Clone ID: PAT_TA_92602.pep
FFFFFLQKWKYFLTASQLPSSPLQNTVYTNTSASENTKWVSYKATPAKPLVLYNDILRKMNEK

SEQ ID NO: 198185 - protein, 118 aa, Triticum aestivum
  unsure (1)..(118): unsure at all Xaa locations
  Clone ID: PAT_TA_92603.pep
MLEARLEQADLLKKIVDAIKDLVQDCNFDCNDSGVALQAMDNSHVALVSMMLKAESFSPYRCDRNLALGLNLGSLTKVLRAAQGDDILTIKAEDAPDVLNLLFESSEXNDRINEYDLK

SEQ ID NO: 198186 - protein, 160 aa, Triticum aestivum
  unsure (1)..(160): unsure at all Xaa locations
  Clone ID: PAT_TA_92604.pep
LVPXSARADISRKDKTKFIKAXRSPNSRKSRRQGRERQKGGTNLPINXNSTRTPGILGRKTPETNFSTAKVRSLRSFSLKTNTAVNLKNSSSXISESILXSVNSLILDLKDAHLKKEDINKIEDKLMDMXRALYEAEKRGRRAHXEXKLSGVRLMXFKIS

SEQ ID NO: 198187 - protein, 99 aa, Triticum aestivum
  unsure (1)..(99): unsure at all Xaa locations
  Clone ID: PAT_TA_92605.pep
LGGLGLKQINRGQRCNNNIHHKGHPRXGALGRRAEQVNHTHTHTHPCXTPSXQRDARYSRILSHHHTSACSLTVAGVALAVVAAAAALAGLAGGHLELP

SEQ ID NO: 198188 - protein, 137 aa, Triticum aestivum
  Clone ID: PAT_TA_92606.pep
TIFQTGNSQPRAIQDDSDVEEEALAADYREQIQYEGLEVLDHMNSANMTQQADDIQSRLVAASQPLDFSAPIEVKFASYDNYCSLFHYILNSDGPVDLEPPSYYWAWDVIDEFIYQFNSFCSYRNRVARQGSNEERK

SEQ ID NO: 198189 - protein, 119 aa, Triticum aestivum
  unsure (1)..(119): unsure at all Xaa locations
  Clone ID: PAT_TA_92607.pep
IFEMKFLSTTITAVFAGISLLVPTAYGNLQYRCEIGDPITESQVLETVNKSFLIDNSPQHPAIPTTEPHKTYFSTRPWSGSESGIASFLIQVYGQPPKYQVYQGVARGWRLCTLENGXL

SEQ ID NO: 198190 - protein, 162 aa, Triticum aestivum
  unsure (1)..(162): unsure at all Xaa locations
  Clone ID: PAT_TA_92608.pep
KRRATGGKQKACRKKRKYELGRQPANTKLSSNKTVRRVRVRGGNVKWXALRLDTGNFSWGSEAVTRKTRLLDVVYNSSNNELVRTXTLVKNAIVQVDAAPFKXWYLTHYGVEIGXKKKAAATAKKDAAEGQESEGAAAATXEAKKNNNVQKELETTRDQLSQ

SEQ ID NO: 198191 - protein, 84 aa, Triticum aestivum
  Clone ID: PAT_TA_92609.pep
RENPKIKEAITAKFTEYLRRAEEIRAVLDEGGGGPPGAPNGGDAAVATRPKTKGKDGGGDGAGGDDSEQSKLRAGLNSAIITEK

SEQ ID NO: 198192 - protein, 125 aa, Triticum aestivum
  unsure (1)..(125): unsure at all Xaa locations
  Clone ID: PAT_TA_92610.pep
MFRNAIRQSGRTVGAISVSGRVTTVAAKRSAAPSTIKNSLIPSRCYAVEAKATPTEVSSILEAKIRGVQEEAGLAETGRVLSVGDGIARVHGMANVQAEELIEFASGVKGMCMNLXAGQVRVVLF

SEQ ID NO: 198193 - protein, 89 aa, Triticum aestivum; identical to SEQ ID NO: 117638
  Clone ID: PAT_TA_92611.pep

SEQ ID NO: 198194 - protein, 82 aa, Triticum aestivum
  Clone ID: PAT_TA_92612.pep
FFFFFFFLHNHLILFITVKKNATQPTSQLACIFFFFLRGTQLACIYAIMHDTVYTRVLDTHLHSACSLSCRIRHELVPNSAR

SEQ ID NO: 198195 - protein, 171 aa, Triticum aestivum
  unsure (1)..(171): unsure at all Xaa locations
  Clone ID: PAT_TA_92613.pep
RAEFGTRALDGVLEKVIGDHRRRRQAGQQTGDDGGDHRDFVDVLLDVSDTDDEAGMRLSTTEIKAIILDMFAAGTDTTSTAMEWAMAEVITHPXDSMRKLQDEXRAAVGGSGHVITEDHIDKLHYLKAVVKETLRLHPTIPLLVPRRXPKTTPKILGQQRPGGHPVVINAL

SEQ ID NO: 198196 - protein, 125 aa, Triticum aestivum
  unsure (1)..(125): unsure at all Xaa locations
  Clone ID: PAT_TA_92614.pep
MSNLFSGISGRFRGTGKGAGAKSPGLPPSASSSSTGNVANGSSGGMAPRVPPLPNSPSLTQTFSMENSESSPARSDVLSHYNLPRPKPLWINDSYAKHIVKGNFMTLSTXPKNVEQGEWIAHQVC

SEQ ID NO: 198197 - protein, 37 aa, Triticum aestivum
  unsure (1)..(37): unsure at all Xaa locations
  Clone ID: PAT_TA_92615.pep
PXSQNPVLGPFKVVAHFIXLSLNYFFCCQLELRYNFS

SEQ ID NO: 198198 - protein, 55 aa, Triticum aestivum
  Clone ID: PAT_TA_92616.pep
IKEILGLDFLAVKTPEICPLTLDMKFALSTLFLKLCQKTIPDFNFYLCNLNQQTG

SEQ ID NO: 198199 - protein, 164 aa, Triticum aestivum
  Clone ID: PAT_TA_92617.pep
CQSIHPANVLLQLIQSFNLLPETFEQAMACDESNKWKESMRDEIKPIVENKTWKLVSVPPNGCKVIQGRWVYRTKSNLDGKIIKYKSRWVVRGFQQEEGYNFTDTFASVVKPMSYKILFSIAASHDLDIDQMDVKTAFLNSPIHEEVYVEQPHGFEVTSLEDKK

SEQ ID NO: 198200 - protein, 97 aa, Triticum aestivum
  unsure (1)..(97): unsure at all Xaa locations
  Clone ID: PAT_TA_92618.pep
MAVASTLPGQLVAVXALLALSVAMTASASASPAPANRSRRCYKHLFSFGDSLIDTGNSMVNSTPPGPVXKAAYGETFFGRPTXXRWXDGRLVRRLHP

SEQ ID NO: 198201 - protein, 63 aa, Triticum aestivum
  Clone ID: PAT_TA_92619.pep
SLRRSVLASGMEFNCIMMVNLILRGPLVSLAPQRVLRLPLPLHVNLKSKVKHHLKFLPQSLLQ

SEQ ID NO: 198202 - protein, 145 aa, Triticum aestivum
  unsure (1)..(145): unsure at all Xaa locations
  Clone ID: PAT_TA_92620.pep
NPVPGKRICPTFSSSIVRNILVGFVPDEFCPDPIQDSLLQALELEXILESSDKGIRAIPCSASPILYSYPASXTILSIICDPRKSGLAVLRKSNTSDDELDELSSPLSFISKVPTNPLAKLKQVSGSNTARYRLLHEVWKLDDQY

SEQ ID NO: 198203 - protein, 165 aa, Triticum aestivum
  unsure (1)..(165): unsure at all Xaa locations
  Clone ID: PAT_TA_92621.pep
LSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGXVKFGEGVWFKGGSQIXFSXGGLDYLXXPKPGSNAQSILAIWACKSCSM

SEQ ID NO: 198204 - protein, 100 aa, Triticum aestivum
  Clone ID: PAT_TA_92622.pep
LVPNSARGGNNLTGPIPASLANATAMVSLSLSNNSFNGQVPPEIGTLRLSKLEMSNNELTATNEDGGWEFLDRLTKCNSLEVLSLDNNKFSGTMPRSIGN

SEQ ID NO: 198205 - protein, 167 aa, Triticum aestivum
  unsure (1)..(167): unsure at all Xaa locations
  Clone ID: PAT_TA_92623.pep
SCRIRHEHASLILHLLLIQEGQWDFPQSLDMRLNTIIPGVIVTVGKNDTPHVQTMVSYNFEGLHLQDPEDGNDIRDMTASWLPIQFQPHKNREDDYKQRIGTDKHLSFATYEATRNGNYQLRKKVRLQDDKLYSVQEVQDYDRGIQATSPPARKGSPRRIKQIRHIX

SEQ ID NO: 198206 - protein, 119 aa, Triticum aestivum
  unsure (1)..(119): unsure at all Xaa locations
  Clone ID: PAT_TA_92624.pep
MAQDLPPIGGYDPVQYKRNLPARGFRPSILLFGVAGIMTYGFWRVGQGIREHNELAREKMWSRIHLIPMLTAXEDRDLVRRHLADXAREESLLGTKXVRXTSDRYVRPTFAITPGKITK

SEQ ID NO: 198207 - protein, 140 aa, Triticum aestivum
  unsure (1)..(140): unsure at all Xaa locations
  Clone ID: PAT_TA_92625.pep
MADQLTDDQIAEFKEAFSLFDKDGDGCITTKELGTVMRSLGQXNPTEAELQDMINEVDADGNGTIDFPEFLNLMXRKMKDTDSEEELKEGFKVFDKXDQNXFISAAEXLRHVMTNSGEXKLTDXXVGQDXFVEXDVXXDG

SEQ ID NO: 198208 - protein, 73 aa, Triticum aestivum
  Clone ID: PAT_TA_92626.pep
SLYNIPKVYVRKRSSQKYELLRDIRTRSSLTEFKSGIIRIQFFLTSITDNLGSSYIHSGVLNVFLGKQRSIPI

SEQ ID NO: 198209 - protein, 146 aa, Triticum aestivum
  unsure (1)..(146): unsure at all Xaa locations
  Clone ID: PAT_TA_92627.pep
MAAAGDAGEKKMITLKSSDGEEFEVEEAVAMESQTIRHMIEDDCADNGIPLPNVNSKILSKVIEYCNKHVQAKPADGAAXAAGASDAAAPAAPAEDLKXWEAEFVKVEQAXTLFDLILAANYLNIKGLLDXTVKTVADMIKGQXPG

SEQ ID NO: 198210 - protein, 159 aa, Triticum aestivum
  unsure (1)..(159): unsure at all Xaa locations
  Clone ID: PAT_TA_92628.pep
CIIFGIFFPGQRSXPGNWERXFSLPIKPGEAILDLXNSQIGVEHWXQXPPFLXXITPWATXXTPIXPQTXXPSNFXXSFVDTXELPQLPQPMTPXEPLCEPEVXRAPRRDHRKLLMRRETAIEPRQEGLVSNNSYDNPKRGTRERRQADPGPGMVPNTQ

SEQ ID NO: 198211 - protein, 129 aa, Triticum aestivum
  Clone ID: PAT_TA_92629.pep
LVPNSARDHDELEEVLQIVKPQHFLPVHGELLFLKEHELLGRSTGIKHTTVIKNGEMLGVSHLRNRKVLSNGFVSLGKQDFKLMYSDGDKAFGTSTDLCIDERFRIASDGIILCQHGDLPDLKPASTQS

SEQ ID NO: 198212 - protein, 72 aa, Triticum aestivum
  unsure (1)..(72): unsure at all Xaa locations
  Clone ID: PAT_TA_92630.pep
MVDNTSPDQDETNEGASLGEQLIEAARRNNTQLLNDIIKAVSDTERLTALLNNTKTVXGNYIYHEAXLQGNY

SEQ ID NO: 198213 - protein, 113 aa, Triticum aestivum
  unsure (1)..(113): unsure at all Xaa locations
  Clone ID: PAT_TA_92631.pep
MSTKIAYQHYLRALSRWPHDVLRPECRFQDVLRRRIDLRLLPKANQNGQDSLARSVVPKKINEKDELAQANSLYLLLEDRFCKKYPLKGSLLKPLSNPTYYXDLITELEHAPL

SEQ ID NO: 198214 - protein, 107 aa, Triticum aestivum
  Clone ID: PAT_TA_92632.pep
FDIVIALDLHPNTLNIINTATRLNHKPFYAAGVHGLYGFLFSDLIQHDFVVERERGNRNTSVTTETRTRSVVEVKEKKENSKTFELVSKRELFSTWFLASDVAGPAG

SEQ ID NO: 198215 - protein, 143 aa, Triticum aestivum
  unsure (1)..(143): unsure at all Xaa locations
  Clone ID: PAT_TA_92633.pep
MAPTVMASSATSVAPFQGLKSTAGLPVSRRSNGAXLGSVSNGGRIRCMQVWPIEGIKKFETLSYLPXLSTEALLKXVDYLIRSKWVPCLXFXKVGFIFRVQNAXPGYYXXRYXXMWQLPXMFGCTDATQGXNEVAXSKXVPDA

SEQ ID NO: 198216 - protein, 127 aa, Triticum aestivum
  unsure (1)..(127): unsure at all Xaa locations
  Clone ID: PAT_TA_92634.pep
ASQPHSPEQPAGRLTPRSCALSGKQRSLRAAWVMALLLLRGCLAPVNATAPAFRRGETTSLVSYRRPSRFGAVVASAAASSPSGGDGATAAVDAVLRGSEGSKGKXLDYGGNNGAVCLRXPLXXEHR

SEQ ID NO: 198217 - protein, 66 aa, Triticum aestivum
  unsure (1)..(66): unsure at all Xaa locations
  Clone ID: PAT_TA_92635.pep
NHLIYISSSSHQHPSLCTTSRWHXLTQNKQMKPVSVFCNKTECQGRGMVRPVGQSVPAHEHVGDAV

SEQ ID NO: 198218 - protein, 144 aa, Triticum aestivum
  unsure (1)..(144): unsure at all Xaa locations
  Clone ID: PAT_TA_92636.pep
MTNNYNPQNDYTTHSTNQPTASLTLQTDNHNMGYHVSNDLDSSVYPVXNTNGINPIHSEHIHNIPYAPPANILIQTSMQSEIIPENSPSTKPKKTTVKPLWTDXKPSILLVEDDKVCARIGTKFPQSXDWAVDTAHDGLGTVNK

SEQ ID NO: 198219 - protein, 127 aa, Triticum aestivum
  unsure (1)..(127): unsure at all Xaa locations
  Clone ID: PAT_TA_92637.pep
IQVFEGERQRTKDNNLLGKFELTGIPPAPRGVPQIEVTFDLDANGIMNVSALEKGTGKSNKIVITNDKGRLSKEDIERMLAEAEKYKAEDEAEAGRISAKNGLESYAYSLRNTLSDSKVXDXKIDAR

SEQ ID NO: 198220 - protein, 124 aa, Triticum aestivum
  unsure (1)..(124): unsure at all Xaa locations
  Clone ID: PAT_TA_92638.pep
KVSEQVIDECKSAAVLYKHKKTGAEVMSVANDDENKVFGIVFRTPPKNSTGIPHILEHSVLCGSRKYPLKEPFVELLKGSLHTFLNAFTYPDRTCYPXVASTXXXDFYNLVDVYLDACIFSLSV

SEQ ID NO: 198221 - protein, 65 aa, Triticum aestivum
  Clone ID: PAT_TA_92639.pep
VIGTRRDILSTYQQSLLSGSSPLSLPHSPATRTGRKSWSELLYQIVSVKTFLSFQHNLRFFPGQE

SEQ ID NO: 198222 - protein, 124 aa, Triticum aestivum
  Clone ID: PAT_TA_92640.pep
DARLEAFTQKGSVGIKVNDDIGHYFQTHKGLRQGDPMSPILFNIVVDMLAILIGRAKEAGQVGGLVPHLVDGGVSILQYADDTIIFMEHDLAKARNMKLVLCLFEQLTGLKINFHKSELFCFGR

SEQ ID NO: 198223 - protein, 105 aa, Triticum aestivum
  Clone ID: PAT_TA_92641.pep
TPKLFHMSPLYLPICSIYLSFQVNFYVPNSKPSNEILFCMLEQLMLQLGLPISSMLGGLFSRGVDSAPHSRGSAGNRDAQSHDPKRYGHLIVVTLTAKVCRSKCY

SEQ ID NO: 198224 - protein, 127 aa, Triticum aestivum
  Clone ID: PAT_TA_92642.pep
CGKPLLTSIARKGQRPGSRYYKCMDYDDGICSFFEFQDKYARRLAQEPPTAIPQSALPAGCSRRSACRARMQCRACHGRKSRTRRCPGAGGTHRQDCCAEVGRSARGHCCGEPAGGLRQPADYQYSH

SEQ ID NO: 198225 - protein, 51 aa, Triticum aestivum
  Clone ID: PAT_TA_92643.pep
IKTKENMTRHRAGVLLFTGVSGFFGSDDLLLSTWRYRVLYLPSYAHSAASQ

SEQ ID NO: 198226 - protein, 81 aa, Triticum aestivum
  Clone ID: PAT_TA_92644.pep
YIRGRGLFESNRFFGFFIFVYFFSFLFSIFFFFFLFFFDFLFPFFFAYSVSIFWFSLFLLAFIPYFSNTCLKFLQCKFNIF

SEQ ID NO: 198227 - protein, 105 aa, Triticum aestivum
  unsure (1)..(105): unsure at all Xaa locations
  Clone ID: PAT_TA_92645.pep
ARSAAKNTLILLILFSPSHRKIYLKFQPSRKCTPSAKSIKLLTERRKKTKLNLITRLSCHRLLQLLRSPGFLFRHLEHLRXGSRMERRRQRHLHPQRPRLXLLLR

SEQ ID NO: 198228 - protein, 68 aa, Triticum aestivum
  Clone ID: PAT_TA_92646.pep
PPTKQILREYIHCRGVINNTTWELLRVLQHDTNKQKQLLQTQEKRQFKGTSESKSTELDVILPPFVNK

SEQ ID NO: 198229 - protein, 137 aa, Triticum aestivum
  Clone ID: PAT_TA_92647.pep
MAEDNGTGNKVDNIHGQPRKLPYQFIKDITNDFDEAQIVGRGAYGTVYKGTRENGEEIAVKVLQNMTGFDNKEFEKEFENLRRLKHQNVVELLGFCNESEKVVAEYNGKQVIAEKMHTALCFEYVCNGNLAEYISGN

SEQ ID NO: 198230 - protein, 123 aa, Triticum aestivum
  Clone ID: PAT_TA_92648.pep
RPNGGSPKPGAAAGRPHPEAEVRNPTRRTSTRAGRDGGDLDVPRQPPPGRGRRRAPLAGAPTHALRVPVPPPPPPPLPRRLPPRRGSPARLPQSPPGRRRRGARGRGRGAGGGRGSAAAPGRA

SEQ ID NO: 198231 - protein, 69 aa, Triticum aestivum
  unsure (1)..(69): unsure at all Xaa locations
  Clone ID: PAT_TA_92649.pep
RRAGQXVXSDGPGESAHEAAXXHLPDGFHFLXYRNHRLGLATRXXSRTEPEPIXNPNRKAXRARAEFGT

SEQ ID NO: 198232 - protein, 165 aa, Triticum aestivum
  unsure (1)..(165): unsure at all Xaa locations
  Clone ID: PAT_TA_92650.pep
LPYTRHLFPPPLEQERSIRPVIIKTRRLATARQQSQNPPDSCPGSDSPPSHGVPHHPAAGRRRRAAAEGGRGERRRRERGRRAATSRPGAXTPTRRCPSPPCCVRXSRELLPQXPXPPQRLPXQAQRRRIRQDFRXGXSXKSXKTSPNSQNNSPEVPNXPETTTX

SEQ ID NO: 198233 - protein, 60 aa, Triticum aestivum
  Clone ID: PAT_TA_92651.pep
PWGLPPPGFFFFFFFFFFFFFFFFFFFFFFFFFFFFLGLSGFSSLRFSVKLPMKDRQTLF

SEQ ID NO: 198234 - protein, 165 aa, Triticum aestivum
  unsure (1)..(165): unsure at all Xaa locations
  Clone ID: PAT_TA_92652.pep
MAASLQAAATLMPAKIGGRASSARPSSHVARAFGVDAGARITCSLQSDIREVASKCADAAKMAGFALATSALLVSGASAEGAPKRLTFDEIXSXTYMEXKGTXTANQCPTIDGGVDSFPSRPARYEXXEILPWXPXSFNVXGRRHQXNXPXALQXDXLMXRXTKP

SEQ ID NO: 198235 - protein, 154 aa, Triticum aestivum
  unsure (1)..(154): unsure at all Xaa locations
  Clone ID: PAT_TA_92653.pep
RAEFGTRKPRLKPPFPAAVGLFGCPSTVANVETIAVAPTIIRRGASWFSSFGRERNSGTKLFCISGHVNNPCTVEEEMSIPLRELIDKHCGGVRGGWDNLKAIIPGGXSSXPILPKEVCXSQAHGFLMPLKDXQVWSSGQASCNQALNCPRLKD

SEQ ID NO: 198236 - protein, 38 aa, Triticum aestivum
  Clone ID: PAT_TA_92654.pep
LIRGVKRLGHNHRHDYGPPSSSINPLILSKKKKKKKKK

SEQ ID NO: 198237 - protein, 93 aa, Triticum aestivum
  unsure (1)..(93): unsure at all Xaa locations
  Clone ID: PAT_TA_92655.pep
TSSKSRQRQDMKETLTQQSQYHVXIYRGQTDESREFDLRMILYTYNLTAELDHGLLYRSSCYVHRSASVLSHLNSLRPPINKQWGLLFRLDIK

SEQ ID NO: 198238 - protein, 164 aa, Triticum aestivum
  unsure (1)..(164): unsure at all Xaa locations
  Clone ID: PAT_TA_92656.pep
GTNKSPPNLVSDRLHARRILLPHRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEXVESSDTIDNVKAXDPRTKEGHSSRXQAXVSSFWQSNFEGWAVTLA

SEQ ID NO: 198239 - protein, 173 aa, Triticum aestivum
  unsure (1)..(173): unsure at all Xaa locations
  Clone ID: PAT_TA_92657.pep
LGSNVNRNYSTCXHGRCCEVKTACILERXDLFPRRWXLGPVAXLEKKKMKAXGKLDKYGRPNEATPAKWNTEYKDFNAPLDGSTCHIRGKSYSSLQEXDAMLANLGADTPMVDNAAEASSLEAGAEESGKKRKRHEGETAEEKAERRRKKKEKKNKKEKSTQATEDSAAEHSA

SEQ ID NO: 198240 - protein, 174 aa, Triticum aestivum
  unsure (1)..(174): unsure at all Xaa locations
  Clone ID: PAT_TA_92658.pep
KYTWKRTRYGTGSISSVKHFWISLKALYQEPSKDHPIVIEEPYFQLKGQYCRTKSTRRALQSIXKTQIDFLVKDIDLPKEXPADWEKVKALGEFTISPGENQRKRKFVQLSRSVREVLCAQPLRRXLHXFCLFEEDFELWLFDRSGVPTVQGQKXIGRNKEVGLFXAIKLVTYX

SEQ ID NO: 198241 - protein, 130 aa, Triticum aestivum
  unsure (1)..(130): unsure at all Xaa locations
  Clone ID: PAT_TA_92659.pep
MVRQEQEANVAQRSGASSSRTGRFSSRPALSVAVPATASIGRPNTSKPISTTLTRRGLDIAKPSSSPTHTTTDDKLKALRAFRKARGLYFTCGXRWGPGHVCASTXQLHVVXACGHDFTPCLNEYCCDSS

SEQ ID NO: 198242 - protein, 108 aa, Triticum aestivum
  Clone ID: PAT_TA_92660.pep
GAEFGTRGNEIEIDLPNQLIKSQTGQPICSFEVEEFRKYCLINGLDDIGLTMKMKDKISEFEKKMTRLTPWLNGSGYLKRRDGGMLAVAAIPIPKTNQGDKLTDPLDW

SEQ ID NO: 198243 - protein, 113 aa, Triticum aestivum
  unsure (1)..(113): unsure at all Xaa locations
  Clone ID: PAT_TA_92661.pep
DHTHLKAQXLPXMVKASVSGVDMDIRASLLQNIVFVGGTSLTLGLXERLDQELKNIYPGARIKINAAGLTSERRFGSWIGGSILGSLGTFHQMWISRKEYDEFGANIVEKRCK

SEQ ID NO: 198244 - protein, 75 aa, Triticum aestivum
  unsure (1)..(75): unsure at all Xaa locations
  Clone ID: PAT_TA_92662.pep
RAEFGTREAGNQKRPTGQLSSRAAPSPHQHPPASLRKLLISSGRLSQAASAAAARSNPSRMPPGKGGEKKXLLGS

SEQ ID NO: 198245 - protein, 101 aa, Triticum aestivum
  Clone ID: PAT_TA_92663.pep
LVPNSARGENESGIEADKPESIGTEKPNQEEDDYDRNTQTPAKVNKDEREGIKDKSNPLIDEENSSLKNETDDDTSNSGAQESSNMNETSDYSKKNENQAR

SEQ ID NO: 198246 - protein, 50 aa, Triticum aestivum
  Clone ID: PAT_TA_92664.pep
LPDKRRRILTTHLFCIPGNASAPNYRSSAVETNYNILRYTPMQAPVRKEL

SEQ ID NO: 198247 - protein, 128 aa, Triticum aestivum
  Clone ID: PAT_TA_92665.pep
VDDPGTPELSIAYRDRQKTFIATEPRGRSIGEETTALDLLQGIRDAILAHQSLFKEARILHRDVSINNIILTDPAVNNGRYGLLIDLDLAISLNDVNSDRDSQDYDWYYGVYRPWDLGSQYFRDWQRV

SEQ ID NO: 198248 - protein, 105 aa, Triticum aestivum
  unsure (1)..(105): unsure at all Xaa locations
  Clone ID: PAT_TA_92666.pep
HITHQHNYFXXVFLTTVLGRKNTIXARKLRCGPRCFYHQFDIVNTIIISSLPSIHHFAFRASTWRVWVNPAVSTRRKMRQRPQQTTAAERRQIQRIETSKSWGDY

SEQ ID NO: 198249 - protein, 94 aa, Triticum aestivum
  Clone ID: PAT_TA_92667.pep
RRESRHGPKPYWPVAAPGWGKGPRPSQAVFKHCRLVYTLQLHCSLQLTKENGLTPPLRMCIAHDIGYVRAHEADKLCRIKNDSSLPMDVQGGHV

SEQ ID NO: 198250 - protein, 122 aa, Triticum aestivum
  Clone ID: PAT_TA_92668.pep
LVPNSAPARAEFGTRKIVHYDIKPGNVLLDGGLTPKVADFGLAQLLNRADTHKTVSGMRGTPGYAAPEMWMQAGATEKCDVYSFGILLFEILGRRRNFDEAAPESQQWVPEAGVDKVRRAAS

SEQ ID NO: 198251 - protein, 164 aa, Triticum aestivum
  unsure (1)..(164): unsure at all Xaa locations
  Clone ID: PAT_TA_92669.pep
MRSVRLSRYHGPRLCHLRPAQQHWLGFASSSKAPNALDTASSVSADEATSSFLSFASRPASSPYPSPLPQRAAHSAKLAALHARLSLPRRLPLETMARTLVDPSADSNPDFNNASLARLGGSLVSYYVGESLICTYPRLPSSVLFXAAYAYNGPNTLGLAPGMG

SEQ ID NO: 198252 - protein, 159 aa, Triticum aestivum
  unsure (1)..(159): unsure at all Xaa locations
  Clone ID: PAT_TA_92670.pep
RAEFGTSSGFAIIDISYGDRSLRVVDLGKLGLLHDGPKAPNRCLPLWNTSVKLGRQLRIDPTNLNLIFYNCTEEATAAARARRDRWLVHARTMGCVNASNSFVRXGSAYDPAGDYAGYALEGCDAINLPVLGVARGTSTGGEPTAQQMSSLTWDSATSS

SEQ ID NO: 198253 - protein, 127 aa, Triticum aestivum
  Clone ID: PAT_TA_92671.pep
RAEFGTRRQRVTFHNLRSNLTHQSTSSDNSTGSVVKFEEDAWSESNSIPSTPLEEATVHDTDHRKMDHPVKSLPPSPSIMPTKGFHEISDNDNGVDFDAESEAGISFMVPAMETTSNTHSLVSKSTR

SEQ ID NO: 198254 - protein, 73 aa, Triticum aestivum
  Clone ID: PAT_TA_92672.pep
WQKCHNVTYLYSTSCQQESWNLDVIPMELRSRGKRSPESWNGSCYPKSINYIVVQASSTCSYTILLSKYLALN

SEQ ID NO: 198255 - protein, 62 aa, Triticum aestivum
  unsure (1)..(62): unsure at all Xaa locations
  Clone ID: PAT_TA_92673.pep
PSASSSSPAPAVAGRXHTXXPSXXPMXVNNXVETLXFDLQXGHGPGXKAPPPADSXARQXQT

SEQ ID NO: 198256 - protein, 161 aa, Triticum aestivum
  unsure (1)..(161): unsure at all Xaa locations
  Clone ID: PAT_TA_92674.pep
EHGIQPDGYLTEERKAADPDEGFSTFFSETGQGKYVPRTIYCDLEPNVIDEVRTGTYRSLFHPEQMISGKEDASNNYARGHYTVGKELIDKVLDKIRHVADNCAGLQGFLVFHSFGGGTGSGFGALLMERLSXDFGKXKVKLEFCVYPAAQTGTSVVEQTQ

SEQ ID NO: 198257 - protein, 77 aa, Triticum aestivum
  Clone ID: PAT_TA_92675.pep
NMSFINPRLSSLGMQILDSLVQNRKGEILDFLICDTYGTSVLVTDIWHFHFALGINWYFIMDLQHRYCRIMPNHNPS

SEQ ID NO: 198258 - protein, 145 aa, Triticum aestivum
  unsure (1)..(145): unsure at all Xaa locations
  Clone ID: PAT_TA_92676.pep
RIRIEDDIDCYKTEXYVYCVEKVAQYADILVVNVSSPNTPGLKNITAGXILTELLRGIVEAAKLVPRKTTPRIMVKVSPDEDGEDQVAGIVDAIWKSGVDGVIVSNTTRRRDIAVPDKAPITPKDQEILKEQGGLSGLVPNSARA

SEQ ID NO: 198259 - protein, 104 aa, Triticum aestivum
  unsure (1)..(104): unsure at all Xaa locations
  Clone ID: PAT_TA_92677.pep
LEXXGXARMLGTRGARGRARGAEPRVLRGRGRERVAREGGVAGAGGGGPRVLPWEARVRQRQAAHGPRRRVHSRRMSCMYCPPTRCPLAADPKPLPFIQQWCTS

SEQ ID NO: 198260 - protein, 129 aa, Triticum aestivum
  Clone ID: PAT_TA_92678.pep
NRRSGTTARPHGTTTNGSGTTACKRYKKNTSVPTSAEQNTRFWSGVVLPLRSRGSTTLERYYHSGATVVPLWSGSKKITSPLAMVVPQQPLPKQPQLLQTDTEFNETKFVGKLTTWANTILIEISIRRK

SEQ ID NO: 198261 - protein, 142 aa, Triticum aestivum
  unsure (1)..(142): unsure at all Xaa locations
  Clone ID: PAT_TA_92679.pep
MAATVGKEREEAVVHPNARQGGKLLSRLLTRDSSAAAPSFRVYYXVSSAGAVPFLWESQPGTPKNAISDAAMPPLTPPPSYYAAGGTASAKNHAARKGKVAGGYFRTSILGLHPHGDAGRATTVARPRPSPSKPPPPTSHLS

SEQ ID NO: 198262 - protein, 185 aa, Triticum aestivum
  unsure (1)..(185): unsure at all Xaa locations
  Clone ID: PAT_TA_92680.pep
LVPNSARAEVQVELLAGKSGEASDVMRINSYEDLVRQCRLEQKVLQDISVFGSREYELDRAAERLICITTILRNLSFYDTNHTQLTEKLVLRFFCTAIRYLGTRKLLLRTSSNTLDFMKDAVIFLSNLAQEIELSGKEEALYLLXFILAFATYPXTNNANSSNNXXFSPYEPAIHPISTPAVXQL

SEQ ID NO: 198263 - protein, 77 aa, Triticum aestivum
  unsure (1)..(77): unsure at all Xaa locations
  Clone ID: PAT_TA_92681.pep
SRVFFFFFFFFFFFFFFFLAWLDPKKKYMYTYXLGTNXGNVSRTFQKHGFFCTVISIYFALLHXHLFPAIAPERXWD

SEQ ID NO: 198264 - protein, 120 aa, Triticum aestivum
  unsure (1)..(120): unsure at all Xaa locations
  Clone ID: PAT_TA_92682.pep
GVXAPXPXRLIXXPXSVFGXXLXRLKRRXPPAAVLIRGGGGAWRTRGGGAAREGAWRGGRERGPTRRRGXGGGGWPPWFGLVSXRCLSRDRGVCRRRGRCARARCSRXPRRVLLVPNSAR

SEQ ID NO: 198265 - protein, 161 aa, Triticum aestivum
  Clone ID: PAT_TA_92683.pep
MLTGSHLKILRRKLIDLQVNILYEAAWPSYPEVVVNLPPEVAVHVEKFDNFYTKKHSGRRLTWKNSLAHCVIKAQFNKGAKELLVSAFQAIVLVLFNNVKPSDPLSYSTIQQVTGLVDLELQRTLQSLACAKFRVLTKHPKGREVNITDTFTVNLVPNSAR

SEQ ID NO: 198266 - protein, 138 aa, Triticum aestivum
  Clone ID: PAT_TA_92684.pep
MSKSWNDLWEEEEEEEAARKIKLRQIQNSRTWSHESELEVRSPQKHCPVDQLRIRDPSKSDAFLEEKRTDIDGDSIADGFFFQDIPSDYTAPQLSPRYSPPYKRNDSDKWLALGERRRAHPGSQESGNGFEFVKEVYS

SEQ ID NO: 198267 - protein, 139 aa, Triticum aestivum
  unsure (1)..(139): unsure at all Xaa locations
  Clone ID: PAT_TA_92685.pep
MGLHQRDDGGSSDKGKAALCDDGAPGAPAHATGRVPPWTEQLTLRXLVVSVAVGTMYSVIVMKLXLTTGLXPNLNVXAALISXXMLRGWTKALARLGRVVCPLTXXGEXTFXXTCAXACYNIGAXGXFXSYXSGFKRKT

SEQ ID NO: 198268 - protein, 108 aa, Triticum aestivum
  unsure (1)..(108): unsure at all Xaa locations
  Clone ID: PAT_TA_92686.pep
ARNTDXTIGRIGYRAPPRVFXFFFLSAVFKAGSKITNLSKTNSTAYMRKTYTASDEEAAFTLALWVGLCEKVNYTNVLDKYKLKDWLSLFIEVFLVPNSARARAEFGT

SEQ ID NO: 198269 - protein, 51 aa, Triticum aestivum
  Clone ID: PAT_TA_92687.pep
DFGLAKLINPKDHRHRTLTSVRGTRGYLAPEWLANLPITVKSDVYSYGMVL

SEQ ID NO: 198270 - protein, 124 aa, Triticum aestivum
  unsure (1)..(124): unsure at all Xaa locations
  Clone ID: PAT_TA_92688.pep
MFTVKGTAIRASRPLTVGATRARLSRCRAESTASSTSALAYKAIHSRIHPLPTPETPSSWSAQAAVSNILYETPSPAITPAKRHILNCLVQNEPSVLSRLSGXLAAXRGFNIDSLXVWQNGLKI

SEQ ID NO: 198271 - protein, 110 aa, Triticum aestivum
  Clone ID: PAT_TA_92689.pep
MVNVPKTRRTYCKGRDCKKHTQHKVTQYKAGKASLFAQGKRRYDRKQSGYGGQTKPVFHKKAKTTKKVVLRLECTSCKTKAQLALKRCKHFELGGDKENKGRSRGLDLHS

SEQ ID NO: 198272 - protein, 137 aa, Triticum aestivum
  unsure (1)..(137): unsure at all Xaa locations
  Clone ID: PAT_TA_92690.pep
PQTKGIPKTTMLSAISQNLLKRVTSTRLKKPNNALYGYRQTNHSKIYFASNKLSSITVLCSRNSYSTSRIKSSPKVNSVKITGKDSRSRVIENALRRSIKPKSSRLLISKRPGIKSFKKSXKPRGNYLTPXERLRLK

SEQ ID NO: 198273 - protein, 144 aa, Triticum aestivum
  unsure (1)..(144): unsure at all Xaa locations
  Clone ID: PAT_TA_92691.pep
MPMISVAPPPALAFPRLTTLTMPPPMIALPDRAHADAPRPPPPLVVRHAAAKHKAVVVMGATGTGKSRLAIDLALRFGGEVINSDKMQVYQGSDVXXNKGPPPGECAXVPNNLFGLRQGTTRTFSAAFEKAQARARRRGVPVPG

SEQ ID NO: 198274 - protein, 122 aa, Triticum aestivum
  Clone ID: PAT_TA_92692.pep
ELVKRAGADPFPSQRRDDAQNPAILDDLGEQEFGVDSIIRARTVRRGRGSFRQALVKWTGWAEPTWEPIEYVADTEALKIFEETYGPITSNDGPSEIYSGRYVGQAEPHVQKTRRERRKKKH

SEQ ID NO: 198275 - protein, 177 aa, Triticum aestivum
  unsure (1)..(177): unsure at all Xaa locations
  Clone ID: PAT_TA_92693.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWAXVEACLMFRGGTDAXRKVINXGGREXQRKDYLXPYVXXIXFDXMXQVXXXQXQRXKPXGCXGV

SEQ ID NO: 198276 - protein, 187 aa, Triticum aestivum
  unsure (1)..(187): unsure at all Xaa locations
  Clone ID: PAT_TA_92694.pep
RAEFGTRDNTQGITNRLSFFIFTVCVFFFSSNDAVPAFIQERFIFIRETSHNAYRASAYVVAGVITYLPFLLLQSAAYALITWWAIGLHGQFVYFLVMLYASLLSTNSFVVFXSSIVPNFILGYAAVIAFTGLFFLFCXYFVDSHSIPQGWXWMNNVSKMKXPYEGLLMNEFGGTATFRRPAARTER

SEQ ID NO: 198277 - protein, 137 aa, Triticum aestivum
  unsure (1)..(137): unsure at all Xaa locations
  Clone ID: PAT_TA_92695.pep
LARLAPLLASPPLASLLLASPPPSRPRRRRCSPPPHTXRRXRLPVTSSPLXLTRVAYTSEVTTRLFLLPKRRXGXAGELXPWLDLKCLDVPXMRMSGRSXSTSEDGEEWRRVXLKFEDGAVRSXXEEQSXEGLAAWX

SEQ ID NO: 198278 - protein, 49 aa, Triticum aestivum
  Clone ID: PAT_TA_92696.pep
SSCYVCCRSYREPGRLHVSIKYVHLNVNKIIKSLILGPLKKKKKKKKKK

SEQ ID NO: 198279 - protein, 159 aa, Triticum aestivum
  unsure (1)..(159): unsure at all Xaa locations
  Clone ID: PAT_TA_92697.pep
QNRRAARALSVVPLLSLIAYIPTLVVRATAWLSLLAISSLLATAYLLLALPFDHPTGLSMLTPSLRPRPRSSRSPRPPYLGPVLQHLPALNLGLVLILAVAGSLARRRVPKYLAWIWLATSRHLRIRXPLSLYHGGVFNPEERTKXVSATXAREXVKAS

SEQ ID NO: 198280 - protein, 114 aa, Triticum aestivum
  unsure (1)..(114): unsure at all Xaa locations
  Clone ID: PAT_TA_92698.pep
TNELCFTCYILRVILSQARFLPSLFGSSTGGRWXRAGAGGSGALGPALLGWGXDGGPDSXARHPRXHRDNQPRRXVRACLQXAXQRGLRAVXIRRTXTKXSXAIVTRSGTXRGX

SEQ ID NO: 198281 - protein, 92 aa, Triticum aestivum
  Clone ID: PAT_TA_92699.pep
NTSNFISLARNFLSNADQITGESVSSDLRIRISHRSRYLNKNRALMIQPDMSQKYYQNISILAARSNENSSIYVADCRVALCDANQLLGLRG

SEQ ID NO: 198282 - protein, 184 aa, Triticum aestivum
  unsure (1)..(184): unsure at all Xaa locations
  Clone ID: PAT_TA_92700.pep
TTPKYSKARYEEIVKEVSSYLKKVGYNPDKVPFVPISGFEGDNMIERSTNLDWYKGPTLLEALDQINEPKRPSDKPLRLPLQDVYXIXXIGTVPVGRVETGVIKXLXMXXTFGPTGLTTEVKSVXMHHXVLCWXRFLGDNXRXQMVKERXLXXDLKRXFVASNFKGDPXKXXGNLNSXGNMTTL

SEQ ID NO: 198283 - protein, 73 aa, Triticum aestivum
  unsure (1)..(73): unsure at all Xaa locations
  Clone ID: PAT_TA_92701.pep
FGSRRSVMVPVKRLPPSMKSYLRHIKISFSLVSMWDKCKDVATEFXINSMPTYFAVKTRKICKVLGRERIFTG

SEQ ID NO: 198284 - protein, 184 aa, Triticum aestivum
  unsure (1)..(184): unsure at all Xaa locations
  Clone ID: PAT_TA_92702.pep
LEAYEPIPXLFLEXYSSXSNSGXHPRCWREXTGAILRKPNKLDYAAXKAYRVISLLXNCLGKVLERIIAKRLSGLAETTDLXHSSQIGGRLRKSAVDAALLLADEIQSQKQHNRKTTTLFLDIKGAFDHVAKDQLLGTMKDLGLPVSLLSWTKLFLSHRKIQLSFDGQKEQFCQVETSCRIRHE

SEQ ID NO: 198285 - protein, 180 aa, Triticum aestivum
  unsure (1)..(180): unsure at all Xaa locations
  Clone ID: PAT_TA_92703.pep
LKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVGGGQEGVPDAYVRIIXFDNMXXKVQCVSFIAFKQRACEEVRKGLNHDRQYLKGNFANPILGFLPN

SEQ ID NO: 198286 - protein, 151 aa, Triticum aestivum
  Clone ID: PAT_TA_92704.pep
MEVSNQASWPDDFLCPISLEVMTDPVILPSGHTFERRSIQRWLDGGHRTCPVTNLPLPPDPTLIPNHALRRLIAAVSVSPAAVSADKVLAGDCQEQGVAPPSSSSVLGMLRLVSGPAGRGGASPARSRCCSRRPPDAKGVLFSLRRPSGLG

SEQ ID NO: 198287 - protein, 117 aa, Triticum aestivum
  Clone ID: PAT_TA_92705.pep
HTFFPESEKNPSKCVTSTSPSPLTPATIKSAGFSWLLIWLKACVLPALVSCDQHVKQPCQILGEFLKDLELANDRRGNKCHFEIESRARFYSAIKFLPYLFLIVEDRTSDHCHHLGI

SEQ ID NO: 198288 - protein, 115 aa, Triticum aestivum
  unsure (1)..(115): unsure at all Xaa locations
  Clone ID: PAT_TA_92706.pep
KLVNLDFDARVPIPFSVFPSSYRGEEKQEPAPAEGHNEAEHHNSSPEQAASCFAQYSASKLLNQLLHQVAPSVAPSVSXEEIXITHXDKYTASXSHKXTLNFLXDEGDTXNQXHT

SEQ ID NO: 198289 - protein, 172 aa, Triticum aestivum
  unsure (1)..(172): unsure at all Xaa locations
  Clone ID: PAT_TA_92707.pep
NGKTITDSVDLFVEMNAIARRHGVGRIDIVENRFIGLKSRGCYETPGFTCLRSAHIDLEGLVLDREVRALRDQFLTVNYSKLLYNGLYFSPEREFLEGSIAVSQKNVNGQVRCRVYKGSFLVLGRSSDTEKLYDEXESSMDXIGSFSPVDTTGFIXVQAIPLKKYGEXKGGG

SEQ ID NO: 198290 - protein, 88 aa, Triticum aestivum
  Clone ID: PAT_TA_92708.pep
NLDKKISPTISDLKYPSFADHPLMTILEEHNAHMLENISEIRRSCEVAMSTFADKLLGYISENRCCCRAVGRTDCLLRSPHTIHGGKH

SEQ ID NO: 198291 - protein, 136 aa, Triticum aestivum
  unsure (1)..(136): unsure at all Xaa locations
  Clone ID: PAT_TA_92709.pep
WDKISDKFHGGGDSSSSSSDSDDXKKGSXAGVKAKIYRLFGRXKPVXAVLGGGKPADLVLWRNXKISGGVLAGATAIWLLFEIMXYHLLTLAXHCLILSLGNSSSSXPMSAFFVXKSPPKXPEXEXFNXTMTVNIG

SEQ ID NO: 198292 - protein, 46 aa, Triticum aestivum
  Clone ID: PAT_TA_92710.pep
RAEFGTSSCRSSFFFFFLVNNRPETRIRLSLIHAPLFSSILAHKAG

SEQ ID NO: 198293 - protein, 130 aa, Triticum aestivum
  unsure (1)..(130): unsure at all Xaa locations
  Clone ID: PAT_TA_92711.pep
RGRAPPSPPXPPWPPPPRSGSPHQPTTPPXPQSPLPPPPPPRSSRRHRATATTPTGPPVCPCPSPSPATPGITLPRPLTSTDLMGARGKASGSLTRGARAPRICRSSLLLLSAPLMGDWPMSAFFMSCSW

SEQ ID NO: 198294 - protein, 102 aa, Triticum aestivum
  unsure (1)..(102): unsure at all Xaa locations
  Clone ID: PAT_TA_92712.pep
RAEFGTSPIGLLHEFPELRHTGGIRCAPWAQPAGYTVVAPDTNRYDGSNFPHVMQDQYTVLHVVGNIVCXIESLGEKHLFVVAHDRGLMISWEHVLVPAGHG

SEQ ID NO: 198295 - protein, 63 aa, Triticum aestivum; identical to SEQ ID NO: 168560
  Clone ID: PAT_TA_92713.pep

SEQ ID NO: 198296 - protein, 70 aa, Triticum aestivum
  Clone ID: PAT_TA_92714.pep
PPPVMEPDYVVNIIVDQVMAGKGGQIVLPPKLNYGTTIRGWPLWMQTGLRNLIGTELKKVRDSLEVISNS

SEQ ID NO: 198297 - protein, 156 aa, Triticum aestivum
  unsure (1)..(156): unsure at all Xaa locations
  Clone ID: PAT_TA_92715.pep
LVPNSARVYIQQNVSWALGFGIATACIAAAYAAFLLATPMYKRTMPTGSPLKSLCQVVVAACRKVSLCLPSDAXLLHEASDKDDEPRIAHXAEFSFFDRAXVYSEAGTWREDRTGSGLGPGKLLNNASRRNSKLAPSWPVLGRTSNQSSPVGIIPR

SEQ ID NO: 198298 - protein, 101 aa, Triticum aestivum
  unsure (1)..(101): unsure at all Xaa locations
  Clone ID: PAT_TA_92716.pep
MASCATTPPAGKRXATGGREGDQMVITPLGAXSEVGRSCVXMTFKGRTVXFXXGIQPAYSGMEXLPXFDXXEPSGIQVLXVNQXXLDXAXSLAIXLDKXNF

SEQ ID NO: 198299 - protein, 101 aa, Triticum aestivum
  Clone ID: PAT_TA_92717.pep
SCRMRYDRLRSVAGRVQTVVGDLAMQGERAQSLLSWRDPRATAIFITMSLLVAVVLYITPFQVVAVVLGLFMLRHPRFRSKQPSVPFNFYKRLPAKGDMLL

SEQ ID NO: 198300 - protein, 111 aa, Triticum aestivum
  unsure (1)..(111): unsure at all Xaa locations
  Clone ID: PAT_TA_92718.pep
NIAYQFTPSPELISSTACLSLGHSQSEGRISYQDSSPAGPSRSLTTKRSHIGGTIRHKISXPMXLISTTNMISYNAPNVPQRATSLSSISSESXSSPXXSISXMSXIDSXS

SEQ ID NO: 198301 - protein, 105 aa, Triticum aestivum
  unsure (1)..(105): unsure at all Xaa locations
  Clone ID: PAT_TA_92719.pep
YTQQCIQKQRRRTQHNSTHLYFGTAPPLDSCRIRHEARPRTRGSRPXHHVXASXSVDRKXMQXLEKIGXXEXDEEKGGRXITQSGQXXLXXIAQTCVEXDNDDVE

SEQ ID NO: 198302 - protein, 166 aa, Triticum aestivum
  unsure (1)..(166): unsure at all Xaa locations
  Clone ID: PAT_TA_92720.pep
IILCRTSQGETPLLIXLRRWFWPKLRESLRRFVRNCDVCGRSTVWREAKAGFLRSLPIPERVGCELTIDFVTDLPPSNGCTNIMVITDRLSKEVFMFGTNSMTSEECAKVFVDRYYRYHGFPRYLTSYRGSDWVSHFWKAFCELTKISQRLTTAYHPQSNASERAN

SEQ ID NO: 198303 - protein, 94 aa, Triticum aestivum
  Clone ID: PAT_TA_92721.pep
LVPNSAREETPHSSQSTQAAETPIMAKILHEVLSIKTSIAHSNLPTRVQEKSRANVASQPQSIGSPIWIQSEDEKKEIAELSSKELVRKIGLRE

SEQ ID NO: 198304 - protein, 168 aa, Triticum aestivum
  Clone ID: PAT_TA_92722.pep
MSSFTRAFRPVLFRSKIPRCSKFTPFVRCSAARNFSATPIIRAKKFTKDHEWIEVSEDGKTGTMGITEYASKSLGDVVYVELPEVKLQAVKGESIGAVESVKSASDINAPVACTITAVNQSLEDSPKIINDEPEKSGWLAKVELSESGINEMHDLMDLQEYKDFTEKD

SEQ ID NO: 198305 - protein, 176 aa, Triticum aestivum
  unsure (1)..(176): unsure at all Xaa locations
  Clone ID: PAT_TA_92723.pep
FMGFVEQGDEVIVFEPFFDQYISNIEMAGGKVVYVALQPPASGDSKNTAAADWSIDFQELEAAITPKTKMIVLNTPHNPIGKIFSKEELTHIGEICVKNSILILSDEVYDRLFYVPFTRIATISPEIENLTLTVGSAGKSFCATXWRXVGWLIRPSHLIRLXVREAHTRICYNSGP

SEQ ID NO: 198306 - protein, 100 aa, Triticum aestivum
  Clone ID: PAT_TA_92724.pep
RAEFGTSSCRIRHEYGGLQQNGHHSAGPLANGHTPGHYSSQQSGYGSIPGPSPGHYSNHQIGYNGSFSAGGYSRAQATVSPQWSASPVQSFGNGYAGYQG

SEQ ID NO: 198307 - protein, 52 aa, Triticum aestivum
  unsure (1)..(52): unsure at all Xaa locations
  Clone ID: PAT_TA_92725.pep
RNKVAGFTTHLMXRIQRGPVRGISLKLQXEERERRMDFVPEKSALEVDEXXV

SEQ ID NO: 198308 - protein, 113 aa, Triticum aestivum
  unsure (1)..(113): unsure at all Xaa locations
  Clone ID: PAT_TA_92726.pep
PAHXVNXVLQHWPNWSLMETXDRRLQGGLRHSXDEVCLVLKVGLLCLHPFPASRPSMRRVLQYLDNDVPLPELAPTHLGFSMPPWMQGKAGSMPYLQLESTSIGTISGLSGGR

SEQ ID NO: 198309 - protein, 142 aa, Triticum aestivum
  unsure (1)..(142): unsure at all Xaa locations
  Clone ID: PAT_TA_92727.pep
RAEFGTSKNDKFPSSAAFDAINNSFKSSEADRIKAIKEAKSVFAFTLKNKAGETESWHIDLLKKGEVGKGLXESPTXTLKMSDEDFGRLVNATEDPQKLFMSGRLGVEGDIMKATKLRNLFXKSXAVKSKVIICCQNNLFGP

SEQ ID NO: 198310 - protein, 90 aa, Triticum aestivum
  Clone ID: PAT_TA_92728.pep
IAVGNLPHSKLAIFHYKVTMLCILARRKPSHDMQSSDLGLRGNITLMRLHLLRMNRQLGLGTWDEQVKWSLMGVYHGLLKAMKLSYKVFM

SEQ ID NO: 198311 - protein, 129 aa, Triticum aestivum
  Clone ID: PAT_TA_92729.pep
NIMNIFRSVSNSHLPLQCYSSTRTTIHRRIHGVGKRCLSNIARKPSTAQKIGLIFSVTISSGFLINYAGYMGMLHAEAIQLPTVEESDQLQAKSLQKRGDILSSSQIQAMNGWEYPGVYAWGNNTGSCY

SEQ ID NO: 198312 - protein, 39 aa, Triticum aestivum
  Clone ID: PAT_TA_92730.pep
SQNNCLIITPLAPAIKKCFGHYHRSFSIVGNPARAEFGT

SEQ ID NO: 198313 - protein, 135 aa, Triticum aestivum
  unsure (1)..(135): unsure at all Xaa locations
  Clone ID: PAT_TA_92731.pep
GXPGRXPXPEDPHADRXWSIXVARXAPPXVRPHEDNXLQKNPLPHSKATNSPEANQELNPAEAEPRTRISHETRRLVVALALDSNQETKKTAQIEPIAEGGRQARGCGRGRWLRLEASQSPSCRIRHELVPNSAR

SEQ ID NO: 198314 - protein, 139 aa, Triticum aestivum
  Clone ID: PAT_TA_92732.pep
SCRIRHEQAQTDGVETLAFAPLPLTLLAAGSVDGSIVLYDSAHRFAVRKHIKNAHDEHSVVKVDFVSQPDNKYILTSCGMDGVVRRWDSRGGNSAANSGLLREWKGHRGNGEGGGVLDFVQGDGTRIVTAGDDGISLVL

SEQ ID NO: 198315 - protein, 77 aa, Triticum aestivum
  unsure (1)..(77): unsure at all Xaa locations
  Clone ID: PAT_TA_92733.pep
MTSPAPAPPAAAAQSPPPRIXLAGLATMGHNLALNIAXKGFPISVYNRXAAXXDSXLSPRXXRGSXSPMIGHRDASS

SEQ ID NO: 198316 - protein, 151 aa, Triticum aestivum
  unsure (1)..(151): unsure at all Xaa locations
  Clone ID: PAT_TA_92734.pep
YLHQAFYPXTNPGYVMGVGNPVXLXVVSVALGADMFDCVWPTRTARFGNAITSHGVINLRNAKYAADLTPLEDGCQCVCCRPVSAGDDIEDGGSGLGITRSFVHHLATRETVGAHLLTLHNVWHMLTLMRHIRQAIVEDQYPSFLRQFFAD

SEQ ID NO: 198317 - protein, 91 aa, Triticum aestivum
  unsure (1)..(91): unsure at all Xaa locations
  Clone ID: PAT_TA_92735.pep
RAEFGTSSCRIRHEREQAAVSSGKQLIEKVNENCFEKCIPKPGSVLSNXETSCLTQCMEKYMMMWSVIHRQYTHRISVEMSKSGAMGTQQT

SEQ ID NO: 198318 - protein, 47 aa, Triticum aestivum
  unsure (1)..(47): unsure at all Xaa locations
  Clone ID: PAT_TA_92736.pep
RPXXPFLXYTLYLTALAFIALFGLSRQPASLHRQSTAQQPNLLLQAG

SEQ ID NO: 198319 - protein, 135 aa, Triticum aestivum
  unsure (1)..(135): unsure at all Xaa locations
  Clone ID: PAT_TA_92737.pep
RAEFGTSSCRIRHELQISPWLNCEKRSLSQNSLPFWVLXISMXRAXQDPRXQQXRTFINRLLIPTTILYLSLPSHPHAPSNHPXINRQRKFAQYLXSSNRXXPSHXPTILXAXSTVNLXFXXETILHHXYLTXPV

SEQ ID NO: 198320 - protein, 121 aa, Triticum aestivum
  unsure (1)..(121): unsure at all Xaa locations
  Clone ID: PAT_TA_92738.pep
ELVSLDSTNFGRESXEFNLPAFRTVAARFMFFLXCSFRVDSFDPWALSLRVHRRAWLLVRFGTINPHKGFAATPYLQYLTCAFPNEGDNLPSSQATAVQFSLEIATQRRWPCLGFKKVTAS

SEQ ID NO: 198321 - protein, 109 aa, Triticum aestivum
  Clone ID: PAT_TA_92739.pep
SGPRRVRRRSLIIPLIHLLLARCDELGALEPMGKARSIKFGLCVMHFLSWAKYACFDGDFTVILGRSANNASFGGRGGSAVSARIIALTNSLLVQKKKKKKNSCRIRHE

SEQ ID NO: 198322 - protein, 116 aa, Triticum aestivum
  unsure (1)..(116): unsure at all Xaa locations
  Clone ID: PAT_TA_92740.pep
NGQKGXKFSXPITLNIXSQTLXSQXTPFXQKQWGIKTEMKGFVVQDKNXATHLVRNALGGNNSDLVSALLSLTAPYSRRYRDDLTVEVIFFGNGENNGEVTINKEASATKMIKSNL

SEQ ID NO: 198323 - protein, 171 aa, Triticum aestivum
  unsure (1)..(171): unsure at all Xaa locations
  Clone ID: PAT_TA_92741.pep
MQIFVKTLTGKTITLEVESSDTIDNVKAKIQDKEGIPPDQXQRLIFAGKQLEDGRTLADYNIQKESTLXLVLRLRGGMQIFVKTLTGKTITLEVESSDTIDNVKGKIQDKEGIPPDQATPYLCWQSKLEDGRTLADYNIQKESTLXLVLRLRGGXQIFXKXLXXKTITLEX

SEQ ID NO: 198324 - protein, 125 aa, Triticum aestivum
  unsure (1)..(125): unsure at all Xaa locations
  Clone ID: PAT_TA_92742.pep
YSWPXXFLQXWSTXLXGELKSSNVDVDLVISYLVTSAMSKXRKPSLLIPNPKTFVRSVLSKIGRSGGAQDMAYTSTPFWGHGIMHWWLNNTVGLGTSLVVEKNRQMHEGIRQRALRKAEREAKRC

SEQ ID NO: 198325 - protein, 148 aa, Triticum aestivum
  unsure (1)..(148): unsure at all Xaa locations
  Clone ID: PAT_TA_92743.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSNTGGFXRLGISXGGKTREXXPPLSILGGEK

SEQ ID NO: 198326 - protein, 149 aa, Triticum aestivum
  unsure (1)..(149): unsure at all Xaa locations
  Clone ID: PAT_TA_92744.pep
LVPNSARAIFESVVMTASAPSTISIGKYPALPGFFFVGPFLLGSPFLFEPSWGVMSNGSVAICSPKPFSLGNSESWXSTHFSFPLRVFDFTGSSMADWSGWCVYEISDILSGSKLISCLSIFAKSVSKRIWAKLDWXPKSLNFEXLFFN

SEQ ID NO: 198327 - protein, 66 aa, Triticum aestivum
  unsure (1)..(66): unsure at all Xaa locations
  Clone ID: PAT_TA_92745.pep
VIRLKNCWXPEQAASXXXELGTVMRPPGGRTPLRXXLXXNGQXXXVADXKXEPIGXSRGSLNXXDP

SEQ ID NO: 198328 - protein, 149 aa, Triticum aestivum
  Clone ID: PAT_TA_92746.pep
ISRPSRFAGISIHLSTFDSNPNSDSDITCLTMYCIYLFTYALSIDQGLKTTFYLLNNLPILKENYYVRYHEISGSREAFFSQNLLHINYKAIPIQNPSFSLGKICEAEWTTLGDVYKYLDQQIGRIDDLGRNIPLPVSLTASRKCLSLL

SEQ ID NO: 198329 - protein, 121 aa, Triticum aestivum
  unsure (1)..(121): unsure at all Xaa locations
  Clone ID: PAT_TA_92747.pep
EMXKTEYQVVCEVTPIQVHPNDKKLGSYSASWIIHFKQVPLNLRFRLFDENGPAIPFSRRRSIEKCQRCWGFHSKRNCVKGQRCEKCSGTHEVAECVERIGLQKLVAVRHRLYHLVKRVGK

SEQ ID NO: 198330 - protein, 189 aa, Triticum aestivum
  unsure (1)..(189): unsure at all Xaa locations
  Clone ID: PAT_TA_92748.pep
EKMLPVGPKLLRTLSIHYLENNDYVLNGQSAANGDGSSHGAKLSPPNDTSTNLQQDTLSNLDGSGTDHVKRKSHRSISMDGVLHKXPYGXRLSGDNIRQELPRSASGTYDXDGLKPYIGTAAKRHGNSGFRXRSRSLTESLESYSHLLXSISSSXSKRGSNKLESPLRDHSLGWPWCNNCNWRSKPSSR

SEQ ID NO: 198331 - protein, 130 aa, Triticum aestivum
  Clone ID: PAT_TA_92749.pep
LVPNSARVAILLATGEKSLYTDRLVITNDATSNSHYGVYSPRGKGFPEPSADSAIFMTKSNVKINGTHVKAYCSLSIPGHEIAEKMANGLTNITKHAHRNFGTTPQAEEECMNSIKSLSKRALFYESKLA

SEQ ID NO: 198332 - protein, 173 aa, Triticum aestivum
  unsure (1)..(173): unsure at all Xaa locations
  Clone ID: PAT_TA_92750.pep
PFNQIISANIGNPQQLGQKPITFFRQVLSLLEYPTLLENEDVLLKQLGYKVDVIERAKWLLKSVGAIGAYSASNGAPAIRESIANFIERRDXHPADPKDIYLSAGASSGVNTLLSIICAKPTTGVLVPIPQYPLYTATLSXLGAKCVPYYLDESKGWGTXVEAIKXAYEQGNF

SEQ ID NO: 198333 - protein, 137 aa, Triticum aestivum
  unsure (1)..(137): unsure at all Xaa locations
  Clone ID: PAT_TA_92751.pep
LRPPTFYSLKNIVGRTLSRXSXWNEVNTQTGDSHWVFESADPATKVINATDSRFFWIALYTQPILWIALAFLAIFSFEFIWLTLVVIALCLAFTNTLAFSRCDKFSQASNIAGSAMLSSGFAGNIAGGMFGRLFSRN

SEQ ID NO: 198334 - protein, 77 aa, Triticum aestivum
  unsure (1)..(77): unsure at all Xaa locations
  Clone ID: PAT_TA_92752.pep
LEVKEIADIMLQEVFXRLKTKDINLQVTXKFKERVVDEGYNPSYXAXSLXRXIMXLLGGTXSPEKNLGGSQRRAPVK

SEQ ID NO: 198335 - protein, 53 aa, Triticum aestivum
  unsure (1)..(53): unsure at all Xaa locations
  Clone ID: PAT_TA_92753.pep
KKYSCIQEEGLKCEKKLPCTCTKLNIVHDYGKTLFLPILLTPLXXLTSYFCHS

SEQ ID NO: 198336 - protein, 95 aa, Triticum aestivum
  unsure (1)..(95): unsure at all Xaa locations
  Clone ID: PAT_TA_92754.pep
FFLKENKXSFXGQXXTXFKXQGXFGXKGQXGYSNSNXTGXXKXLTNXRXXXNLIXPGLGQSLLNFGRCHNXXIXSPHTVGSHGXLSTXQALXYGX

SEQ ID NO: 198337 - protein, 116 aa, Triticum aestivum
  unsure (1)..(116): unsure at all Xaa locations
  Clone ID: PAT_TA_92755.pep
IFIQHHPGEIHGFLGXPCNPIPLDKIPGSNDEIQNFCRINYGVTFPMLGKVNVNGDTAEPLFEWLKVEKPGIMGMKRVKWNFEKWLVSKDGKPIKRYSSAAGPEGIQSLIIEEIEK

SEQ ID NO: 198338 - protein, 185 aa, Triticum aestivum
  unsure (1)..(185): unsure at all Xaa locations
  Clone ID: PAT_TA_92756.pep
RAAGVKSIKSHGQREKSVAFEIESDNTDEEEMNILAARNHNAGRAALSENNLPHHRSGKNIKRGTNESIETSDSCISLAQQTSRERQXSHLQSALSRIRPKLRRREXTMSNSTREELSALEXKXGATXKXRKGQXLPKRVKRTLAKXDNCXXTFNKHYXKAKRNXISXKXIXXELWGLXNXSASS

SEQ ID NO: 198339 - protein, 99 aa, Triticum aestivum
  unsure (1)..(99): unsure at all Xaa locations
  Clone ID: PAT_TA_92757.pep
LEXXPXGTHGXPGIPPXXPLCPFETPXFPLLXPGXLXPIIFXPIXXSGPFFSTYXPSTXINRNCPKYGLFHPPSAGNFLTWSDFIDIIVRILVVVVAQG

SEQ ID NO: 198340 - protein, 50 aa, Triticum aestivum
  unsure (1)..(50): unsure at all Xaa locations
  Clone ID: PAT_TA_92758.pep
LVPNSARGLKSLATSIKSINMGKVSGVPGKCGVSVPFPIXSMSNNCNNVN

SEQ ID NO: 198341 - protein, 90 aa, Triticum aestivum
  unsure (1)..(90): unsure at all Xaa locations
  Clone ID: PAT_TA_92759.pep
XXNFXPXFGAFXPKGXGFLFXXGLXLXXPQETFFXLWLPXPRDQXPSIYQXXVVSXCLLYLHRVPVGVAXAGSCSHRGLTLYXGFPGGAK

SEQ ID NO: 198342 - protein, 176 aa, Triticum aestivum
  unsure (1)..(176): unsure at all Xaa locations
  Clone ID: PAT_TA_92760.pep
MAPTVMASSATSVAPFQGLKSTAGLPVSRRSNGASLGSVSNGGRIRCMQVWPIEGIKKFETLSYLPPLSTEALLKQVDYLIRSKWVPCLEXFSKVGFIFREHNASPGYYDGRYWTMWKLPMFGCTDATXVINEVXGGQRKEYPDAYVRIIGFRQQCAKWQCVKLSSXFKPTGCXEX

SEQ ID NO: 198343 - protein, 71 aa, Triticum aestivum
  unsure (1)..(71): unsure at all Xaa locations
  Clone ID: PAT_TA_92761.pep
RRXAXTXVXLPPPXRXRHRPXSAXVAAGPCRTDAVAAPPRRRRPPYCTSPSPSPAVSNFXLXLXDXFRXFC

SEQ ID NO: 198344 - protein, 136 aa, Triticum aestivum
  Clone ID: PAT_TA_92762.pep
AWDGSAIGLLASDPESVRGGNPVKCWSFPVVEGFPPKSASEQVVHKFPFLNTMAWPDGLCEEVFRVSNVVPELVGNHALAEIGKTVISGYITKELWRNKIPHDGWSAILTEMLDDQAMSRKARETDLTRQCRFFQF

SEQ ID NO: 198345 - protein, 132 aa, Triticum aestivum
  unsure (1)..(132): unsure at all Xaa locations
  Clone ID: PAT_TA_92763.pep
HVASIATGALMAGITLYPTNTLHAESPQEANSRKPIYDDAPAQSMTSVTSSIERRETTPGLRSQSVTDLLAKKVGVARLFLYSHVPKNXKIKSTTSWDSWPFELGRTTXTKQQSQPLGPRRPKKRXKGLWQV

SEQ ID NO: 198346 - protein, 136 aa, Triticum aestivum
  unsure (1)..(136): unsure at all Xaa locations
  Clone ID: PAT_TA_92764.pep
CSPKPQHQAATPRTAAPAPATTTQALEQAPCCATVSARLVRGLDEVRKAHARNFKLGLDRSPPHLRPLLAACALGEWPGSMEYAAXIFATLDEPEAFDYNTLIRGHVVGGRPGGLAGVRPNASKRGQPQRFPQGLG

SEQ ID NO: 198347 - protein, 141 aa, Triticum aestivum
  unsure (1)..(141): unsure at all Xaa locations
  Clone ID: PAT_TA_92765.pep
NLXPPXGFRVXSRTXISGKFXXPXIFPXTGNXREAPPAFGXSGFDQXGXPKXWLXGXKXYELAXSQAXXAAXRKKXXXGEEDXPRAGVXAEXGXVGEXXQXEXDARDXVRXPRXQRPXRACPPXLGTRRXGXLGADAEPIS

SEQ ID NO: 198348 - protein, 173 aa, Triticum aestivum
  unsure (1)..(173): unsure at all Xaa locations
  Clone ID: PAT_TA_92766.pep
PTFRRESTXHFFLRLGXGMQIFVKTLIGKTITLELESSDXIDNVKXKIQDKEGIPPDQQRLIFCXGSSWRMAVPXLDYNIQKEFTXHLVXRXRGGMQIFVKTLTGKTITLEVESSDTIDXVKXKIQDKEGIPPDQQRLIFAGKQLEDGRTLADYNIQKESTLHLVLLVPNSAR

SEQ ID NO: 198349 - protein, 166 aa, Triticum aestivum
  unsure (1)..(166): unsure at all Xaa locations
  Clone ID: PAT_TA_92767.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKXLPKFGCNDATQVXNEVGXVKKEXPDAYVXINRFHKKGQXXCVKFNXXK

SEQ ID NO: 198350 - protein, 93 aa, Triticum aestivum
  unsure (1)..(93): unsure at all Xaa locations
  Clone ID: PAT_TA_92768.pep
IFYPRXNFFPQKXLPLXILGLGLXPPKKXTCGHLSKVEXRKAELFLMLIPFGGQNFPDDESEEKDLSDDEFEEKDXSDDESEEDLSELKSKTN

SEQ ID NO: 198351 - protein, 162 aa, Triticum aestivum
  unsure (1)..(162): unsure at all Xaa locations
  Clone ID: PAT_TA_92769.pep
MGGLLMXLSDSWVRKSKAFAXLPEIDEKDRKMYFQLAGRVLLIFLFVGFIFSGTWTIWRIIVAMFGAVACLMVVVGFKAKFSAIMLVVILXSVFNILVNNFWTLHEHHPHKDFAKYDFFQILSIVGGLLLLVNSGPGKYSIDXXEKGLLSSKTVRLGLLGKP

SEQ ID NO: 198352 - protein, 156 aa, Triticum aestivum
  unsure (1)..(156): unsure at all Xaa locations
  Clone ID: PAT_TA_92770.pep
XYRFIQKXSXILTXXRRKSKXATFCSPXNSVARLKQLXQXSSSGETKFSVXSEPPIRAGRANRTPAGPNQQTTRNRKPPSPSSGTICRSGKGPAASAADSAGPGRKQPSGGRHSSAGGGDEDDGLAGRRRGGADLRRRREEGIGGCCYLLGGRRGE

SEQ ID NO: 198353 - protein, 154 aa, Triticum aestivum
  unsure (1)..(154): unsure at all Xaa locations
  Clone ID: PAT_TA_92771.pep
MEGWLALCFIALSTLLVLWLSGSXSXXNKHLPPGPWXLPIIGSLHHVILGTLPHRXITDLCXRHGXLMLLKLGEVPXVGXSSXXCXGXXMKTNDVXFXNRQTNEVQXIXXSGGKGIIFXPYGEQWRQXXXVCIXELLNSXQVKRKEGIKGGGGG

SEQ ID NO: 198354 - protein, 74 aa, Triticum aestivum
  Clone ID: PAT_TA_92772.pep
QQSDRLNSNFKKTRIFLLGMSVFHGVAVNAVTAQDREISSGTQNNGPTAPATATAPPKLEICDLDGSKCKLLNA

SEQ ID NO: 198355 - protein, 111 aa, Triticum aestivum
  unsure (1)..(111): unsure at all Xaa locations
  Clone ID: PAT_TA_92773.pep
TFSGLATYLATRSLQFKLHWVSGTTICRWCKETPSILLQAAIXLAKGIKLQLXXXLPMGNTNGTVPTWTMQTFGFLQXXVKIMMXSXPKTXRLXQXXKQNXGPXLGEXXDP

SEQ ID NO: 198356 - protein, 68 aa, Triticum aestivum
  unsure (1)..(68): unsure at all Xaa locations
  Clone ID: PAT_TA_92774.pep
LLGMSXXHXVAXNAVTXQDXEXSSXTQTNXPTARATATAXPXXEICDXDXPKXKLLNAXSRIRCSSRG

SEQ ID NO: 198357 - protein, 183 aa, Triticum aestivum
  unsure (1)..(183): unsure at all Xaa locations
  Clone ID: PAT_TA_92775.pep
SWLACTEELVPGVCWLMAASKDPRRPELRQPPPSTGSGCPQSPLRRLPLYPLQAPAPSSRDRADRLIRRASAPQSTQTSPPAPHFPPQAPQASAPVVAAAGSSXRPWSSVRXPDASFASSLAKSNWRHIRRSLRWXLGACIQGNELLQQNKRTXGRPMKGWPQPXGPASRXXGRGTARESRVA

SEQ ID NO: 198358 - protein, 128 aa, Triticum aestivum
  unsure (1)..(128): unsure at all Xaa locations
  Clone ID: PAT_TA_92776.pep
LATPSPSPXHGRMIDGPEPDRPSATXXGGQRQHPXLRTXIRXRPAPPQHTFSSLLXQKPXRTKSAEIQGYYGDFNEGCRSCLSRGWSXRWXGXYXXLRSLQAVPWSXXNHMEKFFAGXSYILLXTTGR

SEQ ID NO: 198359 - protein, 84 aa, Triticum aestivum
  Clone ID: PAT_TA_92777.pep
DIFFLKRKLNYFNHSAYLQVLNRCPLRVPDVSSTVIVASFFLYFFVLFDLRMEARFILMCYLSKGVLGINVFNLHVSIYVYSFR

SEQ ID NO: 198360 - protein, 59 aa, Triticum aestivum
  Clone ID: PAT_TA_92778.pep
MASEPVALLDDALAEVLRRLAPHVLAEARQVCKAWRDAVDNRLRGNMLSRSVRGNLQQL

SEQ ID NO: 198361 - protein, 112 aa, Triticum aestivum
  unsure (1)..(112): unsure at all Xaa locations
  Clone ID: PAT_TA_92779.pep
TTKSNAMEWLVILPDLPGKQEARMAVRPQHIEDLKKDHEKGFWKMGGAYLEDVPKGSEDLKIQGSAVIACAESREEVIEXLKKDVYAEASVWDFSKGQIQPFKWPINGRNRQ

SEQ ID NO: 198362 - protein, 138 aa, Triticum aestivum
  unsure (1)..(138): unsure at all Xaa locations
  Clone ID: PAT_TA_92780.pep
MAPTVMASXXTSVAPFQGLKXTAGLPVSRRSNGASLGSVSNGGRIRCMQVWXIEGIXXFETLSYLPPLSTEALLKQVXYLIRSXWVPCLEFSKVGFIFREXHNASPGYXRMGRXWANGNWLRSGTQKVKRRLDRSGPL

SEQ ID NO: 198363 - protein, 144 aa, Triticum aestivum
  unsure (1)..(144): unsure at all Xaa locations
  Clone ID: PAT_TA_92781.pep
SCRIRHEILHNSSLAPSSANTFHIVRRFVTAVSTYSHAETTPSLRPYLVRRTPSKQLPIYHVTKNGGNKKLTKIGKVEGDTAALTTELRTVLALDEKECRINPLTXQVLVKGHRKIKNHKVLXGTGLTNKDEFTVQSGLKTISQ

SEQ ID NO: 198364 - protein, 51 aa, Triticum aestivum
  Clone ID: PAT_TA_92782.pep
FQICYHVLLRRHNFSFHLYETSSLFTLLYFHYHNIIIVRGLNGIVVGRSLS

SEQ ID NO: 198365 - protein, 53 aa, Triticum aestivum
  Clone ID: PAT_TA_92783.pep
ENGKLTKPMHLIGLEWSLYWAFFPSQPCDNVRNKSGSITNSRPAPVARWSQRD

SEQ ID NO: 198366 - protein, 59 aa, Triticum aestivum
  Clone ID: PAT_TA_92784.pep
DLKVSPRRSRGMDERSQFGVVPWCYEIPYRHDLSSVYSRFFVESHARLVTWFGNLGMQL

SEQ ID NO: 198367 - protein, 74 aa, Triticum aestivum
  Clone ID: PAT_TA_92785.pep
IISVVGIGGLGKTTLVKTVYDKIKGDFKYKAFVPVGQNATVKKVSRDILLDIGMYPSQLTMLDERQLINKLRQI

SEQ ID NO: 198368 - protein, 92 aa, Triticum aestivum
  Clone ID: PAT_TA_92786.pep
SIDPSTPTAHSWNTQLTVLEQDVLDEYARLDENLRTLACKLDELANCPTTEIMDGLRQLERKSGLVYTLLKASVYSIVLQQEMYAVDNAETP

SEQ ID NO: 198369 - protein, 68 aa, Triticum aestivum
  Clone ID: PAT_TA_92787.pep
SCRIRHEVKGMSGVNVVDTRRKIQGKNIRDASKGSKAWILGKKEQMERKGKVVKNSSKYTGRKRRIVF

SEQ ID NO: 198370 - protein, 82 aa, Triticum aestivum
  unsure (1)..(82): unsure at all Xaa locations
  Clone ID: PAT_TA_92788.pep
CYKRGGDKLRKRERIEFVEITIGSSISISNTAXVPECRDYPAVRKVGEXAREVTDHHRREARHXHREPRLGKRAPSXASRTH

SEQ ID NO: 198371 - protein, 84 aa, Triticum aestivum
  Clone ID: PAT_TA_92789.pep
MADKLRAQQQLEALQARYVGTGHADTTKFEWTSNIQRDSRASYIGHPPMLSYMAIGLGECREKVRAQIVEKMIQPVGKPPEVQD

SEQ ID NO: 198372 - protein, 151 aa, Triticum aestivum
  unsure (1)..(151): unsure at all Xaa locations
  Clone ID: PAT_TA_92790.pep
LPAATAARARERDHSEDNMVEIRKNRREESLLKKRREGLQAQAPIPAAGVEKKLESLPAMVGGVYSEDNNLQLEATTQFRXLLSIERSPPIEEVIQSGVVPRFVQXFLTXEDFPQLQFESSXWALTNIASGNIKXSTKGLSXDHGGXPXSL

SEQ ID NO: 198373 - protein, 151 aa, Triticum aestivum
  unsure (1)..(151): unsure at all Xaa locations
  Clone ID: PAT_TA_92791.pep
LVPNSARGDFEVDTDNVDAYTEVEVKFAEIRDRHSSAVATSPYGRSLHNVKSPLELVTVLRDAIKAHWSLMTKAKILHRDISANNIIMTGSEAHKDWKGYVIDLDLAVLLTDGKAQEKRQAMTGTMEFKALEILSGNCESXGVIVXAIITX

SEQ ID NO: 198374 - protein, 68 aa, Triticum aestivum
  unsure (1)..(68): unsure at all Xaa locations
  Clone ID: PAT_TA_92792.pep
LAXXDCSPNLTIVQTYHLTSLXLRYLRXXXEXASTYXGXINITMXLTSLTXMWWAIXLLSITVLDTKI

SEQ ID NO: 198375 - protein, 139 aa, Triticum aestivum
  unsure (1)..(139): unsure at all Xaa locations
  Clone ID: PAT_TA_92793.pep
MMTMAEKVPEMVVQTLVDKAVNRAVSFVFGLRGEKRSQEDLMKRLVTAHDDLELKFERTSRLPITETXLLRRRMEIKQAFQECXDLLSNLELQQDQXATSPXKKGKVSLRLGQQXKNLLRTSGRKVRAGSRRAHKGPRL

SEQ ID NO: 198376 - protein, 169 aa, Triticum aestivum
  unsure (1)..(169): unsure at all Xaa locations
  Clone ID: PAT_TA_92794.pep
FPILLGSAVVIGXCGTARAAIYALHSXGHSPIFVVSRTPSKLTAMISSXFPIEFNVKDLSSVSAIEQLEXTPRVAIATIPADQPIEPKMYEIIAKLFQNPPADPSHQRTMIEMAYKPSVTALMLLAQEAGWVTIPGLEILCGQGLYQFQKWTGIEPLYSDVRKAVMARD

SEQ ID NO: 198377 - protein, 66 aa, Triticum aestivum
  unsure (1)..(66): unsure at all Xaa locations
  Clone ID: PAT_TA_92795.pep
PEKILRWRRSATACINLHIICMINIELLSLGKXSLVQATSDEERVPNXIXLXVLKTNGXPLKFRVK

SEQ ID NO: 198378 - protein, 100 aa, Triticum aestivum
  unsure (1)..(100): unsure at all Xaa locations
  Clone ID: PAT_TA_92796.pep
AALTLEAEASIPRRTMSNSAPKPSRESHHAPLPQTKVSDNNGTGPSESIDMFPTFEIESAAVPNQADWSPTHVAYTENTLVNSGSFSYSAYIRGTTHWVX

SEQ ID NO: 198379 - protein, 120 aa, Triticum aestivum
  unsure (1)..(120): unsure at all Xaa locations
  Clone ID: PAT_TA_92797.pep
MAKISRGAPGGKLKMTLGLPVXAVMNCCDNSXARNLYIISVKGIGARLNRLPAGGVGDMVMATVKKGKPELRKKVMPAVIVRXSKPWRRTDGVFLYFEDNAGVIVXNPKGEMXXSAITXP

SEQ ID NO: 198380 - protein, 98 aa, Triticum aestivum
  unsure (1)..(98): unsure at all Xaa locations
  Clone ID: PAT_TA_92798.pep
MKGTKLAAILILQAVLVMGVLSHVNADFFPKCCNNCRSFSGVDVCDDAHPKCPKGCSACRVVSTXSPEMWRCADMKSNVDXNCGGTLQRSTGSGHAGI

SEQ ID NO: 198381 - protein, 126 aa, Triticum aestivum
  unsure (1)..(126): unsure at all Xaa locations
  Clone ID: PAT_TA_92799.pep
MGKEKTHINIVVIGHVDSGKSTTTGHLIYKLGGIDKRVIERFEKEAAEMNKRSFKYAWVLDKLKAELERGITIDIALWKFETTKYYCTVIDAPGXHRDFIKNMITGXTPKADCAVLNQLTPTLGXF

SEQ ID NO: 198382 - protein, 170 aa, Triticum aestivum
  unsure (1)..(170): unsure at all Xaa locations
  Clone ID: PAT_TA_92800.pep
MSSVLRRRFSALSDPSYLKRASKVVCVGRNYADHIAELNSTRPKYPLFFLKPPSTILLPGEGPVLRPRGVTLHHEVELALVMGKRVKDLDQNDTQGALDAIGGYALCIDMTARNVQSAAIAKGLPWTTCKGFDTFLPTSKLYXKSGIPXPHNVELILQSIMSPSRDNVIH

SEQ ID NO: 198383 - protein, 110 aa, Triticum aestivum
  unsure (1)..(110): unsure at all Xaa locations
  Clone ID: PAT_TA_92801.pep
QPSLLPYNNRLHTTQTPKSSSEMKSTSAVTTLAIGLYTTAKVFAASASPKGCYSSSNGLTLNGSQTFNSIGACSQTCLATKSVTKAMQRXQMVLAGPKLPPXNSLXLMTX

SEQ ID NO: 198384 - protein, 43 aa, Triticum aestivum
  Clone ID: PAT_TA_92802.pep
SCRSSNVVITAGFSIKNSYLWHAKRFWLKTDSRSVYQIHEKPQ

SEQ ID NO: 198385 - protein, 117 aa, Triticum aestivum
  Clone ID: PAT_TA_92803.pep
LVPNSARGRFACAAVCSFLDLPGAAAVPTLTSLAPPRRPDLTSLAPPPLQTTTSLAPPRPSAQIYLPSPRPPRGGTLQSEGPPRNLQTEEATYHTLPRRRPTAPLPTPGTPPLTQLS

SEQ ID NO: 198386 - protein, 117 aa, Triticum aestivum
  unsure (1)..(117): unsure at all Xaa locations
  Clone ID: PAT_TA_92804.pep
LPTNCGGFITXXRIFFGXFWVEGXWIDIVDASIASXVSPARNXLSCINVGLLXCVQENAADRPNMLDVTAMLSSKTMLLRGPKHPAYFNLRVGDEEDSFATHSYSVNDITISVATPR

SEQ ID NO: 198387 - protein, 114 aa, Triticum aestivum
  Clone ID: PAT_TA_92805.pep
ILQFNYLTTTTTYTSRQKERKTTAYRIGHADVSNTHIECCYFPEGVIFFFCEFLMLEYDMCLKIEIKSRGRVGLNHLLLVLYFKSLPPHVFLKSPFIEKKKNPHVFYKKKKKKK

SEQ ID NO: 198388 - protein, 140 aa, Triticum aestivum
  Clone ID: PAT_TA_92806.pep
SQGVFSIKSDVFSFGVIIFEILSGKRNSGNQQYGDFINLLGYAWQLWDEGRWIDLVSSSSFSKSHSTKMMRCINIALLCVQENAADRPTMADVIAMLSYEAMIIDEPKQPAYFNVRVGNEETSTATESCSNNYDQYQQNS

SEQ ID NO: 198389 - protein, 63 aa, Triticum aestivum
  Clone ID: PAT_TA_92807.pep
VNAGLLICLHLSVIINQVDNARKMNVDDRSVAEYRAIFHPLMEEDDEVRPLKPRSRETLPSGL

SEQ ID NO: 198390 - protein, 75 aa, Triticum aestivum; identical to SEQ ID NO: 117174
  Clone ID: PAT_TA_92808.pep

SEQ ID NO: 198391 - protein, 175 aa, Triticum aestivum
  unsure (1)..(175): unsure at all Xaa locations
  Clone ID: PAT_TA_92809.pep
LVPNSARVASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCNDATQVINEVEEVKKEYPDAYLRIIGFXDNNAQVXCVKLQLPSQRGQGVP

SEQ ID NO: 198392 - protein, 67 aa, Triticum aestivum
  unsure (1)..(67): unsure at all Xaa locations
  Clone ID: PAT_TA_92810.pep
ASXGQALAXXXLPCXLAHHXXXNERXXPTGXITAVGVXPGXRXVQXXDXFRRGRPRAGEIGXTGAAV

SEQ ID NO: 198393 - protein, 58 aa, Triticum aestivum
  unsure (1)..(58): unsure at all Xaa locations
  Clone ID: PAT_TA_92811.pep
PKFVPXGAVFKXAXXXSXCASEPSDCRISWQGIIMHGFDXLLMYLLSTTTIKEREGQI

SEQ ID NO: 198394 - protein, 137 aa, Triticum aestivum
  Clone ID: PAT_TA_92812.pep
KHELSRIISPTYRLESPRHLKRLITCLTMKIVLPHLAIALLSIVAPALAVIFDCSGVIINGDVVRRVQATGNRASISKSSSIHGDSTRTYEYFDIHPNGQYSRDYTGFACFSDISLPKPDVREHREDAWWPCSSSVI

SEQ ID NO: 198395 - protein, 180 aa, Triticum aestivum
  unsure (1)..(180): unsure at all Xaa locations
  Clone ID: PAT_TA_92813.pep
GCCLDIEVPMLVYEYVSNGTLYHFLHGKELNTDTTLDTRLRIAAESAEALAYMHSSASPPILHGDVKTANILLDNNLTAKVSDFGASKLAPSDEVQIATLVQGTCGYLXPEYLMTCQLTDTSDVYXFGVVLLXLLTGXEGDLLQAGPXDRSLXARFVAATXAGTHXKLLXRQXKEGNGDT

SEQ ID NO: 198396 - protein, 65 aa, Triticum aestivum
  Clone ID: PAT_TA_92814.pep
NFLRLLIWIRSVNRSKGVKLRFEYDHIAPSGFGDVDQEGIDNYVLFGLNTTYVLTGSPQMTLRVV

SEQ ID NO: 198397 - protein, 178 aa, Triticum aestivum
  unsure (1)..(178): unsure at all Xaa locations
  Clone ID: PAT_TA_92815.pep
SNINPAVTFTNCVFRKHPWHKFPVYLMAQVLGAFCAAGVVYANYKSAIDVFEGGAGIRTVPGYSQNATAGIFATYPQPFMTQTGEFFSEFICATLLMFTIYALKDEKNRYADKFIPLILFFVSIXIGACFGWETGFAINMARDFGPRLMTYCLGYGNEVWTASXHYFWIXMVAPFLXC

SEQ ID NO: 198398 - protein, 157 aa, Triticum aestivum
  unsure (1)..(157): unsure at all Xaa locations
  Clone ID: PAT_TA_92816.pep
MSGGAGYDRHITIFSDQGRLYQVEYAFKAITAANIMSIGVRGKDCAVVLSQKKVPDKLIDPSSVSHIFKLSPSVGCVMTGSIADARAFVQRAIGESAEFRYKYGYEMPGDALAKRIANISQVYTQRAYMRPYGVATTLNALDSEFGPQXLYKCDSAX

SEQ ID NO: 198399 - protein, 149 aa, Triticum aestivum
  Clone ID: PAT_TA_92817.pep
MILHLVLTEMTHPSSLELIKKADIYTDCLEKIRSWWDDSIASELDPIPFISMKSIYYLTKCTASQIMRLASERFVQVHGEFRCFVPYTYEDKPIINAEKHIKLEVEVWKRQAFYGMYEMRHQYALAWFHGHLHVFKRARGIDHVWYLDT

SEQ ID NO: 198400 - protein, 143 aa, Triticum aestivum
  unsure (1)..(143): unsure at all Xaa locations
  Clone ID: PAT_TA_92818.pep
SCRIRXEYTSXLXPPXPVPIRXTATARAREKLPXRLLLPPLSPLPGPSIQXEERAXGGGTTAAXXRPYLPTYLSIYLSXPPEWTRXTXXRAWAPPXDSXRRXSGTPXXRGWTKLXMDXDEXXGRXDXSWXLLXXGXXXIASLV

SEQ ID NO: 198401 - protein, 64 aa, Triticum aestivum
  unsure (1)..(64): unsure at all Xaa locations
  Clone ID: PAT_TA_92819.pep
SATXRTHLGIXYKPKKYFPLDLXPXRTXAIXRRLXKGXXSXKTTQITKREVHFPQRKFVLKAEA

SEQ ID NO: 198402 - protein, 45 aa, Triticum aestivum
  unsure (1)..(45): unsure at all Xaa locations
  Clone ID: PAT_TA_92820.pep
SARGGYGGQRGGGGGYGGGGGYGGGGGYGGXRGGGGGDSGGQWRN

SEQ ID NO: 198403 - protein, 58 aa, Triticum aestivum
  Clone ID: PAT_TA_92821.pep
HGSARRQQRDAHHALCLGLAPWLAAEVPILVDSGMVKHKDDEAAPADAAAASGSAAAS

SEQ ID NO: 198404 - protein, 70 aa, Triticum aestivum
  Clone ID: PAT_TA_92822.pep
RRSQSLDNGNTIGSVYSMRFWLLMQDNLHGCSVGSTSWCARYPAYQSRCLSTSYLSNSSASIHSHLIYQS

SEQ ID NO: 198405 - protein, 137 aa, Triticum aestivum
  unsure (1)..(137): unsure at all Xaa locations
  Clone ID: PAT_TA_92823.pep
LHGXAHGXAYLHGGSGESVIHRDLKPGNILLDDEWKPKIADFGTAKLFVVDQAGPDQTIVVSPSLKRGYAAPEYARRGDMTLKCDVYSFRVVLLETLSGERNGGLQRLLSHVSLDTSEIHIVRACSCHSFSCRIRHE

SEQ ID NO: 198406 - protein, 140 aa, Triticum aestivum
  Clone ID: PAT_TA_92824.pep
FFLAFDVLFSCLIPYASAVKNDDASTQLHNQRSSIDANINKDETDLIRLQPFFNAISEKKNEIEILKIALDFARNPPYRTGLIQRSSRPTSTPSLSKETIQRGNDELLSYNTIAPIVERACKNELNSKVITGFNNFWEMF

SEQ ID NO: 198407 - protein, 57 aa, Triticum aestivum
  unsure (1)..(57): unsure at all Xaa locations
  Clone ID: PAT_TA_92825.pep
AXSGVELIGEXXXDLXVILAGLRHCQSWXWXXLXRSXLVXHXHXPXKKEEALLXPNS

SEQ ID NO: 198408 - protein, 165 aa, Triticum aestivum
  Clone ID: PAT_TA_92826.pep
MLGWGKVNPGEGDRETMEIAALEIARMSEEIDGLRAELRSETERRLKSETRLETLSSRITEIEAEVREECFQEMEHRMETEIQRWKATWALEADLKDEHLDRKLEIFARTFPTTLNILEDENKENNYSCPKTDLEEENARLRKDIESLKRDLIVRSPSSCRIRHE

SEQ ID NO: 198409 - protein, 176 aa, Triticum aestivum
  unsure (1)..(176): unsure at all Xaa locations
  Clone ID: PAT_TA_92827.pep
RAEFGTSKDSNKNITSVSETVENEETKPHIGTMRNCPIFSLEAHVDEVTALHFRGDTLISGSADKTLRQWDLEKGRCVQTLDVMWAAAQASTSLGSGEGSWRQTGKFVSSSADFVGAVQVFDAALACGTADGMVRLWDLRSGQVHRSLVGHTGPVTALQXFDDVQLVXGSLNRSVK

SEQ ID NO: 198410 - protein, 131 aa, Triticum aestivum
  Clone ID: PAT_TA_92828.pep
VGNTDYAFQMLDEMPLNGVFADSVTYNAILEGLIKQRKARETEGFLAEMSKNEQLPSASNCAAAISLCCQEFNPSAAVDVWHCIVEHQITPAEESAKELITGLLDFSRFSEVKKYTDQMLDMGIELPQAHH

SEQ ID NO: 198411 - protein, 41 aa, Triticum aestivum
  unsure (1)..(41): unsure at all Xaa locations
  Clone ID: PAT_TA_92829.pep
IILYSYXPKHNXTXSEHGXITLPLVTXFSGLXCCSPFTNAS

SEQ ID NO: 198412 - protein, 126 aa, Triticum aestivum
  unsure (1)..(126): unsure at all Xaa locations
  Clone ID: PAT_TA_92830.pep
FCWMLAXREVLRLRGSIANRETXWDVMVDLYFYRDPEAEENKDALEDKIPGAEEAGIAAVDTGFAGGNADWEVATGPAAAFAGATATTGAVAGISWDGAADGTDWAAGSAGEWGAAAEPGKVSEQW

SEQ ID NO: 198413 - protein, 136 aa, Triticum aestivum
  Clone ID: PAT_TA_92831.pep
KSDVGITILPPSAIFETFINSATMRCMLALLLLNDIRPKDNDRLITMPLNGDYKYYRIYNSKGLRQFRGVEAGSDVITAARQINSPGTHIAVYCSPSQDSRYLRKYIAEGATELHDSSQFGFHQGSFSRNQMSRTH

SEQ ID NO: 198414 - protein, 173 aa, Triticum aestivum
  Clone ID: PAT_TA_92832.pep
ATILPATFSTHAITNLSFGVLYSFCAYFYTCTMTHDPGYVPKLSGLTQQKAVIDELLSLWKFDENNFCVPCMVRRPLRSKHCKQCRRCVAKHDHHCPWVFNCIGVNNHRQFLLYLLCLEFGIILFVKIVIGYFENKVTSGASGECNLLSSALCQLINVDSYTLILAAWGTLQL

SEQ ID NO: 198415 - protein, 139 aa, Triticum aestivum
  unsure (1)..(139): unsure at all Xaa locations
  Clone ID: PAT_TA_92833.pep
HHRPPSMLYPHAPPLPWIPWRRRRSPDPTAPPSGHGSPXTPRPTTSSAVPNLPFLPISPPPSCATGCAPPPPRSTHTKHPSDEVKRDAPAPPPTTPVAGALGPAAATHPPRRAARAPSPVPLDAHLLAASPDPPPWSWR

SEQ ID NO: 198416 - protein, 70 aa, Triticum aestivum
  Clone ID: PAT_TA_92834.pep
RSLSIASSRTTHEFLRHFCDIRILQYAAEVWGAATSASAAHLTGELSETWIIHEITQHFRVTHEILSHTC

SEQ ID NO: 198417 - protein, 170 aa, Triticum aestivum
  unsure (1)..(170): unsure at all Xaa locations
  Clone ID: PAT_TA_92835.pep
RAEFGTSHLDLRNNRLSGGVPPLPMTVVYLSLAGNRLSXRVGGVLRRLTRLSFLDLGGNWFSGEVPGEVFSFRIGYLQLRKNAFSGELRPAGRLPSGATVXLSHNALSGRVPAELASADAVYLNGNKFAGAVPAEIVAAAEGGRMRVLFLQRQLLNXNVRGVPSNTVLNW

SEQ ID NO: 198418 - protein, 118 aa, Triticum aestivum
  unsure (1)..(118): unsure at all Xaa locations
  Clone ID: PAT_TA_92836.pep
TPPPPPSSPSLIFPPDPIKAPPPPXPPPPTSPPSPPRPPSLRHPPRRLPSPPSXTIPFXPSFPXPTTRSPTRQHMAVYTGGGHPRLLGRHRRRHRQVQHLPLQVAESVHHHGVFTMPL

SEQ ID NO: 198419 - protein, 171 aa, Triticum aestivum
  Clone ID: PAT_TA_92837.pep
IHPGCRYHSIAIPSTPSYERPLDYISSYIHFEPSNSTMPGALGSSCHFKHKHDTSSSSLSTYPYSSTLPSYRSAVAQSTQDTRAPRNQSLDITHETSFTPRGIELPHDIHLNKTDYQLGLSLSPLSQRSSISGSLSARPACKDTPHLDTSVMVIDSSDILRRMLERDIVVN

SEQ ID NO: 198420 - protein, 65 aa, Triticum aestivum
  Clone ID: PAT_TA_92838.pep
ECASHLNSNKLKFIAARSRCNLYIAKKIYGKPDCLNISCFCPALRSIRSKRSFSKTLKNSRLVLS

SEQ ID NO: 198421 - protein, 60 aa, Triticum aestivum
  unsure (1)..(60): unsure at all Xaa locations
  Clone ID: PAT_TA_92839.pep
APXXVPXXXGRFGRRPGXGDXXEVERRGXXVXAXTAGDPXQRVAVDPDGTVLEPLXXHRR

SEQ ID NO: 198422 - protein, 102 aa, Triticum aestivum
  Clone ID: PAT_TA_92840.pep
HACSQLLYSRGRSSKLMVTPLELAATYSHIELPADPSPASHHRRRSGSGISTHSFFETPQGIFSQGKQVMHHRWPVMDRRRRAVASDPSGEVGGGRRLRSRQ

SEQ ID NO: 198423 - protein, 132 aa, Triticum aestivum
  unsure (1)..(132): unsure at all Xaa locations
  Clone ID: PAT_TA_92841.pep
XPWTIGLPRTRPFSSSRATPVTQIPLLVHRSPAAFLPLASMASLAGAARRATSLXPWLHRSCPASIRPYVAKSIVGSNKTARRSQHPSLVRCSCHSRRHHHSRFQQNWPSVPANLGDGSSFANFVAPPTHLA

SEQ ID NO: 198424 - protein, 174 aa, Triticum aestivum
  unsure (1)..(174): unsure at all Xaa locations
  Clone ID: PAT_TA_92842.pep
SCRIRHEVTLLESPHTTTIKISTHPIRMYSTMIKRVIIITFMGIGLVEDITGSPLTAKIQHSTGNMAELKSRGTSAVGATVLATVFGNALGGILSPKFVELGKKHAENAEKKKNKSQESLDEDNPRPKKSKSKEESSSSVEPTSRKEDKEIAEADNLSSKDSVTSXVAKAKPLR

SEQ ID NO: 198425 - protein, 158 aa, Triticum aestivum
  unsure (1)..(158): unsure at all Xaa locations
  Clone ID: PAT_TA_92843.pep
MDISAHLIMAVIAPWTEPFLDYLDRKELPEDQNEARCIIRRSKAYKVHDGELYKKSATVVLQRCISEEEGRQLLXEIHAXIQAVTNATSSGPLLAKGFRIGFYWPTAXADAQDLVQCCVGCQLFANQSHMPNTALXQSPSLXPFAVWGLNMGWTSERG

SEQ ID NO: 198426 - protein, 93 aa, Triticum aestivum
  unsure (1)..(93): unsure at all Xaa locations
  Clone ID: PAT_TA_92844.pep
SCRIRHEMSGNEVEKAKAAAGXGVGEYGTFHGPPSYPLPRXPVMAPVXRXAARPPRXSRXQLAPSRWLPXRXSSXSLXRCXXTXTXTVFHAAV

SEQ ID NO: 198427 - protein, 41 aa, Triticum aestivum
  Clone ID: PAT_TA_92845.pep
SCRIRHEAIGDDAVHGEEAYALWGDGEHYDDTKHGAAVVPV

SEQ ID NO: 198428 - protein, 174 aa, Triticum aestivum
  unsure (1)..(174): unsure at all Xaa locations
  Clone ID: PAT_TA_92846.pep
EKGHTDWTSCVRFSPNPQNPVIVSSSWDKLVKVWELSSCRLQTDHSGHTGYINCVTISPDGSLCASGGKDGTTMLWDLNESKHLYSLSAGDEIHALVFSPNRYWLCAATSSYIIIFDLEKKSKVDQLKPEFPTAGKKSREPXCVSLAWSSNGQDIICKDTLITSXRARGIMXRA

SEQ ID NO: 198429 - protein, 100 aa, Triticum aestivum
  unsure (1)..(100): unsure at all Xaa locations
  Clone ID: PAT_TA_92847.pep
SLXTXKXRRAXXAXPRRGSSSKRATXXXLXAXHSXPSAAVTRXXSXLRDRPPXLGAQSSPYXDXNXLKQCDRDXRHXSWPRXXILXAAMTRKILVPNSAR

SEQ ID NO: 198430 - protein, 153 aa, Triticum aestivum
  unsure (1)..(153): unsure at all Xaa locations
  Clone ID: PAT_TA_92848.pep
MSAAQLLNPKAESRRRGEALKVNISAGEGLQDVLKSNLGPLGTIKMLVDGAGAIKLTKDGNVLLXEMQIQNPTAVMIARAATAQDDICGDGTTSVVLLVGELLKQAERYISEGLHPRIXTDGYEXAXIXGFKVXLDEFKMXREVVRRSVTGGV

SEQ ID NO: 198431 - protein, 155 aa, Triticum aestivum
  unsure (1)..(155): unsure at all Xaa locations
  Clone ID: PAT_TA_92849.pep
MDAFVSSLRRQLFRKHLGLIPAQDPRHQTMNFLPLTHGPNEYDWDSPADRLVRDPLSDNFIELWDRTARTNTEVFSRAFHVVPSDNCKNWEEYKNWYEKFFVSSSKDDNRRVPPKYEYGHLVKEEFPXXLREAKELXALVKGTIVEMXLRFMKKM

SEQ ID NO: 198432 - protein, 164 aa, Triticum aestivum
  unsure (1)..(164): unsure at all Xaa locations
  Clone ID: PAT_TA_92850.pep
IHCRWAMLGALGCVFPELLARNGVKFGEAVWFKAGSQXIFSEGGLDYLGNPSLVHAQSILAIWACQVVLMGAVEGYRVAGXPLGEIVDPLYPGGXSFDPLGLADDPXXFAELXGGGSTRLMFSMFGFFARPSVRGPLETSVRTFRQTNLGPGNQTFAQGYAGGP

SEQ ID NO: 198433 - protein, 52 aa, Triticum aestivum
  Clone ID: PAT_TA_92851.pep
ASFFFFFLETFLCFGHLLIKFICAMHQESATLFILLYSHFPHRSLLVPNSAR

SEQ ID NO: 198434 - protein, 166 aa, Triticum aestivum
  unsure (1)..(166): unsure at all Xaa locations
  Clone ID: PAT_TA_92852.pep
MAPTVMASSVTSVAPFQGLKSTAGLPVSRRSNGSSLGSVSNGGRIRXMXVWPIEGIKKFEXLSYLPXLSTXALLKQVDYLIRSKWVPCLEFSKVGFIFREHNASPGYYXGRYWAMWXLXMFGCTDXTQVIIDVXEVKTDNLTXYVXINGFDNXMRQVKGVKFIAFX

SEQ ID NO: 198435 - protein, 132 aa, Triticum aestivum
  unsure (1)..(132): unsure at all Xaa locations
  Clone ID: PAT_TA_92853.pep
MARLNSKAVAAAVVLAAVVLMMAGREASAALSCGQVDSKLAPCVAYVTGRASSISXECCSGVQGLNGLXRSXSPDRKIACRCLKSLATXSIKSIXMGQGSPAWPGKCGVKRGPSPSXCPXXCNQCQSRSIPS

SEQ ID NO: 198436 - protein, 91 aa, Triticum aestivum
  unsure (1)..(91): unsure at all Xaa locations
  Clone ID: PAT_TA_92854.pep
GLHRTGPVDGGGSCRPAAKXXSFVXGRPRPASLLPPLGGVRAGAPGRIRHQAQLGVVGGHHGVLTAQSGHLALAGRRPDQLTTXXHQPKIS

SEQ ID NO: 198437 - protein, 176 aa, Triticum aestivum
  unsure (1)..(176): unsure at all Xaa locations
  Clone ID: PAT_TA_92855.pep
TVARLALDLMGSALPNDYHSELQDIVDAEEARKEGITQAEEFHDAQQELPSETNAASVVSLNHPTGAYVSEAGHTVIAEEVNRRRASIKEAILECDSEANKVEASCADQYRIVMTGTNPNKRELIRRQEDFKNPDIWWIDRGIIIKSVLGTSVDGFIHAAVFTPNNFEGCKXASVM

SEQ ID NO: 198438 - protein, 121 aa, Triticum aestivum
  unsure (1)..(121): unsure at all Xaa locations
  Clone ID: PAT_TA_92856.pep
MSSIENLRTFDPFAEADEDTGEIKQSQNYIHIRIQQRNGRKTLTTVQGLPKKFDQKKILKVIKKKFACNGTIVVDTEMGEVIQLQGDQRKXVQEFLTXKKEGLELDLKDQLRXMXFNYTNV

SEQ ID NO: 198439 - protein, 122 aa, Triticum aestivum
  unsure (1)..(122): unsure at all Xaa locations
  Clone ID: PAT_TA_92857.pep
SCRIRHELVPNSAREQRKAIRVAVEEAKLEGFPTDVEXREGYFMQEIAKGEGLSSDXSASQEAALCFYKALKVYPSPPDLISIYDKTVPKAILDILAEMIAADSSMSVNPLKAELDNEKGLD

SEQ ID NO: 198440 - protein, 87 aa, Triticum aestivum
  unsure (1)..(87): unsure at all Xaa locations
  Clone ID: PAT_TA_92858.pep
MAAAAASTGNGSPPVGLLVLMVLALAAGWXANAVRPPXPTPCGAPGGPPVTAPXVRMRDGRFLAYAESGVSRDXARXXVVXSHXFSX

SEQ ID NO: 198441 - protein, 119 aa, Triticum aestivum
  Clone ID: PAT_TA_92859.pep
PDWYSLFLHPIKFWRTLTEVIKLDTVRVSEETAARRKERVEEVTKRAAFRKAHGLSENAGLGAWVSSTNNGTNSLDGRVKIQNGEVADVPSQASNLESQTEIKEEVQEKRPIKKWLGIW

SEQ ID NO: 198442 - protein, 56 aa, Triticum aestivum
  Clone ID: PAT_TA_92860.pep
GQESDGICWHKWRGVKIYRLENNCILCRSRVAFSRTHLGTTSIGLTVSSAISIVHS

SEQ ID NO: 198443 - protein, 155 aa, Triticum aestivum
  unsure (1)..(155): unsure at all Xaa locations
  Clone ID: PAT_TA_92861.pep
REREQHSVILVPSNTRGISIKRMMSVYGYDDAPHGHGHLVFNNVKVPSSNLILGSGRGFEIVQSRLGPGRIHHAMRCIGAAERAIEWMLYRINDPRKIAFGKQLSEHGVVLDLLAKSRVXIDAARLVVLNAAIMIDKFGSKKALXEIGEAKIPCT

SEQ ID NO: 198444 - protein, 156 aa, Triticum aestivum
  unsure (1)..(156): unsure at all Xaa locations
  Clone ID: PAT_TA_92862.pep
LVDFWRLSTAHSQYLVVKNFYNALXSDKTVEELDSTTLGVLNKIFRLYALDTLEKEASEFFSSAAVTIRQIQLTXTKAVMQLLEDIRPHAIRLTDAWQFXDWQLDSXLGRXDGKAYEDLFYRASELNPLNGLTVDPYPNSEVIVKRDETYEFKSKL

SEQ ID NO: 198445 - protein, 97 aa, Triticum aestivum
  unsure (1)..(97): unsure at all Xaa locations
  Clone ID: PAT_TA_92863.pep
GGIARMRLLCWRVNXFRNAHELDRCLYFAKNLCXIXTLSNTLINHHTHYLINCYXFAXQLQAPCIYPHLYISSRYFPLNRCIXHLLNDFXDCXEMIT

SEQ ID NO: 198446 - protein, 172 aa, Triticum aestivum
  unsure (1)..(172): unsure at all Xaa locations
  Clone ID: PAT_TA_92864.pep
QIGDKFASRXGQKGTIGITYRXXDMPFTCQGIVPDLIINPHAIPSRMTIAHLIECQLSKVSTLRGLEGDATPFTEVTVDSVSKLLRDHGYQSRGFEIMYHXHTGRKLVAQVFLXPTYYQXRLRHMVXDKIXARARGPVQXILTRQPVXXSCQEMVGLRXGEMXRXCMILKGQ

SEQ ID NO: 198447 - protein, 75 aa, Triticum aestivum
  unsure (1)..(75): unsure at all Xaa locations
  Clone ID: PAT_TA_92865.pep
GPXXMXXXRYVRRDKXYRARXLPLGLXLLHVRREVXAXXGGGAEDPAXAAADGEXNRRPRAGYPLKTGKFSMRVV

SEQ ID NO: 198448 - protein, 44 aa, Triticum aestivum
  unsure (1)..(44): unsure at all Xaa locations
  Clone ID: PAT_TA_92866.pep
LECSXLXGNYNSCIRRDXGXIXXRXLXXXLHXXAVKPXICSYFS

SEQ ID NO: 198449 - protein, 88 aa, Triticum aestivum
  Clone ID: PAT_TA_92867.pep
LALRILEVVGCPTVLTFEKGSMTKLEVLVLRFYDEKSSIVGLENLEILKNVKLHGRKGNPAMERAVQQLKALFTESNQIVKVVVDYWC

SEQ ID NO: 198450 - protein, 154 aa, Triticum aestivum
  unsure (1)..(154): unsure at all Xaa locations
  Clone ID: PAT_TA_92868.pep
MDPVSHKMCVGPDYRHPLQKPTATVSIPMHFENVHTLPQTPQLIALLTIIRDQSTARADFIFYSNRIIRLLVEEGLNHLPVIEHSVTTPVGQTYEGVKFQGKICGVSIMRXAGEAMEQGLRDCCRSVRIGKILIQRDEETSLXRLFYDKLPKXI

SEQ ID NO: 198451 - protein, 111 aa, Triticum aestivum
  Clone ID: PAT_TA_92869.pep
MDLVNHLEGRLLFAVPKKGRLLQATLDLLKGADIKFRRENRLDIALVVNHPIALVFLPAADIPTFVGEGRVSLGITGQDTVAEHASSLLKRKIRQESLNVSQSDYDDGIWM

SEQ ID NO: 198452 - protein, 170 aa, Triticum aestivum
  unsure (1)..(170): unsure at all Xaa locations
  Clone ID: PAT_TA_92870.pep
XQRRSVLVPQXLIPHLTHXCTHKVAYLTVXKGINQKQEPEARDKIYKALFFXSNDETLETILSDHACGATLIFKVLTTPFFDESIRPEVVEKIRNVLIRLKAQPAQCYKRLMDEVGLSPRGVSTGPARDHAPNGPMDRPRPASTPSQIVNQQMPQHFNAAHYSQMQSSSF

SEQ ID NO: 198453 - protein, 158 aa, Triticum aestivum
  Clone ID: PAT_TA_92871.pep
MEKPDLEIANVILQLTEGAPRDQELALQRYFLPDAGLIHPLCRVPRFRDLPLPLLGPVDSRWVIGMIYRWYKILSPRVSLQVQRVVYDDKAAHLYCEVQQIFSPVFLPFYHASSHLTVKLQLQRDPAGYYIVTQEDLYQSTELGALLWARLLHARLLP

SEQ ID NO: 198454 - protein, 56 aa, Triticum aestivum
  Clone ID: PAT_TA_92872.pep
PQIPPEQSEIKACPLRNLDSRRKNRISLHRMLMAWAGLEQILSNSKAWKSHTVHMK

SEQ ID NO: 198455 - protein, 117 aa, Triticum aestivum
  Clone ID: PAT_TA_92873.pep
SIVCLAIAMPQSNTPQLSKSFDDWEGVCQEFGFEFVDFEMKGLNQYMESTGVKRIKEALESNDWEGRDHLESALQFEDLDEDEENEGLGLRVEADQMKIEMLGLNEAIHVVEGNLNE

SEQ ID NO: 198456 - protein, 171 aa, Triticum aestivum
  unsure (1)..(171): unsure at all Xaa locations
  Clone ID: PAT_TA_92874.pep
DISVVSLPRIAPMDRTCLLGCGITTGYGAAIETAKIEQGSTVGIFGAGCVGLSVVQGAVXSXASRIIVIDINPDKKGWAEKFGATDFLNPTELKNXXIVEKLIEMTDGGCXYTFDCTGNVGVMRAALEACHXGWGXSIIIGVAAAGQXISTPPFQLVTERVWXGCAFGGNX

SEQ ID NO: 198457 - protein, 70 aa, Triticum aestivum
  unsure (1)..(70): unsure at all Xaa locations
  Clone ID: PAT_TA_92875.pep
ILSNSRTLGESWGFSRIFIFDFHQKNKTRILGFNYFLSGKIFHLKKINERRKYDFSKTSXXHKXGXPKRP

SEQ ID NO: 198458 - protein, 174 aa, Triticum aestivum
  unsure (1)..(174): unsure at all Xaa locations
  Clone ID: PAT_TA_92876.pep
SCRIRHEERETFAVSGTPSIGDFFPALRWVDRLRGVEAALVSLQTRRDAFVGALIDDHRRTSNAGGRDVEKKGVIDVLMEHQAADPVYYTDTVVKGIVLVLLTAGTDTSALTTEWALALLVKHPEVMQKARAEIDAKVGIGRLVEESDIXPNLPYLQCVXKETLRLCPRRANQS

SEQ ID NO: 198459 - protein, 144 aa, Triticum aestivum
  unsure (1)..(144): unsure at all Xaa locations
  Clone ID: PAT_TA_92877.pep
MANPXVFFXMTVGGAPXGXIVMELYKDAVPRTVENFRALCTGEKGVGKSGKPLHYKGSSFHRVIPDFMCQGXDFTKGNGTXGESIYXEKFADEXFVHRHTXPGILSMXXAGPXTNXSQFFICTVPCNWLDGKHVVFGXVVRGQL

SEQ ID NO: 198460 - protein, 53 aa, Triticum aestivum
  Clone ID: PAT_TA_92878.pep
TQVKSYSMVKLPERSLRESWIRGCPDSQTITVGRTPGLCRYKIEDFVPCPDGT

SEQ ID NO: 198461 - protein, 135 aa, Triticum aestivum
  unsure (1)..(135): unsure at all Xaa locations
  Clone ID: PAT_TA_92879.pep
MGPTVMASSATSVAPFQGLKSTAXGLPVSRRSNGAXLXSVSNGGRXRCMXVWPIEGIKXFETLSYLPXFSTEALLKQVYYLIRSXWVPCLXFSXVXFIFRXXNASPVYYXGRYWTMWKXPMXXCXDLHXXXNEVX

SEQ ID NO: 198462 - protein, 71 aa, Triticum aestivum
  unsure (1)..(71): unsure at all Xaa locations
  Clone ID: PAT_TA_92880.pep
YDTYIXTAMDLTVXCLDRTXXIAPFXGLIXSVRXLTSGRRXXXSVTISRXSNCGXITXMHSVGHQXXQXVQ

SEQ ID NO: 198463 - protein, 165 aa, Triticum aestivum
  unsure (1)..(165): unsure at all Xaa locations
  Clone ID: PAT_TA_92881.pep
MDIHRCRFVPIPPSSINALAFSHSNISSNKKTAPLRLAVGRANGDIEIWNPIKGSWLQEIIIRGGKDRXIDGLVWTQDPNEEIDGKTIIGKLRLFSIGYTTTITEWDLSTGKPLRQASGNHGEIWCIAAQPSSNPATVALSNIDGQEKCQVFNYWAALMEPLSTP

SEQ ID NO: 198464 - protein, 65 aa, Triticum aestivum
  unsure (1)..(65): unsure at all Xaa locations
  Clone ID: PAT_TA_92882.pep
SSHPMGQPPGXLXDTXTRPXXXASTLHHSAAKHLVIXXSPXTALTXGXSXIXXXPXHDXPWAXDS

SEQ ID NO: 198465 - protein, 145 aa, Triticum aestivum
  unsure (1)..(145): unsure at all Xaa locations
  Clone ID: PAT_TA_92883.pep
MVNITEKIKXIXEEMRRTQKNKATEYHLGLLKGKLARYRAQLLEPGPGAGGGGGAGFDVSKSGDARIALVGFPSVGKSTFLSKITKTKSXVAAYSFTTLTAIPGVLEYXGAXEXQVXGLPSIIERGHQXGQKEGARQGISAAKXE

SEQ ID NO: 198466 - protein, 54 aa, Triticum aestivum
  unsure (1)..(54): unsure at all Xaa locations
  Clone ID: PAT_TA_92884.pep
SYTFFCNPMMLNCVGTNLLLPVSVLXFLLXSLKKISVELLKPXTKQLYILKXXA

SEQ ID NO: 198467 - protein, 52 aa, Triticum aestivum
  unsure (1)..(52): unsure at all Xaa locations
  Clone ID: PAT_TA_92885.pep
SCXXRHELPSHXPHHRVHQTLXVGARRXDXGXASVLXSYXGXAQVXXRXGPA

SEQ ID NO: 198468 - protein, 77 aa, Triticum aestivum
  Clone ID: PAT_TA_92886.pep
IFSLSQAQSNFALSRKLAHEAMIQESHQVYKYNLVHPHFNDRTSCRLSLALAVRQIHAHADIYTRREKQSVEHKSER

SEQ ID NO: 198469 - protein, 83 aa, Triticum aestivum
  unsure (1)..(83): unsure at all Xaa locations
  Clone ID: PAT_TA_92887.pep
MAXRALELXLISGKDLKDVNLFXXMEVYXVVSLSXDPRSRQRVATDXSGGRNPTWKATSPLHXSXLXXRGXXVHVLLRAERXL

SEQ ID NO: 198470 - protein, 99 aa, Triticum aestivum
  unsure (1)..(99): unsure at all Xaa locations
  Clone ID: PAT_TA_92888.pep
ADQAXXRRERLQHXDQRXPXLRKQRXEARPPEXXTLRPPASSPXXPPSCXXVRLCXETSXVISLCTTNSRREEEVEARXEFLQXXASHVVXRVVPVHAR

SEQ ID NO: 198471 - protein, 51 aa, Triticum aestivum
  unsure (1)..(51): unsure at all Xaa locations
  Clone ID: PAT_TA_92889.pep
GLELPXGTSDTAXSXRPGEGXLXDVRXQSTERGTHARXLRGXPXLVERVRP

SEQ ID NO: 198472 - protein, 127 aa, Triticum aestivum
  unsure (1)..(127): unsure at all Xaa locations
  Clone ID: PAT_TA_92890.pep
LAVGQHQQSHLEGRLDFPRADPPWAPRSPRSAPSPPWTPTRSASPVSQPPTPSPDAXALVSDPAHALRLLVVCEAPLVIVVFSXGPGXNSKXXSXPXGLLXXELLWALPXXGQSYNXLWXXXGPWXR

SEQ ID NO: 198473 - protein, 166 aa, Triticum aestivum
  unsure (1)..(166): unsure at all Xaa locations
  Clone ID: PAT_TA_92891.pep
SCRIRHEVRGKAALNAAQRTGSVIGTEKKFTAGNLASKPGVEGQHLTKVDRSDDIVKPNTVGKEVGSAISERRQKIEPKMTQRDLATXCXTTHXIVAEFXRGTAAPDQXILGNMEKVLGIKLRGXSXIGAPRFXSKEKHSHISFRGSRIRRACFLRVGNETMVIIC

SEQ ID NO: 198474 - protein, 93 aa, Triticum aestivum
  unsure (1)..(93): unsure at all Xaa locations
  Clone ID: PAT_TA_92892.pep
SRXRXRDRXRGAGAQXPRGRRRREPEGPPEKRAHRPLRHGCRCXEVEEASPAXGVWTGEGRRRPAGLARVPRGACRRRIPXSGLAGFGXXGPR

SEQ ID NO: 198475 - protein, 101 aa, Triticum aestivum
  Clone ID: PAT_TA_92893.pep
EDVLGHTIRSEGINAVCGPQAVRLDVGLSRGCGNGLPEVLEINGGGSEVRVITTDPAEAWQYRKQKPDKAATALEKKGEVKDGLALLVRESHVLKGVEAKA

SEQ ID NO: 198476 - protein, 73 aa, Triticum aestivum
  Clone ID: PAT_TA_92894.pep
LPSNEVARHIDFTHHDSLVDIPVITTRNRGMSIDGEKYHYVKIHESWCSSHDNSDIKGVILQGRTEPKAGLAF

SEQ ID NO: 198477 - protein, 169 aa, Triticum aestivum
  unsure (1)..(169): unsure at all Xaa locations
  Clone ID: PAT_TA_92895.pep
MAARQPQFNQTVLIDTAPLPADIPPVKEVGSSSAPLLSASFFIGARCKPYNDDFMQCKTENPGKGEFNCLKEGRKVSRCARSVIEDVNKHCLDEFRKHWSCLENNNQQLWHCRPAEWKLNQCVFDSLNLQKVIPNTPEGETPXHLRKRQDIFAKLMLPISPQKSVPWLM

SEQ ID NO: 198478 - protein, 174 aa, Triticum aestivum
  unsure (1)..(174): unsure at all Xaa locations
  Clone ID: PAT_TA_92896.pep
SCRIRHEPLSSSSLQLPRGASGFLAAARPLPARRSRDFFSLSAAASSTQPLAAGLYSVLQEPPAPGWIHFPCLPACLSCPVRRERGINLHLPPGELARIILLHRRRWNLPVIIARISRQEEEAAAAARSKILQXRREXGXWXHGFLRGSXVRXRLSVPNPGGCPXPTRSTSPPQ

SEQ ID NO: 198479 - protein, 174 aa, Triticum aestivum
  Clone ID: PAT_TA_92897.pep
DSQRKCRLSAHLTLGLSHHFLGAPSTALKYFLSILEESGDSTDTVCLLAQVLWAMNNEESRNSARNYLFNSIEGKPDHVQSVLLLGVIALVENDKESLEAVTASLYEIRTTSNLSAIEKYQVEEVLWGMASVSNSRREKEAIIEAQKDVFLYPYQPIGWSRLSDFKYKIYSYNG

SEQ ID NO: 198480 - protein, 108 aa, Triticum aestivum
  Clone ID: PAT_TA_92898.pep
SCRIRHEAAASQLRWHRRPLHRSSGGCCITTPAPTRPLLPCWACLERTVGVVPAEKCNPRETKRTATMFTIRRLSRRLITASYQAGLRLASAFFHLLLYKGMSSGVHR

SEQ ID NO: 198481 - protein, 175 aa, Triticum aestivum
  unsure (1)..(175): unsure at all Xaa locations
  Clone ID: PAT_TA_92899.pep
VYLWRCVVSVVPLHDNIAWSLGTFIIALVIWLVKCIAVLCRFVLAPVAVLIFLAHKYWKTRITIDAVEKFLRMQQMLGPTRYAYTDITAITNHFRDKLGQGGYGSVFKGALSPGNVHVAVKMLEGNTNCNGXEDFISEVATIGRIHHVNVVRLMGFCPEEMRQALRLRSTCLEGG

SEQ ID NO: 198482 - protein, 176 aa, Triticum aestivum
  unsure (1)..(176): unsure at all Xaa locations
  Clone ID: PAT_TA_92900.pep
RSLWRRNGFPTSSDAAALPLSLAPYRIRDKSDIRIGYDHSVAGDWLLARFKYPHNPDLYGKVQDSISSAASTQVKSVNGKFTIVLTVTQIRNYNADSYTSIVSTRALRIQPDQYGRVCYEECKMTRKPLSSILLLRAIWNEYRKMVKYRDTIYVDTIPFVDDRQIDFMSKEDARXV

SEQ ID NO: 198483 - protein, 118 aa, Triticum aestivum
  unsure (1)..(118): unsure at all Xaa locations
  Clone ID: PAT_TA_92901.pep
LLRLSRIYRSPPSFRFRERLXKQKTKKXKXKKKKKKKKMKKKKKKKKKKKKKKKKKKKKKNKEEEEKKKKKXKKKKKKKKKKKKKKKKKKXKEEEEKKKXKRKKKNRHEPAFPGDPLF

SEQ ID NO: 198484 - protein, 86 aa, Triticum aestivum
  Clone ID: PAT_TA_92902.pep
FNIASYLKNTTCLDWVAQTGNHVNTTKSNRPRNSCQFAMKTIIEWNVERRISFQYLGVWLLLPWQASHYLPKVRSFILYFVETVIL

SEQ ID NO: 198485 - protein, 61 aa, Triticum aestivum
  Clone ID: PAT_TA_92903.pep
LVPNSARGFIVSQAVGNRLLRRLCIRYRRKDAQALAWRMHLVGYDMDVYLREPTKTLLYSQ

SEQ ID NO: 198486 - protein, 69 aa, Triticum aestivum
  unsure (1)..(69): unsure at all Xaa locations
  Clone ID: PAT_TA_92904.pep
AERQKLGARLPPPRANSPIKTFLQSPARRNPSILPASSPFKXSIVKPRTASXNVSLQKXLXLSXXKATX

SEQ ID NO: 198487 - protein, 131 aa, Triticum aestivum
  unsure (1)..(131): unsure at all Xaa locations
  Clone ID: PAT_TA_92905.pep
GVIKPGMVVTFGPSGLTTEVKSVEMHHESLLEALPGDNVGFNVKNVAVKDLKRGFVASNSKDDPAKEAANFTSQVIIMNHPGQXIGNGYAPXVLDCHTSHIAVKFAELXTKIDRRSXGKEIEAXPKFLKER

SEQ ID NO: 198488 - protein, 150 aa, Triticum aestivum
  unsure (1)..(150): unsure at all Xaa locations
  Clone ID: PAT_TA_92906.pep
LVPNSARVLVRDVFNPEHGMFTYDEDSRMCYFNPHSFETSDQFFLVGVILGLAIYNSTILDVALPPFAFRKLLAASPSPXLGAATHTKPSMTYSLXDDLXLKYRPSLAXXLRQLLEYDGXDVESTFLRXFWLPILIVTGQVRYKFRYPEG

SEQ ID NO: 198489 - protein, 93 aa, Triticum aestivum
  unsure (1)..(93): unsure at all Xaa locations
  Clone ID: PAT_TA_92907.pep
MSCCGGNCGCGTACKCGNGCGGCNMYPEVEXAGATLLVSATATHKASSGGMEMAAENGGCXCTQXCKCXTXSCXCSCQLSHRLMHAWPGIRSF

SEQ ID NO: 198490 - protein, 89 aa, Triticum aestivum
  unsure (1)..(89): unsure at all Xaa locations
  Clone ID: PAT_TA_92908.pep
VRVEEVRLLLVGPAEVNQRPCVEHPERETAEASQADHPRGLTKLPGDYCRSNGPQGRATRSXRTFQDXRGXXLXPSRTPXXXEAALLEG

SEQ ID NO: 198491 - protein, 125 aa, Triticum aestivum
  unsure (1)..(125): unsure at all Xaa locations
  Clone ID: PAT_TA_92909.pep
XGTNAQDVRALVLGMQXARLLLXMLGKGIESALINPSTLLPEPWQASSELLSNIEPDKMTVDPALLPSIQGYVDAVLNLASXFITRXRGYASFCRXLXXHAVGASSRVRVKGIWVPNPTKFSRSN

SEQ ID NO: 198492 - protein, 70 aa, Triticum aestivum
  unsure (1)..(70): unsure at all Xaa locations
  Clone ID: PAT_TA_92910.pep
APLPCVAKPFVTTHQPKINDSKHQNIHLSCLPSIHRFQSYSKTPPTYQSLSIPLLFSPPXPVTLSLALRY

SEQ ID NO: 198493 - protein, 98 aa, Triticum aestivum
  unsure (1)..(98): unsure at all Xaa locations
  Clone ID: PAT_TA_92911.pep
YFQYKNYARHCEPQXYYEASSCATTTHQVRSGLNSAAXIXKXXXCXXLLIKKXKVCKXCCHWELXAIGIFQDSSVXIXVQLPFLGTWYKFQAXPXQRK

SEQ ID NO: 198494 - protein, 88 aa, Triticum aestivum
  unsure (1)..(88): unsure at all Xaa locations
  Clone ID: PAT_TA_92912.pep
MAAAAGEAPRALSQKEQDIQMMLAADVXXGXKKCDFXMERYAXXRRSDXIYIINLXXKTWEKLXLAARVSSPXRNPQGKXSVPVRPGP

SEQ ID NO: 198495 - protein, 132 aa, Triticum aestivum
  Clone ID: PAT_TA_92913.pep
QIRSNMLNGSIPESFSKLKVIQQIDLSENNLTGQVPQYFVNFSSLNYINISYNKFEGPIPTGGIFRNSAAVFLQGNTGLCETAAAIFGLPICPTSSATRRKINARLLLIIAPPITIAVDLIIMCCCHYYEGN

SEQ ID NO: 198496 - protein, 138 aa, Triticum aestivum
  unsure (1)..(138): unsure at all Xaa locations
  Clone ID: PAT_TA_92914.pep
KXXRNXQIXFGPXVRTXLXXHISXRKLPGPRDQCXXYSXQPXXXXGXPPRYAAXGGAAPLSTSEETPRTEPRRRAGLWRSGRMEDADGAGKXRARSPAGSGRRRRQELGGGEGRXRHLLSSVWKXXCRLSPLARVLGA

SEQ ID NO: 198497 - protein, 150 aa, Triticum aestivum
  unsure (1)..(150): unsure at all Xaa locations
  Clone ID: PAT_TA_92915.pep
SCRIRHELVPNSARAPIETKLVFILFEIHSVGYPYIFQGSRVLQGTTTLRMHKSFIDHISHILRMAKILLHRVTTHKIHISTNNANFIHSQGDYNPLAFPLHVSTQHLKYXKKMFSLLLLHFLCCKXQLFIXKVSLSLGAFXXKVAWLQL

SEQ ID NO: 198498 - protein, 125 aa, Triticum aestivum
  unsure (1)..(125): unsure at all Xaa locations
  Clone ID: PAT_TA_92916.pep
WARIPVRYVFXEGFVNHVILTXFWDFDHXPRYDQLLAXEWRKSLSDKQXSSKAPEKLIQALRRNSGISSRRVSXSDISGPYSRQESKHSPFKIHXKFIXWSEXPEXPLSRFGLIRGEPGKWXITE

SEQ ID NO: 198499 - protein, 100 aa, Triticum aestivum
  unsure (1)..(100): unsure at all Xaa locations
  Clone ID: PAT_TA_92917.pep
TGTCIILVCXSCXCLRLGGIYQRVGLVSFPGGFAFLKXPGXKXFAXLVEGNFGSXXGXPXFXVLXFXXGXSXVPFLPLXXGXFXXGKGXEPGLNPLXISX

SEQ ID NO: 198500 - protein, 82 aa, Triticum aestivum
  unsure (1)..(82): unsure at all Xaa locations
  Clone ID: PAT_TA_92918.pep
ASSSCPTPHADXVAMXXHDSDHGGTVXVLLLPYPKQGHXXPFLQFGKXLASXAGVRCKLARXXAXSXGKGREXVPGGRPTRR

SEQ ID NO: 198501 - protein, 92 aa, Triticum aestivum
  unsure (1)..(92): unsure at all Xaa locations
  Clone ID: PAT_TA_92919.pep
EDIKICXNLIRXSRVSXLIIXVLQXYLXXMXLLLXQHHTLXXXRWFTXSEVXVWKARPFTSQYFLSXSXAERSFXXWRXLXTIXXXRLAVPS

SEQ ID NO: 198502 - protein, 143 aa, Triticum aestivum
  unsure (1)..(143): unsure at all Xaa locations
  Clone ID: PAT_TA_92920.pep
SRLPFKFLRLXXEFLSLLXQVSQTCPSSFSDCPSIFSALLIKFAVDFIIIDLSRLNNLFCLDILNWLLNRLSLNVVFNISFYFTLNFIILKLRFIFTVKVFIVVIIIVVIGDFGRLLVLVIGILSSIIAFAFIYITLGYVEGI

SEQ ID NO: 198503 - protein, 48 aa, Triticum aestivum
  Clone ID: PAT_TA_92921.pep
LVPNSARARAEFGTSADEAHHRDVNHFAADIHFQGLELNKTPAPLGYH

SEQ ID NO: 198504 - protein, 64 aa, Triticum aestivum
  unsure (1)..(64): unsure at all Xaa locations
  Clone ID: PAT_TA_92922.pep
XXIDXXCXSSKSICPTRLIQRVSIYILITLRXYFNXFPRHGLSSIKRXPXPFAQACFTRLETEX

SEQ ID NO: 198505 - protein, 58 aa, Triticum aestivum
  Clone ID: PAT_TA_92923.pep
HLLHEIVHPLQPQMPILLCTSSSSSMRDIRCVLAKLPGCSDNNPLQSLLSIKDRSNIS

SEQ ID NO: 198506 - protein, 77 aa, Triticum aestivum
  unsure (1)..(77): unsure at all Xaa locations
  Clone ID: PAT_TA_92924.pep
DYPLITPQXLRLICMXTVPRRRTGSWLKLTXQRLYFXLSRXPAPCWNDRLVLFXPSECFXLDVXXVLLLCQKKKKKK

SEQ ID NO: 198507 - protein, 104 aa, Triticum aestivum
  unsure (1)..(104): unsure at all Xaa locations
  Clone ID: PAT_TA_92925.pep
RPPGXEVXXXAGXXAPVXSARGRRXPKNXXRRXXGAADXXGXSNPTLPAMRIXEISEQHRAGRRVEEVXADSAAAAAGKXPGRRRLQYKFFFSWTGMLXPNSAR

SEQ ID NO: 198508 - protein, 72 aa, Triticum aestivum
  unsure (1)..(72): unsure at all Xaa locations
  Clone ID: PAT_TA_92926.pep
TTPVATQRILFLAASXRFSLSLYSCKNFSRSFFRGSCIICRAFAPAQPPVVVCLSLPVLATGKYWLCSRYTD

SEQ ID NO: 198509 - protein, 35 aa, Triticum aestivum
  unsure (1)..(35): unsure at all Xaa locations
  Clone ID: PAT_TA_92927.pep
FSMLFRRCALSLFPXXEEATXRPYXYNIIRSXLXW

SEQ ID NO: 198510 - protein, 101 aa, Triticum aestivum
  unsure (1)..(101): unsure at all Xaa locations
  Clone ID: PAT_TA_92928.pep
RENRTSFIAKWANLNHNYLQIISNSKFGMIIVLTIISLLFQNIVAFSATADTEKCKSLHIKPSMERLGLSTAVHLKHHAQKLVEKSVIWISGITQEQKPLX

SEQ ID NO: 198511 - protein, 122 aa, Triticum aestivum
  unsure (1)..(122): unsure at all Xaa locations
  Clone ID: PAT_TA_92929.pep
MHTSLPLFPSLSLSHSPKTIMPNAGSERAASLSLKKQDTATFSGKLPSTKQRFSSVSXAACPSFRIYYYDGAAGAVPFEWESHPGTPXXPSSELPTLPPLTPPPSHFSFSXGDQIRRRSQKV

SEQ ID NO: 198512 - protein, 74 aa, Triticum aestivum
  unsure (1)..(74): unsure at all Xaa locations
  Clone ID: PAT_TA_92930.pep
MNGQQCFTIWSPGQGLLRVGNLLEYTFKKLSLWYQEKKKKKKXKKXKKKKKTXRLVXXRAEFXTRGGPGPQFXL

SEQ ID NO: 198513 - protein, 114 aa, Triticum aestivum
  unsure (1)..(114): unsure at all Xaa locations
  Clone ID: PAT_TA_92931.pep
MXTTAMGLSPSSFAGKAVKDLPSSALFGEXRVTMRKTAXKXKPVSSGSPWXXSDRVXYLXPLSXDPPSYLTGEFPGDYGWDTAGLSXDPETFSKKRELGVIHCRWAMLGALGCV

SEQ ID NO: 198514 - protein, 116 aa, Triticum aestivum
  unsure (1)..(116): unsure at all Xaa locations
  Clone ID: PAT_TA_92932.pep
RAEFGTSSRIRHEAIYKSQAETGEIXGHYLNXTAGTCEEMIKRAXFARELXXPTVMHDYXTGGFTPNXTLAQYCXRDNXLLLHXHPCNACXLLXDKKNHGMXFXXLXKTLXYVXGQ

SEQ ID NO: 198515 - protein, 126 aa, Triticum aestivum
  unsure (1)..(126): unsure at all Xaa locations
  Clone ID: PAT_TA_92933.pep
LVPNSARELLVHFDVVIFEFNLIDTAYKKIIIDITNKMGNGMADYALNAEHNINGINTIEDYENYCHYVAGLVGDGLTXLFVXSGFANPALLQXQNLRXSMGQFLQKTNIIRXIREDXDDKXXXWX

SEQ ID NO: 198516 - protein, 74 aa, Triticum aestivum
  unsure (1)..(74): unsure at all Xaa locations
  Clone ID: PAT_TA_92934.pep
KHLKKKEKKVKKKKKKQRKRTEEKNKNDNVNTTVHGGCLVIVAIFVXECPXFESRSLFLRFKIRKKYWQDPKYL

SEQ ID NO: 198517 - protein, 71 aa, Triticum aestivum
  unsure (1)..(71): unsure at all Xaa locations
  Clone ID: PAT_TA_92935.pep
FXDEXLXDVLPGXQVDLARSRRRLPXVVXCMEARXSRLTATARRTRSSVGVTAXVVDVGELHAEPCAWHXL

SEQ ID NO: 198518 - protein, 109 aa, Triticum aestivum
  unsure (1)..(109): unsure at all Xaa locations
  Clone ID: PAT_TA_92936.pep
XXGXSPGGVXXCPRXXGGGXRSTXXXFPXXAGSYXIXAXXCAASLSIYLSTSNYSFFSSLTQXXTKKHXXIPXSNTQYSTCGXLKKXXRXLTAXXPQAGQISSLFLXXL

SEQ ID NO: 198519 - protein, 72 aa, Triticum aestivum
  unsure (1)..(72): unsure at all Xaa locations
  Clone ID: PAT_TA_92937.pep
XFVFIFFPLFXISFVILNLPXFXLFLFFRIPNFVQNFKKXSEIKICXCFXMLFRSSKNLVIFTTCSPFKKCS

SEQ ID NO: 198520 - protein, 123 aa, Triticum aestivum
  unsure (1)..(123): unsure at all Xaa locations
  Clone ID: PAT_TA_92938.pep
PLSTCHQRRQRRREGGCSWTAGERAATIMQGDQAGKKGXVXKGWLAVRVPPGPGGAXGRRXPAVRHPHRLPLPSALPTAXGGXPGTRXXXTRAXPALAALLRXXXFLRPSRALGXXGGRXXQL

SEQ ID NO: 198521 - protein, 137 aa, Triticum aestivum
  unsure (1)..(137): unsure at all Xaa locations
  Clone ID: PAT_TA_92939.pep
QIVRIEAGPSLSTREMSRATKRXLISIRKMIPPLLPKFYKGQMGSVAVIGGSQDYTGAPYFSAMACAKTGADLVHVICEPQAAQVIKTYSPNLMIHPLMRQSDRASTEDSAQSIASKIIELLPRLHVLVIGPGLGKR

SEQ ID NO: 198522 - protein, 136 aa, Triticum aestivum
  unsure (1)..(136): unsure at all Xaa locations
  Clone ID: PAT_TA_92940.pep
SXAXFLXPQXSDXGXXXXEPXGTXHSXGXMXPLPGXEXWERXSRRARRPTAPXMRXXXPLXDXXAHXAGHXRXXDPXXXAXHRRQRDGXAXXRAPRRQEPGRGRATXDGGDGGGGSXHCLLAGVVGXICSRAEFGT

SEQ ID NO: 198523 - protein, 92 aa, Triticum aestivum
  Clone ID: PAT_TA_92941.pep
SFDKLRSFQTIFKSLGLVRASNDILLTASVGLFPSVDVTAPRTMENYIKETFSTTLHYHHSSLAFKPKSSSNGFSTDMVGIYRGKKKYKMAG

SEQ ID NO: 198524 - protein, 100 aa, Triticum aestivum
  Clone ID: PAT_TA_92942.pep
LVPNSARGTFPNVKIDGPAGTQMIANPLYSYKFHPLDTSEFQGDPFDKYPATIRYPTGETASASSQNNIFEQRFDSSKDNIRSRLYALLTNYHDYLGFKQ

SEQ ID NO: 198525 - protein, 70 aa, Triticum aestivum
  unsure (1)..(70): unsure at all Xaa locations
  Clone ID: PAT_TA_92943.pep
LINWMSSAMKRSAKAKSIFSRFAKHGRNLEPASQTTYAYELTIADFKIRLSFHPLCXXTRGQSNPSGAKL

SEQ ID NO: 198526 - protein, 153 aa, Triticum aestivum
  unsure (1)..(153): unsure at all Xaa locations
  Clone ID: PAT_TA_92944.pep
WCRIRHEDKVVSRRLDWSEGPGTRPGESKFVSVPRRPPGASPTSDMEGKTHCALLEKGQNQSVSASLRRPPGHAGPGGEKRSXGWMGGENGMSGWSLLQVPRTIEKNPNQSFLAKGGTIKWFGDLGWWVVIIINFFWFQXLFPFGGXINPPFG

SEQ ID NO: 198527 - protein, 134 aa, Triticum aestivum
  Clone ID: PAT_TA_92945.pep
PGQLFPWAKNRLFAFLPRVAGPRPFRRPACNPGLDQVPLTVSPYTGAFIDPSGRSMFELWRNWRGSGPESDLPSSGDADPALSSTRGAGLVVKTAFYSSDSLLLFAPSLCSVMPLLSRSCSERNDVEAWNAPHG

SEQ ID NO: 198528 - protein, 103 aa, Triticum aestivum
  unsure (1)..(103): unsure at all Xaa locations
  Clone ID: PAT_TA_92946.pep
LVPNSARARAEFGTSDGRGELLEVRRRAVAXGHGGGSGGRGGDGPGSYHCAGSDXRGGHAXXPAPXPCKAGXXAQTXSNQXCQGRAXARSXLSXRRRXQELXG

SEQ ID NO: 198529 - protein, 113 aa, Triticum aestivum
  unsure (1)..(113): unsure at all Xaa locations
  Clone ID: PAT_TA_92947.pep
MSSSILKQIFRASRCSRFTHHRPLDRTPRTINSYRPLIPRCLAATYCPSHHSTALSVLKSSVETSSEDFQQNERQMCEAIMNIENLITKIQIGGSLKAXREKHLARNKLLPRR

SEQ ID NO: 198530 - protein, 118 aa, Triticum aestivum
  Clone ID: PAT_TA_92948.pep
PPPSSSPSTTTSSTPSSSRPPASAGSRPVSLPDRKTILEVRDKPASLKADDWARVVAVFVLGKERQFKAANNFSFEPDVVAWPRRQGGGVLGARPWRRRPRRWSMAAAYTVDLGNREE

SEQ ID NO: 198531 - protein, 74 aa, Triticum aestivum
  unsure (1)..(74): unsure at all Xaa locations
  Clone ID: PAT_TA_92949.pep
PVTTPLIKAYGIXGMPRRCLSSLMQEMRXKGINADRVTYTNLIAALQRNENFLEAVKWSLWMKQTGVVGVGARP

SEQ ID NO: 198532 - protein, 61 aa, Triticum aestivum
  Clone ID: PAT_TA_92950.pep
PTCCILLVLAEISFSLHLTPREIQGRSEVHKYNNKAGKITGCRLQHSSRCGQHALLFHKST

SEQ ID NO: 198533 - protein, 58 aa, Triticum aestivum
  Clone ID: PAT_TA_92951.pep
RGKEAELPSHADVAGSSSSAAATQAGVGETSGRFRRLMSSFGLGRSSRSTVLPIHLDP

SEQ ID NO: 198534 - protein, 134 aa, Triticum aestivum
  unsure (1)..(134): unsure at all Xaa locations
  Clone ID: PAT_TA_92952.pep
XXIDQIIDATAGHDSLCFLDAYFXYHQMKMAESDQAATAFITPYGPFCFNTMPFGLKNAGATYQRMIQTCLEKQIGKTVEAYVDNVVVKTRHVESLIDDLRLTFDNLRTYDIKLNPEKCVFGVPAGKPRAEFGT

SEQ ID NO: 198535 - protein, 100 aa, Triticum aestivum
  Clone ID: PAT_TA_92953.pep
MAPTQESAAFLAKKPTVPPNFDGVDRNDTKRLKQAQDAIIREQWVRSMMARLVREELGRCYYREGVNHLEKCGALRERYFELLKDAKIKGYLFNQRNYIK

SEQ ID NO: 198536 - protein, 102 aa, Triticum aestivum
  unsure (1)..(102): unsure at all Xaa locations
  Clone ID: PAT_TA_92954.pep
MSRQNSNTDRQKIASARLNIVEDSTTKPSKDSHETGSRTEEEAVVNTLPEKEGIFMFQHRNYXISSSRKGLKVVRRFSDFVWLLDCLQKRYPFRQLPLLPPK

SEQ ID NO: 198537 - protein, 125 aa, Triticum aestivum
  unsure (1)..(125): unsure at all Xaa locations
  Clone ID: PAT_TA_92955.pep
XRGFLHXTNLDIAVKKVSXSSRQGWKEFVSEVRIISQIRHRXLVRLVGWFHGGDDDDLLLVYXLMPKGSLDAHLYKPXPPGYRXPGQVRRSVLRXLGSCTACYLHEGKTGAKRNPGNRGIKAANR

SEQ ID NO: 198538 - protein, 132 aa, Triticum aestivum
  unsure (1)..(132): unsure at all Xaa locations
  Clone ID: PAT_TA_92956.pep
SIFSIYNLHHTSITPLLLLXTTLNAKINYLFSDIFSTFSGVNFPSTAFCAFSWSAASAITRLSSFSSIFSVGLEGESSPGLFIFFILPHSXLLIKNPWLALSGTFQGRWLIRGAGXLRAANEILPXFXIXNE

SEQ ID NO: 198539 - protein, 143 aa, Triticum aestivum
  unsure (1)..(143): unsure at all Xaa locations
  Clone ID: PAT_TA_92957.pep
LVPNSARGERGKPLLDPQFYEDKRIRLRGYQXRAMVKSMTLAAKVPHFHYLEEINCDALVQLKASFQKENKDHDVKHTFLPFLIKSLSXHLSKYPLLNSSFIDETNEVILKGFHNIGVAMATEQGLVXVPTIKKVQSLSILXI

SEQ ID NO: 198540 - protein, 120 aa, Triticum aestivum
  Clone ID: PAT_TA_92958.pep
MAEEDLFGSLRRQSDPEKLEKQAKAVAEREASCSAKAEERLKYLLDDNSTLPISVSSIQLVGASHTRRSFLDKLFTPLLSCNRDAPYTLSTALHEIGILSDKLSRFGIFQPEISTFLRPI

SEQ ID NO: 198541 - protein, 116 aa, Triticum aestivum
  unsure (1)..(116): unsure at all Xaa locations
  Clone ID: PAT_TA_92959.pep
PALTLREQLLKLLHENPLYGHRGAAALYTLLSRTYWWPKCHKECXSMRKVAKPAPSAAFRHLTLDFVGPLPTCNIRNFNYRYILQVVDRLTKRVWIIALERPTARDTAEAFLNRHE

SEQ ID NO: 198542 - protein, 160 aa, Triticum aestivum
  unsure (1)..(160): unsure at all Xaa locations
  Clone ID: PAT_TA_92960.pep
VRGXGQXPLGKTKXGAAAPLKRLPAGTGRERTIRPXRRPGXPEXRDVNSRPARPRGPXXPRXXGPYAVGAXSGPGAWPGAVLXRRSGXDLXRSPTRVWATLGXWCAAAIAITALVDRSVARLVVAWSPRRRRGDEGGGAVGGTAAKQTLSTHATSEVDGV

SEQ ID NO: 198543 - protein, 123 aa, Triticum aestivum
  Clone ID: PAT_TA_92961.pep
LVPNSARAFFQEVFNYVGCKVEWLKEEGCGTHDNGVTIALATVTGPLRKILRGKRIALNVLSRCSSIATQTDKMISIARNAGFKGSLAGTRETTPGFRLVEKYGLIIGGADAHRFDLSNLTSP

SEQ ID NO: 198544 - protein, 76 aa, Triticum aestivum
  unsure (1)..(76): unsure at all Xaa locations
  Clone ID: PAT_TA_92962.pep
SNXRRLLCPXXSKEIHIIAEXLHIKXVRGVTITXTLGXXXETNIGWXKHXXLPSFNQETSXDLSPKXXXLFGXTSP

SEQ ID NO: 198545 - protein, 130 aa, Triticum aestivum
  unsure (1)..(130): unsure at all Xaa locations
  Clone ID: PAT_TA_92963.pep
MAPTVMASSATSVAPFQGLKSTAGLPVSRRSNGASLGSVSNGGRIRCMQVWPIEGIKKFETLSYLPPLXTEGLLKQVDYLIRSKWVPCLEFNKVGFIFREXNASXGYYEXRYWDKCXKLPNVXVQPTPTQ

SEQ ID NO: 198546 - protein, 143 aa, Triticum aestivum
  unsure (1)..(143): unsure at all Xaa locations
  Clone ID: PAT_TA_92964.pep
RSPASDDYMLHFALGIAERAVGASAMIVNTFDDLEGEAVAAMEALGLPKVYTIGPLHLLAPSSSISMSLWKQEEECLPWLDGKEXAQVMYVNFGSITVMTNXQLLEFAWGLGQXSGNHFLWIIRPDLVKGDTAVLPPEFSAET

SEQ ID NO: 198547 - protein, 76 aa, Triticum aestivum
  unsure (1)..(76): unsure at all Xaa locations
  Clone ID: PAT_TA_92965.pep
FTLTTDSSQFSLLLHWXQSMIQHHIQITKNEYYNARFLRFSAPPFSELLRIFCGFNLQIYVDMCFKKLQINLXSTA

SEQ ID NO: 198548 - protein, 107 aa, Triticum aestivum
  Clone ID: PAT_TA_92966.pep
TRAFGEYLIFINQQISLATIPLTMRFSSITIILQSASIFFTTVAGVTTNQIDEPRKSFVCNGVTIKFNKFGHQRSLVEDAASKFQPGSLYQIYTYELTQAHQERAYL

SEQ ID NO: 198549 - protein, 126 aa, Triticum aestivum
  unsure (1)..(126): unsure at all Xaa locations
  Clone ID: PAT_TA_92967.pep
APLXNLRLENPXXWPFHPTAAAEACPDXPKHPGPGXPFSWXTXPVXRPXEVRPXEPLLXLTPQDGIEVGARXTGVHXAXNRGLRTDVGRSXRAXQXCRRDGCRQLXRRWRTIECSRADEVGLAXXK

SEQ ID NO: 198550 - protein, 123 aa, Triticum aestivum
  unsure (1)..(123): unsure at all Xaa locations
  Clone ID: PAT_TA_92968.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLGXVSPRDTIDNVKGKDPRTKEGIPPGPSKRLI

SEQ ID NO: 198551 - protein, 69 aa, Triticum aestivum
  unsure (1)..(69): unsure at all Xaa locations
  Clone ID: PAT_TA_92969.pep
LLAKXVXXXVHXEGALFVKHFXXVERXXPASWSXSXEHLLGLCHPVMKXCXXPMGTFLGSLWLXXHHXX

SEQ ID NO: 198552 - protein, 62 aa, Triticum aestivum
  unsure (1)..(62): unsure at all Xaa locations
  Clone ID: PAT_TA_92970.pep
IXISSPSXFTIFHHVTSRSXXQLPKDILCLSXXKNXETLNGTSRHXVIHGMNLMLNXRWAAR

SEQ ID NO: 198553 - protein, 117 aa, Triticum aestivum
  unsure (1)..(117): unsure at all Xaa locations
  Clone ID: PAT_TA_92971.pep
MCSSDHFASNNDLYLQPNHQRGAGIMEACDLDRSGHGQSRHGQEAEEHRSDPSAALTTYLTFLEXKIGHLRGILCSTPRHPQQQRAIVSAELRCIIVQLVSIANYLDSXSRAPGAAD

SEQ ID NO: 198554 - protein, 68 aa, Triticum aestivum
  unsure (1)..(68): unsure at all Xaa locations
  Clone ID: PAT_TA_92972.pep
SRVYVAXAREREHXGVGLFLPRHGRSXXSXLPXAPLAXXLAXSIAXXTHLXARRRSTTSTNLVXNSAX

SEQ ID NO: 198555 - protein, 102 aa, Triticum aestivum
  unsure (1)..(102): unsure at all Xaa locations
  Clone ID: PAT_TA_92973.pep
TXFXXXXLSTLIXTXGGGGGXPPPLPTXLELXXSPXSSXFXTISILPLPFCXHPXDXPTFHXYXTHXPSXXPTRHYXSXPFXFSPXXPXLYPTKHIXLHTSS

SEQ ID NO: 198556 - protein, 72 aa, Triticum aestivum
  unsure (1)..(72): unsure at all Xaa locations
  Clone ID: PAT_TA_92974.pep
TLLIKKVLFALTGSVTVGEYSELXTLPHSLAMLELPLSASLSDALDAFISFKVAXSLDLRSRGSXLGLLGFF

SEQ ID NO: 198557 - protein, 61 aa, Triticum aestivum
  Clone ID: PAT_TA_92975.pep
TVFIAYYRVLASSLNTMHCNLNMTSEEFDDSVRCYSSDTSCGSNSKRMFLFWVLDSCVPKY

SEQ ID NO: 198558 - protein, 139 aa, Triticum aestivum
  unsure (1)..(139): unsure at all Xaa locations
  Clone ID: PAT_TA_92976.pep
QPFRTFXTAQTDIFKXPTKYGGKYTVTLIPGDGIGAEIVDSVKTIFKADNVPVEWEQIDVTGVETGEKLSEDLFRESITSLKRNKLGLKGILHTPIKRSGHQSFNVAMRQELDIYASTXVIKNIXPGYKTRHEKCLXCA

SEQ ID NO: 198559 - protein, 123 aa, Triticum aestivum
  unsure (1)..(123): unsure at all Xaa locations
  Clone ID: PAT_TA_92977.pep
ILCDFEKIXPPXFFDVMVDLAWMYPXQRRLXTFKXYVKNRARPGGSIAEAYIATEALTFXCSKYIETTDQLSKEVGEDNPGLNVFDYSDRVTGKSQQEDKPKDLDKMVWYVLINCPEILPYIK

SEQ ID NO: 198560 - protein, 92 aa, Triticum aestivum
  Clone ID: PAT_TA_92978.pep
MGLAFSKIFDKLWGKKEMRILMVGLDAAGKTTILYKLKLGEIVTTIPTIGFNVETVEYKNIQFTVWDVGGQDKIRPLWRHYFQNTQGIIFCG

SEQ ID NO: 198561 - protein, 81 aa, Triticum aestivum
  Clone ID: PAT_TA_92979.pep
MTFGLRIPKIINFNTDEEYAHNEIIRSTGEQQVHNPVRAIAPGKHSLKQLVNAAQSQKEALEESFAKGKSNRAEASSRYGW

SEQ ID NO: 198562 - protein, 140 aa, Triticum aestivum
  Clone ID: PAT_TA_92980.pep
WTSEATPHAYYDQLETHLKFLHASPPLISRMLHIFITIGFSGFFIKLFKPSEANLLFDGASLVLYVIGVVVYISNIVKGLRIVTSGNYGLKEGNTELAIGREESLKVLAASNTILALVLIGVLVLQAGQWYAERKEIGWR

SEQ ID NO: 198563 - protein, 142 aa, Triticum aestivum
  unsure (1)..(142): unsure at all Xaa locations
  Clone ID: PAT_TA_92981.pep
GGGGSKTKWDSPGLQGIRHDSDVDCVVNFASSXSVYTSTMELMEYPQIKXIAIIAEGVPERRAREILHVAKKKGITIIGXPPTVXGIKPGSFXXIGIXXGMMDNIVASKAXYEKGXVGYVPKIESKSKYHPTTNVVPKGGWE

SEQ ID NO: 198564 - protein, 78 aa, Triticum aestivum
  unsure (1)..(78): unsure at all Xaa locations
  Clone ID: PAT_TA_92982.pep
MGFEKIKVAXPIVEMDGDXMTRVFWQSIKDKLIFPXLXLGIKXLWXWGVPHRDXTDXKGSXGGXXGYPXKYKCGXIKL

SEQ ID NO: 198565 - protein, 150 aa, Triticum aestivum
  unsure (1)..(150): unsure at all Xaa locations
  Clone ID: PAT_TA_92983.pep
PHRPSIHAXVSLFSSGXPXVPLASVEGSGAXTSLRNGRGSPASXXFPSLSSPSRGPPXTLAASXGLPGALAPYLAEAHLXAXLPSLSRILXWNRTKAKSAXALVAKLREAHPGSGRRRSTVRQVSGGTIRLGCRERGVPEGRICVGGKLA

SEQ ID NO: 198566 - protein, 77 aa, Triticum aestivum
  Clone ID: PAT_TA_92984.pep
LGPLFPPCRGSVLASHGLQPLGDLILLSYLILFISFYISTYRKQSSRKAAAKVAAVRASEEAKGGSINTSSTRIIKT

SEQ ID NO: 198567 - protein, 121 aa, Triticum aestivum
  unsure (1)..(121): unsure at all Xaa locations
  Clone ID: PAT_TA_92985.pep
DSPXKLVNVSRXHLSHSSQIESDXLRTNDGXSTNTFFAREKYKSLRDISSSVKDXEYPSLIRSNPVRKSTSXPARNTSXIQTITIGFSIKLRLAMXLKNHVQLDILWKDAARWAGTXIMES

SEQ ID NO: 198568 - protein, 119 aa, Triticum aestivum
  unsure (1)..(119): unsure at all Xaa locations
  Clone ID: PAT_TA_92986.pep
KNQXIXVQLDYTPXPXWSALETPTXMTLLPYSMKLAQEWLLRRRGKLQPQSSRSISSCNREIRTALEXRHTDLRLRRVDPSNAPTCWLLRIRFGSKLSQRPRLNPGRPTGCSRLVPWHR

SEQ ID NO: 198569 - protein, 62 aa, Triticum aestivum
  unsure (1)..(62): unsure at all Xaa locations
  Clone ID: PAT_TA_92987.pep
SCLVPNSARGYILYNIGLIHTSNXEHTKALEYYFRALERNPFLPQAFNNMAVICHYVRLSPL

SEQ ID NO: 198570 - protein, 65 aa, Triticum aestivum
  unsure (1)..(65): unsure at all Xaa locations
  Clone ID: PAT_TA_92988.pep
VPGTHLSRXXVAXRAPDGEEERRKTFRKMRXPHSAREXGREVANPAIGVESRPXPAPARAEFGTT

SEQ ID NO: 198571 - protein, 58 aa, Triticum aestivum
  unsure (1)..(58): unsure at all Xaa locations
  Clone ID: PAT_TA_92989.pep
PGFAIGIVGDAGVRGTAQQPRLFVGMILILIFAXEVLGLYGLIVALLMNSKASLDVSC

SEQ ID NO: 198572 - protein, 57 aa, Triticum aestivum
  unsure (1)..(57): unsure at all Xaa locations
  Clone ID: PAT_TA_92990.pep
RSEFLILSFTTPQVGEISCYLLLPISDRVETVVLILFLDCLGTVPYCLPHLXPNSAR

SEQ ID NO: 198573 - protein, 111 aa, Triticum aestivum
  unsure (1)..(111): unsure at all Xaa locations
  Clone ID: PAT_TA_92991.pep
MSTEKIPNKITLISNDGAVITVDSQVAMKSVLIKNMIEDLGDAVAESDVPIPNVNESVLRKVIEWCEHHKHDPAPAADDDSDSRKRTTDIEEWDQKFMQVDQXEMLFEIIL

SEQ ID NO: 198574 - protein, 135 aa, Triticum aestivum
  unsure (1)..(135): unsure at all Xaa locations
  Clone ID: PAT_TA_92992.pep
MRDDPEDVDSRSIFVGNVDYSSSPEEIQAHFQSCGSINRVTILLDKFTGHPKGYAYVEFTEPSFVAQALVLNESVFKGRNLKVVPKRTNIPGMTRGKXRGGPRGRGYGGRGXTHQEESGYRGGFRGSRGRGYSPY

SEQ ID NO: 198575 - protein, 61 aa, Triticum aestivum
  unsure (1)..(61): unsure at all Xaa locations
  Clone ID: PAT_TA_92993.pep
WQGXAVRAXSFXCXAVVGXWFLXXEXCRANDXDDLYHRFFIILWLTCQKKKKKNLVPNSAR

SEQ ID NO: 198576 - protein, 114 aa, Triticum aestivum
  unsure (1)..(114): unsure at all Xaa locations
  Clone ID: PAT_TA_92994.pep
LLFYLSSTCKGLLPLHSSFHVLYLSVYQLTPPHLNSTNDTSIRLMNPMPVAKFVHPARXYSRRVTFKKQLSELVISCTSRTYLMLAQECVEVRPEFPRMFTGIIADEVGHNLHX

SEQ ID NO: 198577 - protein, 78 aa, Triticum aestivum
  unsure (1)..(78): unsure at all Xaa locations
  Clone ID: PAT_TA_92995.pep
AGXXPXXRNRXXSTAGGAXMXCCXSVVLGXXPGVXXCGQDVRRKLAREDIXTKEGEESVKRRKXIGRGGDVEXVVAXT

SEQ ID NO: 198578 - protein, 147 aa, Triticum aestivum
  Clone ID: PAT_TA_92996.pep
DGYLKEKLVTWLSPAALALHQITWDDPASLLEKIVAYEAVHPIRNLIDLKRRLGVGRRCFGYFHPAIPGEPLIFIEVALLKDMATSIQEVLLDVPPIAECEAKCALFYSISSTQPGLSGINLGKFLLKRVIDMLRKDMPSVQIFATL

SEQ ID NO: 198579 - protein, 151 aa, Triticum aestivum
  unsure (1)..(151): unsure at all Xaa locations
  Clone ID: PAT_TA_92997.pep
RSGVKASPPGGGRVVVRXPLLXPXPPALVAQRXDFSXWWGIPAPSEEGKPKRNSSEEGIDYRTXTRRLXREKAGGQXDEERDRAGRESAQRGYIVPSGQSTSRSADEMLEDDGPVGNGKASSPPLXADEMHRNDRHISCRIRHELVPNSAP

SEQ ID NO: 198580 - protein, 66 aa, Triticum aestivum
  unsure (1)..(66): unsure at all Xaa locations
  Clone ID: PAT_TA_92998.pep
EVVRRRSSRSEXSIAAVRSRRGGPASPPGXGQAAXPAAPTAACPRQERGASIVXVSCDCPWXXXRR

SEQ ID NO: 198581 - protein, 66 aa, Triticum aestivum
  Clone ID: PAT_TA_92999.pep
RAEFGTSPDNTFPANLTLGQTVFHALRLHFLSDRTIQLSNLQSSPTLFPFLKDEGLTVLHRVRCIV

SEQ ID NO: 198582 - protein, 76 aa, Triticum aestivum
  Clone ID: PAT_TA_93000.pep
MALSTMALSSPALAAKQAKIASFNVFGEGRITMRKTAAKAKPAASSSPWYGPDRVLYLGPLSGDAPSYLTGEFPGD

SEQ ID NO: 198583 - protein, 134 aa, Triticum aestivum
  unsure (1)..(134): unsure at all Xaa locations
  Clone ID: PAT_TA_93001.pep
LKKCQSCKASXDDINKALRTKPNVTVDQAREKLPEQVREFAHLFADGGGADELPPLRGTLDHAINLQQQDGKPLSPPWGPLYGMSREELLVLRKTLTELLKKGWIRPSNSAAAAPVLFAKKPNGGLRLCVDYRG

SEQ ID NO: 198584 - protein, 75 aa, Triticum aestivum
  Clone ID: PAT_TA_93002.pep
AQSFTSGTVRSLSRGHSRYEHNHPHGRGGFMCESLLDPTPATFIHLGSPWVNGIAFLTWDFTTQLDSLQPHKLAP

SEQ ID NO: 198585 - protein, 78 aa, Triticum aestivum
  unsure (1)..(78): unsure at all Xaa locations
  Clone ID: PAT_TA_93003.pep
CQXRRGXSTLGPSXTQSTXYGCRSXLRQLTFLRSRXEPTVTSTSYLDPMLTVLPPSXRXMEEANGMXCLXALVPNSAR

SEQ ID NO: 198586 - protein, 97 aa, Triticum aestivum
  Clone ID: PAT_TA_93004.pep
IHHYSALQAHWIPVAYSCHNPSFSTAICMSILLPNAHRYVDSKACFVQRRRGTGLAGRRILQNRIEPERNRASSRSLLTGRRFGVGACSSSCRIRHE

SEQ ID NO: 198587 - protein, 110 aa, Triticum aestivum
  unsure (1)..(110): unsure at all Xaa locations
  Clone ID: PAT_TA_93005.pep
GGKLWENRQNYEKWDPAPXLQHWATPHLVIHNELDYRLPISEGLATFNVLQSRGIESRFLXFPDENHWVLKPENSLVWHKEVLGWINKYSGVAEEQEAFRRGFSQIVVSR

SEQ ID NO: 198588 - protein, 68 aa, Triticum aestivum
  Clone ID: PAT_TA_93006.pep
FFFFFFFFFFFFFFFFFFFRSYDDLHFLPFKPSSNIGYSNITSQSMTEGIAASPTTDRPRLKDNTCCF

SEQ ID NO: 198589 - protein, 147 aa, Triticum aestivum
  unsure (1)..(147): unsure at all Xaa locations
  Clone ID: PAT_TA_93007.pep
RAEFGTRHALESDIXVGSALVDMYAKCGCLAXXRAVFDRLPRRNVITWNVLIMAYGMHGLGGDAVALFDXMAAGRRGGAQXRSPSSPALGGXCSHSRGWFPTGLEACSGNGRGTNKRTPGLPPPLVNLASGPDGGEFQKGVQSIPFP

SEQ ID NO: 198590 - protein, 153 aa, Triticum aestivum
  Clone ID: PAT_TA_93008.pep
LVPNSARGEREPIGRVAASAIAEKYLRLTYGIEIVSWVSSVGNLHMFPPTSEHPTPSTNPEFLSLIQTITREKVDEFGPVRCPDAKVSAEMAKLIAQYRDQHDSIGGTVSCVIRHVPSGLGEPTFDKMEAMLAHAMLSIPASKGFEIGSGFGG

SEQ ID NO: 198591 - protein, 92 aa, Triticum aestivum
  unsure (1)..(92): unsure at all Xaa locations
  Clone ID: PAT_TA_93009.pep
VRKQSFFALPLASLLELFVERIPLFIGRWNXXGIMYPGFXRKTLWFFMDPLMHXYVRXQGKAILXASKGTFFLKKKWKCYLINLCSCRIRHE

SEQ ID NO: 198592 - protein, 63 aa, Triticum aestivum
  unsure (1)..(63): unsure at all Xaa locations
  Clone ID: PAT_TA_93010.pep
FSXGKGGGPGWXVXASLXADIDXRGYVIIPPLCNGAGILLISECLXXHXLXVYXMXSYGFGRX

SEQ ID NO: 198593 - protein, 87 aa, Triticum aestivum
  Clone ID: PAT_TA_93011.pep
MSKDVAADIPAAEAPAKRAPLNKYALACAILASMNSILLGYDVSVMSGAQIFMKRDLKITDAQIEVLAGIINIFSLVGSLAAGRTSD

SEQ ID NO: 198594 - protein, 51 aa, Triticum aestivum
  Clone ID: PAT_TA_93012.pep
RAEFGTSLMSLGLVYCEHVLSLICVECLIYVPYLVAYCYTDDLALKKKKKK

SEQ ID NO: 198595 - protein, 66 aa, Triticum aestivum
  unsure (1)..(66): unsure at all Xaa locations
  Clone ID: PAT_TA_93013.pep
AGILMHHAVYDRVSRLGQNGDLTSEENRILLAEFYLRHXESTATVIHEYAKRKANNLVAKLDRSDC

SEQ ID NO: 198596 - protein, 48 aa, Triticum aestivum
  Clone ID: PAT_TA_93014.pep
ALRTRTPEEVETLLRGCGVSLDDWKLLSGTEQHTWPIGNMSWVIALKR

SEQ ID NO: 198597 - protein, 130 aa, Triticum aestivum
  Clone ID: PAT_TA_93015.pep
MSKMNAEMGKQNVTYKVSSRKPLSQDYREFLSRALRVNQAGELAATLIYKSQIPPLVAAHPSLRPLMQHMHDQEAGHLHKFNQLIARHRVRPTAMYPVWTIAASVLGWGTAMMGREAAMACTEAIETEIG

SEQ ID NO: 198598 - protein, 97 aa, Triticum aestivum
  Clone ID: PAT_TA_93016.pep
MASMDYENENSARYEEEPSRYEHDRSASPRPSRRNDSPRERPRRSASPSGNTHVDSRPPKGDTRGAPPDDGAINPGSNLFVTGIHPRLSEQDVTRLF

SEQ ID NO: 198599 - protein, 105 aa, Triticum aestivum
  Clone ID: PAT_TA_93017.pep
VYSFGVLVLELFMGHHPGDFLSSMDNNSQSTSLVNFLDTRLPLPEAEIARKIFKVISVAVWCIEPDPAHRPTMQQVIKAFSTAEQSPANNVNYLHTAIVIPACWS

SEQ ID NO: 198600 - protein, 94 aa, Triticum aestivum
  unsure (1)..(94): unsure at all Xaa locations
  Clone ID: PAT_TA_93018.pep
KVFPAMSFPCTXIQVLKITLILLASXTNYQQEIISQPQIRRSKHSQPWSQGDREVLTRWLVRKLEPSMSSLLLVAHSKELHVGWDLAHVISSVL

SEQ ID NO: 198601 - protein, 121 aa, Triticum aestivum
  Clone ID: PAT_TA_93019.pep
SRIPCFPFFFFFANPSPFRPETHAPVPWTQGAEPSSGAAPSLWHPRRYSPRPRTLPCRSRTPGRTTTDRRPLPLEHRPQQPISARAQAAAAPLRLSIDRSHPTHSYKREKKIPFSHRRRLL

SEQ ID NO: 198602 - protein, 70 aa, Triticum aestivum
  unsure (1)..(70): unsure at all Xaa locations
  Clone ID: PAT_TA_93020.pep
LKDNSSFXEKLXIPGQNELQYCSSQFKRGPITFSDVSTKPRVPVVNQPFEVDMKGTLHVPLSXPGKNSGL

SEQ ID NO: 198603 - protein, 135 aa, Triticum aestivum
  Clone ID: PAT_TA_93021.pep
EFVQRITDGQEYAQASMAFVQQRMESASNQKRLPQERFEEGDLVWLKLKNIETPQLSKKLSWVNAKYRVLKVISPHVVELDVPSGIHPRFHVDLLKRDPQNPLPSQIMLDEQPPPLVNPDGDNEQFVEKILRAEK

SEQ ID NO: 198604 - protein, 109 aa, Triticum aestivum
  unsure (1)..(109): unsure at all Xaa locations
  Clone ID: PAT_TA_93022.pep
GAXLXQXVVKAGSTXLAAVKPTPTTPRXAVFXLXPRXNQGRXSXIXAXFPGALXQTXFGKGXNPVAGXXLSXYXXPSLGEKGGDCXLQRAILRFGXNRQGFFPQFXEXL

SEQ ID NO: 198605 - protein, 142 aa, Triticum aestivum
  Clone ID: PAT_TA_93023.pep
RAEFGTSLHDLRPPRNTPSPLAIATGSPPASSTLTATTTTLSRYPSTSFSFSSFDECSLPDAATWPSGIGSYLGYGSSSGTSYNGPNKGTFKAALSSIHGRQQGSAASLYQPVHVLQRAAELKKWWHEARRRRSCSLIRSPR

SEQ ID NO: 198606 - protein, 133 aa, Triticum aestivum
  Clone ID: PAT_TA_93024.pep
MDEASVSVSNRPLQSLPASMQTYIWHATLPLAITHASSVVPYLLHVPRLSYLPLVLPRLNLFFGPGIVGSSFSHHGRALPNLPIGLLFDIFAPPLPWALELGNSPVYETHDTFINSLKEADFVRNGTARGRTG

SEQ ID NO: 198607 - protein, 155 aa, Triticum aestivum
  unsure (1)..(155): unsure at all Xaa locations
  Clone ID: PAT_TA_93025.pep
SCRHHPLFLLQRLHTENRQFAEPLPTPHTPPILSMMEIDLSLNSVSLVAALGVSAYLVDQCITPPNPAPSASIEYGNDSMQVIHKLELLRPWAFLVWFLHYALILFPHNRESICLNPDLLNEGPLYLEIKTTXIYILVILVGCYQAESLPNGPNF

SEQ ID NO: 198608 - protein, 115 aa, Triticum aestivum
  unsure (1)..(115): unsure at all Xaa locations
  Clone ID: PAT_TA_93026.pep
IVQNLYGDTSFTMIGVPMPLFSRVQMFQLSTKRVAFKITGQILRCINSAPPQSAIVSPITLTGLPPLPPQSLSSNNEEAKARILRRREQAQILNRGTNSQLTANEGIKGRXFWKE

SEQ ID NO: 198609 - protein, 150 aa, Triticum aestivum
  unsure (1)..(150): unsure at all Xaa locations
  Clone ID: PAT_TA_93027.pep
MVNLTTQKRLAASVARCGERKIWLDPNEISEISNANSRQTIRKLIADGLIIKKPVTMHSRSRARELAAARKLGRHRGFGKRKGTADARMPSQVVWMRRLRVLRRLLVKYRASGKIDKHLYHELXHLSXGNXFKHKRAIIXQXHRAKXKKA

SEQ ID NO: 198610 - protein, 158 aa, Triticum aestivum
  unsure (1)..(158): unsure at all Xaa locations
  Clone ID: PAT_TA_93028.pep
LEVKXQAGLTRWNXVPRRLLKSAWLPHRQEPKXLADYPPKEQVQLFLANLYFKASDRMIEVLKSSTNPYPMIQRWLDTADGVVLPYLLEVEEEPDQKVVNDLTRFALKNCANNYAXFISRLKAVKKLIRKXSPPSKRELPVNEEDKGTLPSKYFPCLM

SEQ ID NO: 198611 - protein, 93 aa, Triticum aestivum
  unsure (1)..(93): unsure at all Xaa locations
  Clone ID: PAT_TA_93029.pep
KTEHVLGSXFMDGRYVSPXRCFSRGGLIXLEFDGLPGXFPRXXRXTVRAXLLVTPLEXPAKLYISDGXASXSGEEVICHSFXRVAXMVXPEPR

SEQ ID NO: 198612 - protein, 149 aa, Triticum aestivum
  unsure (1)..(149): unsure at all Xaa locations
  Clone ID: PAT_TA_93030.pep
HTECLPDLIKLACLLPAKEDSLRTVITKYLLXVSGRYGKDYLEHIMLPVFLIAAGDIDSXDFTYFPLXSKSKVRXFRPKTSVAEKIAIICVLPLLLSGILGSPSSRQQLEXEYLRKLLIQNTKDXSFSMHHTAEIIDAIRFLCIFEEQQ

SEQ ID NO: 198613 - protein, 112 aa, Triticum aestivum
  unsure (1)..(112): unsure at all Xaa locations
  Clone ID: PAT_TA_93031.pep
MTQTGAAGLLQRQLKYMQXAKDLPGISCGLLENDIFVWEVMLMISDDCKYYXGXNFCCLLAFPSEYPLLQPTXTFRKPIPFQPKIXAXGRLCISNLHATGVKINMGKSATGR

SEQ ID NO: 198614 - protein, 136 aa, Triticum aestivum
  unsure (1)..(136): unsure at all Xaa locations
  Clone ID: PAT_TA_93032.pep
RAEFGTRLPPRPALKSSLGSSAHPNRASPPXSPRAPLSPPASSPAPPPSPAPAHSPPXPPASPAAQAPPRLLSAPXRATPPSPAPPPPSPRRAAGPPPACCSATPARAKGRRPRAAWAPSTGKCRTRAEELHGWKG

SEQ ID NO: 198615 - protein, 162 aa, Triticum aestivum
  unsure (1)..(162): unsure at all Xaa locations
  Clone ID: PAT_TA_93033.pep
RAEFGTSFSSXSLQQLAIPSIRKYLRLPHXSYNSSLFXPQLNREIKFSNKSSHPKKIQEKFVIHDNSSMKIFSLVTLXAILNCLTPVLATSNYQCHNKXLXAQYINRAVAKEYNRLGQNLGIKYGAREQNGRRIFNNYCKLXIKTSISVKSHYRXLRRTKRS

SEQ ID NO: 198616 - protein, 83 aa, Triticum aestivum
  unsure (1)..(83): unsure at all Xaa locations
  Clone ID: PAT_TA_93034.pep
VPAGWSRRIRGXXGXRKKESGSXRKRSAWGGGNRGRXDFRSGRGLIKRIWGGGXRLSRACVREKQGAGIGEISLVLRRVFILG

SEQ ID NO: 198617 - protein, 116 aa, Triticum aestivum
  unsure (1)..(116): unsure at all Xaa locations
  Clone ID: PAT_TA_93035.pep
GALSEMYLLSTCDVFVTTGFSTFGYVAQGLGGIRPWIMPSTPIWSESDLVEKKEVPEPPCVRAMSVEPCFHSPXXYDCTARRDVDVGKVVPYVRHCEDVSWGIKIAKPKASPVLTL

SEQ ID NO: 198618 - protein, 120 aa, Triticum aestivum
  unsure (1)..(120): unsure at all Xaa locations
  Clone ID: PAT_TA_93036.pep
LAPVTAMAIHQGPELIAAPNRNSDFSFYCRSGKSYNKNYLMGEVRDAINLIGESRTFLIHPEPFEEVQYQISGEQWFYPLQAYYGSRDHVVFTRDAQVAGVXHLMIRDNXERYYDPCIIT

SEQ ID NO: 198619 - protein, 117 aa, Triticum aestivum
  unsure (1)..(117): unsure at all Xaa locations
  Clone ID: PAT_TA_93037.pep
RNPRPPRLAGMGSAASPPRGLXAXXXEDLXRVSAHRAXXMVESGMXLGLXTXSXXAHALXRLGGLLRTGALRAVAGVATSLXTEEHTARRRDHARRRRRNLLTGISSSRLKGPCSSP

SEQ ID NO: 198620 - protein, 139 aa, Triticum aestivum
  unsure (1)..(139): unsure at all Xaa locations
  Clone ID: PAT_TA_93038.pep
RGSTHRLRRGRHWRPXPEPTPETRWEVRGWPLVPAGADLGGWEGPAVREDHGMCFAVAGLAERRRNQPPPVAQRGAARREKLDARGMGGWGCGGSGSLRGCEMGGWKEKGQRRGVAEEGDETVGGGDLGETRAIGGSVS

SEQ ID NO: 198621 - protein, 116 aa, Triticum aestivum
  unsure (1)..(116): unsure at all Xaa locations
  Clone ID: PAT_TA_93039.pep
MLNNNMAPRSASXRKQXILCACYDCWRLGXTTGDFLMHSLXTXVKTRQQXDTHTPPKYTSMSSSXSTILRXEXXXRSLYXXWGPALLGQFLXLXXLXGTYEYSKKXMIVPGFTISN

SEQ ID NO: 198622 - protein, 194 aa, Triticum aestivum
  unsure (1)..(194): unsure at all Xaa locations
  Clone ID: PAT_TA_93040.pep
MXGLYEKTSETYXKKRARYPXEWFSMLASLTAGQQXAWEAGCXSGXASVSIAEHYNXXVXTDVSEGQVRHAIAQPKVXYLHTRXTPXGRTLPLVXGXGXLXLVILGNAXXWFDVPLFYXVVKRVLXXTGGVLXXWGXKLXHQXFGDKLHXTLFPACGVIXXRQGMGQLRSFPPVAQSRSIRGITGDRFIRSHKR

SEQ ID NO: 198623 - protein, 80 aa, Triticum aestivum
  unsure (1)..(80): unsure at all Xaa locations
  Clone ID: PAT_TA_93041.pep
RLXCQXLXLGVFLSDXKXNVXSLGVXXNKFLVRNNYPLLVRYITKLNILSENSSLSKINDLSNVKKKKKKLETSCRIRHE

SEQ ID NO: 198624 - protein, 155 aa, Triticum aestivum
  unsure (1)..(155): unsure at all Xaa locations
  Clone ID: PAT_TA_93042.pep
XRNHXLXQDSLYCXXLISSXRTXXEEAXRIRAHYCSVLXCXERQPVTPGTLKSXLXWVQNGTXIHVMAXPEXFIKSXKXQLIXILSHHLDSHLXVYXTQHSAXLGRRHAIIGSYFXRFXPXXXTQSIVXELXRXPHXLGFTRKFSWXIXAXNNPL

SEQ ID NO: 198625 - protein, 99 aa, Triticum aestivum
  unsure (1)..(99): unsure at all Xaa locations
  Clone ID: PAT_TA_93043.pep
FGHVFTDHMLSIEWXEXTXWXSPRITPYQKLQIDPAGCVLHXASECFQXMKAYRDXSNXXRXFXPTKNMXRXNRXTARIALPXFXSXXKIELISKLGKL

SEQ ID NO: 198626 - protein, 153 aa, Triticum aestivum
  unsure (1)..(153): unsure at all Xaa locations
  Clone ID: PAT_TA_93044.pep
SCRIRHEPALTSLSFLDINLAELTEEGLVTLGELPALLHLVLWFRTRPDDRVIVRGFPSLKQFTIYSNDASAYVTFVKGSMPKLKKLDLLINVSTAKTYGFHLGIEHLTCLKQATARLDNRGATPSERKAAKAVIKVEASAXPNHPAVTICDE

SEQ ID NO: 198627 - protein, 70 aa, Triticum aestivum
  unsure (1)..(70): unsure at all Xaa locations
  Clone ID: PAT_TA_93045.pep
XHVVDPLXGVDGXXXLGXPVQRRXRXXAXKXXHPPVEAXVLHXLVDQQXHXMVGDAAEXPHDVXRAXFGX

SEQ ID NO: 198628 - protein, 50 aa, Triticum aestivum
  unsure (1)..(50): unsure at all Xaa locations
  Clone ID: PAT_TA_93046.pep
MXPTXMGSXXXSVAPFXGXKSXAGLPVXRRSNXXSLRSXXNSXRIMXMQV

SEQ ID NO: 198629 - protein, 126 aa, Triticum aestivum
  unsure (1)..(126): unsure at all Xaa locations
  Clone ID: PAT_TA_93047.pep
VCTRPSGHLLPPRNTRSAERXGAAALGTELLXEARAPGFXAWLRGXRPXXXKTGAGXXXKRNSALVRAELDALGVXYVWAIXRNGVVATXSXGVXGPVXXLRGDIEALPIQEIVGWEXXNKGXGED

SEQ ID NO: 198630 - protein, 112 aa, Triticum aestivum
  unsure (1)..(112): unsure at all Xaa locations
  Clone ID: PAT_TA_93048.pep
PCRIGTKWASVFKLEYNXQAACLAQSPXLYKQMSICGGLXRXFEVGPVLTAXKQXTHRXXCEFIGWXAEMEIKXHYLXXCEIIHGXFVXIXKHXNEXCQKEXVTINKQXPFV

SEQ ID NO: 198631 - protein, 68 aa, Triticum aestivum
  unsure (1)..(68): unsure at all Xaa locations
  Clone ID: PAT_TA_93049.pep
PPLVPNSARXSVQCSLLLRCMLDWFLGQLLINPVKLKEILSQCFFFTSDLPGPXRSAIYNGVTFLFKK

SEQ ID NO: 198632 - protein, 122 aa, Triticum aestivum
  unsure (1)..(122): unsure at all Xaa locations
  Clone ID: PAT_TA_93050.pep
LXXQLRGGNANKXILXSADCTGKIXVXSVKRXKKXXVDKKXMVPICGQKLXKXXVAQXTXKXXSXXEXTXSGXXSXGXVQAXILDKTNRPIXXERGGPXRKIXLSXHMXQFHXKSXYXKGXG

SEQ ID NO: 198633 - protein, 85 aa, Triticum aestivum
  unsure (1)..(85): unsure at all Xaa locations
  Clone ID: PAT_TA_93051.pep
LVPSNXQPXMSLSGWVREVLSSGEKALWCVRSSGKLWLCAXLXXARFAGVQMVXXLXEPLDPAKYSLTXPEKSXXLVLXNPDGVS

SEQ ID NO: 198634 - protein, 68 aa, Triticum aestivum
  unsure (1)..(68): unsure at all Xaa locations
  Clone ID: PAT_TA_93052.pep
LXPRFSXXTXKRRXWARXSTPLXNLXPAPXXFFFFFFFXXXIEVVRLSALIQNKTSLLGVRVASRRXL

SEQ ID NO: 198635 - protein, 140 aa, Triticum aestivum
  unsure (1)..(140): unsure at all Xaa locations
  Clone ID: PAT_TA_93053.pep
MARTKQTARKSTGGKAPRKQLASKAARKSAPSTGGVKKPHRYKPGTVALREIRRYQKSTELLIRKLPFQRLVREIAQDFKSDLRFQSSAISALQESXVEAYLVSLFEDTNLCAIHAKRVTIQSXKDIQLARRVRGEALLT

SEQ ID NO: 198636 - protein, 162 aa, Triticum aestivum
  unsure (1)..(162): unsure at all Xaa locations
  Clone ID: PAT_TA_93054.pep
SXEVFRVXTGSTVNAXXXSPLXCRPLGFFFLNXGIXLPCSIGXQVDTXXSMRIXSXIHHIVSSTXDXSLXFRVCMSQXTTHSNSVFLVLHILIHFFXFLSFLLDSCDTXHSRTWFYVLXPQYIXXYXISEVIFLYTCKPFRXAVQSRPPXRCXEWNHFECXV

SEQ ID NO: 198637 - protein, 153 aa, Triticum aestivum
  unsure (1)..(153): unsure at all Xaa locations
  Clone ID: PAT_TA_93055.pep
IAFNYSSLHPTNLGHLITTFLLPVIVIMKFLYSASLMSLFTLXLSKCKYVCPGGYEITEEKLLVVTDKVDRXPKKKHDTIWKTETSIHVMFDLEKTKINNTEYLITGQIYTPKNITWLYETEXETGKKSYCDNXEVNEEDEXSYDESFEXNFP

SEQ ID NO: 198638 - protein, 102 aa, Triticum aestivum
  unsure (1)..(102): unsure at all Xaa locations
  Clone ID: PAT_TA_93056.pep
KSAQYLXRXSXMRHNRKXXNDQDXQSTINSQIARYNGTHLTIXNYEHKVQLKSCGPRNXMXNNTPWMGEGDXIKLPPTKKXLHKXSLXSSTWTXXNRXSQRP

SEQ ID NO: 198639 - protein, 115 aa, Triticum aestivum
  unsure (1)..(115): unsure at all Xaa locations
  Clone ID: PAT_TA_93057.pep
XTRXRLARTPXXSXXTRXGXXACXXXCXRXLRLSXPAXXHXFLXGXFFKVEEDXDVXXWXTXEXCGXXFSDRPRRWCGGPSRLIXEVRRAGEREARWXTTPRAXXKRLVKKAGXF

SEQ ID NO: 198640 - protein, 56 aa, Triticum aestivum
  unsure (1)..(56): unsure at all Xaa locations
  Clone ID: PAT_TA_93058.pep
PGERXQWAPDRXXXFVXRFXXALXRPXXXHDLRVIWIDFLSNXDKXCXMXVXNLSS

SEQ ID NO: 198641 - protein, 129 aa, Triticum aestivum
  unsure (1)..(129): unsure at all Xaa locations
  Clone ID: PAT_TA_93059.pep
WGATTTAXXGACPTPTTMSASMXXXRCXQHQRRLLXRRQARARARAWHGHGGXNMXANTTDWSVPXLXQARXTWWXXDMFXTXXTRSVLSRKDRHGXXTXXGTKXXGHVYSTTTXECXWGEEGKGSIIK

SEQ ID NO: 198642 - protein, 68 aa, Triticum aestivum
  unsure (1)..(68): unsure at all Xaa locations
  Clone ID: PAT_TA_93060.pep
PPXYPXGVIHXXIWRDXALYXTGRDSQAXLYXGSSXVNAXWGYXSYGDWSGPPDFFFFLILLXIRLLI

SEQ ID NO: 198643 - protein, 54 aa, Triticum aestivum
  Clone ID: PAT_TA_93061.pep
APRTVDPGLQESDSSCRFFFFERNMIYTVLNSTPLFTHPCIYKRVVENKHEMAQ

SEQ ID NO: 198644 - protein, 95 aa, Triticum aestivum
  unsure (1)..(95): unsure at all Xaa locations
  Clone ID: PAT_TA_93062.pep
AIKRXRLSGYAHCFVYWAPXAMWXWXTELNMRWXSIXXNSCVCXATXPVXVXAKXRGTAXGCTXXQKKKXTVRGKXGXWHVAQLXKSXIXXRNGV

SEQ ID NO: 198645 - protein, 89 aa, Triticum aestivum
  unsure (1)..(89): unsure at all Xaa locations
  Clone ID: PAT_TA_93063.pep
KLLPVFPAISERRPAPPRRDVXXEXRLNVVPTVTMLGVVKARLXWAXPGXALLXKKSGALTVQFXAILKKIVXTKESMXEGMCXSSFSL

SEQ ID NO: 198646 - protein, 132 aa, Triticum aestivum
  unsure (1)..(132): unsure at all Xaa locations
  Clone ID: PAT_TA_93064.pep
LVPPPPSSSSPDLIGRISVXCVTNSKEQSIVLLCSSCNSTMXLPKKASRRRAPQAXYPPPGXXQTSLHXXAAVHVXARTTXTSRRRDTTNAGGQGHRGDGXXXDVXGALLXCSXTLXLXEXVQVFLTVNNSX

SEQ ID NO: 198647 - protein, 83 aa, Triticum aestivum
  unsure (1)..(83): unsure at all Xaa locations
  Clone ID: PAT_TA_93065.pep
RIPLLVPNSTFVDFQGNSRTKASSSSTCSALNLXGHLLRGIRFSSLSSTRKLHLPSCESKFVEYMLCLQALVSGANFXRDNVC

SEQ ID NO: 198648 - protein, 52 aa, Triticum aestivum
  unsure (1)..(52): unsure at all Xaa locations
  Clone ID: PAT_TA_93066.pep
DSRAAXIRTRXYIFTKSIXMDXPMSSLICLEXYXFRVXSKGXSRTFHLIXXG

SEQ ID NO: 198649 - protein, 84 aa, Triticum aestivum
  Clone ID: PAT_TA_93067.pep
TKLNAISIYQHAPFQPPDLPWIWLPSCVSELEFGNYRCGNGVTVRDYNIRMAFVATQRRISGLSANEHQVLQDLLYTGSFSAQC

SEQ ID NO: 198650 - protein, 91 aa, Triticum aestivum
  unsure (1)..(91): unsure at all Xaa locations
  Clone ID: PAT_TA_93068.pep
RRSRKXDSRAAGRGEXGDEETNKIQTQERRHTNESIDRSIEFSFCCPQKSKQERRGHKPLPSSIFPFXPSXSAARVAPPLLPXXCXCXXQH

SEQ ID NO: 198651 - protein, 128 aa, Triticum aestivum
  unsure (1)..(128): unsure at all Xaa locations
  Clone ID: PAT_TA_93069.pep
WSPGCKLVPNSARAAFGGGGGCRPALGLPFSTASMDWKETPTAHVFMADVPGLRREEVKVEVEHEXVLRISGXRARAXEDKGDRWHXXEXNAXEFXXTVRXPPNADVDGGSVHASLDXGVLTSHPQRQ

SEQ ID NO: 198652 - protein, 150 aa, Triticum aestivum
  unsure (1)..(150): unsure at all Xaa locations
  Clone ID: PAT_TA_93070.pep
NCYFCSQTCYPSKGITFVRNDARAFKFCRGKCHKNFXMKRNPRKLKWXKAFRXTAXKEMXXDSTLSFAARRXIPXVRYNRDLLGKTLNAMSRVSEIRQKREXVFXXXRMXGNKEXQMGLNRELXAENXHLPXRXRAXERXAKTQRGDGVV

SEQ ID NO: 198653 - protein, 53 aa, Triticum aestivum
  unsure (1)..(53): unsure at all Xaa locations
  Clone ID: PAT_TA_93071.pep
XAARAIVXETSCRXXTPPAAATATQTRSXTSRCAXHVEGXRFDHXFSXXSCTR

SEQ ID NO: 198654 - protein, 115 aa, Triticum aestivum
  unsure (1)..(115): unsure at all Xaa locations
  Clone ID: PAT_TA_93072.pep
PRTXXXGXETRXXLRFDPRXLXRPRTGGRVARGGSTEXRXSSRRRRRXVRRSRXCGRPDPEXQRARRWRRRRASXEXEDGVLXRGVAXXAXTTRRFGLVRXRHXLQPGXHYSRAP

SEQ ID NO: 198655 - protein, 138 aa, Triticum aestivum
  unsure (1)..(138): unsure at all Xaa locations
  Clone ID: PAT_TA_93073.pep
XFAXVXXXVXLXPWXXDXTXFSXGDLFAGVXELPGXFCCQVPPGLKTPPTLSPPRGXWXEXSPGVXFVGIDGDCLIPSLAFXLMARVCLPAARRSXSSPXSGXARPPRRPTXCPASCAEVEXXRCKNLCHFACSTSHR

SEQ ID NO: 198656 - protein, 117 aa, Triticum aestivum
  unsure (1)..(117): unsure at all Xaa locations
  Clone ID: PAT_TA_93074.pep
KXYXINRVLXSPAXCXTYXLTSKXYKNELXKGEGFRXVGVXLXXQTIVSPXARVGSKSXPXGGTKGXXHEXPRPFXGGVGXTATFNKKAILPQLXXTVGQKXNIXRSSTGXXKSTIP

SEQ ID NO: 198657 - protein, 80 aa, Triticum aestivum
  unsure (1)..(80): unsure at all Xaa locations
  Clone ID: PAT_TA_93075.pep
EPPVVVVXXYKIXXNTRGXXXPIDNAGYHDVFXPPPRXRXXMFVXPPAGXVTVXLXSRLLXXQHHIWTCWXVQXFTLPAH

SEQ ID NO: 198658 - protein, 123 aa, Triticum aestivum
  unsure (1)..(123): unsure at all Xaa locations
  Clone ID: PAT_TA_93076.pep
XGALEQWIPGCXSCRIGREVPPDSTYYNKKHQSQSCSLQYALLTIATTISAQLSLPGFLMQHLTMLRXPTGKRCRXNSCLRSFIAKSPLYLSEIAXHMSSVTKLNCRSVFISQRAXXPGTWCL

SEQ ID NO: 198659 - protein, 83 aa, Triticum aestivum
  unsure (1)..(83): unsure at all Xaa locations
  Clone ID: PAT_TA_93077.pep
SCRIRHEEQLEGEYFISINTQSRFIKQVGLGIISQPPIHPLITKLYDGNLVPMYKLQMPPSSLISHPKINQALPRSQAIIXAL

SEQ ID NO: 198660 - protein, 119 aa, Triticum aestivum
  unsure (1)..(119): unsure at all Xaa locations
  Clone ID: PAT_TA_93078.pep
NMDPGLQXVAXSDKXDGEWXPSPPNGXTGGXELRHPHVHRTXTGCXGWXKHRXXXDKHPGSXRLXAHGVNSDLAAVXAEPFLSAPLKXYGEIXXSTXTVGXAAGHHXXSXXGRRXGRRT

SEQ ID NO: 198661 - protein, 222 aa, Triticum aestivum
  unsure (1)..(222): unsure at all Xaa locations
  Clone ID: PAT_TA_93079.pep
MATELYDGAIGIDLSTTYSCVATYEGTNVGIIANEQGSXTTPSFISFTDXERXIGEAAKNQAAMNPRNTIFDIKRLIXRRFDDPTVKKDVASWAFKVIDXDGSPMGEVEYXGETKVFLHKKXXLWVYQKMKEIAXVXLGKKVTKSCLTXPXXFNXXQRQGTXXAGAIAGXNXYEIIMSPRXXRLPPGLXXGNIRGESFYSGEPVTKGRGIKHGPLGFVNPGQ

SEQ ID NO: 198662 - protein, 139 aa, Triticum aestivum
  unsure (1)..(139): unsure at all Xaa locations
  Clone ID: PAT_TA_93080.pep
MSRRGIDGAADAARHGPSERPAVVFDNGNGYXSKLGFAGXSEXSFNXPTVXAVNEXFLXQSKQCSXANWXAXXNASVMADLDFFIGDXGLSQFXSNGLXKXXKPIRHGQXVNDWDTMERIWNNPISLSTXNPEEXXFYL

SEQ ID NO: 198663 - protein, 139 aa, Triticum aestivum
  unsure (1)..(139): unsure at all Xaa locations
  Clone ID: PAT_TA_93081.pep
KXFXEXGXPXPXXSXVGGXEKXPLGXPPXQGPKYLPXXXCPTKXEQXFPRRQIGALTKXWAPVPSFLXSQVFFRLPLLGXRQRRGKARGXGHXTKXFGLRGLTEGXRXSTLRGKGIKTEAPLLXDWMSXPLRKTTHWMR

SEQ ID NO: 198664 - protein, 109 aa, Triticum aestivum
  unsure (1)..(109): unsure at all Xaa locations
  Clone ID: PAT_TA_93082.pep
DYIDQAVXRRKINLLMITDRDGSKFCRAERLHRVHDYATLTEPTGMYDCPXGQPQNQXLPXAXYRIFQPXRXGXNKYXXDQPLPLIRXRCWSTRXMQLXRRXSXXRAAG

SEQ ID NO: 198665 - protein, 81 aa, Triticum aestivum
  Clone ID: PAT_TA_93083.pep
RAEFGTRRLGQLPCARHSAAMEVRVAPVDLVPRGCIIVTFSQKHHESRRQKERPIAFLVLDFENNLCVFREFPVTSMYKKA

SEQ ID NO: 198666 - protein, 103 aa, Triticum aestivum
  unsure (1)..(103): unsure at all Xaa locations
  Clone ID: PAT_TA_93084.pep
ERERASGINKHNKKSMAMAMAAAMRVGGGALLRRAPVVEARQRLVHXTPEEMREVATRAAQIGKTKEXLFDMVIDLNSNYNVPHSMKREHLLLSQRLSSQIQA

SEQ ID NO: 198667 - protein, 133 aa, Triticum aestivum
  unsure (1)..(133): unsure at all Xaa locations
  Clone ID: PAT_TA_93085.pep
RXGRDVAXXGGXGIRLGRAXQNAPPRPXPGREFAKLRRNFRGTSNQQAPRTKFLPXKQKPIELGIXQKGESRXEXLWVCSXGGVYDSXXGXPKVMFDNWQLPXVXKPKSLXAPGLIXKLKGEAXRKNXSXGXE

SEQ ID NO: 198668 - protein, 78 aa, Triticum aestivum
  unsure (1)..(78): unsure at all Xaa locations
  Clone ID: PAT_TA_93086.pep
MSCNCGSGCXSCGSNCKCGKMYXDLTEQGSAXAAXXAAVVVLXVXPENKXGXFXVXRRXNPAXGCNCXDNCKCKPCNC

SEQ ID NO: 198669 - protein, 96 aa, Triticum aestivum
  Clone ID: PAT_TA_93087.pep
TSRPGPSWLNRAANIGVALPCVVPKEWIAPPDFETADGELVEEDDDEPHRNLESRGMLETTDTKNISVEETTHSNEEQKKIVESEKKYHSRRFIHK

SEQ ID NO: 198670 - protein, 75 aa, Triticum aestivum
  unsure (1)..(75): unsure at all Xaa locations
  Clone ID: PAT_TA_93088.pep
XAGTVXRXAVXVSPXXRVNQAIALLTIGAREAAFKNIKSVTECLXEELINAAKGSXNSYAIKKKDELERXAKSNK

SEQ ID NO: 198671 - protein, 111 aa, Triticum aestivum
  Clone ID: PAT_TA_93089.pep
PKESASPLSYIPVFEGHARKDYSLFHHHKLYFTNGPIKPCAKLFIDVVIFPQRLSIGWCCTNGIYTLHQHRLDRSNFGKRFGYKVDDVIKILRLLCRSFFWFPHGFILTFL

SEQ ID NO: 198672 - protein, 54 aa, Triticum aestivum
  unsure (1)..(54): unsure at all Xaa locations
  Clone ID: PAT_TA_93090.pep
LMIRXKAHXAXCYEKRXGQXFCTTITNLMWLVSRVQRKALHEXECFQPFCNTGS

SEQ ID NO: 198673 - protein, 101 aa, Triticum aestivum
  unsure (1)..(101): unsure at all Xaa locations
  Clone ID: PAT_TA_93091.pep
PPGLAXKFRNXGKNKGXVYFPDKTRVQPKNPQKQXFGGSGKKGXPPKNGVXRWXKPGXXKLLLKXGGGGIRENWLAKKQXYPPXKLXQIKNGPIXXXPXFF

SEQ ID NO: 198674 - protein, 82 aa, Triticum aestivum
  unsure (1)..(82): unsure at all Xaa locations
  Clone ID: PAT_TA_93092.pep
GDRSIISEEEWATRFVNISKDETATYTFVASSHALEFLADIWSEKGXFGKADKALTLLGEKYDPIRKNYWEWKRLGLSTNLK

SEQ ID NO: 198675 - protein, 114 aa, Triticum aestivum
  unsure (1)..(114): unsure at all Xaa locations
  Clone ID: PAT_TA_93093.pep
LAYFQNPDTHTPAGVQLAHLRAVVRRCIFQWSAKNGQVAANGDGLCVAQPARADPLNWGKAAEELSGSHLDAVKRMVEEYRRPVVTMEGAXSLTIAMVAAVAAGNETKVELDXS

SEQ ID NO: 198676 - protein, 58 aa, Triticum aestivum
  unsure (1)..(58): unsure at all Xaa locations
  Clone ID: PAT_TA_93094.pep
EKXGIDAQWKESAWAKKRTQRERRXALXDFXXFXXMXXXXQXXFXVXKSFPKIXAXTT

SEQ ID NO: 198677 - protein, 91 aa, Triticum aestivum
  unsure (1)..(91): unsure at all Xaa locations
  Clone ID: PAT_TA_93095.pep
RAEFGTSGDAVDNAEDQDPNQRPRKKRYHRHTQHXXQEMEAFFKECPHPDDKQRKELSRELGLXPLHVXXWXXNXRXXMKNXHERHENXQL

SEQ ID NO: 198678 - protein, 78 aa, Triticum aestivum
  unsure (1)..(78): unsure at all Xaa locations
  Clone ID: PAT_TA_93096.pep
MGKEKTHINIVVIXHVDSXKSTTTGHLIYKLXGIDKRVIXRFXKEAAEMNKRSFKXYAWVLXKLKAERERGITIXIAL

SEQ ID NO: 198679 - protein, 71 aa, Triticum aestivum
  unsure (1)..(71): unsure at all Xaa locations
  Clone ID: PAT_TA_93097.pep
QPRLILSXRAHXHFHGRRLPSSQXRLLPPFIDFXXVRVLRWXAQXQKRTSWFVVKGGAKPWCXVELTGGKP

SEQ ID NO: 198680 - protein, 130 aa, Triticum aestivum
  unsure (1)..(130): unsure at all Xaa locations
  Clone ID: PAT_TA_93098.pep
MGXXFSSTVGXPXSTPTNFLGKKLKKQVTSAVNYHGKSSKXNXFTIMGGGNLXXKEEHRQSXXGLAYDISRRPAXTSPKGKGSWDSLFQGAHGGNGEPPRASSSSQVRQAGNSKKNFQPMGGFYNRLPGN

SEQ ID NO: 198681 - protein, 39 aa, Triticum aestivum
  Clone ID: PAT_TA_93099.pep
FFFFFLRYYTYCFNETIYYIYRENDTTNTSFMPFTQLTH

SEQ ID NO: 198682 - protein, 156 aa, Triticum aestivum
  unsure (1)..(156): unsure at all Xaa locations
  Clone ID: PAT_TA_93100.pep
RAEFGTSTSGASLGSVSNGGRXXCMXVWPIEGIKKFETLSYLPPLSTEALLKQVDYLIRSKWVPCLXFNKVGFIFREHNASPGYYDGRYWTMWKLPMFGCTDATQVXKXVEEVXKXXPDAXSASXGFHNKPQVEVALSFNPFXPNRGXEGPAKGNL

SEQ ID NO: 198683 - protein, 118 aa, Triticum aestivum
  unsure (1)..(118): unsure at all Xaa locations
  Clone ID: PAT_TA_93101.pep
YSFRAEHDGXYPYCFSNEHWXAASKEVSFNVHGVVYVSEPEHPSDPLEAEVRELSSLLSQVKDEQSYIVLRERTHRNTAESTNSRVKWWSIFQMAVLLGEGIFQVWWLKRFFEVKRVV

SEQ ID NO: 198684 - protein, 180 aa, Triticum aestivum
  unsure (1)..(180): unsure at all Xaa locations
  Clone ID: PAT_TA_93102.pep
EHSTNTNQSRFKATKEQWAGXXGLGLLDFWXNPFGQARSHXAXRRXGXPNEVTWREDLXAGKKRNGXSGSKPGXNKERFRVAPPTNGPPPSNEVPHQSLQVTSXGSPSPEGPRALLPSGTPXAAARKARFLGPTNVXTXKGLXKWGXPGFWEXSKGGNPKGGKXAPPXNXLGXFLKKTLR

SEQ ID NO: 198685 - protein, 73 aa, Triticum aestivum
  unsure (1)..(73): unsure at all Xaa locations
  Clone ID: PAT_TA_93103.pep
FTYYQPHSCTSACSLIRDILSFSPFQIPPNKVKKSRRRRRRRGEPTAXXLRRKYKRPSPFTRRRQAYLRSVKS

SEQ ID NO: 198686 - protein, 57 aa, Triticum aestivum
  unsure (1)..(57): unsure at all Xaa locations
  Clone ID: PAT_TA_93104.pep
AXLCSTFVFAXPXXFWAPXSGLRCRKNGXPLKLQFLPSRLSSLVKFGCSPSYRICSC

SEQ ID NO: 198687 - protein, 156 aa, Triticum aestivum
  unsure (1)..(156): unsure at all Xaa locations
  Clone ID: PAT_TA_93105.pep
KAEAPTXEEPKAEEPAKEESKAEAPDQEEPXAEAPAAVAVVEEPXAEAXAAVAAAEEPKAEVTAEEAKPEEKTVXVAEEEGTKTVEAIXEXAVPAAXXPEAXPAGRXEXELIWGXVXXVGGDKRXTDXVLLKFPPRAAKXKVKRAGDFSKGPLLVQ

SEQ ID NO: 198688 - protein, 129 aa, Triticum aestivum
  unsure (1)..(129): unsure at all Xaa locations
  Clone ID: PAT_TA_93106.pep
MGLLDXLNLXLTDSTXXXIAEYIWXXXFXMDFKSKGXTLPGPVTXPTKLPKWXYEGSNNGQAPXEXKEXILFPXGXFKGPVQGKGKTLSSAKWPKLWQSPLNKKKKSWRFFTNLNVKGGPRDRYARGTP

SEQ ID NO: 198689 - protein, 134 aa, Triticum aestivum
  unsure (1)..(134): unsure at all Xaa locations
  Clone ID: PAT_TA_93107.pep
MGKIKIGINGFGRIGRLVXRVALQXSDDVXLVAVNDPFXXTEYMTYMFKYDTVHGHWXKHSDIKLKDDKTLLFGXKXLPSSASGNPEEIXWGEAGADYXVXESNGVFTDKDKGXAHXXGXXQXRGSSLPQTKMP

SEQ ID NO: 198690 - protein, 55 aa, Triticum aestivum
  unsure (1)..(55): unsure at all Xaa locations
  Clone ID: PAT_TA_93108.pep
VILYLLVXSTFGAYRFTANRPDGTPTNYLVQSVSVDPYQRXFELSRSPMGEYVLC

SEQ ID NO: 198691 - protein, 69 aa, Triticum aestivum
  unsure (1)..(69): unsure at all Xaa locations
  Clone ID: PAT_TA_93109.pep
WIGXGXLLVLLCXELHXXFFXXLNFFWESLCFXVEECXLFSQEFVXKXGXPXFSKKXMGQPXXPXXXEW

SEQ ID NO: 198692 - protein, 67 aa, Triticum aestivum
  unsure (1)..(67): unsure at all Xaa locations
  Clone ID: PAT_TA_93110.pep
PDHPLTMRSHHDSPSSIGLLIPHIXXSSVQFNQXLFPITCISKVQLTTAYALYGFXTRCKLVLPPCR

SEQ ID NO: 198693 - protein, 86 aa, Triticum aestivum
  unsure (1)..(86): unsure at all Xaa locations
  Clone ID: PAT_TA_93111.pep
SCRISARAPGVFEFDAFANGTKETLXAAVEAAXQGKIVIIXGXDTATVAAKYKXEDKLXHVSTXGXASLELLKXKELPXVTALSST

SEQ ID NO: 198694 - protein, 133 aa, Triticum aestivum
  unsure (1)..(133): unsure at all Xaa locations
  Clone ID: PAT_TA_93112.pep
RXRXXTRRXSLRANXASSSAXEXTLXDXRTLGWTXTSXKGVXPPPGWLKAFLGGXCKIFFKEXSNGQRTSTLXRVGVLRAPIRQMXKGAKXSSNKWXXNFPREXKQASQSFPLGKXNLGGDGPXPLGXTXKQS

SEQ ID NO: 198695 - protein, 55 aa, Triticum aestivum
  Clone ID: PAT_TA_93113.pep
EMPTKVLLNNLGCTSSERDSNIKLMWKVRYEKNIQTISHQKSWHLLFKQEFLGMR

SEQ ID NO: 198696 - protein, 93 aa, Triticum aestivum
  unsure (1)..(93): unsure at all Xaa locations
  Clone ID: PAT_TA_93114.pep
AAQXVKXEXEAXQRLCDXXNXLVQXSAXSQIFXXXKEXKKRLECLNPIRASVDVSGINIXXQXATNXVPQQPTSXNLXNAIAPAXNIHKPTKR

SEQ ID NO: 198697 - protein, 131 aa, Triticum aestivum
  Clone ID: PAT_TA_93115.pep
LVPNSARGEIKAAYRRLAREVHPDVAGCGGDEGFIRLHAAYVTLADPDERARYDRDVTSRAAGMTMRQASATTGPAFRRRTWETDQVLVRRTAGQTRLPSGGPDRRPPGSVRHGAGEKVFSTIVLLRKIRI

SEQ ID NO: 198698 - protein, 77 aa, Triticum aestivum
  unsure (1)..(77): unsure at all Xaa locations
  Clone ID: PAT_TA_93116.pep
LCXLWKEEFILNFESKIXPALMRDHKEMGEREIEVFRKKWIYYFVYCEAGFATKTLGDVIITVGREGAMELMEGIPR

SEQ ID NO: 198699 - protein, 131 aa, Triticum aestivum
  unsure (1)..(131): unsure at all Xaa locations
  Clone ID: PAT_TA_93117.pep
EXGXGXNFGGDXXAEKXFXPTEXPCWGVFHRHKEXSPFITPPPFXEVPGEISLHPXRXEPXSXGRTGNXXSPSPPEKTXPEGDNSPARRRVCXWKGAQEEKEISFLIFLLRDYYFSIAYSIFFSSCRIRHE

SEQ ID NO: 198700 - protein, 89 aa, Triticum aestivum
  Clone ID: PAT_TA_93118.pep
MAPFMMSFAARDLASQVGSECTRKKIRGTAVQLDQGERLELLQYECTADGKTVVCRPVERFYRRFQTGKKSWMIETTAWENPTDGGTKT

SEQ ID NO: 198701 - protein, 101 aa, Triticum aestivum
  unsure (1)..(101): unsure at all Xaa locations
  Clone ID: PAT_TA_93119.pep
ETIXMTGXHXRGRXXETXKLLGXRXRSRTAAXXRXXRGERPRXRRXRGXEXGHGPDHRGSXSEXRXLVRRGGRLVWVGXPRGLLRGLAERGYLTSCRIRHE

SEQ ID NO: 198702 - protein, 156 aa, Triticum aestivum
  unsure (1)..(156): unsure at all Xaa locations
  Clone ID: PAT_TA_93120.pep
HPVGXSFRERWWGRRPTADMRSVXGRSAAPSAPTPYGARRHPRRCSSEHVPSAMAKAVRVRGAACLLVEAARSTANAKMTASATSPFPHKGRAHQRSSPGRSPPAAQPWPSASTAKVAPATIDNTSRLPVVLASASPRATVVPGGASSGAANGQRL

SEQ ID NO: 198703 - protein, 40 aa, Triticum aestivum
  unsure (1)..(40): unsure at all Xaa locations
  Clone ID: PAT_TA_93121.pep
SCRIREQQGTLPVPAGCXXQTXKNFDPTARSDDGSCLYTF

SEQ ID NO: 198704 - protein, 169 aa, Triticum aestivum
  unsure (1)..(169): unsure at all Xaa locations
  Clone ID: PAT_TA_93122.pep
RPGSRSFXPDPFVAPNLLHPLNSPTXLNLLXXPFQIIVXLVXSXTERDXPPSLGEVPLVTFVXRKXEXQKEFGGSGSRPDSLGLXCREYXTLFLFWDLKPHRYGLHXIPQXPVTNXSFLWGRGGRRRRXAXGWRGGETSWRRXRRPWRGSPFXLRSPDEEVRSCRIRHE

SEQ ID NO: 198705 - protein, 57 aa, Triticum aestivum
  unsure (1)..(57): unsure at all Xaa locations
  Clone ID: PAT_TA_93123.pep
KLLLYWQLFCACAFSPKLTKRTCNRTLKCFHNGNRAIVLSKSYKILIPLFENRAKXK

SEQ ID NO: 198706 - protein, 146 aa, Triticum aestivum
  unsure (1)..(146): unsure at all Xaa locations
  Clone ID: PAT_TA_93124.pep
LXXLSDEAAXRFEDVLGXDSXWPPXPPPPARWQADWQGKTXXFQGAXSEIPXLXXICPVXGEXTGERXXGGPTCDGRDGAGVHHSERTRCRRLPLXMRPRTARRPAASXSXXDALTMNMXALLPAGPGRRTPCDRPVMDXMVCAIS

SEQ ID NO: 198707 - protein, 119 aa, Triticum aestivum
  unsure (1)..(119): unsure at all Xaa locations
  Clone ID: PAT_TA_93125.pep
PTPTSPSRRFGKRFFXGHADRFNVYVHAXPAVRXRVPPTPSFRGPLRLGXXXTRARGXXPHRCGAGPVFXPRYSKEPGQNPNFAXSPKKXFXLQXPSXXSLKXGVFXXQXGGGNKKRLP

SEQ ID NO: 198708 - protein, 147 aa, Triticum aestivum
  Clone ID: PAT_TA_93126.pep
RAEFGTSFKINVQCLRVTHSQILISATPNPKYNICELNTHNKTLKGGSSKTVTPQKIHSASPTPNTRQHDALNARAAAGASSKTVTPLKIHSVLPTPNTQKPDALNARSATGGNSKTVTPMNIHLASPTPNTRQQDALNAQAATGST

SEQ ID NO: 198709 - protein, 157 aa, Triticum aestivum
  unsure (1)..(157): unsure at all Xaa locations
  Clone ID: PAT_TA_93127.pep
LVPNSARACLFAGVKISGTNAEVMPAQWEFQVGPCEGIELGDQLWVARFLLHRIAEEFGAKISFHPKPIPXDWNGAGLHSNFSSEEMRKPGGMKAIEAAMKKLEARHXEHIAXYXEDNTMRLTGRHETGNIDSFTYRWCKTRTSNSLPREKKKFWSF

SEQ ID NO: 198710 - protein, 195 aa, Triticum aestivum
  unsure (1)..(195): unsure at all Xaa locations
  Clone ID: PAT_TA_93128.pep
RKLXKNXSPGKMAXXSXXGPLXPKGXQRXXKQTSTGQXQDSRGGXXSGELNPWTSXXLXNIGAKLDGKFWQFXKPLSGVYSNCKXNSXGGGPXVTPKFXPXXXGGXVLXAAASXGAVXFLQXXPXPGGKNPGRXTQNXKSALWXGXKSPPFPQXXGVNKPKKRARQXGXXPFPKKVCRXTLXWXKMGNPPLVSGG

SEQ ID NO: 198711 - protein, 92 aa, Triticum aestivum
  unsure (1)..(92): unsure at all Xaa locations
  Clone ID: PAT_TA_93129.pep
EPRKFFXRTLAWSHRQMLAXGSCPERIDIVTGWGRRSRVTGSSLVRQSIEKLLHLFQFPLFAARGNTGCFVGCGEPLSQWLHNPYVERMHLL

SEQ ID NO: 198712 - protein, 64 aa, Triticum aestivum
  unsure (1)..(64): unsure at all Xaa locations
  Clone ID: PAT_TA_93130.pep
DNSXICXXAXHLLLKQIPSXCAAXLXWTAXRXIVXXXXAERGRAAGGGWHGEVGGAGSCRIRHE

SEQ ID NO: 198713 - protein, 153 aa, Triticum aestivum
  unsure (1)..(153): unsure at all Xaa locations
  Clone ID: PAT_TA_93131.pep
RSSGSIGAATTVPPPTPPPPPPPPPTSTKPAGSGRRRHVGRGRAREPPXRRPPAAPLARRRPGRVRRPRRRRGWGRVRRLPXRRCGASRRGVRVRVRGXRRRXAATASXATRGGSCRGGXRGARPSCPGCGSLQAGAGPPPGDGRQRGWAALP

SEQ ID NO: 198714 - protein, 123 aa, Triticum aestivum
  unsure (1)..(123): unsure at all Xaa locations
  Clone ID: PAT_TA_93132.pep
MEVLLGITGKDFTLIAASKAAMRGPTVLTAADDKTSILNKQTLMAYSGEAGDTIQFAEFVHANVRLYSMRNSTDLSPSAXAHFVRDNLASSLRSRNPYNVNLLLGGGDPXITNKPSLYWGLLN

SEQ ID NO: 198715 - protein, 115 aa, Triticum aestivum
  unsure (1)..(115): unsure at all Xaa locations
  Clone ID: PAT_TA_93133.pep
MADQLTDDQIAEFKEAFSLFDKDGDGCITTKELGTVMRSLGQXNPTEAELQDMINEVDADGNGTIDFPEFLNLMARKMKDTDSEEELKEAFRVFDKDQNGFISAAELRHVMTKPR

SEQ ID NO: 198716 - protein, 156 aa, Triticum aestivum
  unsure (1)..(156): unsure at all Xaa locations
  Clone ID: PAT_TA_93134.pep
VXEVLQRVQDHADYMPSYXRDQVLIENLGPGWRDXFSSFDETPLAAASIGQVHRAILKSNGIPVAVKIQYPGVANSIDSDLNNLKVLLMASKLLPKGLYLDKTIDNARTELAWECDYEREAXCGRRFKHLLQDESRXSWXPSFTQXASGRQXLTMX

SEQ ID NO: 198717 - protein, 65 aa, Triticum aestivum
  unsure (1)..(65): unsure at all Xaa locations
  Clone ID: PAT_TA_93135.pep
PVCRPAESRDLSXDXPRSPRAXQQIRXPESXRRLPRSRTPLSNLXTPPPSSXPQEGXPDPGGEGD

SEQ ID NO: 198718 - protein, 62 aa, Triticum aestivum
  unsure (1)..(62): unsure at all Xaa locations
  Clone ID: PAT_TA_93136.pep
KKACRLYGKHLERTRKDKXGKXRLIXLIESPDSXSISXXYKXVGVLPPTWRYESXXXSTLVS

SEQ ID NO: 198719 - protein, 126 aa, Triticum aestivum
  unsure (1)..(126): unsure at all Xaa locations
  Clone ID: PAT_TA_93137.pep
MSCCGGNCGCGTACKCGNGCXGCNMYPXEVEAAGATLLVSATATHKXSSGGMEMAXEKGGCGCTQCKXCXNNCGCSCCRLLDHHPNALHRAVACIIHIDLLPYQVATLIEGPLSQPPCIKSGCQCQ

SEQ ID NO: 198720 - protein, 76 aa, Triticum aestivum
  unsure (1)..(76): unsure at all Xaa locations
  Clone ID: PAT_TA_93138.pep
KXHLASCSPPAGPDTGTVLNQVPPLPGFFRCDXXSGNLGDHXAHLFAFRTWHIRVLGIHQLILTCKTRPRFITPTI

SEQ ID NO: 198721 - protein, 155 aa, Triticum aestivum
  unsure (1)..(155): unsure at all Xaa locations
  Clone ID: PAT_TA_93139.pep
VVPXSAQRLPLXPAXAXVVISAXKXTXKARSKSXHXXXAKXTNGXSTLPHPAKXNGTNPPCSAPVKQVRGSEGQSTXXPAPNCLPXXGXPEXEKGSXKXVXMVXRXPKXXSSVLSKVXGNXTFXXAXXXPPGDSXSQSYRTNPPMSRXKKVSQAQ

SEQ ID NO: 198722 - protein, 82 aa, Triticum aestivum
  unsure (1)..(82): unsure at all Xaa locations
  Clone ID: PAT_TA_93140.pep
RPDXKDTXSLCDWEFRDCNXIKXWCDQGXLNXGLXWVNLSXXKXVXAXQXXVXKXITLFXGGVGEVQLIFQXDFXGYPXIEX

SEQ ID NO: 198723 - protein, 94 aa, Triticum aestivum
  unsure (1)..(94): unsure at all Xaa locations
  Clone ID: PAT_TA_93141.pep
AWEAXPAKLGKPPVNEFAMGQXPXXGSGWEXKGYEATPVQQKSFLXIQXXXGVAHYAXVFXLXLGWEEKAXGXXXNEQNGLGGVPKIWXXWSXX

SEQ ID NO: 198724 - protein, 128 aa, Triticum aestivum
  unsure (1)..(128): unsure at all Xaa locations
  Clone ID: PAT_TA_93142.pep
XXGQFCXRRXXLXGIXRXPPXGXLXGXXPNSPFKQXRPAGXTPVTTAXXXGGXGAMSASXFFFPLXPEWSXQIWGRSVRFYNPQXSWPDLGLGETGPLTLGRGIRGIXVXQISPPPNLXGRXXGTLWD

SEQ ID NO: 198725 - protein, 174 aa, Triticum aestivum
  unsure (1)..(174): unsure at all Xaa locations
  Clone ID: PAT_TA_93143.pep
NLRSXARNXDPKLHLLNLDDLPLYXFXXLXFLFXPXMFGXHXCGXFXLEPLXSFCXNXTQVLSPPPLGNIGFVIRSPKLFLXVPFDEXWNPLXXSFXEXPSLFQDFQXTLLAPPQTSPKSRRLWIXGSXQYLNSXICFIILVLDLEXXPSXVARYWLNIDFVLECKSXXXAQYX

SEQ ID NO: 198726 - protein, 71 aa, Triticum aestivum
  unsure (1)..(71): unsure at all Xaa locations
  Clone ID: PAT_TA_93144.pep
VATXLIPXYRTNQNXXLXPLRRXXTLLPLLXPXLXRXRPFFXFIGXXELXLPFXAGVNXASXGQSTSGXTF

SEQ ID NO: 198727 - protein, 87 aa, Triticum aestivum
  unsure (1)..(87): unsure at all Xaa locations
  Clone ID: PAT_TA_93145.pep
RPPKVRXXSXXIXLGPXXWIXPXTXWYXPGICRLLYFXSPAXSXRYIGESTVATCMDPSXPKSQSLPFLNXPCXHFVGLGNYCAHDI

SEQ ID NO: 198728 - protein, 68 aa, Triticum aestivum
  unsure (1)..(68): unsure at all Xaa locations
  Clone ID: PAT_TA_93146.pep
RSIYLXQSWKCLAKQYARLDIGGELVILLRVGGDXGAPGFRREKCFSLCXQSCARLKLRISTSGIFIV

SEQ ID NO: 198729 - protein, 78 aa, Triticum aestivum
  unsure (1)..(78): unsure at all Xaa locations
  Clone ID: PAT_TA_93147.pep
KFWXXVKQPFFRXSGXXXPXSXPGXQRPPCHLSLSFXXXILWLGGGGGDXNPAXLAPXRXREEGRRGLGAEERPGXVX

SEQ ID NO: 198730 - protein, 108 aa, Triticum aestivum
  unsure (1)..(108): unsure at all Xaa locations
  Clone ID: PAT_TA_93148.pep
SWRIRHXVGEEKTVXPKXYWPLALPPQDLRXYPVQMASNGGXRMLLSAGCCSAGDXGPPXXRCTXGLVSPXVXISKTIARAXFXXXPSSSFPXSFGLFNRGKFTQKKA

SEQ ID NO: 198731 - protein, 71 aa, Triticum aestivum
  unsure (1)..(71): unsure at all Xaa locations
  Clone ID: PAT_TA_93149.pep
APGLWAPSIXXVMVAVEXRXSGXARHCSXCTSTTAXSKXCERVCSAVXHGTKRYPEPRGRLKGASXVHRQH

SEQ ID NO: 198732 - protein, 150 aa, Triticum aestivum
  unsure (1)..(150): unsure at all Xaa locations
  Clone ID: PAT_TA_93150.pep
MGKGKPRGLLTXXKLQTHXRDXRWADLSYKKXXAGTXFKSXPFXGGSSHXKGIVLEKXGVQGXXPNSAIXKCVRVQLIKNGKKVTXFVPNDGCPNFVXMKNDEVLLAXGFXXKGKRQRGDIPGSAGSKGSGVSRCGELTWLLWKRRKGKL

SEQ ID NO: 198733 - protein, 133 aa, Triticum aestivum
  unsure (1)..(133): unsure at all Xaa locations
  Clone ID: PAT_TA_93151.pep
HRFEAXYWPQXQNXIDMXTELGDRQLFXPDLXKEXEEKVKXXXTDLKIAQSRQKSYVDSKRKEVTYEIGDRAYLGVXPLRGVKRFGVKGKLAPRFIGPYRILERMGEVPYKLELPEGLSGXHDXFQVSQLKKC

SEQ ID NO: 198734 - protein, 120 aa, Triticum aestivum
  unsure (1)..(120): unsure at all Xaa locations
  Clone ID: PAT_TA_93152.pep
MGXMKXALLAVGAMGVLLXXASXAVTYNVGDXXXWXLNNDYXSWVSGKXFNXGDEXVFKLRTQRTTVRGQTKGRNSKHRTGANLPGNERQSTLKRQPGNPGNSSGGSLQLGPRPPAKEKR

SEQ ID NO: 198735 - protein, 77 aa, Triticum aestivum
  unsure (1)..(77): unsure at all Xaa locations
  Clone ID: PAT_TA_93153.pep
EHSLGRVTRQXWGVPSIIIXPAKMGXSKKAIRNTVNIIXVKELAXRQTXRLAVVWDXFXXVXXGGLXCXXWXXGKXX

SEQ ID NO: 198736 - protein, 79 aa, Triticum aestivum
  unsure (1)..(79): unsure at all Xaa locations
  Clone ID: PAT_TA_93154.pep
IXRAXMQTXGXDPXKVXELMDXSIRXIXLQVPIXVLGVDGVXYXFSGCHRYEXXXRLXLPTIRCKXXRGXKETLRDQMR

SEQ ID NO: 198737 - protein, 105 aa, Triticum aestivum
  unsure (1)..(105): unsure at all Xaa locations
  Clone ID: PAT_TA_93155.pep
PVXQKXXPGETGPSNQNXLDXHWXGAAFSCLCSPNCLPTKDFTHGQFFVXPRXRXXQGPVQPIILNISLLHSLGPXSXXHFXXAVQKVHPPPXGXFXFGARGGVV

SEQ ID NO: 198738 - protein, 77 aa, Triticum aestivum
  unsure (1)..(77): unsure at all Xaa locations
  Clone ID: PAT_TA_93156.pep
SLPNSXRXKISAXGRXTIWXLKYAXCQDEXEAVLVXRGRNPPPNAPXPGRPXALCPNASDLRSLQRYLGAQVXXRRY

SEQ ID NO: 198739 - protein, 114 aa, Triticum aestivum
  unsure (1)..(114): unsure at all Xaa locations
  Clone ID: PAT_TA_93157.pep
GWXLQAPQAGIKEXXNXGSXXPSPXXDXAPAVVSPSPXKYALVXARXASPFLCKWXNSXTKLLXVDRRXXWNNMVDSRCEIPRWLVGSFWGAKGGGPPGLNCPGWIRTNLGKKD

SEQ ID NO: 198740 - protein, 109 aa, Triticum aestivum
  unsure (1)..(109): unsure at all Xaa locations
  Clone ID: PAT_TA_93158.pep
VRAEIXDENRPKLSXVRRLPAGSXARPXDXLPRPXXQSPAPGRXAXSRDSXPSDLXAXPAXARPERLNKNFLXNQXGQEXXERXXXKLKWGGASWFXKAKVPGGXFRLQ

SEQ ID NO: 198741 - protein, 71 aa, Triticum aestivum
  Clone ID: PAT_TA_93159.pep
RAEFGTSSCRESLRRSAKNFYFSTTPEWPMQPKRCQTHTLNDDGIPPRRRFLERAPLIFICLSALWLLQKY

SEQ ID NO: 198742 - protein, 116 aa, Triticum aestivum
  unsure (1)..(116): unsure at all Xaa locations
  Clone ID: PAT_TA_93160.pep
PWAGAMVNLSQSPKNSASGTTSSPHXAARAGRRCGRRVSWEHEXLXGFAQXATPNQEDQRPAKAPKHSRGGPYGGRNIFLGVRAGRGPGXGGRAXGESLXGGTKXXKGLXTXGSQP

SEQ ID NO: 198743 - protein, 75 aa, Triticum aestivum
  Clone ID: PAT_TA_93161.pep
LPNQSKGLYIVTHISSDFHGKALTAKSKFNPAIEGIHDYNDNDGEEILSEPDPDDSEPEGAISKADRCHSLSIGT

SEQ ID NO: 198744 - protein, 86 aa, Triticum aestivum
  unsure (1)..(86): unsure at all Xaa locations
  Clone ID: PAT_TA_93162.pep
XLKLXQRASLXAXXKNQXXXGVFAVXCRXGTGIPXAXQXCQIXVNNCXLDVKXLQDLRCLXXIXINXXSFISNSGGRGEWVTSRSL

SEQ ID NO: 198745 - protein, 62 aa, Triticum aestivum
  unsure (1)..(62): unsure at all Xaa locations
  Clone ID: PAT_TA_93163.pep
GGRXVLILVGAAPLXTQEXSKGGAGREXGXPPXGERRSXLEPXDDMIIXSFMXRXFLGAEFL

SEQ ID NO: 198746 - protein, 105 aa, Triticum aestivum
  unsure (1)..(105): unsure at all Xaa locations
  Clone ID: PAT_TA_93164.pep
LSXXLRQRXYPAQLFVNLFIYHGSVRXPFVPRDGLVVDSGNETTDILSCXARARPHCVQYHARIAMCLNHLYTPTISLPPALKRPFQXRKMTNVTATLXSDSAAL

SEQ ID NO: 198747 - protein, 88 aa, Triticum aestivum
  unsure (1)..(88): unsure at all Xaa locations
  Clone ID: PAT_TA_93165.pep
RNDFFVNLLDPAISWKGIDDDXXFEGIDRRTDEKKWIGSRADLVFGSXAELRAIAEVYGSADGNEKLIKDFIAAWNKVXNXDLFNLAH

SEQ ID NO: 198748 - protein, 89 aa, Triticum aestivum
  unsure (1)..(89): unsure at all Xaa locations
  Clone ID: PAT_TA_93166.pep
XGVXGLXYRGELGTXPPPRXEFGTSSIQTYDHTIQHALLQPFESFGKHMQIYKQMLARSASQYGAAYRLCFHIHKQGQDFGVCKHRNHN

SEQ ID NO: 198749 - protein, 163 aa, Triticum aestivum
  unsure (1)..(163): unsure at all Xaa locations
  Clone ID: PAT_TA_93167.pep
RYSPPSDLAGKSLSKRSEGSLVLLLKMQIFVKTLTGKTITLEVESSDTIDNVKAKIQDKEGIPPDQQRLIFAGKQLEDGRTLADYNIQKESTLHLVLXLRGGMQIFVKDPHXGKTITLEXXSPQDTIDNVKGKXQGQGRVSHRDASVSSFAGGKLGPQPEELK

SEQ ID NO: 198750 - protein, 92 aa, Triticum aestivum
  unsure (1)..(92): unsure at all Xaa locations
  Clone ID: PAT_TA_93168.pep
IMIIQPTSSKLILTKTGVLHLFXXNLEGREIHANMYIEKSYQKLKILQCYWRHHDEXHCRDKQTPPHMRDLSRHVSMSSWFRNYLRFTQTSL

SEQ ID NO: 198751 - protein, 126 aa, Triticum aestivum
  Clone ID: PAT_TA_93169.pep
LVPNSARASTHLPPLYPPPSLPLLNPPSIDTFIAPTGTNRPSILKSPLLALHLERTRLLARARDYLSLLISKFSSPKETSFWSRAFSINRSTIAPTALALHRQMYLSFAEGDSSALQKICLRRHSG

SEQ ID NO: 198752 - protein, 165 aa, Triticum aestivum
  unsure (1)..(165): unsure at all Xaa locations
  Clone ID: PAT_TA_93170.pep
FWAFAGNWPFASRGSTQASPTLTSXPHNIFVXXTNFQTQKISRFFALAKXCARDQSIVTLTXAAXGTXGYIAPXELYSRNFGGISYXSDVYSFGMLXVLEMXSGRRNSDPSVGSQSEVXLPEWIFEKVITGQDLILTLEXPQEEXEXVRQLAIVGLWCIQWNPKN

SEQ ID NO: 198753 - protein, 128 aa, Triticum aestivum
  unsure (1)..(128): unsure at all Xaa locations
  Clone ID: PAT_TA_93171.pep
NQTGSKTRXGYAXPXLQYISPENRTIIPSSSKGTKIKRPXESGPXQRGRNKLYKLXRGKQPTGRHQNNNHSIQSXXYKRKNTXRPPVVXAAWLRHPPPRPXLFICPXSSSGLXGLISGXPVVXQRSES

SEQ ID NO: 198754 - protein, 145 aa, Triticum aestivum
  unsure (1)..(145): unsure at all Xaa locations
  Clone ID: PAT_TA_93172.pep
RAEFGTRQREWRSVHHFLQDRIEVLSQKALNCTANRITKNLVYSMFRNIVDYDEIYKGIQSLVLDGYEALAEVTLPEKHGHWLAPPHFVENVLXVAGFVMNCGDVFDHRDTFTVFPGLGXDLRLLGALKPGEKLRAYVRLTPGKR

SEQ ID NO: 198755 - protein, 113 aa, Triticum aestivum
  Clone ID: PAT_TA_93173.pep
FPTIVVTPEDEQHALMPLFHMCIDDLPSSTKAPELNDSNAVSVLRDDAYHWTGIDSSDGKTVSQEQIGTILAYLVAIGFIPKPDENRGTKLPVIALVPNLDSSRRKVGGRGAK

SEQ ID NO: 198756 - protein, 160 aa, Triticum aestivum
  unsure (1)..(160): unsure at all Xaa locations
  Clone ID: PAT_TA_93174.pep
MSTAEATREENVYMAKLAXXAERYXEMVEFMEXVAKTADVGELTVEERNLLSVGYKNVIGARRASWRIISSIEQKEESRGNXAYVASIKEYRTKIETELNKICDGILKLLDSHLXPSATASXSPKXFXLKMKXXXHXYLXGFXXGAXRKKTTXNTPVGKK

SEQ ID NO: 198757 - protein, 122 aa, Triticum aestivum
  unsure (1)..(122): unsure at all Xaa locations
  Clone ID: PAT_TA_93175.pep
GVQIMDSALVAAATYSNRYITDRFLPDKAIDLMDEAASALRLQQESKPEEIMRLDQRIMTLQIEIESLRKEKDVASLERREKLELDLSQCQEEAAKLLXVWEREKAGIEEVKRVKQDLEKAQ

SEQ ID NO: 198758 - protein, 131 aa, Triticum aestivum
  unsure (1)..(131): unsure at all Xaa locations
  Clone ID: PAT_TA_93176.pep
MDVSESLVYCPVYAPFFGAMGCTAAIVFTCFGAAYGTAKSGVGICAMGVLRPDLIVKNIVPVIMAGIIGIYGLVVSVLISDGLKQXLPLYTGFIQXLGAGLSVGLTSLXAAGFAIGIVGDAGVRXTAQQPR

SEQ ID NO: 198759 - protein, 134 aa, Triticum aestivum
  Clone ID: PAT_TA_93177.pep
MAVSVLFLIAGVVLMLALHVLVIVWAVRRGAVLRLRGAARERDQEQGEATGLTADELGELPCQDFKAAAAVGTGAAECAVCLEAFQGGDRCRVLPGCHHGFHAQCVDSWLRQSRRCPVCRAEVACRGKAAGAVV

SEQ ID NO: 198760 - protein, 126 aa, Triticum aestivum
  unsure (1)..(126): unsure at all Xaa locations
  Clone ID: PAT_TA_93178.pep
XARSTVRGHDLLVRRRALLLMSGXSXLLRXDDDPVDESPERRPXPGLIGWVGLGALRLRLHXXVRLXVTXTQPAXAATALCXXSLSRPPXLXSXPPLXXNWLAPQXERXXRSXWXXFVXXXTPGPR

SEQ ID NO: 198761 - protein, 163 aa, Triticum aestivum
  unsure (1)..(163): unsure at all Xaa locations
  Clone ID: PAT_TA_93179.pep
RSCSSHRCKGAGPGRSGVGAVKVLLRAVKPWSPPPPPSLVLVAPEXGALSHRCKDAGCMLLWQELQPVMKIAATGYAEMAGGNYWCYNXQLMGREDXXLLVMQPVRLFAGTGCXKKLQTTLFIAGTXXTXSHLLXGTTFVFAXTCXNFLXXKKKKKTPXGGPG

SEQ ID NO: 198762 - protein, 119 aa, Triticum aestivum
  unsure (1)..(119): unsure at all Xaa locations
  Clone ID: PAT_TA_93180.pep
SCRIRHEGELVAVGGKVALLPIPLGTADFLXHHIHAFTIHVTVLILLKGVLFARSSRLIPDKANLGFRFPCXGXLGRGGTXQVSAXDQVFLRLFWMYXAISVGNFHFNWEXXSAVWGTX

SEQ ID NO: 198763 - protein, 160 aa, Triticum aestivum
  unsure (1)..(160): unsure at all Xaa locations
  Clone ID: PAT_TA_93181.pep
SCRIRHERMYVNSEKYQTKAMKVAATATGVESVTLAGGDKNLLLVIGDDVDSNKLTKSLKKKVGAAEIVELRTLDTFGASSLPLPAGTXGAVAPGRSPYNGSQHYXYGRGARPVXSTTTTRRRXAAQRXXRFRVTLTEXLLXPRWGATNRGTTPXWSRXX

SEQ ID NO: 198764 - protein, 122 aa, Triticum aestivum
  unsure (1)..(122): unsure at all Xaa locations
  Clone ID: PAT_TA_93182.pep
SCRIRHELVPNSARAQTFDQRREGDAATSPPPPTKPPSLVSRWTYMETMVANGGGEGRAAARYGDREQXGAGCGGARRFQMPLHYPEVHQXQLRGHAPSGXLEPPPLXTXXLPRQREAFXQK

SEQ ID NO: 198765 - protein, 155 aa, Triticum aestivum
  unsure (1)..(155): unsure at all Xaa locations
  Clone ID: PAT_TA_93183.pep
XAYFWSEIHFFNCLNYYRNEGSHCQSNIFFRVQAIVPSINIIKLVIVLCRFILAPLSVLILLVYKYWKTRIRIDAVEKFLRMQQILGPTRYAYTDITAITSHFRDKLGQGGYGSVFKGVLLPXNVQVGVKMLKXNSNCNXEXFINEXSTNXKXQQ

SEQ ID NO: 198766 - protein, 134 aa, Triticum aestivum
  unsure (1)..(134): unsure at all Xaa locations
  Clone ID: PAT_TA_93184.pep
MPPTRAPGHKKRGRHPRAPSPAPSPSPFAAPPKASPLLAPPHVVRXLPSXPXXSHDPQVAAPVNPLHXHSWRXYGLGTGGXAXLLVKKTGFGVYCRAKKVGXVRAWVXKGKXGEMXRAIVTSVPSLKTVKAGPV

SEQ ID NO: 198767 - protein, 114 aa, Triticum aestivum
  Clone ID: PAT_TA_93185.pep
HSSWKSQPKKFCASPINSRINSYSSYSRVSVVGIGDSLALPFKYIRICVPPSACSTTENWPRFPGARLMFFNLNISRSMDAIADPTILAPKQKCIPWPSKEYDLKSRSRAEFGT

SEQ ID NO: 198768 - protein, 134 aa, Triticum aestivum
  unsure (1)..(134): unsure at all Xaa locations
  Clone ID: PAT_TA_93186.pep
SCRIRHESLSYLSLTLDPIQSSPMRLPRPHRPPRQQILLAPRSRAPLLRSRALPCYSAGARWSKRRPGQPHLAGSGPIPVASATRLAAARRXRLLARLSXPDPXPPGPGPTSSXPXXXNPXGAAXRXRXGXGNR

SEQ ID NO: 198769 - protein, 166 aa, Triticum aestivum
  unsure (1)..(166): unsure at all Xaa locations
  Clone ID: PAT_TA_93187.pep
LXSASHRNCLXSXTXARTXIXSKGGXRWXSPKLVLLXSPSXGXXLPSKMEXKGSPTLSXNKDNSKGDETVQRAKAXXXPSPXGXPMNLHPSVNSIXKARGRHQACQRWGHQXFKTSATLPGXLGGKGDWHPXXXGNQVVXXNTQXKGEERRLXGAXXXPLTXGMGW

SEQ ID NO: 198770 - protein, 86 aa, Triticum aestivum
  Clone ID: PAT_TA_93188.pep
IRWQRKYCAPYLRSMKLALVQSTCSVQRYIQLHKFDVDDTNFSHCCCLLPAMESWSCKIYMMQWRGLLDADAACPSCTGCFNRYRS

SEQ ID NO: 198771 - protein, 142 aa, Triticum aestivum
  unsure (1)..(142): unsure at all Xaa locations
  Clone ID: PAT_TA_93189.pep
MDIINATSDYLAELRGEAPVELEHYFLEFEDQWERKLWHQLTXTLIXYFKHEKSAFQRLPLYRNFILHFADKINQLKLVXLALSAASQCRDXQERLEFLSSVXTKXXNPNSQDAYVYATXAVATVKLKLRDFESAKKELGKS

SEQ ID NO: 198772 - protein, 52 aa, Triticum aestivum
  Clone ID: PAT_TA_93190.pep
YNLQSFWTTTIPLAIETQIKPSITYRPDTNEEIAQNYSPNVVPPATLSLASN

SEQ ID NO: 198773 - protein, 120 aa, Triticum aestivum
  unsure (1)..(120): unsure at all Xaa locations
  Clone ID: PAT_TA_93191.pep
AVXLXXQERAAFSQSIXTPXSPXQXPRKIYXCRXSLHEGLKPTXXXIDAFRDKKIKVYLEVVSYELXIMIFVXVRXYAVPMERLXNXYRAXSXGDVPLMXWSRYDIEYESLQSSPSKSHS

SEQ ID NO: 198774 - protein, 108 aa, Triticum aestivum
  unsure (1)..(108): unsure at all Xaa locations
  Clone ID: PAT_TA_93192.pep
MAATTTMXLSSPAIKLAGASYALGXXXRITMRKXAPKXSASNSPWYXPDRVLYLXPLSXEPPXSYLNXEFPGDYGWDNAGLSADPENFAKXNRELEVIXXRWGMLGAL

SEQ ID NO: 198775 - protein, 153 aa, Triticum aestivum
  unsure (1)..(153): unsure at all Xaa locations
  Clone ID: PAT_TA_93193.pep
QPAXTFFAGRGGPPFXFXPXTARRGRGXPXFVELPLTXRGPXFPCCHRQGRXVLCSFTGXLGXRAHXLDAPGGEGAXRGGGASERYKRSXXXIPALARXARRRRARERPVPXGDAAPGQRXRQGHGGXXXLHXXRAXVALHRSSYSPDVTRIP

SEQ ID NO: 198776 - protein, 108 aa, Triticum aestivum
  Clone ID: PAT_TA_93194.pep
PPPNLYPSTLARHRHIEYPLGLAITSRTPSSAGPPNPLPLPVPHPRDKPLLHSHSLLSIVLPWSRTQPQNWQSQAQAPSQAWGRWSDHPHQTIGLILYCRHIRNNSNL

SEQ ID NO: 198777 - protein, 81 aa, Triticum aestivum
  unsure (1)..(81): unsure at all Xaa locations
  Clone ID: PAT_TA_93195.pep
AREFSRASLCLSSAPRHVPPRVRLRIGPPPRRGARGHLTXDXIXEXKEAFNLFDXDXGDXCITTKELGTVMXSLGHNTNGG

SEQ ID NO: 198778 - protein, 171 aa, Triticum aestivum
  unsure (1)..(171): unsure at all Xaa locations
  Clone ID: PAT_TA_93196.pep
QSKPPSDLAEKSPIEAKRSQGSLLLLLRCKIFVKTLTGKTITLEVESSDTIDNVKAKXQDKEGIPPDQQXRLIFAGKQLEDGRTLADYNIQKESTLHLVLRLRGGMQXIFVKTLTGKXTINLEVESSDTXIDNVXXKDXGQRRXIPPXKQRLIFGWESXSKDXXTLCRQHR

SEQ ID NO: 198779 - protein, 57 aa, Triticum aestivum
  unsure (1)..(57): unsure at all Xaa locations
  Clone ID: PAT_TA_93197.pep
GELGTGPPPXSFFFFFLLRYIFKTYTETFVDLFRKFPALKCGAMSNIQRLIFQCPDP

SEQ ID NO: 198780 - protein, 127 aa, Triticum aestivum
  unsure (1)..(127): unsure at all Xaa locations
  Clone ID: PAT_TA_93198.pep
KVIGTYEINIDVLLRGIEKLNAVYSVPGVVGRVQDFRXRHAQTLWPLPHYEELVEKQTRQLERLKSWRFXNDDESSKFELPAEFGESGIDEEIRKEEIEIEELEQKKLELESRIQSIEKDIGGLMRS

SEQ ID NO: 198781 - protein, 72 aa, Triticum aestivum
  unsure (1)..(72): unsure at all Xaa locations
  Clone ID: PAT_TA_93199.pep
CSLHLSLRLISLLFILGVTPARXTQMQVLTHLLDQPTRARKRSSDKIAYCINQKYRDCRLLVSAHALEIFCS

SEQ ID NO: 198782 - protein, 97 aa, Triticum aestivum
  unsure (1)..(97): unsure at all Xaa locations
  Clone ID: PAT_TA_93200.pep
SNQSVREAAISCIEEMYKNMGSQFHEELQRHNLPTYMLKEINSRLNRIEPKVPASDGTATQHKVAASRSVSVNPKRXSPRTKSTPRESTLFGGNLIG

SEQ ID NO: 198783 - protein, 113 aa, Triticum aestivum
  unsure (1)..(113): unsure at all Xaa locations
  Clone ID: PAT_TA_93201.pep
MELEEPSTVGLXSPKPAPSSNGSKKLPXRFXRVCVFXGSNPGRKPAYQLVAVQLGXXLVERGINLXXXGGSXGLMXLVSPPVHXGGGXXTXVVARSVLXXEAHRKPGEGERRH

SEQ ID NO: 198784 - protein, 84 aa, Triticum aestivum
  unsure (1)..(84): unsure at all Xaa locations
  Clone ID: PAT_TA_93202.pep
FFPVSNVFPGYYDARXYWTMWXLXYVPGAXDATQGXQRVEEVKKEYPDXAYVRIIGFDNMRXQVQCVSXFIAFKPPGCEESGKA

SEQ ID NO: 198785 - protein, 68 aa, Triticum aestivum
  unsure (1)..(68): unsure at all Xaa locations
  Clone ID: PAT_TA_93203.pep
PSGNVNTNCQLYVENQPVTGVSVQTLAWLXSSTSICQAWQAAWSFQLIGCTFLLWMLIMAYRVYRDHV

SEQ ID NO: 198786 - protein, 57 aa, Triticum aestivum
  unsure (1)..(57): unsure at all Xaa locations
  Clone ID: PAT_TA_93204.pep
GSIGXLQEMXXLFPXXDLSXXNRXEFECXICYLRXXLKSLIKRTQYWGXHNLRDHLX

SEQ ID NO: 198787 - protein, 97 aa, Triticum aestivum
  unsure (1)..(97): unsure at all Xaa locations
  Clone ID: PAT_TA_93205.pep
MLLQSQIRALVLLAIASLSIAAPSRSHVEKRSFKVARVPNPXYMGRTPGAGTRGSHQSPENSKFDLPQGLLDTMMSNARGWPSVANTPQKSNNLCYR

SEQ ID NO: 198788 - protein, 76 aa, Triticum aestivum
  unsure (1)..(76): unsure at all Xaa locations
  Clone ID: PAT_TA_93206.pep
XIXRACEXXPLNLATXPXGXQPXPAXPLTXPGVVXQXRDGRDRXQTRRXEAGXXXGRSPHSLSAPPXFDFAPSXRR

SEQ ID NO: 198789 - protein, 83 aa, Triticum aestivum
  unsure (1)..(83): unsure at all Xaa locations
  Clone ID: PAT_TA_93207.pep
RGPRSFVVPAPHPARAHRLPNRHPLPTAPSAAPSGACXRRRRCRPSPPPPPPXPSPRLPPPGKGKGNSVSQLGSCRIGTGELG

SEQ ID NO: 198790 - protein, 55 aa, Triticum aestivum
  unsure (1)..(55): unsure at all Xaa locations
  Clone ID: PAT_TA_93208.pep
RXEIXTXLLCXEXXXXRLNTSFKSEGXKLTCCRQLKFIYQDXNSFYFCCEIHTGK

SEQ ID NO: 198791 - protein, 71 aa, Triticum aestivum
  unsure (1)..(71): unsure at all Xaa locations
  Clone ID: PAT_TA_93209.pep
YYASCFXHSALCYELYICCTFFVRVIDVDVFLLVVGSENKNLFPWLSNKYCMRNACCFLLQTFECQVGXNI

SEQ ID NO: 198792 - protein, 119 aa, Triticum aestivum
  unsure (1)..(119): unsure at all Xaa locations
  Clone ID: PAT_TA_93210.pep
YXXLTQFLAPXXFNFWRXMLEKMXXHVVAGAXPXDGPRQNSGKGGXAXTNLPVXXSQXCNGEGELXKSAXXWPXRXPXQXXRVDRXVRSVRXPPPAAGRXXXCGSXPFFPTPRXGKRLV

SEQ ID NO: 198793 - protein, 152 aa, Triticum aestivum
  unsure (1)..(152): unsure at all Xaa locations
  Clone ID: PAT_TA_93211.pep
RHKIGDFARLYAKDLKADXGAEYDQYIEVNLSELEPHINGPFTPDLATPISKFSEAVKANNWPEELKVGLIGSCTNXSYEDMSRAASVARDALXXGIKSKALFTVTPGSEQIRXTIERDGQLQTFEEFGGTVLXNXCGPCIGQWDRQGRQEN

SEQ ID NO: 198794 - protein, 132 aa, Triticum aestivum
  unsure (1)..(132): unsure at all Xaa locations
  Clone ID: PAT_TA_93212.pep
GSAPFTPPIDIPADIYNAALDIKIPITXAIIYAFSALILNAYNHKCGNKPWNISKTRTFSTFVFLHNILLAVYSGWTFLGMWGTMQRSVPIPSDGSNLVHXVDALCKIHGSRGLGESNRGHFTSLWPTSTQG

SEQ ID NO: 198795 - protein, 95 aa, Triticum aestivum
  unsure (1)..(95): unsure at all Xaa locations
  Clone ID: PAT_TA_93213.pep
AKSVSATGQPASDSPPPPHRRRRXQAPLSTQAGSPSRXRPLTGPASPARXAPARLXFXRRRRGGEERNXGEMAGRFFWEXPRHGRXPXXGRXRGP

SEQ ID NO: 198796 - protein, 155 aa, Triticum aestivum
  unsure (1)..(155): unsure at all Xaa locations
  Clone ID: PAT_TA_93214.pep
KNSYETTNTVYIYTXRGGINKPPIAHLPGHKKPSIVVKCSXIFYKHRKSTPPTRHISMDXSSTDGNMAALPEPTTAXSESPTPVMEPPPLVVPGDVAGSKPSSESTAEEIGDPXHGFSIPYRIIYAVATEDTVYLXTRNKQTPLCVVANLHWATF

SEQ ID NO: 198797 - protein, 105 aa, Triticum aestivum
  unsure (1)..(105): unsure at all Xaa locations
  Clone ID: PAT_TA_93215.pep
GELXTGPPLFFLPPTHNHLLIHGGYSGYLNTSNXXFXXREKTQRTKTRHMVYIFVAHTHTHRHDDAAHXXELLFHFRXNXSCWHXXIILFXGPTAGXVDGGFHXX

SEQ ID NO: 198798 - protein, 156 aa, Triticum aestivum
  Clone ID: PAT_TA_93216.pep
LVPNSARGKTGEGNLDLWGIKRCDVLVASHDATVLRTVGIGLLQNLWSNSISAELARDSRSPEDLLSKYRDDNHSWIVIIKQDSVLKVKSMDRKDATDVDILPAQLLSFLKGEIRERDRKNGANQREMLQQNCGTGIEEREQDVRVLISGTKSKKS

SEQ ID NO: 198799 - protein, 60 aa, Triticum aestivum
  unsure (1)..(60): unsure at all Xaa locations
  Clone ID: PAT_TA_93217.pep
GXRIFPRLVRSRSSRNEIYEESQLILTRGMRXPEMNIKSHTIXNAHHFKELTSSRIMLXC

SEQ ID NO: 198800 - protein, 132 aa, Triticum aestivum
  unsure (1)..(132): unsure at all Xaa locations
  Clone ID: PAT_TA_93218.pep
MKVIEKIQEAAANGRTVFSFEYFPPKTEEGVENLFERMDRMVAHGPNFCDVTLDIANRMQNMVCVETMMHLTCTNMPVAKIDNALATIXVQXGIQNVPGTFXENSPHGQXTKFCSSCLGXFSCCSILVGATI

SEQ ID NO: 198801 - protein, 119 aa, Triticum aestivum
  unsure (1)..(119): unsure at all Xaa locations
  Clone ID: PAT_TA_93219.pep
MVKAVAVLTGSEGVKGTIFFTQEGDGPTTVTGSVTGLKEGLHGFHVHALGDTTNGCMSTGPHFNPAGHVHGAPXEDEIRHAGDLGNVTXGADGVANINVTDWHIPLTXGPNSIVGRAVV

SEQ ID NO: 198802 - protein, 44 aa, Triticum aestivum
  Clone ID: PAT_TA_93220.pep
FFFSPRIKKKIFFCIRFLQRSSFSQKRSILKERRVTCRDPRTHF

SEQ ID NO: 198803 - protein, 107 aa, Triticum aestivum
  unsure (1)..(107): unsure at all Xaa locations
  Clone ID: PAT_TA_93221.pep
MSRGGSAGGGQSSLGYLFGDGEPAKPAAAPAAKPAPAEKPXPAAADVAKQIPXAGIPGSRANNYYRADXXEHGQTSLRXRPSNQXLMLLPGGGSSLGLLVLGGESEC

SEQ ID NO: 198804 - protein, 56 aa, Triticum aestivum
  unsure (1)..(56): unsure at all Xaa locations
  Clone ID: PAT_TA_93222.pep
SXXXRKXDVXVGGVGXXRXXGKAGXCSDXRXLTEEEIDERLQAIAEKVLLSSIIDL

SEQ ID NO: 198805 - protein, 83 aa, Triticum aestivum
  unsure (1)..(83): unsure at all Xaa locations
  Clone ID: PAT_TA_93223.pep
MLVAAADSEPAVPNYFLCPISLDMMRDPVTAPTGITYDRESLEGXWSAGTHVPRPGRCWRSSLNNPTKGDSRSGVQTGGLGVK

SEQ ID NO: 198806 - protein, 61 aa, Triticum aestivum
  unsure (1)..(61): unsure at all Xaa locations
  Clone ID: PAT_TA_93224.pep
GGRYFQSFRRIGEVDLAVCRILGFIILVQLEAVKDRPLWWTLFCLVAPHHYAMPLSCCNEX

SEQ ID NO: 198807 - protein, 62 aa, Triticum aestivum
  Clone ID: PAT_TA_93225.pep
DWHVSKYPLIYIHLIGLYYPVVPYYQSHCARHQPDLICPEPHATHHPVTNAMSPRVQRHTIR

SEQ ID NO: 198808 - protein, 89 aa, Triticum aestivum
  unsure (1)..(89): unsure at all Xaa locations
  Clone ID: PAT_TA_93226.pep
IXXNFKXGEDRTFFGLPRAPPXXLVXSXMGAAXGXXKTXVXVXXMXVMXSGAXEXDQSQTVXMSRWWLGDLRVPSVFVXISHPEIKHPX

SEQ ID NO: 198809 - protein, 76 aa, Triticum aestivum
  unsure (1)..(76): unsure at all Xaa locations
  Clone ID: PAT_TA_93227.pep
YKTLLHPIATFSFFTFAYPSAPFSFSPIKHKTSNCKIRYYGEXCLYFDDSSHQHHKRIARGGLSFSLWAVILSYKP

SEQ ID NO: 198810 - protein, 59 aa, Triticum aestivum
  unsure (1)..(59): unsure at all Xaa locations
  Clone ID: PAT_TA_93228.pep
CLIPLSDSSLSDSAGLRXVGIVRRGWSLSDDXSLASXLFTLSTDFDLFXFLSSGFLVLG

SEQ ID NO: 198811 - protein, 75 aa, Triticum aestivum
  unsure (1)..(75): unsure at all Xaa locations
  Clone ID: PAT_TA_93229.pep
THTPPNSSRNLERIMXGVXTKCGRXQARRGGDAXRLXXRRQKRVXVAPPXDRRAALLGLAVVFRRHRRLRPGVGS

SEQ ID NO: 198812 - protein, 104 aa, Triticum aestivum
  unsure (1)..(104): unsure at all Xaa locations
  Clone ID: PAT_TA_93230.pep
TRPSXFQDSSFIKTCNPAPLVKPNSQYPIFGLDSQRRVTILTPFPGREGNKVLASKXXSCFXXQKCQLGGRKKLLGAHYPXLRQRGFDXPICLMXKIKIGGKFA

SEQ ID NO: 198813 - protein, 39 aa, Triticum aestivum
  unsure (1)..(39): unsure at all Xaa locations
  Clone ID: PAT_TA_93231.pep
HEAARKXAEKEERERLEKLKKAEIDARESKRREAALGPS

SEQ ID NO: 198814 - protein, 105 aa, Triticum aestivum
  unsure (1)..(105): unsure at all Xaa locations
  Clone ID: PAT_TA_93232.pep
QXPRXSQXKNCVYMGKGYSKPARNTYSXGPMAIKCKIWTSQCSLKSTKPNCLARXKSWATFPNPLLLLXPVITGNWVQKSXKTWGKDIXXQRXNKXXRGKLKFXX

SEQ ID NO: 198815 - protein, 119 aa, Triticum aestivum
  unsure (1)..(119): unsure at all Xaa locations
  Clone ID: PAT_TA_93233.pep
AHRRRPFLNRPPSPAALVAPGQRGVIAARGTPARAQRSLPKGLPGPRKFYKXXAILRPWRVXHVXSGLLQMGXXGVTVSDVRGYGGAXRGXRERYQGSEFSXDTFIAKVKMAKSQRSVC

SEQ ID NO: 198816 - protein, 165 aa, Triticum aestivum
  unsure (1)..(165): unsure at all Xaa locations
  Clone ID: PAT_TA_93234.pep
ATVAPFQGLKSTXGLPVSRRSSGSLGSVSNXGRIRCMQVWPIEGIKKFETLSYLPPLSTEALLKQVDYLIRSKWVPCLEFXSKVGFVFREHNSSPGYYDGRYWXTCGKLPMFGCTDATQVLNEVEEVKKXYPDAYVRVIXFDXNLRQVQVRSSFIAFKAXGAKES

SEQ ID NO: 198817 - protein, 146 aa, Triticum aestivum
  unsure (1)..(146): unsure at all Xaa locations
  Clone ID: PAT_TA_93235.pep
XXDVQSQRCWVVXPPEKGXXXAPXVWQRXPPXLQXXKMXNSPNKSXRRAWXKXXLXTLGRTPPCXPXRCLXNPVEAKPCXXAXXCLEXQNNCXLXKXPGYXLGMLIXXGGPXXPXIXGXLKNVQPGIWXQWXNKTIKIYWGKXLIF

SEQ ID NO: 198818 - protein, 163 aa, Triticum aestivum
  unsure (1)..(163): unsure at all Xaa locations
  Clone ID: PAT_TA_93236.pep
ATVAPFQGLKSTXGLPVSRRSSGSLGSVSNGGRIRCMQVWPIEGIKKFETLSYLPPLSTEALLKXVDYLIRSKWVPCLEFXKVGFVFREHNSSPGYYDXRYWTMXKLPMFGCTDATXVLNEVEEGQRXSTLTPYVRVIXGFDNLRQGASASXSIAFKPPGCEG

SEQ ID NO: 198819 - protein, 93 aa, Triticum aestivum
  unsure (1)..(93): unsure at all Xaa locations
  Clone ID: PAT_TA_93237.pep
FLGRXRFFSFXEGGKLXSRXKFLXVWASXFDXGXPLPMAXDFXRLGNXFRMAFNNCFQLGSGRXPGLGRGFPPXHLXQLEEPFXQEFXXNTSY

SEQ ID NO: 198820 - protein, 67 aa, Triticum aestivum
  unsure (1)..(67): unsure at all Xaa locations
  Clone ID: PAT_TA_93238.pep
EXXXKEKXRKXXTPPPRSSSDRSCRSLAPSLALPWLKSMYASTGLCLRWCPXCACASXWSGEGAGGC

SEQ ID NO: 198821 - protein, 155 aa, Triticum aestivum
  unsure (1)..(155): unsure at all Xaa locations
  Clone ID: PAT_TA_93239.pep
LVPNSARGERTRDGSLHDHLADCGADEACPSLSRRGSSFAVVCKRWAKKIKVDKAPXDSXGGLTSRHPTPTGKERVXAKKGAVYQVCWTXVRVPNGPTGXQAQIYTAXEGNGSWKSWWTRYRPGGKRTRGASYPGGRSPSGRASLRXRAGVLPPS

SEQ ID NO: 198822 - protein, 116 aa, Triticum aestivum
  unsure (1)..(116): unsure at all Xaa locations
  Clone ID: PAT_TA_93240.pep
RSNISPLANISFGINFLNKKMXVSSIQDRTNEFRSVLTQVQKRXATSKSSTQRQSLLTXSEKVAANANENGDSKPXRXRVCKESCKNWERNCIXHGKIKKAGASWXRERRFLTTDQ

SEQ ID NO: 198823 - protein, 159 aa, Triticum aestivum
  unsure (1)..(159): unsure at all Xaa locations
  Clone ID: PAT_TA_93241.pep
MSLSKAITNCLNINCARRAILTLGPKRAAXSIAXSSQQKLLADNLKDADPSIYEIXQNEKRRXKHYINLIPSENFTXQAVLXALGSVMQNKYSEGYPGARYYGXNKFIDXARATLXKKRALQAFGLNESXWGVNVQPLSGXPANLHTFSALNNVHDREN

SEQ ID NO: 198824 - protein, 145 aa, Triticum aestivum
  unsure (1)..(145): unsure at all Xaa locations
  Clone ID: PAT_TA_93242.pep
MAEIRKKLVIVGDGACGKTCLLIVFSKGTFPEXYVPTVFENYVXDVEVDGKHVELALWDTAGQEDYDRLRPLSYPDSHVILICFAVDSPDSLDNVQEKWISXVLHFCCGLPIILVGCKKDLRYEQKTLEELHKXNQXKPVAPKQR

SEQ ID NO: 198825 - protein, 53 aa, Triticum aestivum
  Clone ID: PAT_TA_93243.pep
IFEYMAKKFTQVQVNYALLELFELKFWAFKGLISGISKLSSQVSVIIFVPKQP

SEQ ID NO: 198826 - protein, 118 aa, Triticum aestivum
  unsure (1)..(118): unsure at all Xaa locations
  Clone ID: PAT_TA_93244.pep
MADQLTDDQIAEFKEAFSLFDKDGDGCITTKELGTVMRSLGQNPTEAELQXDMINEVDADGNGTIDFPEFLNXLMARKMKXTDSXEEELKEAFKVFDKDQNXFISAAELRHXXTNLXD

SEQ ID NO: 198827 - protein, 118 aa, Triticum aestivum
  unsure (1)..(118): unsure at all Xaa locations
  Clone ID: PAT_TA_93245.pep
MQIFVKTLTGKTITLEVESSDTIXNVNGEXIXDKEGIPPDQQRLIFAGKQLEDGRTLADYNIQXESTLHLVLRLRGGXQIFVKEXLRAKTITLVVXSSVXXXNVKAXDPXXMEGHPPR

SEQ ID NO: 198828 - protein, 96 aa, Triticum aestivum
  unsure (1)..(96): unsure at all Xaa locations
  Clone ID: PAT_TA_93246.pep
IHRRXXAVMDRXSSSNSGXGGXXNPHLGVNKHGRNIRNSNARRRLLXSRPARRTPSRRXXTSXRTSSXTWVHXAHRRXAFPSGXXQDXHXPPSAXX

SEQ ID NO: 198829 - protein, 73 aa, Triticum aestivum
  unsure (1)..(73): unsure at all Xaa locations
  Clone ID: PAT_TA_93247.pep
RXPXTXGEXDTFPXXXADXRDXAAXXTSPPPGTXDPFPRKXRXRRPRHHPNRHXAGXPAXXXGXGKGRCEGEG

SEQ ID NO: 198830 - protein, 120 aa, Triticum aestivum
  unsure (1)..(120): unsure at all Xaa locations
  Clone ID: PAT_TA_93248.pep
HXPYQPSLTYEPDKSMRSLLILAVXALFTSIDASHFPFRRHMRRRLHRREEPQQSFACRLAKYDSADIERARNQACVLLTQXDTTKGSHKFPLDYRNNHLYPVLSGXKIYTKWXFHDTRL

SEQ ID NO: 198831 - protein, 69 aa, Triticum aestivum
  Clone ID: PAT_TA_93249.pep
ATHSLFTSFRYVGYDWAGDVERLRESAVIQAWWKITRHYQASPDCEMREKADDGEPDWWQGIARAPFQP

SEQ ID NO: 198832 - protein, 139 aa, Triticum aestivum
  unsure (1)..(139): unsure at all Xaa locations
  Clone ID: PAT_TA_93250.pep
VPPPASRVPPLSPHLPXLIAXPAGGRSGXPPTKWXRAXGQGTXXWXSSWXXXFFLGRHXSSCSTSXXVDCALEEXXSXXHINPVXFILSEXNKSXVXHEFXXVRXFLKLXXFLLXXAXWCXCFLRXXCPXXXXPNXLYE

SEQ ID NO: 198833 - protein, 120 aa, Triticum aestivum
  Clone ID: PAT_TA_93251.pep
SCRIRHEVKPSNILLDNNFVPKISDTGISRLIVRGHEHSGISIGDMAYMDPVYVRTGLLTEQSDVYSFGVIILELVTRRKATHMDKNSLVINFLENHKQGRKSTELFDKEIAVTENFLIK

SEQ ID NO: 198834 - protein, 116 aa, Triticum aestivum
  unsure (1)..(116): unsure at all Xaa locations
  Clone ID: PAT_TA_93252.pep
MQIFVKTLTGKTITLXVESSDTIDNVKAKIQDKEGIPPDXQRLIFAGKXLEDGRTLAXYNIQKXSTLHLVLRLRGGHQXFVKTLTXKKITXEXXSSXXNSKXLXGKIQGQGGASLR

SEQ ID NO: 198835 - protein, 145 aa, Triticum aestivum
  unsure (1)..(145): unsure at all Xaa locations
  Clone ID: PAT_TA_93253.pep
IRSSQNYLPILAWETSAILSEVLIIEPHRKSTIETVAVNMTNQGQPYEHTHKSSLSSRVSPFRRPQSPASPSPLRQTTPSPSPTKSAATITTPSQLAQCSSSALGDTHMNSLNYRPRYNFEKNNQASTGKXINTSLQLXGSLSSR

SEQ ID NO: 198836 - protein, 129 aa, Triticum aestivum
  unsure (1)..(129): unsure at all Xaa locations
  Clone ID: PAT_TA_93254.pep
KDKRCLPKGGKLVLPTGGVRLPSWESSNXHNNCAXKGGCFVLTXNQXFCRXKDFPPPPEYXFGXQXEEPTPKTAVCPGXGSAIXSPXGXCLAXXNYEXEGLLTAELDXLXEIVRAKVXFQRPWGLTPRP

SEQ ID NO: 198837 - protein, 127 aa, Triticum aestivum
  unsure (1)..(127): unsure at all Xaa locations
  Clone ID: PAT_TA_93255.pep
TRHAPFSLPAPPALPHRAPSDSPRGLAELRTVIPRRRAASSRKVGGLNGRDWRRIAXXIRAIPXFPKXGILXQVITXLLLDPHXFXXTTDLXVERXXDKDITXVAXCLTPXDXXLGXPXAXANQRSK

SEQ ID NO: 198838 - protein, 102 aa, Triticum aestivum
  unsure (1)..(102): unsure at all Xaa locations
  Clone ID: PAT_TA_93256.pep
STAXNXYHHAPPRRPPSVXRXAIARPQALGLPQLXTRXERVRVXXLQXRQGGDPGGRRPRGRRVPAXXGXRGDRXPRCSVARLXYXXRIVXXGGTGLIPXGX

SEQ ID NO: 198839 - protein, 143 aa, Triticum aestivum
  unsure (1)..(143): unsure at all Xaa locations
  Clone ID: PAT_TA_93257.pep
MAPTVMXSSGTSVAPFQGLKSTAXLPVSRRSNGASLGSVSNGGRIRCMQVWPIEGIKKFETLSYLPPLXTEXLLKQVDYLIRSKWVPCLEFSKVGFIFREHXXSPGYYDGRYWXTCGKLPMFGCTGGHTKINQGGRSKKGVTP

SEQ ID NO: 198840 - protein, 134 aa, Triticum aestivum
  unsure (1)..(134): unsure at all Xaa locations
  Clone ID: PAT_TA_93258.pep
MNTSLLIKKLSDHARLPTRGSSGAAGYDMYAAHATSVPARGKVLVATDLAVAVPPGTYGRIAPRSGLAAKHMIDTGAGVIDADYRGEIKILLFNHSEVDFPIKXGDRIAQLVLEKIVTPEVXEVDNLEESVRGT

SEQ ID NO: 198841 - protein, 132 aa, Triticum aestivum
  unsure (1)..(132): unsure at all Xaa locations
  Clone ID: PAT_TA_93259.pep
MQRQEESGEDIVIVGAGLAGLAAALGLHRKGVRSVVLESSPSLRASGFAFATWPNAFRALDALGVGDXIRKLHLHIEGLRVMSASTGEITEGGGLQGRVQLASSGDVLLQVLAGCRATIPLLPPRFVSNPTR

SEQ ID NO: 198842 - protein, 89 aa, Triticum aestivum
  unsure (1)..(89): unsure at all Xaa locations
  Clone ID: PAT_TA_93260.pep
XKAYVFHIGSRTGGAGRVPCNLSXSLXRXNXVNXYQKCSLIKQRRKIKKIKTTPKKKPEDSSMXDPVNVLLTHSLVCHXFQXTXLLLLC

SEQ ID NO: 198843 - protein, 119 aa, Triticum aestivum
  unsure (1)..(119): unsure at all Xaa locations
  Clone ID: PAT_TA_93261.pep
XSXPPPXFXGXXAREKEDGPCXRXPXRDVSREETXXEVFEVALGXLPEAHGAALXXXHGASHXPEQLASPAPAXAATTRLRSSCPSXSGFPCSSAXPMILPETPSVLDELMRTRTYGST

SEQ ID NO: 198844 - protein, 142 aa, Triticum aestivum
  unsure (1)..(142): unsure at all Xaa locations
  Clone ID: PAT_TA_93262.pep
MGPTVMXSSXTSVAPFQGLKSTAGLPVSRRSNGASLGSVSNGGRIRCMQVWPIEGIKKFETLSYLPPLXSTEALLKQVDYLIRSKWVPCLEFXSKVGFIFREHNASPGYYDGRYWTMWKLPMFGCTAPHXVIKHGGRRSQNG

SEQ ID NO: 198845 - protein, 87 aa, Triticum aestivum
  unsure (1)..(87): unsure at all Xaa locations
  Clone ID: PAT_TA_93263.pep
CTCRMMKAHDDSLGFITLFPVYLQLQSECEDSNRQIEPSYLRYTYSDKTCMGLKXAKSGKNELYIYMYTRAEFGTRFSXNFVQTIHQ

SEQ ID NO: 198846 - protein, 58 aa, Triticum aestivum
  Clone ID: PAT_TA_93264.pep
RVNYNCRTQVYVVVEKNENKYSLIDGKFVNLVTWEMWMYNNLMFRTGHSFVDNISHVC

SEQ ID NO: 198847 - protein, 142 aa, Triticum aestivum
  unsure (1)..(142): unsure at all Xaa locations
  Clone ID: PAT_TA_93265.pep
APAGLRRRPPPRSRATGGWSPCRASTAAACAGSSPAPSSLSSKKSFSKGPLGLFKSMMGPKYNGQHLHSILKELLGDTRVSQTLKSIVVIPTFDIKLLQPTIFSTYDARWDVSKDALLSDVCINTSAAPTXLPGQHFXTXDK

SEQ ID NO: 198848 - protein, 73 aa, Triticum aestivum
  unsure (1)..(73): unsure at all Xaa locations
  Clone ID: PAT_TA_93266.pep
FLDFKSNKATECRPQLIFLGESLCLRLICYSITAHQQFLLSFCASHLILQSCFVESNSRPPSRRIFRADQLXR

SEQ ID NO: 198849 - protein, 121 aa, Triticum aestivum
  unsure (1)..(121): unsure at all Xaa locations
  Clone ID: PAT_TA_93267.pep
MAPTVMXSSATSVAPFQGLKSTXGLPVSRRSNGASLGSVSNGGRIRCMQVWPIEGIKKFEXTLSYLPPLXTEALLKQVDYLIRSKWVPCLEFSKVGFIFRXSTNASPGVLRRXRYWTMWKA

SEQ ID NO: 198850 - protein, 109 aa, Triticum aestivum
  unsure (1)..(109): unsure at all Xaa locations
  Clone ID: PAT_TA_93268.pep
DKRSHETALTTIPTMQYLWFPTIHFSLASRYHPDECSTLVCSENCWXIAPGRIAYRASIHETRPNGTPLKIVRHVWEGIFQDFSANPLKASIDRLPSILFSRLWSTRSF

SEQ ID NO: 198851 - protein, 147 aa, Triticum aestivum
  unsure (1)..(147): unsure at all Xaa locations
  Clone ID: PAT_TA_93269.pep
SAPAPKERNQQIPTNLVSNRPEARPILLPHRLKMQIFVKTLTGKTITLEVESSDTIDNVKAKIQDKEGIPPDQQRLIFAXGKQLEDGRTLADYNIQKESTLHLVLRLRGXMQIFVKTLTGKTITLXXLKKSDTIDKCQXAKIQDXGR

SEQ ID NO: 198852 - protein, 92 aa, Triticum aestivum
  Clone ID: PAT_TA_93270.pep
CIVISIFAIVILSVIGVLFKSNHHSFVGSIEDPPNGAAVASTVFSAVTVYALFLIGCSFQAYLHARENRKGAIKNLVNIVQGCINAMRFRKF

SEQ ID NO: 198853 - protein, 118 aa, Triticum aestivum
  unsure (1)..(118): unsure at all Xaa locations
  Clone ID: PAT_TA_93271.pep
GRRIXEXDEGYXRPVTHTVRGPDRXLVAAARAXDVACRXPRGXNRPRGRARRASPPPPPACXACSVGXPXRLGAXVRPPPGLSXALGSASGGVIRKRQLWCGRALRGVDNYRRRRGEV

SEQ ID NO: 198854 - protein, 75 aa, Triticum aestivum
  Clone ID: PAT_TA_93272.pep
ERLLKPLNDWQFLFLHKEVRLFWYYFLVQYPSFFGRVEPCNHYTLLDIFLLMDKKPEFDSGHFAPDAGIKGSFKP

SEQ ID NO: 198855 - protein, 39 aa, Triticum aestivum
  Clone ID: PAT_TA_93273.pep
VLFEFLGVAYCCFVVATCLMKDLSCAKKKKKKNSRRVLS

SEQ ID NO: 198856 - protein, 64 aa, Triticum aestivum
  unsure (1)..(64): unsure at all Xaa locations
  Clone ID: PAT_TA_93274.pep
RPEVRTAARAAAIKEGKDXRAAAASAKKAEKAXLASASAKGQTSRLQSKQGAKGAPKKIQATTR

SEQ ID NO: 198857 - protein, 64 aa, Triticum aestivum
  unsure (1)..(64): unsure at all Xaa locations
  Clone ID: PAT_TA_93275.pep
RPXPXTDXLXPAPGXRXPXAGXGPGGXRPRWGGTARRRSRWPWXSLPRICVGGQXPTCGEFLIS

SEQ ID NO: 198858 - protein, 125 aa, Triticum aestivum
  unsure (1)..(125): unsure at all Xaa locations
  Clone ID: PAT_TA_93276.pep
MAASMITSPIVAPTSVPSLSRRGSSFAVVCSGGKKIKVDKPLGLGGGLTVDIDANGRKVGKKGVYQXFVDKYGANVDGYSPIYTPXEEWSESGDRYAGGTTGLLIWAVTLAGLLGGRPPPSTKTT

SEQ ID NO: 198859 - protein, 109 aa, Triticum aestivum
  unsure (1)..(109): unsure at all Xaa locations
  Clone ID: PAT_TA_93277.pep
MATPKKVLLLGAGFVTRPTLDILXNAGIQVTVACRTILSAEKLIKGITNAQPIALDVNDANALDIEVSKNDLVIXLIPYTFHALXIKXSXXRNKKNVXVTTSYVSPGNA

SEQ ID NO: 198860 - protein, 128 aa, Triticum aestivum
  unsure (1)..(128): unsure at all Xaa locations
  Clone ID: PAT_TA_93278.pep
MAPTVMASSATSVAPFQGXKSTAGLPVSRRSNGASLGSVSNGGRIRCMQVWPIEGIKKFETLSYLPPLXSTEALLKQVDYLIRSKWVPCLEXFNKVGFIFREHNXSSWVTMRVIGTVGKAALCFGCTD

SEQ ID NO: 198861 - protein, 143 aa, Triticum aestivum
  unsure (1)..(143): unsure at all Xaa locations
  Clone ID: PAT_TA_93279.pep
KDGSIHAGNASQISDGAAAVLMMKRSTAERLGQQILGKFVASSVVGVAPLLMGVGPWAAIPKVFEKTGLTKEDIDTFEINEAFASQCLWCSQELGLDSNKINPQGGXAIALGHPLGCTGARQVSTLLYGTGGEREGRIXITNM

SEQ ID NO: 198862 - protein, 130 aa, Triticum aestivum
  unsure (1)..(130): unsure at all Xaa locations
  Clone ID: PAT_TA_93280.pep
RAEFGTSLASFNKLEEQNTIWTPPWXQTQILTSISSETKEITKLWHLQQLKHIPIEDIIVYTDGSLSRHRKQALALWYTCQSAERXXVSQITLXDTMGITXAGDSLPIEKQTQYCGRDIFQXRQYXXSLE

SEQ ID NO: 198863 - protein, 65 aa, Triticum aestivum
  unsure (1)..(65): unsure at all Xaa locations
  Clone ID: PAT_TA_93281.pep
MKLFYLGLGKXPAGTFFYFLESKVXFPKEYPWLXLMPRVKXKWTPIXPXPXIXRHFXQILXTGSS

SEQ ID NO: 198864 - protein, 143 aa, Triticum aestivum
  unsure (1)..(143): unsure at all Xaa locations
  Clone ID: PAT_TA_93282.pep
MGPTVMGSSGTSVAPFQGLKSTAXLPVSRRSXSAXLXXVSNXXRIRCMQVWPIEGIKKFETLSYLXPLSTEXLLKQVDYLXRSKWVXCLEXFNKGGFVFREHXSSPGYYXGRYWDNVESWLCSGWTDATQGAQTKVGGGQRKE

SEQ ID NO: 198865 - protein, 163 aa, Triticum aestivum
  unsure (1)..(163): unsure at all Xaa locations
  Clone ID: PAT_TA_93283.pep
TVDARLKSLYKGHLSSXHKVGIAHFTDSVTAIIKAGQKTNASYEFSETVTRERNKALXQFEIEARNLTMKGLPWSNFEQQISLFSQELKLVSANLRKEXMRRLGTRTERWVRTRLSXLVXLEFNKLXSAKKGAIRPTTSETLKXGISLWDRIWEIFTSNYPLR

SEQ ID NO: 198866 - protein, 78 aa, Triticum aestivum
  unsure (1)..(78): unsure at all Xaa locations
  Clone ID: PAT_TA_93284.pep
MSCCGGNCGCGTACKCGNGCGGCNMYPEXEXAGATLLVSAXATXKGSSGGMEMAAENXGCGCTQCKCXNXCGCSCCSC

SEQ ID NO: 198867 - protein, 159 aa, Triticum aestivum
  unsure (1)..(159): unsure at all Xaa locations
  Clone ID: PAT_TA_93285.pep
MPAVMGSSATXVAPFQGLKSTAGLPVSRRSGSAGLXSVSNXGRIRCMQVWXIEGIKKFETLSYLPPLSTEXLLKQVDYLIRSKWVPCLEFXKVXFVFREHNXSPGYYDGRYWTMWKLPMFGCNDATXVLNXVEEVKKEXPDAYVRVIXFXNKRQVQMRQ

SEQ ID NO: 198868 - protein, 117 aa, Triticum aestivum
  unsure (1)..(117): unsure at all Xaa locations
  Clone ID: PAT_TA_93286.pep
XLQHAXWGELPXGIWSLRXFSLXXFLXREXXHKKKXFSQXPXXGTLRXFTSXXWGXVASXXXNWQGPFFXSCXHSFVLKXFSPHXHRQPPSXGSFALXEGXSXQXGESAFXPLHWHG

SEQ ID NO: 198869 - protein, 131 aa, Triticum aestivum
  unsure (1)..(131): unsure at all Xaa locations
  Clone ID: PAT_TA_93287.pep
MQIFVKTLTXKXTITLEVESSDTIDNVKXKXXDKXGIPPDXQRLIFXGXXLEDGRTLADYXIQKEXTLXLVLRLRXXMXIFVKXLTGKTITLGXXSSXXIDNVKXKIQXQGGELGKLNSLGKLGRNLPQEV

SEQ ID NO: 198870 - protein, 166 aa, Triticum aestivum
  unsure (1)..(166): unsure at all Xaa locations
  Clone ID: PAT_TA_93288.pep
RAEFGTRAAGGWPHPGLTTTFRRSPPSTWCSGFVEACKIFVKTLTGKTITLEVESSDTIDNVKAKIQDKEGIPPDQXQRLIFAGKQLEDGRTLADYNIQXKESTLHLVLKLRGGMQIFVKTLNGKDHQPGGGVLRTHRQCEGQDSKIREGNSPGPSNPLGKQLGGW

SEQ ID NO: 198871 - protein, 89 aa, Triticum aestivum
  Clone ID: PAT_TA_93289.pep
DTSQILEPSAESSLSPVTNKAHRRSKLLTNSYRHFSTGCGLRGIKSASKTAFSPTPSATEYAIDYATLCQTPNLDESDSDPPSRPISRK

SEQ ID NO: 198872 - protein, 48 aa, Triticum aestivum
  unsure (1)..(48): unsure at all Xaa locations
  Clone ID: PAT_TA_93290.pep
MENGGSKXXVPXDANAHCPGTQSEEXXXGDSXXXWXNQQIXAXAPXGP

SEQ ID NO: 198873 - protein, 153 aa, Triticum aestivum
  unsure (1)..(153): unsure at all Xaa locations
  Clone ID: PAT_TA_93291.pep
EIQATXSAGSLAEXPVPVAAGXRXLSVSXXMSKVMXKGKTXLIPYIXAXDPDLXTTXXALRXLDALGADVVELGMPFSDASADGXVIKDSAARALAAGATADAIMXMLKEVXPXLSCPVGXFSYFXPIXQXGMGSFXPPVKEXXGERYNNPFL

SEQ ID NO: 198874 - protein, 56 aa, Triticum aestivum
  unsure (1)..(56): unsure at all Xaa locations
  Clone ID: PAT_TA_93292.pep
AAXEQNLSLHTSLITQLNSLRLICGKKDKGRVVSKFVNRHRSTISPIWKFIRNRDC

SEQ ID NO: 198875 - protein, 75 aa, Triticum aestivum
  unsure (1)..(75): unsure at all Xaa locations
  Clone ID: PAT_TA_93293.pep
IGLVVXLTKFPKIQNVXIDDGXRPCCIHXVSXPXXLXKYSRGAHPQWEDLGASXDRHDFXQXXNWXTLXXQQQKR

SEQ ID NO: 198876 - protein, 126 aa, Triticum aestivum
  unsure (1)..(126): unsure at all Xaa locations
  Clone ID: PAT_TA_93294.pep
SDAAAPAAPAGXLKNWDAEXVKXXXAXLFXLILGXNYLNIKGXLDLXCXTVAXMIXXKTPEEXRXTFNXXNXFXPEEXXXIRKENQWAFGLGASRCHRAERTKLSIRHVCSLLIMSVVMGLSSRGG

SEQ ID NO: 198877 - protein, 63 aa, Triticum aestivum
  Clone ID: PAT_TA_93295.pep
FFFFFFFFFFFFFFFFFLKTVRSELIDSVVYLLLSAQIKARNPGSHEQKRKRTSCRIRHEPAA

SEQ ID NO: 198878 - protein, 173 aa, Triticum aestivum
  unsure (1)..(173): unsure at all Xaa locations
  Clone ID: PAT_TA_93296.pep
SCRIRHEPXHTESHTQLLAFSNTDLAASSFVHRRQEGMAGRVLVVVVLLVHVVARLLGRRRRGLRREAGFPRGKLQKASVKFLCKLRGXDPSTPPRRXRSATSXGNNRVLSVDRPLQFHEAATGKLTXHVRDGEGGEACGAKLPTEELDALVSVTNKRRTXGXFLEXVPTAXK

SEQ ID NO: 198879 - protein, 78 aa, Triticum aestivum
  unsure (1)..(78): unsure at all Xaa locations
  Clone ID: PAT_TA_93297.pep
AITNNPFKRRQRQSFPGQVLGWFPTNRTNNTWRGKVKKFNCHQKLYQVKKDFARXPRARDKKEWXENKLSWAWVRXQI

SEQ ID NO: 198880 - protein, 98 aa, Triticum aestivum
  unsure (1)..(98): unsure at all Xaa locations
  Clone ID: PAT_TA_93298.pep
SCRIRHERXQTXLXRAHARWXPPRSPXRLWXRRXWRPSPAGXPPSPSSXXVGKRLKVDKPLRLXXGLTXXIXAKGKKGPEKRGWXNLFXSXGGQRSNG

SEQ ID NO: 198881 - protein, 161 aa, Triticum aestivum
  unsure (1)..(161): unsure at all Xaa locations
  Clone ID: PAT_TA_93299.pep
VRRERRVPAGXPNPDPPLRAGPCFPPPRARPXPPXXASASVVASAPPAAFVVVGAVPELSDXLXLRFRLRRFGENLEEXMDLSRPGSSDLSLGXHPHAHANAXXARAXGAPPXPLRGVXTNPTTSXTGGQXXXAGGDRXXKGEYXRGAEQTXLAPXVXXLW

SEQ ID NO: 198882 - protein, 81 aa, Triticum aestivum
  unsure (1)..(81): unsure at all Xaa locations
  Clone ID: PAT_TA_93300.pep
ARAEIRHXVHXPQXKSVXIXPXKWEHRALGWXSMXXCQXGYKTCXSXMPXFHEYWTTEQFIXEXLLGAXAWSSPGXXLLVX

SEQ ID NO: 198883 - protein, 141 aa, Triticum aestivum
  unsure (1)..(141): unsure at all Xaa locations
  Clone ID: PAT_TA_93301.pep
AGXXMAGGKEPXQVKXRLFDGXDIXPKQSNDPRQHRLRAQGLHPXPRVGPQDKENNSKQLVNDLKASXNWXXKDNWXEITRTTLPEVXRVTIXEEGPLXRWXXTNAWWVXXAPPTKXXKKTKXASWXNSPXSXNXNAGCXQ

SEQ ID NO: 198884 - protein, 127 aa, Triticum aestivum
  unsure (1)..(127): unsure at all Xaa locations
  Clone ID: PAT_TA_93302.pep
VISLIPYTFXALVIKSAIRNKXNVVTTSYVSPAMLELDEEAKLAGITVLNEIGLRSXGLDHLYAIKTIEEVHXAGGKINSFNSNCXXGYLHLRRLDNPIXYKXSWXSRGVLLXLXNXAXIPRKGQNL

SEQ ID NO: 198885 - protein, 127 aa, Triticum aestivum
  unsure (1)..(127): unsure at all Xaa locations
  Clone ID: PAT_TA_93303.pep
WAPEKXSSXGTXAXQERPERAQPEXXCVHHVQKLLHAXPXFTVGXGAPQHXPPLXLRXVQAQGXQEXPELGARDQXVVVGVXRLEXLHEXVDVAQRLEVHRQRFLLXRRXPAGRRXHRVGENEXXRX

SEQ ID NO: 198886 - protein, 124 aa, Triticum aestivum
  unsure (1)..(124): unsure at all Xaa locations
  Clone ID: PAT_TA_93304.pep
LSANIRSTSAQASCTRAAKVPSSPRFFSKACAAYILRLFAQFLVEVMNDFKIGRRRRSSSLLYHEPPRDDRAYERPRRAFQISTRIGLMLKVHGTIHLSSNNMXSKYFSISYLXVLKKXQGXLE

SEQ ID NO: 198887 - protein, 80 aa, Triticum aestivum
  unsure (1)..(80): unsure at all Xaa locations
  Clone ID: PAT_TA_93305.pep
MSFKGFQKSIIRAPQTLKXRLNFGENTKDLXYIDXEXRRFQELETXETKKLHDESKKYFXAISEMMMHQIEFSQAIAENL

SEQ ID NO: 198888 - protein, 77 aa, Triticum aestivum
  Clone ID: PAT_TA_93306.pep
PGQLGDFSLLASATEGPRLKQVYFACPHAHNYLPLRTRAYDLSEKRVYVCLVKKRTEVIKSLKTVEELKNENYIQRR

SEQ ID NO: 198889 - protein, 89 aa, Triticum aestivum
  unsure (1)..(89): unsure at all Xaa locations
  Clone ID: PAT_TA_93307.pep
MKXTKLAGXLXLXAVLVMGVLSHVNADFFPKXCNNCRSFSGVDVCDDAHPKCPKXCSACRVVSTSPXMWXCAXMKSTVDGXCXGPCKKY

SEQ ID NO: 198890 - protein, 78 aa, Triticum aestivum
  Clone ID: PAT_TA_93308.pep
TEAAGVLLNDVLGLSCGILIFLSCRVIWIRGLNLDKSLIVNLTVVALLERNFRAIARPYLVSLLDGMHSFICNHNSVC

SEQ ID NO: 198891 - protein, 117 aa, Triticum aestivum
  Clone ID: PAT_TA_93309.pep
FFFFFFEVSAGNIDFTEETQRQSDRIWHDFRGGTSKGHIDKNRAVQGVNRHLSNNIQKAKKAIAYANYDELSKRDKFSMWVVGARPIDYERHPEWYNVGKHKRSVSTTSSLKSFLNL

SEQ ID NO: 198892 - protein, 62 aa, Triticum aestivum
  unsure (1)..(62): unsure at all Xaa locations
  Clone ID: PAT_TA_93310.pep
XRRRYIKKMKPSLIDYMPCEILYLLLPRSFISNKFXTTXNWIKXGFKLGGKTIWVVSTSVYC

SEQ ID NO: 198893 - protein, 180 aa, Triticum aestivum
  unsure (1)..(180): unsure at all Xaa locations
  Clone ID: PAT_TA_93311.pep
WGRXKXWIPGLQXXAEFRTXXILPGNWELRHPCRHVXXEDXXPELCLCVGXRRPGAGXDXXDRHGXAVDXHPXGCKHVXLXXXDDDXTPFHXIXXXLRSSLXATXFKLLXAXRQAGPPPRXGGSRHQTAPPPTGXXXXWRXXXQKSXRLXGDEEXHLLVLXGXVPEVDNXQLPXPXVVVE

SEQ ID NO: 198894 - protein, 106 aa, Triticum aestivum
  unsure (1)..(106): unsure at all Xaa locations
  Clone ID: PAT_TA_93312.pep
KSSRLPWXPLGNDATGSKALGKQRTLKQPWLFPVAGLGEXPYNRVRPLEEKFYXXVNGTNRXRWAKXLNYNPWXKGSIXQKTNAKXFGLGXXGXXGXGGGXXRNYY

SEQ ID NO: 198895 - protein, 109 aa, Triticum aestivum
  unsure (1)..(109): unsure at all Xaa locations
  Clone ID: PAT_TA_93313.pep
IAWXTNSSFDKLSFSKRPFFPPHLQVARRLRGRRRTTEALERARPPTGRRVXRAPRGXESRIEXTQHQDLXIFEXFEGPLGFXIXLPEIXGSRRSXQVXXFXGRCARPW

SEQ ID NO: 198896 - protein, 72 aa, Triticum aestivum
  unsure (1)..(72): unsure at all Xaa locations
  Clone ID: PAT_TA_93314.pep
XHFILIHDSFKSVDLQKKLHFFQRKSRFSVNVGNVHAKSSVATFFXSXXVPLRGNSQCAQVAQVXGPTTIFE

SEQ ID NO: 198897 - protein, 84 aa, Triticum aestivum
  unsure (1)..(84): unsure at all Xaa locations
  Clone ID: PAT_TA_93315.pep
EGIVEPSFVYLPGITGGAEIQKXSALTFFSVPIELSTNGAEKIQDPISNATDDEKNLIKAAIGGLKENIEKGITFFHTPQSEFL

SEQ ID NO: 198898 - protein, 119 aa, Triticum aestivum
  unsure (1)..(119): unsure at all Xaa locations
  Clone ID: PAT_TA_93316.pep
LLADHYEFFPNYCPAAAPSIPYVELSLLYNFCKKVNFLLLFNAWVHTVVGSEFPASNLRFSMRSHWALGARFARQIAKPRVQCCRNFFLTXLYWXGXHSPYEXCWDXWQGXNFXGKKKH

SEQ ID NO: 198899 - protein, 96 aa, Triticum aestivum
  unsure (1)..(96): unsure at all Xaa locations
  Clone ID: PAT_TA_93317.pep
FFNSHNMHSVTFFSILLTGVVTTRADVARVVTDINKISRNWGHLSPYANNRDDDFGVEYVGLPAGCQIESAHTLQRHAERFPTKGINDXRNNQRFK

SEQ ID NO: 198900 - protein, 171 aa, Triticum aestivum
  unsure (1)..(171): unsure at all Xaa locations
  Clone ID: PAT_TA_93318.pep
RAEFGTRRELVSVNENAADAPMDASEGSKDAINQPGALAEEATYINHNFANQVMIENESXKVEMPNENPFYNPAEENEPAASKAYKYRRFDLSLNDEDPVHLXVRTELDAVQKNAISGEDQFLTVKALNEFDHKAXGSXGALEWXDKNLVKPAAGAVVATEMKNNXCXANK

SEQ ID NO: 198901 - protein, 75 aa, Triticum aestivum
  unsure (1)..(75): unsure at all Xaa locations
  Clone ID: PAT_TA_93319.pep
LKFLRIEFRESKQSLRYQYSTSSTYTPTHSTWITPQSVXFQFNNQRXKYGXXVXKDXGGXTKXGXVGLSSNXRXK

SEQ ID NO: 198902 - protein, 92 aa, Triticum aestivum
  unsure (1)..(92): unsure at all Xaa locations
  Clone ID: PAT_TA_93320.pep
CGSGHLDGGRRRPLDSLTNAIEQRKKVYYELFDDLTRAHRRDRHEAMNKTKHMSSGRIRARSSXRIRHEGENXSRGGGXGTQFRPXVEAXXT

SEQ ID NO: 198903 - protein, 64 aa, Triticum aestivum
  unsure (1)..(64): unsure at all Xaa locations
  Clone ID: PAT_TA_93321.pep
LVPNSARGWXLLPFRXGXXVRFGFRSSREGXXVAXSRXSVXEXVKIHGXYGVXXGFXGGLAWAT

SEQ ID NO: 198904 - protein, 94 aa, Triticum aestivum
  Clone ID: PAT_TA_93322.pep
RCFLAEKTPWSTSNIIATDIFCHVLQKGVDSSSDSVDSEKKYSLWKLEFDTETYFGQGNTFFPTVEVTFQVEAGGLYHVPLLLGPYSYTTYRGS

SEQ ID NO: 198905 - protein, 152 aa, Triticum aestivum
  unsure (1)..(152): unsure at all Xaa locations
  Clone ID: PAT_TA_93323.pep
MTYLLFYSAFLVLIITTFLYLTRSMWIRHLPALPGSSFIYSRLPSNFVSDMENGLSSPEFDLSSNIAAGDTRRGLDDNSKREIQGIMKSRRVNFDEARRIFTEGCFAKNDISXDGLPRRSQIRSASHNTISIPTIFNKAPYNKTPLHISANT

SEQ ID NO: 198906 - protein, 155 aa, Triticum aestivum
  Clone ID: PAT_TA_93324.pep
MSTQMNEAYNLRVESRVQETQIVDLIDRVVWYAREGLQILEEYVLPMVANYRDLKVLSFKLRASFYYLYTLFHNQPPLNFESKQSTRAWGRPPTYRKIDKGRVVDLYSHPSYFRGTFSRQKKPEFFFFRRIALLGIFSYLTKNNGQSSLNNFRGG

SEQ ID NO: 198907 - protein, 59 aa, Triticum aestivum
  unsure (1)..(59): unsure at all Xaa locations
  Clone ID: PAT_TA_93325.pep
RANWVPXPPXSFFXFXFYKNKYGLLIDTWFMMIHVPKEADERSFTMLCARHADRQRYDR

SEQ ID NO: 198908 - protein, 140 aa, Triticum aestivum
  unsure (1)..(140): unsure at all Xaa locations
  Clone ID: PAT_TA_93326.pep
LKYGVMPMTSFLSKLFDRLRPAIGATPGKLRLIYISTLAGIDKPISSLILSDLRIFTRARIIYALTSSKVAGAVSQTGIYDYRFTDDPEKSHFGPPVTSLELFFXXSDNHKTXNTLSSGEIAIAGPTGVGGEIEIRSAKE

SEQ ID NO: 198909 - protein, 133 aa, Triticum aestivum
  Clone ID: PAT_TA_93327.pep
DRVSNFLMPSKWVPCLEFSKVGFIFREHNASPGYYDGRYWTMWKLPMFGCTDATQVINEVEGGQERSTLTRYVPHQSGFDNNAKWVRSSNCSPTGACKPGKGLKKTNPPKGAQRQLKFNPRKLAFGFSLPNLP

SEQ ID NO: 198910 - protein, 69 aa, Triticum aestivum
  Clone ID: PAT_TA_93328.pep
HDLSRSEVLSSRNIHLFVQTWRGSTASHMKKDSKFCQPVSIYNYSRYHLITGAFISLANTAGSILVPNI

SEQ ID NO: 198911 - protein, 126 aa, Triticum aestivum
  unsure (1)..(126): unsure at all Xaa locations
  Clone ID: PAT_TA_93329.pep
MSGKFEPRTPTTLQPPKDDPITLDELRRADGVQSNHCYVAIKGKVFDVSGNKAYLPGGSYHVFAGRDASRALSSYQVSKSKTFRPEWEGSKMQKKKKTLDDWMIFFXSKRYNVVRQPLEGVQRYKG

SEQ ID NO: 198912 - protein, 142 aa, Triticum aestivum
  unsure (1)..(142): unsure at all Xaa locations
  Clone ID: PAT_TA_93330.pep
AYQKSIQTLFNWVHKKVNTSKTQVIFRTYAPVHFRGGDWNSGGSCHLETLPDATPFKSLEQWADKLEPVHNVLGSSTRPKLPGLAILNVTQMTAQXRKDGHLSVYISPSGPVPLXRQDCXSHWCLPGVXDTWKRTLCYANPS

SEQ ID NO: 198913 - protein, 99 aa, Triticum aestivum
  unsure (1)..(99): unsure at all Xaa locations
  Clone ID: PAT_TA_93331.pep
WSISLAGQEVHPIHSPCCFLLLPLASHXQPSKQTHTWDGSGVRTTKSPASAAHSVSHRGRFRSPAMLRRRATPLVHSSYSLWLVHSNSITRWSAVLSPK

SEQ ID NO: 198914 - protein, 140 aa, Triticum aestivum
  unsure (1)..(140): unsure at all Xaa locations
  Clone ID: PAT_TA_93332.pep
ASPPNNSRTPPWXQXVMVSSATTVAPFQGLKSTAGLPVSPPLRQRRGSGXXQVXRXKXSXCMKSXVRIEGHXEVXXPCLTCQAXLHCRXLIXARVDLPECRLQXXVXLPFEVSSXGXGVPXLPGXATXKXPXGATXRXGS

SEQ ID NO: 198915 - protein, 93 aa, Triticum aestivum
  unsure (1)..(93): unsure at all Xaa locations
  Clone ID: PAT_TA_93333.pep
VPGARSCSVVXLGLMEMASFYPALSDRSMRKIDCASVPKKYFLCPYEIDLADLPRNPQTLVVDGSLSLDVERKKAQDRWRTLMGRNLTANGAS

SEQ ID NO: 198916 - protein, 166 aa, Triticum aestivum
  unsure (1)..(166): unsure at all Xaa locations
  Clone ID: PAT_TA_93334.pep
QDASLDLSKFGKMVKLINFAPYRGAAEALENVNLVSEGVLSDYLRSNLELNLPKPSKKQKVVLGVSDKNLAGSIKATFPGVECETSETSEVAADLLRGLRLHIGKLLKGLEDGDVDRAQLGLGHAYSRAKVKFSVQKNDNHIIQAIATIDXLDKAINTFSMRVREW

SEQ ID NO: 198917 - protein, 167 aa, Triticum aestivum
  unsure (1)..(167): unsure at all Xaa locations
  Clone ID: PAT_TA_93335.pep
GAPPIPPAXLGXFFWGEFQAVDPPFKTGDILPIPTLAKPGLQGTFFPXGFGTGVSRRPXFQGTAAGTYRCPFFFFGQISIAGFSDDFLVSHSQGFGIHMGLCXGXGWTFSLLHPEDCTSPSRWLGPFEVSFXWKPRSLFFPYPDPLGPKYKFGRGPQPQVGATSQQP

SEQ ID NO: 198918 - protein, 168 aa, Triticum aestivum
  unsure (1)..(168): unsure at all Xaa locations
  Clone ID: PAT_TA_93336.pep
RPRSSSGAYSLVSWYLDNSGPGWGAPDALPDQADXAARAVAWLLLAAYLQLQYRSHGEERFAAPLKLXWWALFLLLSVLALAVHAATSLCYGVPVPALPWARDAVEVLAAVALLVAGFSAKTTGGSASEEPLLNGASESRGDDTVDASLFTSAGFLSVLTFSWMGPLL

SEQ ID NO: 198919 - protein, 83 aa, Triticum aestivum
  unsure (1)..(83): unsure at all Xaa locations
  Clone ID: PAT_TA_93337.pep
PSKNLYKSCIHGIKDGXKLLARGKEELKTRIKILVSRASXTAIEAVEQAGGTVVTRYYTKHSIRRLLNGQSESSVTSCRIRHE

SEQ ID NO: 198920 - protein, 130 aa, Triticum aestivum
  unsure (1)..(130): unsure at all Xaa locations
  Clone ID: PAT_TA_93338.pep
VPNSARGWLLLPTQVLGSRSGSVPFGSLXFKXPGXXXAWXDRRVPLLXCGGLAWATDRTKSLHXSLXQRYVXNXIXLLYDHHXTXEDVAXSRXVQGFDHXRXLTEAXCLQXXFGXSLKXXXGPCXRPXIX

SEQ ID NO: 198921 - protein, 94 aa, Triticum aestivum
  Clone ID: PAT_TA_93339.pep
MASAGVNVLRYSVLGAGVIYGFLHQSKLSSAAKHSAIQKEYDHKVALIAQAKAEYVKRTSPSNPKAASNTAIFDLENPKFDLEAYINKISTDGH

SEQ ID NO: 198922 - protein, 161 aa, Triticum aestivum
  unsure (1)..(161): unsure at all Xaa locations
  Clone ID: PAT_TA_93340.pep
QSPYHLXXPAQYRARXEXIYFLPPRGDRSQPVXXWARRPRXRSPRRXRRRRRPTCSSYASXGQGXRQPHXSXLDXGXFAGQRVSXXXFSSXLXXLGGXXQRPPSWGATAWSADGVXRLXPXGTIPXVXVLCXXRXFXRQTXLXXNSXXRAXWQVPTXPRXG

SEQ ID NO: 198923 - protein, 143 aa, Triticum aestivum
  unsure (1)..(143): unsure at all Xaa locations
  Clone ID: PAT_TA_93341.pep
MASNTRTYSLLVACRRNSRHSLFKLSPSRSVSTDTKLEPLEKQRPTYFKDSLNSVPSFSEFMGVDNKSLEPTDVFKLRTAFVGPPGKQRQITRLPEWLKTPIPNNSNYKKIKNDLRGLNLHTXVCEEARCPNISDCWXGSDKS

SEQ ID NO: 198924 - protein, 86 aa, Triticum aestivum
  unsure (1)..(86): unsure at all Xaa locations
  Clone ID: PAT_TA_93342.pep
MSSYLEQAADSVNDVAAIDQALPDNQASTDNAPGGAQLDPVATSAVEGRRLYIGNLAYATTEGELQELFKGYLIESTSIPKNPRTX

SEQ ID NO: 198925 - protein, 92 aa, Triticum aestivum
  Clone ID: PAT_TA_93343.pep
GRRTLVNPSACTVSRSSGPGTRAAPALSRLGASCGASSLSAEAPGHPNGSGRIYDLLVLLGASLVLNVLSCMMFYIIGRKASLVRPERSRTG

SEQ ID NO: 198926 - protein, 161 aa, Triticum aestivum
  unsure (1)..(161): unsure at all Xaa locations
  Clone ID: PAT_TA_93344.pep
SCRIRHGHGAGERGGRRLRSTSRYHRGELLTPCGSDRRGRPXYLKSAKVIHGKAHRLLLARNRHGDTPLHCAARAGNRHMISCLIELAAGDGMARAMVGVQNEDGRTALHEVIGSDDMQMVQALMAHDKELARVDASDGTSPLFLAISLGHQPDCSLASRV

SEQ ID NO: 198927 - protein, 85 aa, Triticum aestivum
  unsure (1)..(85): unsure at all Xaa locations
  Clone ID: PAT_TA_93345.pep
MAPTVMASSATSVAPFQGLKSTAGLPVSRRSNGASLGSVSNGGRIRCMQVWPIEGIKKFETLSNXXQXIRAAXXIPKYNXLMPSP

SEQ ID NO: 198928 - protein, 76 aa, Triticum aestivum
  unsure (1)..(76): unsure at all Xaa locations
  Clone ID: PAT_TA_93346.pep
RGWNLYLGDWLKGVIPILFPNWSNGCRVGEIWXFLPSAXQGFLISWGYPLKFWPVTNNPPNRDWDPEPKRSDKXSN

SEQ ID NO: 198929 - protein, 94 aa, Triticum aestivum
  Clone ID: PAT_TA_93347.pep
SCRIRHEERTSLDGTCRIWDLRSSRSGTKEEGNGVVSEAVYVIEREGHQGKRPVGGEGIKVFGVHWDKEVGMVSSGEDKKVQINHGRGVTRLTT

SEQ ID NO: 198930 - protein, 104 aa, Triticum aestivum
  Clone ID: PAT_TA_93348.pep
LVPNSARGGAKGRFLPTKPRPETSMVLPKATILQMCEGILKKLMTQKCSHIFNVPVDVEKLNIPDYNDIIKHPMDLGTIKKKLDSGSYTRPSDFAADVRLTFSN

SEQ ID NO: 198931 - protein, 79 aa, Triticum aestivum
  unsure (1)..(79): unsure at all Xaa locations
  Clone ID: PAT_TA_93349.pep
VTXVXXXLXDGXLSPRXXLAXARLRTAWRXGPLXGCRWRRRRAGRRARGGSVRXPLQASLELRRSFYVWXGXLVPNXAR

SEQ ID NO: 198932 - protein, 110 aa, Triticum aestivum
  unsure (1)..(110): unsure at all Xaa locations
  Clone ID: PAT_TA_93350.pep
LPALQFLNLSNNHLDGPVPGSLLRFSDASFAGNSMTRPAPVSPAVPPPSLAPPAAGAPAKKRGRLSEAVVLAIIVGGCVMLFAVVAVLLIAFCSRRGGXGXEPGVREGRG

SEQ ID NO: 198933 - protein, 106 aa, Triticum aestivum
  Clone ID: PAT_TA_93351.pep
SPPTTVNQTSTTPMAARRQSLEKQLAQRPTAPELRARHILPETAAAPALQGAAHDLAKQMLADSLHEKLARRPDAEELVQKGILTEADRLYEERIEEEYAKREGGA

SEQ ID NO: 198934 - protein, 153 aa, Triticum aestivum
  unsure (1)..(153): unsure at all Xaa locations
  Clone ID: PAT_TA_93352.pep
FFWXPEISPSPPXTSANRRRGIRTWSASTGSNSMLMPRSVTAPWRRTASTGPASPAAPQRGRPGRPPPRASGCRQPPPPWPGEKGAGALMVTSLPRAPLLGAPALDVLRCGEASCVAVDAAAPLLGGGSTAAPGPDLALSRTIPTTKGWSGGG

SEQ ID NO: 198935 - protein, 117 aa, Triticum aestivum
  unsure (1)..(117): unsure at all Xaa locations
  Clone ID: PAT_TA_93353.pep
MSGETFEFQAEISQLLSLIINTVYSNKEIFLRELVSNCSDALDKIRYESLADSSKLDSGKDLRVDIIPNKENKTLTIRDSGIGMTKADLVNNLGTIARSGTKQFMXEALTAGADISM

SEQ ID NO: 198936 - protein, 79 aa, Triticum aestivum
  Clone ID: PAT_TA_93354.pep
ARGTELQRKGKASPWLSYVPHIWLPRRPWSSSCTSSYLALRISTRESQGNEINPNTLALDGVNVMEERLANEQSAICNW

SEQ ID NO: 198937 - protein, 78 aa, Triticum aestivum
  unsure (1)..(78): unsure at all Xaa locations
  Clone ID: PAT_TA_93355.pep
SLTLPTPTTPKFSSNFFPSPAPPPPYHHHYYHHHCYYXHYYNYHYHHHYHHHHLYHSLTLPPTPKLWCRLASQHRGLR

SEQ ID NO: 198938 - protein, 86 aa, Triticum aestivum
  Clone ID: PAT_TA_93356.pep
RSRKRPGRGRAWRRGKTWPRSQASWALSTSYVARPSGERLARSSARRRESMELIGKKFGWIFGAESNGSDTNCEDISTSSTQSTRI

SEQ ID NO: 198939 - protein, 144 aa, Triticum aestivum
  unsure (1)..(144): unsure at all Xaa locations
  Clone ID: PAT_TA_93357.pep
KGWALLGPTPPLPPPAGVGPQGREGPIQPVPGQQQGFPGRRXSNPPGHPQFXPAPCTRXPCGSPSVWQSSPPPPRRLIKSLGPFSWLDGIALDYRSRRRIPFSPAPSRTIGLRQKDRTNQWPVARRREEPRRRRRHELRAEFGT

SEQ ID NO: 198940 - protein, 52 aa, Triticum aestivum
  Clone ID: PAT_TA_93358.pep
VMLTSLRWPHRHLDKKWTKRHPRTSNATSNYGWTSGFVLSQTYLSLIKFMKK

SEQ ID NO: 198941 - protein, 121 aa, Triticum aestivum
  unsure (1)..(121): unsure at all Xaa locations
  Clone ID: PAT_TA_93359.pep
TSRMNLVGWXPDILAGSFTITTFGXFSSXTLLXHWTIFNDGCSQAHVXSINNVGTHPPSXMTGSECCLVGADXVSXNEFCGSVGAKRNSKSSXARYPLRPWXPSSVXXVGXXLLFPLRRFQ

SEQ ID NO: 198942 - protein, 166 aa, Triticum aestivum
  unsure (1)..(166): unsure at all Xaa locations
  Clone ID: PAT_TA_93360.pep
EIXGIPPGAGXGSARQWVASACPSSPPSLGRXPAPGSLGPWRAGXRGXGRPNEXRGERRLVRAAGIAGLVGTPNXGGSKKXGDXQPLRQXPCNLGSNVNLXNTRQAGGRAAWDLRQTPNVSGLHRAPSSSRLGEIFKYLXGLVQETTSNXRRXKXEVWGKAEXNFD

SEQ ID NO: 198943 - protein, 45 aa, Triticum aestivum
  Clone ID: PAT_TA_93361.pep
RAEFGTRFSMIEGQRRYVRRVVLKKYEPKTPDHILFVTLVYNYES

SEQ ID NO: 198944 - protein, 94 aa, Triticum aestivum
  unsure (1)..(94): unsure at all Xaa locations
  Clone ID: PAT_TA_93362.pep
EXNGLPLLXLXLNKSXRSTXLXQMLSNPILFVTRILSPRTXLILQFITPVQPLSTPLGKTKYPCCGSMPSXLFFSHDAKSSFSLXLSQMGEEXS

SEQ ID NO: 198945 - protein, 73 aa, Triticum aestivum
  Clone ID: PAT_TA_93363.pep
VLVLQLGSIDGYPKPYMPSPRAKGCAGCLEFPLSDTLKIWRGGPVKYRAVFGPLRDTVNVFSDIDGGQECVSA

SEQ ID NO: 198946 - protein, 131 aa, Triticum aestivum
  unsure (1)..(131): unsure at all Xaa locations
  Clone ID: PAT_TA_93364.pep
PASXLCPAPRPSPGPXKPXPRGKGGHHEGGKXSPLKGSSHSPVPGARKTPRRIKVPGRAKPXYRSKRRVKPXELKSKKKGFASFILPRGXNGXXWKPSXSNKKNERVXKXVASLIXMGIDPXXNGXXXSIW

SEQ ID NO: 198947 - protein, 145 aa, Triticum aestivum
  unsure (1)..(145): unsure at all Xaa locations
  Clone ID: PAT_TA_93365.pep
LLYWIAQLLGSTAACFLLRFSTGGLPTGTFGLTGIGAWEAVVLEIVMTFGLVYTVYATAVDPKKGSLGTIAPIAIGLXIVGANILVGGAFSGASMNPAVSFGPALVSWEWGYQWXVYWXGPLIGGGLAGVIYEAALHLPAPTKQA

SEQ ID NO: 198948 - protein, 134 aa, Triticum aestivum
  unsure (1)..(134): unsure at all Xaa locations
  Clone ID: PAT_TA_93366.pep
LVPRNRSSSCCSSSPSSWPGRKEGKGSGGDQAMAAPLGVPGGAGLDPAXSCVVEWYARPRPDLYQAGEALGTKLTLKXSXQVXSALRPSVQGGGGMXPGFQAWYTSXSILLNFRRRQRXNSFLXNFGSTFRRAX

SEQ ID NO: 198949 - protein, 67 aa, Triticum aestivum
  Clone ID: PAT_TA_93367.pep
KRQTNFDKFNHFNSQYFLIDGEEMFVDYDVAAIAVGCKYCKGLYQVSLIYIFIMEISSREVYYSMYM

SEQ ID NO: 198950 - protein, 64 aa, Triticum aestivum
  unsure (1)..(64): unsure at all Xaa locations
  Clone ID: PAT_TA_93368.pep
PETXXXGFXTXFXLLHRPRXSLPILRFXLKXRGXCKXLKXPREFGXIXYKGPARVLFAPRXFVS

SEQ ID NO: 198951 - protein, 146 aa, Triticum aestivum
  unsure (1)..(146): unsure at all Xaa locations
  Clone ID: PAT_TA_93369.pep
MXPTVMASSVTSVAPFQGLKSTAGLPVSRRSNXASLGSVSXXVGRIRCMQVWPIEGIKKFETLSYLPPLXTEALLKQVDYLIRLQSGCPCLEVQXGWGSSSREHNAIPPGVLRIGPGTWTVKPGNCGIATRTAQRQRLITEGLGRE

SEQ ID NO: 198952 - protein, 92 aa, Triticum aestivum
  unsure (1)..(92): unsure at all Xaa locations
  Clone ID: PAT_TA_93370.pep
RRSQXLYRPPTASXXAXSPXEXSQXPGPTHLPPAAAXXDLXXLXFSSLRLLGGGGGGGGHRCLEGRGETQEQLRTTTVVXPFLLSSCRIRHE

SEQ ID NO: 198953 - protein, 61 aa, Triticum aestivum
  unsure (1)..(61): unsure at all Xaa locations
  Clone ID: PAT_TA_93371.pep
LVPSARARAEGTRFFWNWNTESAPEWHFQNLTRAGLIPQPLGFAERYQASVGTSQXLIPGN

SEQ ID NO: 198954 - protein, 111 aa, Triticum aestivum
  unsure (1)..(111): unsure at all Xaa locations
  Clone ID: PAT_TA_93372.pep
RIQXTVGXAPNXEWNALSQXNAXRPRVXPXVRSLRNSPLVXXKQGXGGGSQXXGGTKXLXTSNPGLFGPNLGGPPESWTXKNRNGSNPXTNPXKGLFPAPPPKXXGVXPKP

SEQ ID NO: 198955 - protein, 75 aa, Triticum aestivum
  unsure (1)..(75): unsure at all Xaa locations
  Clone ID: PAT_TA_93373.pep
XXVRXSLXGKTHPNFXWGPXQXXGGXIRPNQLLXPAGCSXDXPNLXRLTXXLINHLGLALGLEAXXLWGXGDLFX

SEQ ID NO: 198956 - protein, 153 aa, Triticum aestivum
  unsure (1)..(153): unsure at all Xaa locations
  Clone ID: PAT_TA_93374.pep
MPLPVSSYVPAITNPLTIYRSLLATKRIEPDPSQYRLAIHLQNLYFRLIDYSPHLEYSQRLKDLSRLVRNPTXNDENTHVXAXXHPLRQESLIRLAYFPKERCTGESLALXRVXHPTEIGISLFLTTGTWYRVVGKAGESQMFNITLDRGLPK

SEQ ID NO: 198957 - protein, 83 aa, Triticum aestivum
  unsure (1)..(83): unsure at all Xaa locations
  Clone ID: PAT_TA_93375.pep
MAXAGDAXEKKMITLKSSXGEEFEVEEAVAMESQMIRHMIXDGLXXDNRNPAPPQLKILLLRSSGGHVPRKAPPSGRLAPSVE

SEQ ID NO: 198958 - protein, 126 aa, Triticum aestivum
  unsure (1)..(126): unsure at all Xaa locations
  Clone ID: PAT_TA_93376.pep
RXGGWRPLRTGGDXPARLSLRDLTAVHPSSSPEEECCEVXEGHYHXGFXTTVPQKGSXXRTKAWKALRPGGSARPGAANAXEKQGQAVDAAGLEQLGTEAPDRXANLAAQGTDAGCPQPALSTNKM

SEQ ID NO: 198959 - protein, 43 aa, Triticum aestivum
  Clone ID: PAT_TA_93377.pep
IGIHLIVSERLTWRSILNHCLMGQLCFLFLNHLICMQLSSHNT

SEQ ID NO: 198960 - protein, 121 aa, Triticum aestivum
  unsure (1)..(121): unsure at all Xaa locations
  Clone ID: PAT_TA_93378.pep
SLIKGLXXDQIGGNQVRSXNKASRIXALXCCTIHPPHXQTLRGRRRKNRTXXEXPIFCRAPXEGRXVSKSSXLXGNLTNWEXGFILAXPGAPXGSPEESWGFARGHAVXPSRGXXEALGLR

SEQ ID NO: 198961 - protein, 163 aa, Triticum aestivum
  unsure (1)..(163): unsure at all Xaa locations
  Clone ID: PAT_TA_93379.pep
FAVINSSHXHTPXSXTXNEXSCXCVXXXLXTPLHPGGVTRGSIHTWXGGHGADXNGGGXRALKGQVHPKTQVRSSSXRRPTSKSVXAAGLPGXXTXXNARXPAGRXLRWQQGPTAPEGPVAGXEXGPXQXGAGPVAVLPGKRXQALNXRXGXPGRRAKXGGRG

SEQ ID NO: 198962 - protein, 154 aa, Triticum aestivum
  Clone ID: PAT_TA_93380.pep
LVPNSARGGSGPGAGFSSFIARRQQRRAATRGLDAEVVKAFPTMRYAEAKALRVGRKAAPLLECAVCLSEFEDEDRLRLLPKCSHAFHPDCIGEWLASHVTCPVCRRNLDPKQGRWRRTRVTPRCLEPKQQPPAIARWFRHHQKAGAGPWVQSN

SEQ ID NO: 198963 - protein, 101 aa, Triticum aestivum
  unsure (1)..(101): unsure at all Xaa locations
  Clone ID: PAT_TA_93381.pep
XRXFXLLTPFFKIFXLRTIFILLGXPIQAFXVCLDLFCRSFVSQIYFPGEDPRPAGFSFANNDFRLLAFPGLCFARRVSHFNLAVHGLHNLCRTVRYRFXL

SEQ ID NO: 198964 - protein, 154 aa, Triticum aestivum
  unsure (1)..(154): unsure at all Xaa locations
  Clone ID: PAT_TA_93382.pep
FISSRRSLHRSQERSRAKGGRREMSEEXARPRARXKGRGWVTRRSTPSTLHKAPPWDAPSKERKAPKCHQREDQGESLQQEKGPWGEPNGWSAIERWKASKQKAQSWGXQSGAIKGSGPPKXRKSGGQRGXAPXKEGKMEPKGRDXLKGEGKPG

SEQ ID NO: 198965 - protein, 121 aa, Triticum aestivum
  unsure (1)..(121): unsure at all Xaa locations
  Clone ID: PAT_TA_93383.pep
SCRIRHELQQPLIERVSYSKLYTPLTGGEWQPQIPTFINTTHFLHDSPISRPSIVESPRLTEFIRTSWKEKLPSQAMGSQETKVLRRNAAAAPNKXKQRSFPGKSWGPGRKSRGXATFTXS

SEQ ID NO: 198966 - protein, 90 aa, Triticum aestivum
  unsure (1)..(90): unsure at all Xaa locations
  Clone ID: PAT_TA_93384.pep
ARQHQXRPGSLQRRAGRSPCPVRPGGVEDXAMAGQMYAPWCSFPLMGPPASMHPGLDGHHLHIGHSSSSRPPPCCRXSCMYILAWDRLGA

SEQ ID NO: 198967 - protein, 136 aa, Triticum aestivum
  unsure (1)..(136): unsure at all Xaa locations
  Clone ID: PAT_TA_93385.pep
MQLSTYLAVAISVGSSNALYQGFNAQVRNSDGSCKKQADWEADFNTTLSLPGNFNSLRLFSSLECDAINLIAPAAIVTGGKVLAGIXDTTPKNFLQVEKQQLLXKAVKHHGSEWLAAXSVGYDDLKNSEILSDSPS

SEQ ID NO: 198968 - protein, 101 aa, Triticum aestivum
  unsure (1)..(101): unsure at all Xaa locations
  Clone ID: PAT_TA_93386.pep
SCRIRXELPCSPLLLLLLLLPVDHCTCTAXDFFTDXSXQSXEXXFDRQXXICCTTGHXXXRXXVPXHEXGAEGRPKTRRPKPXCAGGGLXSPAPQRPAKGW

SEQ ID NO: 198969 - protein, 173 aa, Triticum aestivum
  unsure (1)..(173): unsure at all Xaa locations
  Clone ID: PAT_TA_93387.pep
GPXFGLXPPXLGRXGGIVLXRRIKVWGKRQGXFPSQXXXVKRRPVERRRNTXSPXRANLGTGAPPSCRIRARGEAPLQHPPRCITAPGFAVKLQCSAGEVSLQPSAVTGEATLHRLPACYIAAQGRRGSSIVAPPAASRLRAPPVKLRCSAEFYDSARALHRTXRSHRQALRC

SEQ ID NO: 198970 - protein, 120 aa, Triticum aestivum
  unsure (1)..(120): unsure at all Xaa locations
  Clone ID: PAT_TA_93388.pep
KNXSCKLARXWTTQSIMASADIMKLXGFVSRANPKXNDRHVILGVVGWKPRDFAQQMNLSLSNGWGIVRTIADMCLKREEGKYVLLKDPNKPMLRLYEVPVGSFEEEEPETIDEVEEPEN

SEQ ID NO: 198971 - protein, 84 aa, Triticum aestivum
  unsure (1)..(84): unsure at all Xaa locations
  Clone ID: PAT_TA_93389.pep
RDAIAKPWSWKSRNLSKWXPTKALWKSMVKSNKIGLAFINSSNGAKWDRTPSLSFVFGGEKMFAFSGWGVXXDVXPXGXNFEXR

SEQ ID NO: 198972 - protein, 108 aa, Triticum aestivum
  unsure (1)..(108): unsure at all Xaa locations
  Clone ID: PAT_TA_93390.pep
LVPNSXXGPVQAPARRRNXEHYLPLLPRPAPPHPPAPPLPXPRHXLPASGRSPRXRXAPPPSPGPRAGGAXERAALGARPGRSTDEGGVTAAARRPSVSARGRRGGRG

SEQ ID NO: 198973 - protein, 114 aa, Triticum aestivum
  unsure (1)..(114): unsure at all Xaa locations
  Clone ID: PAT_TA_93391.pep
RAEFGTRFGKNILIATGXSEATPFPGLEXDEKRIITSTXGAIALSKVPESMVVIGGGIIGLEMGSXVWSRLGAKVSVVEYLSQIGGPGMDAEISKSVQKIFKKQGHRGSNSIPK

SEQ ID NO: 198974 - protein, 158 aa, Triticum aestivum
  unsure (1)..(158): unsure at all Xaa locations
  Clone ID: PAT_TA_93392.pep
LSATLFLRPRLEQQERAQPWRRTETFAFXAXIXQLLSLXIKTFYSNKEIFLXXELISNSSDALXKIRFESLTDKXXLDAQPELFIHIIPDKATNTLTXXDSGIGMTKSDLVKQPPGTIAKVGEPRVSWEGPSPARRPTSMNWGKFWWFGFSSRHTFGR

SEQ ID NO: 198975 - protein, 127 aa, Triticum aestivum
  Clone ID: PAT_TA_93393.pep
DFSAHSNYVELALREMGYRDVFPHTGVSTELNIQGHYIYPLTTGTFGAVDFLHSVLGEATDHFTQTEVDEMDLVLKNAEKIQDGDSRKSSLFGSGSDLIRLLKKVPGLGLDLSSTAKNLKIFRKRNN

SEQ ID NO: 198976 - protein, 53 aa, Triticum aestivum
  Clone ID: PAT_TA_93394.pep
YNLSKQIYGYLIYEIKSLSLCGHSYKGIIFKELKLLDLKLSSQWFTSRAEFGT

SEQ ID NO: 198977 - protein, 108 aa, Triticum aestivum
  unsure (1)..(108): unsure at all Xaa locations
  Clone ID: PAT_TA_93395.pep
MGKIKIGINGFGRIGRLVARVALQSDDVELVAVNDPFITTEYMTYMFXYDTVHGHWXXTSDIKLKDDKTLLFGGEAKLPSFGVRNPGGRSPLGEGLVIYVCGGPTGCL

SEQ ID NO: 198978 - protein, 64 aa, Triticum aestivum
  unsure (1)..(64): unsure at all Xaa locations
  Clone ID: PAT_TA_93396.pep
SXDTNTFINILARPMTLICHGVTXSSLNLKFQVSXHITTSFMSQRDSRFESPXDLGFFRAKSRD

SEQ ID NO: 198979 - protein, 150 aa, Triticum aestivum
  unsure (1)..(150): unsure at all Xaa locations
  Clone ID: PAT_TA_93397.pep
SCSSIKFVLLTLHKGATRSIVEARLKNLGLRLIRLPLEQEATDRHVPIFVSSELKSKKRIIILFYEQQQDLGILSYRIICGKGGINHGSVVNMVKFIQSTHCSPDSQDSPGIILXNMGQLRWWRRGKKALTQNSWDTXPSKSLVDPCYQF

SEQ ID NO: 198980 - protein, 49 aa, Triticum aestivum
  unsure (1)..(49): unsure at all Xaa locations
  Clone ID: PAT_TA_93398.pep
MXSKGGKKSXSSSSXMYEAPLGYSIEDVRPAGGXKKFSAAYXNCXKKPT

SEQ ID NO: 198981 - protein, 130 aa, Triticum aestivum
  unsure (1)..(130): unsure at all Xaa locations
  Clone ID: PAT_TA_93399.pep
IREFSXSWRSGGVVLANFWSKIRLAEISRLHNSTKSTIYTPGTNRKIGYNLSDVRITTTDTFRILFSFSLXNSFSAKLISRASPQTSHHLQKKSHTSKKPNRHQRSKKMSXPPQLPIAVRVRSEITGSDA

SEQ ID NO: 198982 - protein, 118 aa, Triticum aestivum
  unsure (1)..(118): unsure at all Xaa locations
  Clone ID: PAT_TA_93400.pep
MVGSTAVLAAILLIDIXAFGLAIGADQSXPSASLETXARKEWTYCVYRPDAATGMGGXALALLXVGXAVAGVAXRCFCCGAXALRPXXRXAGWALMXFPSSWWHFSAGGDAWLGPGPP

SEQ ID NO: 198983 - protein, 82 aa, Triticum aestivum
  unsure (1)..(82): unsure at all Xaa locations
  Clone ID: PAT_TA_93401.pep
GNKNRFEKVFIVXPQPRFXGXGCXHLXGGYNGNRFCFLFXWLLRCXSXXGCLXXXHGXTRQLKRLTLGIPEFFISNSRHLFA

SEQ ID NO: 198984 - protein, 103 aa, Triticum aestivum
  unsure (1)..(103): unsure at all Xaa locations
  Clone ID: PAT_TA_93402.pep
MXSXAXXEXRSGADVHTELCEXXAREFLXELGLPDGVLPLPSLLEVGYXRATGFXWXRXXXSXGLTHNFNAIXKXVWYXPXVTAVVERXRMXTINGXKXKEVL

SEQ ID NO: 198985 - protein, 149 aa, Triticum aestivum
  unsure (1)..(149): unsure at all Xaa locations
  Clone ID: PAT_TA_93403.pep
RLEMQRFYWWGAXXPPMLNDXGXXVDWYAHLQTPXIFNHHEPLVINESSIXXISLNPXKSTPKAVMNEERILIXTPLRDAASYLPKYFDLLSELSYPHHLXDLXFXVXDSTDDTLAVLSXXLQRIQXKSGYIKANHFGGPINWKKGFGD

SEQ ID NO: 198986 - protein, 136 aa, Triticum aestivum
  Clone ID: PAT_TA_93404.pep
CIETRLFKRLRQRLISYVPPHNNATINLDEEVKLTESKSRARSPGFSGQRFSSILVTLDEIEKAFLKDAIAVSSYTEICDRLLKQYKAILNDEAVSREFVDLETFKNTWEIEVPRATERVRIGLPSTSYCHESNIS

SEQ ID NO: 198987 - protein, 150 aa, Triticum aestivum
  unsure (1)..(150): unsure at all Xaa locations
  Clone ID: PAT_TA_93405.pep
SCRIRHELVPIRHEGQIGYALVPMIARGVMLGADQPVILHMLDIEFAAEALKGVKMELIDAAFPLLKGVVATTDVVEACTGVNVAVMVGGFPRKEXMERKDVMTKNVSIYKAQASALEAQAXPNCKXVWVVANPTNTNALILKEFAPSIP

SEQ ID NO: 198988 - protein, 52 aa, Triticum aestivum
  unsure (1)..(52): unsure at all Xaa locations
  Clone ID: PAT_TA_93406.pep
DATQVINEVXEEVKKEYPDAYVRIIGFDNMRQVQCVSFIAFKPPGCEESGKA

SEQ ID NO: 198989 - protein, 115 aa, Triticum aestivum
  unsure (1)..(115): unsure at all Xaa locations
  Clone ID: PAT_TA_93407.pep
RRRNRRLRAAVHNEKDLRGCYXXIKNKPYPKSXXCRGVPDPKIXIYDVGMNXKGVDEFSHCVHLVSWEKENVSSEALXAAXRIACNKYMTNXAXXXDAFHLKGQGSTVPWCSRNK

SEQ ID NO: 198990 - protein, 138 aa, Triticum aestivum
  unsure (1)..(138): unsure at all Xaa locations
  Clone ID: PAT_TA_93408.pep
MFHIDWVGLSVPLAYICVLVGSLITFSSVYRRRKAAASASLAPWFPPHIQRDIYLSLLHLEPENKDGKLLVVPDSLKRAALLRRALGDIHRIIQIRNAKQACSSLLQRGSVGDDLWQRFLRTENEMXEEELXDVXIXA

SEQ ID NO: 198991 - protein, 174 aa, Triticum aestivum
  unsure (1)..(174): unsure at all Xaa locations
  Clone ID: PAT_TA_93409.pep
WLRLCSLRPLXRLLFSPPPSVTVPSLFIXPPPSSLSPGHSSLQSACVGERRRYSCWWREYVPXXGRQQAAGAKEEKEKGEGGAGAGAGGDCLRRFFLAVRXGRRDEKPCCGICDLLFRALDPPVSSGCRPAMLRRNGVXTKGRAPXGNGXXPKPPPVXGXLFARSXVXKXAXGP

SEQ ID NO: 198992 - protein, 167 aa, Triticum aestivum
  unsure (1)..(167): unsure at all Xaa locations
  Clone ID: PAT_TA_93410.pep
SCRIRHELALHLLPPHILTPISASSALPAAGDAPLSEAVQKLNALNTLLSQASYAAFWSTLDSDDLYADLIVDVAGFEELIRIRIAXAVSQTVREIDXQVLESCLGIQGDSFXAFINGVCGWXIKGNQVHXPLNKKNEAKXAQLVXENXNIQQFSXVIRRGXDKPSL

SEQ ID NO: 198993 - protein, 153 aa, Triticum aestivum
  unsure (1)..(153): unsure at all Xaa locations
  Clone ID: PAT_TA_93411.pep
MXPTVMASSVNSVAPFXGLKSTAGLPVXRXSNGASLGSVSNGGRIRCMQVWPIEGIKKFETLSYLPPLXTXALLKQVDXLIRSKWVXCLXFXKVGFIFREXHNASPGYYDGRYWTXWKLXMFGXXRRQRXVIKXGGGGQXKGXPDAYXXIIGF

SEQ ID NO: 198994 - protein, 177 aa, Triticum aestivum
  unsure (1)..(177): unsure at all Xaa locations
  Clone ID: PAT_TA_93412.pep
MVPRAAAVPNSDSFVPPLSAQTSLPPNSSPFRQRTQTPPAAMRECISIHIXQAGIQVGNXCWELYCLEHGIQPDGQXMPGDKTVGGGDDAFNTFFNETGAGKHVPRAVFXDLEPTVIDEVRTGAYRQLFXPEQLISGKGRMLANNFRPVGITPFGKGELLXXXLXRYQXSXQDNCWS

SEQ ID NO: 198995 - protein, 135 aa, Triticum aestivum
  unsure (1)..(135): unsure at all Xaa locations
  Clone ID: PAT_TA_93413.pep
MCSAKITRNFRLLKXLXKGEKGLGVETCSYGLVDGDEMLMSNWMGTIIGPPRSAHENRIYSLKMYCGDXYPXXPPTIQFXSRVNLPCVKSGWKGLIQNPCLSKLITSTHGRTVFELKTWALPKQKLPQNGISLSR

SEQ ID NO: 198996 - protein, 117 aa, Triticum aestivum
  unsure (1)..(117): unsure at all Xaa locations
  Clone ID: PAT_TA_93414.pep
RIPLQYXLFXMAWRXAXAWKGELSCPPHGERVELXESEXGXAPERAVRGXRSVSSQXAPPXPCAFXPGHLSPAAPPEPRSRRGXVQIRPESXRRNPRXVRCAXGPLARRRSFRIXHE

SEQ ID NO: 198997 - protein, 68 aa, Triticum aestivum
  Clone ID: PAT_TA_93415.pep
LVPNSARVFKSRKLHVEFKSSIISHHITHLLGLHNTTKPSMEYISLHKNIAETEGIYNKTIMAHLLQS

SEQ ID NO: 198998 - protein, 90 aa, Triticum aestivum
  unsure (1)..(90): unsure at all Xaa locations
  Clone ID: PAT_TA_93416.pep
VXLHLYGIXLGTDSQIIPLKNXDEXPHKSIALSKMNTSDLMFGDHLFELTXLMRAKGDVGIISDIIPEAIKIHKQDHCQTHSNKXPSVRI

SEQ ID NO: 198999 - protein, 109 aa, Triticum aestivum
  unsure (1)..(109): unsure at all Xaa locations
  Clone ID: PAT_TA_93417.pep
PPPRXREPRFXLPPGVGXSTQIPDHXLWRCRXGLVXRXTLXPXFVNGTWYTPXLPTFPAVGVDVDCQAASQVPRGLSTLIFLXTACRRRRRRNPGGRGRXRSSAPQSAR

SEQ ID NO: 199000 - protein, 76 aa, Triticum aestivum
  unsure (1)..(76): unsure at all Xaa locations
  Clone ID: PAT_TA_93418.pep
SDLVERGFLNLYIEAHIYEHLPELHNVKLERIKXSTLHRQNRQIQFALTSLVPDHQYHFILKSTAEKKMLDSIQEI

SEQ ID NO: 199001 - protein, 93 aa, Triticum aestivum
  unsure (1)..(93): unsure at all Xaa locations
  Clone ID: PAT_TA_93419.pep
XGGXYSPGGGXTXEXRXWPRLAARGARXPXGGVRSAAXIIGGLSSSRXMAPVXAAXPVVSRNPCPXRYSLAPXDDRGGGGXRREGRKKHXLVA

SEQ ID NO: 199002 - protein, 90 aa, Triticum aestivum
  unsure (1)..(90): unsure at all Xaa locations
  Clone ID: PAT_TA_93420.pep
MKXNKLPGXLILQAVLXMGXLSHVNADYFPKCCNNCRSFSGVDVCDDAHPKCPKGCSACXRVVSXNPEMWRCXDXKSNVDXNCXGACKKY

SEQ ID NO: 199003 - protein, 66 aa, Triticum aestivum
  unsure (1)..(66): unsure at all Xaa locations
  Clone ID: PAT_TA_93421.pep
VLSLGEXLXRAGTNGLLNLGRQPXRAPRGGGXPRLXKQRLSPXXXRSTCYXXAGPLLSCTSLVILP

SEQ ID NO: 199004 - protein, 144 aa, Triticum aestivum
  Clone ID: PAT_TA_93422.pep
FFSKRRSKRSKQSDQPSYTEMKSFSYADLTKATNGFSPHNLVGSGAYGSVYKGVLESETNGMIAVKVFKLDQLGAPKSFVAECEAFRNTRHHNLVRVISACSTWDNKGNDFKALINEFMANGTLQSWVYSKTKKTVEFGLQSKQ

SEQ ID NO: 199005 - protein, 146 aa, Triticum aestivum
  unsure (1)..(146): unsure at all Xaa locations
  Clone ID: PAT_TA_93423.pep
LVPNSXRAQIDMPRPRAXRPTGALSPPRNNLLAFSXIALSPSPASXFFLFFLWACREQPQGXSPLLPPPGHRRAAASSEFAXRWXSSSPATSASPCRRTMMXSAPAIEXLPGXSFSXRMGWGGPFFSPXLXWAETARRGKXGPFPG

SEQ ID NO: 199006 - protein, 144 aa, Triticum aestivum
  unsure (1)..(144): unsure at all Xaa locations
  Clone ID: PAT_TA_93424.pep
MIPRNSLRHVQKSFRSYYFPTGTKRQFSKSLGWLTQSSHQTSKYEKKTHFGFETVTEAEKEDRVGGVFSSVAASYDTMNDFMSLGIHRLWKDHFVRSINPXFXHQKRPPLPRSMLDIAXGTGDIALPSTKSLRIESTNPSESHN

SEQ ID NO: 199007 - protein, 176 aa, Triticum aestivum
  unsure (1)..(176): unsure at all Xaa locations
  Clone ID: PAT_TA_93425.pep
XXLXLRXRXGXGXWXRFNLGRXXDSPRXKRDPSGRETQGGGPPRGGPXLHAAKXXEEPPRPGAXXEVXPLPQXXPLCPPGTAFEXPPPPRRRRRRGGRXLTRARFXCRTPPNIXAXGSRTSRXPSRXXWNGGMARKXSRXFLXPQSINQSIGRXCERAXXXXRREKXGEGGGGAGD

SEQ ID NO: 199008 - protein, 101 aa, Triticum aestivum
  unsure (1)..(101): unsure at all Xaa locations
  Clone ID: PAT_TA_93426.pep
FEIVFVXPTXEXIKNKRXLXNXLKANPGXPTSSEFXWXTGETXRRSAXXSEKVKVFDXPHGEKIPKRXXNSSGKKGKQXKKXDPETEERQKKAXXGQRRAN

SEQ ID NO: 199009 - protein, 98 aa, Triticum aestivum
  unsure (1)..(98): unsure at all Xaa locations
  Clone ID: PAT_TA_93427.pep
ILCIAELLGIQCVNIIHGGDKCGMSMHACVSFVALYIISKVRKYLTKTYVSFIYTCHESAMVSPSVAGRSSXFCSCSGLLVKKVXSPHTKKGAKDQES

SEQ ID NO: 199010 - protein, 75 aa, Triticum aestivum
  unsure (1)..(75): unsure at all Xaa locations
  Clone ID: PAT_TA_93428.pep
MSCNCGSXCXCGSNCKCGKMYPDLTEXGSAAAEVAAVVVLGVAPENKAGQFEVAAGXSGEGCSCGDNCKCNPCNC

SEQ ID NO: 199011 - protein, 66 aa, Triticum aestivum
  Clone ID: PAT_TA_93429.pep
MHLMYTLDASGKRIYTLNKIVSGEVSKSAHPARFSPDDKYSRHRVTLKKRYGLLITQPKDIRILGQ

SEQ ID NO: 199012 - protein, 161 aa, Triticum aestivum
  unsure (1)..(161): unsure at all Xaa locations
  Clone ID: PAT_TA_93430.pep
MKISMAAAAPLLLALAATXGAVTFDVTNEAASTAGGQRFDREYGAAYAKQVLSDASSFTWGIFNQPDPSDRRPADGDTVTLAVRDTDGIASTKXASTIQLXARSVGGITGDNLXEQVDGVLFHXVAHVWXWGLQEYGAHSGISRVSRTNXRVKGRYXXANW

SEQ ID NO: 199013 - protein, 153 aa, Triticum aestivum
  unsure (1)..(153): unsure at all Xaa locations
  Clone ID: PAT_TA_93431.pep
MGKXMMGGSNNSCSPRRALLKPAGSSXPRRRPRRKPRSFLKQLPGLAAKXXAXGVASVPLPXLGVEMEKXXLFDFKLTLPXXXXEFLLLMGGAGTXSTSPPLGKXMDERERQFAPELRAVKGLRKVRWGSKAKGKFQKAPREISGGSNKDKGT

SEQ ID NO: 199014 - protein, 114 aa, Triticum aestivum
  unsure (1)..(114): unsure at all Xaa locations
  Clone ID: PAT_TA_93432.pep
SXXPQQVSXHWEKNXTFNSXFXRXNTNNXGKQKVMXALTNIKGGGKKIFQPCLQKSRRXTXTKXSWEKLTSERTLSGVVXNLXKNPTKYKDXLQGFLTDKRDIIDGERTNKFXG

SEQ ID NO: 199015 - protein, 61 aa, Triticum aestivum
  unsure (1)..(61): unsure at all Xaa locations
  Clone ID: PAT_TA_93433.pep
XDSNVKGRSTHSLRISFASSHLLSCXSFFLWPQVTPHPGEYPPQGNVSKILKLSRHASIIH

SEQ ID NO: 199016 - protein, 64 aa, Triticum aestivum
  unsure (1)..(64): unsure at all Xaa locations
  Clone ID: PAT_TA_93434.pep
RAEXGTSSXRIRHERHDXVGXRNQLPAXSSFYMXNHGAXSXQXVKXCXTXSVXXPTYNQXLXAT

SEQ ID NO: 199017 - protein, 75 aa, Triticum aestivum
  unsure (1)..(75): unsure at all Xaa locations
  Clone ID: PAT_TA_93435.pep
RXGGXQPXEDSLVGASPPCPKRKKRKNLXRQGRERXTMCEKXEEGFSRXRIXLPVXRXATRARHIELGLXPNSAR

SEQ ID NO: 199018 - protein, 116 aa, Triticum aestivum
  unsure (1)..(116): unsure at all Xaa locations
  Clone ID: PAT_TA_93436.pep
FFFFLWKAALFVPIASXHMRYSNCSTDYATQGASVREQYKPYQLKSTFGXNSRXXVLPSKHLDXSSHCWXICKNLTEMHHNPNTINFLTTSVISPLIPESTGDNIHXSVQKSTAGK

SEQ ID NO: 199019 - protein, 158 aa, Triticum aestivum
  unsure (1)..(158): unsure at all Xaa locations
  Clone ID: PAT_TA_93437.pep
EFFFFFSPPVVTKQKVLETCXKGWALHAPQAGIRERVSNXXYXPSRAXXAXPAVVSPSPXNHALVXARRXSRFXCKCKNSVYXVIVGXAXKXWDNMXDXRCEXXPVLLDFXXPLCWDXXRWIXPCVXGEXXEKGXVGKIKCXKXKRDNTREGAIVAQC

SEQ ID NO: 199020 - protein, 134 aa, Triticum aestivum
  unsure (1)..(134): unsure at all Xaa locations
  Clone ID: PAT_TA_93438.pep
QLLGRPLQSSISRSSSSRKSPFVVRASSNPPAKQNDNRQLWFASXQSLTYLXXTLPGDFGFDPLGLSDPEGNGGFIEPKWXXYGEISTAGRRMMGVVGMIAPGRXGQXGXWCPPGERGIPWFQGKAPIPAGRAT

SEQ ID NO: 199021 - protein, 132 aa, Triticum aestivum
  unsure (1)..(132): unsure at all Xaa locations
  Clone ID: PAT_TA_93439.pep
MAPTVMXSSXTSVAPFQGLKSTAGLPVKXAAPTALSLGSVSNGGRIRCMQVWPIEGIKKFETLSYLPTLSTEALLKQVDYLIRSKWVPCLEFSKVGFIFREXHNASPGYYDXRYXWTMWKAALCSGXTDATR

SEQ ID NO: 199022 - protein, 92 aa, Triticum aestivum
  unsure (1)..(92): unsure at all Xaa locations
  Clone ID: PAT_TA_93440.pep
LRQGTAPXRTYPGLPXTFQXTELEYLKCILRPREKALXFSECPPXLXCXRSCEKLPPPGVKEIIQDKGWQKFSQFLTTGRCYSLPKNEQGVR

SEQ ID NO: 199023 - protein, 67 aa, Triticum aestivum
  unsure (1)..(67): unsure at all Xaa locations
  Clone ID: PAT_TA_93441.pep
MXQTPQQRKRNEKFSKLQNAKRGKANIEVKPKQEFKSPLSPLWAGLLSFVVFGGLVXFELINRIFIH

SEQ ID NO: 199024 - protein, 128 aa, Triticum aestivum
  unsure (1)..(128): unsure at all Xaa locations
  Clone ID: PAT_TA_93442.pep
RNYRSIRIGGRPGSXRVVIDDQGSLVGVVMNAKNGAGVKPTYEKCTPFLKYDKLSPELNVDNRYKISGFACGSNFLSTEIQNEMKCKCSGLKNLSPTNKRGFSSFLXQMVIHGQKINYXIKHVTKKGL

SEQ ID NO: 199025 - protein, 109 aa, Triticum aestivum
  unsure (1)..(109): unsure at all Xaa locations
  Clone ID: PAT_TA_93443.pep
RXHGDSVDSLPALELKLSKRRXAQVPGLLLPPLTGGAIGYVGYDCIRYFEPKTXKPMKDILKVPESLXMFFDTXVAFDRLTEQMKVITYLHVPEDLSMLPRCIQICPKK

SEQ ID NO: 199026 - protein, 143 aa, Triticum aestivum
  unsure (1)..(143): unsure at all Xaa locations
  Clone ID: PAT_TA_93444.pep
MKGAKSXGAAKADAKLAVKSKGAEXPAAKGKKGXAGKDPNKPKRGPSAFFVFMGEFREEFKQKNPKNKSVXAVXKTGGEXWKSLXXSRKRPLCXQGATKLKXGVKQRALXLQKXAKSAFAXAPKKGAXXEGGKLGGNLNSNGI

SEQ ID NO: 199027 - protein, 167 aa, Triticum aestivum
  unsure (1)..(167): unsure at all Xaa locations
  Clone ID: PAT_TA_93445.pep
KSSAARTTCVSMSVDVTKSVHSLVLDSGPIIKNETSASTLLSLAETLYTIPSXVIEEIRDAVTRARVESLLLPFLTIRSPRPASIKTIHEFARKTGDLXYLSRTDIHLXALAYELECERNHGDWRLRKHXQGQKRXNXSPTASLNGSPQQPITKYFKKYLVRRPDKS

SEQ ID NO: 199028 - protein, 101 aa, Triticum aestivum
  unsure (1)..(101): unsure at all Xaa locations
  Clone ID: PAT_TA_93446.pep
PKRLSVSNSSLQLTFLYAVICRGPSSGMHGMIYFLHLLFLLFPDFLITNNHIIIITTFNIQSRFLKKYHQPHYXLRSRFLLXQKRSLXRIXHDSHVEGASF

SEQ ID NO: 199029 - protein, 102 aa, Triticum aestivum
  unsure (1)..(102): unsure at all Xaa locations
  Clone ID: PAT_TA_93447.pep
MAPTVMAXSATSVAPFQGLKSTAGLPVSRRSNGASLGSVSNGGRXRCMQVWPIEGIKKFETLSYLPXSVPPRAHYRVVLAQSQVISVNHSWVYIAWECYVGD

SEQ ID NO: 199030 - protein, 84 aa, Triticum aestivum
  unsure (1)..(84): unsure at all Xaa locations
  Clone ID: PAT_TA_93448.pep
ANSYLMKVFHRFIMRXKIKSSLAEIRLQISRQFFLVARYRPAPFCDYTVXFSSSXXRVSQLESKWLLPIFEGSQXGXEIXRPGX

SEQ ID NO: 199031 - protein, 70 aa, Triticum aestivum
  unsure (1)..(70): unsure at all Xaa locations
  Clone ID: PAT_TA_93449.pep
KXHIXHCXDYLRRNILKRWAREXXSXQVSXTSXSXSDYXXGTXXFXVXXKLKPYPIIANMXENSXXTXXH

SEQ ID NO: 199032 - protein, 107 aa, Triticum aestivum
  unsure (1)..(107): unsure at all Xaa locations
  Clone ID: PAT_TA_93450.pep
GHHMISYYXHRATXXXQSLVTHTFRPXLPXSXGWRWGDEEGGAGGLGLRVHVAPPQPLPHLQAVPQPQFPPSKTSSVRLELRRWRGFDWLELLLVPNSAPARAEFGT

SEQ ID NO: 199033 - protein, 77 aa, Triticum aestivum
  Clone ID: PAT_TA_93451.pep
AEITRYSDAVFPRHSNTGTTVILNGELIMNGFSQVGFSLSVCGLLRIYHRYMFLECYVVPQDEIRDKWLLTRAEFGT

SEQ ID NO: 199034 - protein, 75 aa, Triticum aestivum
  unsure (1)..(75): unsure at all Xaa locations
  Clone ID: PAT_TA_93452.pep
NPXVRXVLXRAXLRATXLXHPXCXVLLDVPTRVMSSSTVHGPXLSLVFSQQGALTIASFSHSSVLSRLLSLSLCV

SEQ ID NO: 199035 - protein, 81 aa, Triticum aestivum
  unsure (1)..(81): unsure at all Xaa locations
  Clone ID: PAT_TA_93453.pep
AVLIRSNQMLQSKSEFLSLRSGWNRHTLLIVRHCSLQPGSPTQTPALRRKVSQESGLLDRGRDYYRAVMISEKELGXKPXE

SEQ ID NO: 199036 - protein, 105 aa, Triticum aestivum
  unsure (1)..(105): unsure at all Xaa locations
  Clone ID: PAT_TA_93454.pep
LDSAXXXVRDIRRTFSXXXTACEVXXWHDREGRLRSXXXVPAXPLPIAPPLYPRLVHGVRNRQLDKSDDILGIAIGHDHGVYQVECRRRSYSDSFKFTSVELFNC

SEQ ID NO: 199037 - protein, 96 aa, Triticum aestivum
  unsure (1)..(96): unsure at all Xaa locations
  Clone ID: PAT_TA_93455.pep
XPLKIFYLFPPPXIXGXIKXIQLIPXGRLSAARGRRKLRLGHAPDWLQALRRALEGAPPPRFGFPPGRAGXVFRXLCFVARISGXGAFASPRGNPT

SEQ ID NO: 199038 - protein, 72 aa, Triticum aestivum
  unsure (1)..(72): unsure at all Xaa locations
  Clone ID: PAT_TA_93456.pep
ASWPTARSRRGGSSRAAAGRRRGAAARAGTGGQCCRGVAEQLLCTFXKAIPSLRPSRRPAGTXRGXPPGRRC

SEQ ID NO: 199039 - protein, 78 aa, Triticum aestivum
  unsure (1)..(78): unsure at all Xaa locations
  Clone ID: PAT_TA_93457.pep
VRXMTXXTVVEXSSPRAAPTAXSYRSGQRARPXSWRSXRAAARRGCVGEVLVHQQARRAVLARHAHSSFTTFTCRMEL

SEQ ID NO: 199040 - protein, 49 aa, Triticum aestivum
  Clone ID: PAT_TA_93458.pep
DHHVLGVGCKIRFRPGHAAWSDVQDQNSSTSRFSPLDRSSVAQLLVHVW

SEQ ID NO: 199041 - protein, 104 aa, Triticum aestivum
  unsure (1)..(104): unsure at all Xaa locations
  Clone ID: PAT_TA_93459.pep
SCRIRHEPTHSSYYLGTTSPTELASRAMAPNGDNTVXNVTSGIDSTNKTLLKSDALYLTSSTPPCSPASTKCMRTCASXRRPWXHDXPAGTXGVXXXRKNXXWG

SEQ ID NO: 199042 - protein, 76 aa, Triticum aestivum
  unsure (1)..(76): unsure at all Xaa locations
  Clone ID: PAT_TA_93460.pep
SCRIRHEIPFREEMAKRHLKXSGDLGKIIFMEYDLRNTKXLEESVRHSDVVYNLVGRXYPTKNFDLXDVHVEXVDE

SEQ ID NO: 199043 - protein, 109 aa, Triticum aestivum
  unsure (1)..(109): unsure at all Xaa locations
  Clone ID: PAT_TA_93461.pep
GVLPWSTGKKKQDGLHNGXXRXHLXXPGXGNIXDQVXRAMSXENXDXRSPGIXGLTKXPAXGREEXFQXTXRDPLXFQXDXLEGXQXLXGXGXSLLGLXVWLQXXLCLF

SEQ ID NO: 199044 - protein, 109 aa, Triticum aestivum
  unsure (1)..(109): unsure at all Xaa locations
  Clone ID: PAT_TA_93462.pep
IPSSHFGLDGELYVSLVEVHITLLKSQSMPKKWKDSKQEQKRKRLQNSFGNSPSRTALFDGNSKSKTLNRSCSPRVKIQPLGQKDAEETKQNKSPNIKFRSIKRXQVQV

SEQ ID NO: 199045 - protein, 106 aa, Triticum aestivum
  unsure (1)..(106): unsure at all Xaa locations
  Clone ID: PAT_TA_93463.pep
IFLPAXDXLNXXELPGGAFAMRRGDXEVXGPGXCGPVXTVXRXASXARHSAXPPCCPXARXXSPPPXXXYRXTKARXSPRAPFFFIFFAXSLRSXXTLSFCCXNSL

SEQ ID NO: 199046 - protein, 85 aa, Triticum aestivum
  unsure (1)..(85): unsure at all Xaa locations
  Clone ID: PAT_TA_93464.pep
XTXNNPXKVSXXQDHXXXXAVTHETCXEHAPQLGXXSNGATXSTSSEDLDLNPISISVGGDPPVRMLPEPLLLQIRGRRQLPPKR

SEQ ID NO: 199047 - protein, 120 aa, Triticum aestivum
  Clone ID: PAT_TA_93465.pep
MKTMQTAVWGALAALVVAVTAQTGDNLPECGRRCIDNMHKKATELGCADGDAVCLCKNANFAYGIRDCSTDVCGAEATVPVIAYAVTCNSAGAGGSGSGSTGSGTNSKPGMSHTGSSNST

SEQ ID NO: 199048 - protein, 114 aa, Triticum aestivum
  unsure (1)..(114): unsure at all Xaa locations
  Clone ID: PAT_TA_93466.pep
QCISSLLCRQTSVLSLLVQVHTHSSPDFYFAALNLQTDYVHHLRNFVDPSQKILSTWQLFRNEASTTSSFIAFIALIGLRKNLHQXITCNXYYGNILXRIRXADFTSITATISF

SEQ ID NO: 199049 - protein, 103 aa, Triticum aestivum
  unsure (1)..(103): unsure at all Xaa locations
  Clone ID: PAT_TA_93467.pep
XXQSKSXRXYNXXTXRKXQXIVXTXSIPDITIXYSXLRSIKNKCVRRLILVXVWIQSNSEVQSAYRHDGLVMMMLRCLLGVGLDITVKPLLRRCNRAVKNIVL

SEQ ID NO: 199050 - protein, 83 aa, Triticum aestivum
  unsure (1)..(83): unsure at all Xaa locations
  Clone ID: PAT_TA_93468.pep
MGSAGRRPXVXKQXALFFVVXGXIKXRSXCLGAAAGDXXARSGAFXPXRPAVPSXGXAGKTYXGRRXLPKXRCXPPXXGATSK

SEQ ID NO: 199051 - protein, 156 aa, Triticum aestivum
  unsure (1)..(156): unsure at all Xaa locations
  Clone ID: PAT_TA_93469.pep
YTVGXLHLTVRNNVPEESPLAGIGXNLWKEQDVPLRWXDXRPPRSVGYVNFGSITVMSKEHLLEFAWGXANTGYAFLXNVRADLXKGDDETALPXEFSXGIEGXNMLSTWCPQEKVXXHEAXXVFLTHSXMGXNHSEGNXXEXFPMVCWAXLPWRQ

SEQ ID NO: 199052 - protein, 171 aa, Triticum aestivum
  unsure (1)..(171): unsure at all Xaa locations
  Clone ID: PAT_TA_93470.pep
VENQFXNKRSQGEVNGKNAPKLGPVFAPPLXQLGGXRPNGLNPFSQSPKKLRPQXNLPSPALNKRPAPRPPVRAVGPRVKLGSNESLQGGFAPRSLXPNPRRXXRTGKAPSNSGGGXPTGEETIFLGRVGPGRRDWKRRAGPRLKACWVGXXKERTNELTGVQTTXGRGRG

SEQ ID NO: 199053 - protein, 39 aa, Triticum aestivum
  unsure (1)..(39): unsure at all Xaa locations
  Clone ID: PAT_TA_93471.pep
KELGDEXEVKAKGKVLTKGKDYVVEDXDILLIKXGAAKG

SEQ ID NO: 199054 - protein, 143 aa, Triticum aestivum
  unsure (1)..(143): unsure at all Xaa locations
  Clone ID: PAT_TA_93472.pep
RAEFGTRHLRRAPWPPFSSQSPPASPRPRARPSPPPAPLPASSPSPSQHAAAAAAARDASSPPPLRRRPPRPRPXLSAPCPPPRPPSSSPAPRATSAASSSASCSAAATESSPSPARAAASAGKNSPDEGRLRPLPXPASSSR

SEQ ID NO: 199055 - protein, 122 aa, Triticum aestivum
  unsure (1)..(122): unsure at all Xaa locations
  Clone ID: PAT_TA_93473.pep
ERTSGGYFELVGFDPXEVQQEIYKFVSIGLCAPVVAQCLVELMVNPPREGSPSYELYRQEYDGIFNXLKTRAFALYEAFKEMEGVECDEPQGSMYLFPTIKLSSKAVEAAKKEGRSPDEYYA

SEQ ID NO: 199056 - protein, 104 aa, Triticum aestivum
  unsure (1)..(104): unsure at all Xaa locations
  Clone ID: PAT_TA_93474.pep
VPNSGTRIFXQCLXLXSQRNNYKASNLTYLQDDLNISLEVLYQKLQDLELIEQKVFGCVDNSHXRTFLQNLXTQNDDTDXQKASQTKXFRYLASQXWGVRRLDF

SEQ ID NO: 199057 - protein, 75 aa, Triticum aestivum
  unsure (1)..(75): unsure at all Xaa locations
  Clone ID: PAT_TA_93475.pep
MSSXMGGXVLLRRAGAGAXRLFAXXPSPGGXAVLXGGEGAWVRLMSTSAGXXVKDEAXXAVXAEAAXAVAEAAGG

SEQ ID NO: 199058 - protein, 75 aa, Triticum aestivum
  Clone ID: PAT_TA_93476.pep
SCRIRHEGFFFFFFFFFFFFFFFFFFFFFFFFFFFFPPKLERVKPPLFILILAKQTKRFFGHPRYFDEFEAPLPL

SEQ ID NO: 199059 - protein, 96 aa, Triticum aestivum
  unsure (1)..(96): unsure at all Xaa locations
  Clone ID: PAT_TA_93477.pep
GXREXNLTRGNPXGPPNXPRLTXXFFGXFGAGGXXRPMXPXFEPXXNCXGNPXVVRPPKINXPPXXLCPLRAATKPWVIFFFLPPXKKPANQSPHL

SEQ ID NO: 199060 - protein, 79 aa, Triticum aestivum
  unsure (1)..(79): unsure at all Xaa locations
  Clone ID: PAT_TA_93478.pep
AGSSGPGXXPSGPPXXNKGDRYKKVSLPXXXDXNAKPYXNANGXYXXKPNKATNKGFGXKKMXAGXGXXXNXNXXNHGV

SEQ ID NO: 199061 - protein, 110 aa, Triticum aestivum
  unsure (1)..(110): unsure at all Xaa locations
  Clone ID: PAT_TA_93479.pep
MSKSKPSRKDESTDPNMDSRFKALETDPRFRLPSKKQTRTKLDKRFSRMLTDSDFHNSTTADRYGRRLKKGGKKKALXRLYLPEDANEDETQTESKXRSNNLDTKNDEIK

SEQ ID NO: 199062 - protein, 136 aa, Triticum aestivum
  unsure (1)..(136): unsure at all Xaa locations
  Clone ID: PAT_TA_93480.pep
MXPTVMGSSGTSVAPFQGLKSTAGLPVSRRSNGASLGSVSNGGRIRCMQVWPXXGIXKFETLSYLXXLXTXXLLKQVDYLIRSKWVPCLEFXKGGFXFREXNAXPGYXXGRXWTMXXLPMFXCNDXTXVXNXGGGG

SEQ ID NO: 199063 - protein, 149 aa, Triticum aestivum
  unsure (1)..(149): unsure at all Xaa locations
  Clone ID: PAT_TA_93481.pep
SGIGFLDHMLHALAKHAGWSLALHCKGDLHIDDHHTAXEDVCLALGEAFNVALGTKMGIARFGSAYAPLDEALSRAVVDISNRPYCVSELKLQREKIXDLSTEMIPHCMXSFAQNAXXTLHVHCLHXDNDHQXAKXAFKGLANSFTGQN

SEQ ID NO: 199064 - protein, 77 aa, Triticum aestivum
  unsure (1)..(77): unsure at all Xaa locations
  Clone ID: PAT_TA_93482.pep
GXSFXXKDLDRXASTKPEHXTRGGHHKNTHXGRXTSGETHLXLFXDXRAPXTXXMGSSXAXXFWXXRAXXXGSPPXL

SEQ ID NO: 199065 - protein, 142 aa, Triticum aestivum
  unsure (1)..(142): unsure at all Xaa locations
  Clone ID: PAT_TA_93483.pep
VVPSMRPPPCVDARGAQGHECVPASGGQLALLYVALYLIAXGAGGLKANVSGFGSDQXFDGRNPREERAMVFFFNRFYFCISLGSLFAVTVLVYVQDNVGRGWGYXRVGPPPWPSASSCSVAGTSXYRYRAAGGEPRSRVIG

SEQ ID NO: 199066 - protein, 168 aa, Triticum aestivum
  unsure (1)..(168): unsure at all Xaa locations
  Clone ID: PAT_TA_93484.pep
TNNNPPXKYPPLXKSFPXFFYPRXCKSPGLFYFFXXKXLXRFFVNRNIAXXLHCXYPLXIGAXXPXTVIXPRAXFVSFPDXXNHXPFPLFSPEGRGPTPLPVESTPTPTFXCYXPPXVPXPGGGPVIVXXCXXNCFPGXVXXFGXHLXSRGNPLXLGGPAHRRGAADF

SEQ ID NO: 199067 - protein, 112 aa, Triticum aestivum
  unsure (1)..(112): unsure at all Xaa locations
  Clone ID: PAT_TA_93485.pep
MEXVTKLAGQRAVVIFGMSSCCMCHTVTXLLRDLGVNPMVVELDEDPRGXEMGKXLVRLLGRKPAVXAVFXXGRXVGXTDXXKSLQLGGETCPTFMLVVWGVRGKGFVVIPA

SEQ ID NO: 199068 - protein, 53 aa, Triticum aestivum
  unsure (1)..(53): unsure at all Xaa locations
  Clone ID: PAT_TA_93486.pep
MTFTTCKDDNEFDIFQIFTCPDHLDISXLLHRKLIQCHRMYKENIKIWMGRDQ

SEQ ID NO: 199069 - protein, 98 aa, Triticum aestivum
  unsure (1)..(98): unsure at all Xaa locations
  Clone ID: PAT_TA_93487.pep
SDLKHMEGDTFQEEVKCLXEXKHKNVAXFLRYCAXTQRXVXDFXGRFXXXDAXRXFLCFKYRRKDTYXGVXWGEHYEIIXEIXRVYXTFTXIILFXWX

SEQ ID NO: 199070 - protein, 113 aa, Triticum aestivum
  unsure (1)..(113): unsure at all Xaa locations
  Clone ID: PAT_TA_93488.pep
LPADPTXXFPXGIPPTPXHHXFSPLTXXVASGIHPLLKXXPPGNCLAPLLPRPSPFSXIILXPGXTPIEIKFLAFDFKGTLWPNPPSFLXSLKGNXQPGIRFSEIQGTSLXYH

SEQ ID NO: 199071 - protein, 103 aa, Triticum aestivum
  unsure (1)..(103): unsure at all Xaa locations
  Clone ID: PAT_TA_93489.pep
LIRFXDXLNYKNIAXLDNLNFXHFNEEVCKNIHASTVSALADMXQAXVSMYVDLXAKGLVSRQXVYKHYVLGMLASLKXRNEARSNSTDCEKLLTVLCEIELN

SEQ ID NO: 199072 - protein, 107 aa, Triticum aestivum
  unsure (1)..(107): unsure at all Xaa locations
  Clone ID: PAT_TA_93490.pep
WAPSGXSVAPFXGVKSXAGLPVXSRRSNGAKLRXVNNGXRIRCXMXVWXIEGIKKFETLSYXPPLNTGGLLKQVDYLIRSKWXVPCLXEFXKGGFILREQNATPWVI

SEQ ID NO: 199073 - protein, 178 aa, Triticum aestivum
  unsure (1)..(178): unsure at all Xaa locations
  Clone ID: PAT_TA_93491.pep
KEGWALPRPRNFLXIFXGNLXRAXXXRGKGXFRTPPPVRLVRAHLVXGGFPGYPFTLPNFRFFCFLNSRXKGSXLXWGAPLPAFXXPGDEGXPRGWRGXKPRPFFGXRRAQLCFADLPLMSDLPGSKXIXAPAXTPNPRADXRRXSRGGGPPPNXXRHQVARXLXXPSHFGRWLGTRV

SEQ ID NO: 199074 - protein, 103 aa, Triticum aestivum
  unsure (1)..(103): unsure at all Xaa locations
  Clone ID: PAT_TA_93492.pep
KSTGTXGGXRXRRNPTXXFXXXPXPTXPCSXAXGKGXWGRATXRXNXNNXLKELSWATTTKGXGGVTXPXPIGEXRQPGKGNQSNSLRPIPTLLRLVPLXTKN

SEQ ID NO: 199075 - protein, 154 aa, Triticum aestivum
  unsure (1)..(154): unsure at all Xaa locations
  Clone ID: PAT_TA_93493.pep
MKRRATMDPHXEQQAXSYXIHVKMLKTVAIDVSCTDTVDHIKSKVSAIEGIDKCSQELFFSGIHLKXDDKXLADYNIMANSSVDLFVTDGMQITVKIPSVXGKTINLNVRKSNKGGDVKAHIEQKVGXLMNNQILMFASPQLXDNQLLSXCDLE

SEQ ID NO: 199076 - protein, 69 aa, Triticum aestivum
  unsure (1)..(69): unsure at all Xaa locations
  Clone ID: PAT_TA_93494.pep
LRXXEXPXVPCCCXIXIXXEXAXXRXFFHPEFARAEEXGCRCAVSLTSLGEGXXXXRREELGGSTPTFP

SEQ ID NO: 199077 - protein, 138 aa, Triticum aestivum
  unsure (1)..(138): unsure at all Xaa locations
  Clone ID: PAT_TA_93495.pep
MGQTXGSMTGLXQXXRXPSPAGXXANKXXVRAXXAEAXXAGRRAVLGLMGNGVVXSAFAXVVXAXNVXXIXVGPPPPLSGGFPGTDNSDXXREFDLPLXXRFYLQALPTCGSXGAXPXESAXEILXLXAAQTKSNGRS

SEQ ID NO: 199078 - protein, 104 aa, Triticum aestivum
  unsure (1)..(104): unsure at all Xaa locations
  Clone ID: PAT_TA_93496.pep
IQXXTGFTXKYFQXRDGQSXFFKASTGNXNRIXRXSQVIKFYKQKWLLRGYKRLAVKXNFSLVKRSAXISHIWXXEGXXLNDLDKFYPGNNXTSKEXLIXXFMG

SEQ ID NO: 199079 - protein, 72 aa, Triticum aestivum
  unsure (1)..(72): unsure at all Xaa locations
  Clone ID: PAT_TA_93497.pep
STVLIFKILNMKSSALVFFAALLSHSMPILALTHYNCXETYITVXSVKRRVKERYNNLXERGFVPKSTRRRD

SEQ ID NO: 199080 - protein, 174 aa, Triticum aestivum
  unsure (1)..(174): unsure at all Xaa locations
  Clone ID: PAT_TA_93498.pep
YCVPSHPXPPAVLPGESPFXQFSKPYQDAPPGDQKRGRCSHSACLLRDEQRXVSWTSPPVARPALRVRSICRCQHRSLLXSPARLSRARXCCRVDTDGSCAGGVSSGAPRRARAGRRGFGDEGEXEDEEPRDDDQGGGAAEHAVXXDVAVAVHPPPAVALXVVHAXXLRQQDHG

SEQ ID NO: 199081 - protein, 74 aa, Triticum aestivum
  unsure (1)..(74): unsure at all Xaa locations
  Clone ID: PAT_TA_93499.pep
LFPKNKDCVSWKVKLKFVSTGPIYKGTXAXFVDTXESIKERKEEAWLRFPKPKPPAXTGAQGSAWLHSPKARXR

SEQ ID NO: 199082 - protein, 70 aa, Triticum aestivum
  unsure (1)..(70): unsure at all Xaa locations
  Clone ID: PAT_TA_93500.pep
GEPLGEXVXXPXXVXXXAXRHPGAXGXGXXXQQXRHPHGXCTSSPPLEDPIPIFSXXGWCSPLAGVRQQQ

SEQ ID NO: 199083 - protein, 140 aa, Triticum aestivum
  unsure (1)..(140): unsure at all Xaa locations
  Clone ID: PAT_TA_93501.pep
LXWEELKNPPPGLLPGVESXAXIMSSAFFXRLNTTFVQQXSXMELTILVVAVARGSXPSLEXXCVMTWXLLXNKXIXPALRXFXTSDDXXPVREFSPXITQTHAIWWTXRTRTHXRHRRXAHRFWXRALSASFXFLXLFS

SEQ ID NO: 199084 - protein, 187 aa, Triticum aestivum
  unsure (1)..(187): unsure at all Xaa locations
  Clone ID: PAT_TA_93502.pep
XSLPFSLEVEEFNPGLRPGLVHWRGSPNRGRXAAQTRKSQVIISNQLSWXNTWDDGTVGXLLFNKGGXHPSLQGRTSSPPQRXGACWLXXMGCKRAPXAFGKNKXXXANAQATRGNKLQXSXQGKAXTNPPGGHNLSRKNLHXGENKQSKQXGLFAENRQPGTGKKAGGLPGXRGGDLLGAPSXDXG

SEQ ID NO: 199085 - protein, 154 aa, Triticum aestivum
  unsure (1)..(154): unsure at all Xaa locations
  Clone ID: PAT_TA_93503.pep
XPXCPGRKGSXGGLYLLIAPTILGLLVXLTKEGPKAIYXXPEQXFQGXFLFGPTNCSPRRLGACFIDATNQGHYLLLENRPHQFSSXPRKAKGHLLEALLAPPWXLLSTNQALLXLRTQGGGLXFFSPLVXLXVLLVGXCFXLGALXTPSCXFY

SEQ ID NO: 199086 - protein, 163 aa, Triticum aestivum
  unsure (1)..(163): unsure at all Xaa locations
  Clone ID: PAT_TA_93504.pep
PSDGLLLGSYILLSGVACIPIVALHFPHAQSAKRVLVLVVATGLLFVIMQPPVKLSWVYRSELIRAAHLSDDDTSIYGFVASKPTWPSWLLIATVVLTLAAATSIIPXKYIVELRALYAVGVGLXLSIYISVQYFFQAVVRILLLLRQLSVLQVLKXFTHPSI

SEQ ID NO: 199087 - protein, 187 aa, Triticum aestivum
  unsure (1)..(187): unsure at all Xaa locations
  Clone ID: PAT_TA_93505.pep
XRLXLRFPAAGXRILDALFSVXTXEDXAHFLEEYDXXSRDRLPAAQDKGVLVPKGQDAAAFRRPPXRPGQRCCTSATSTTTRLAPLRXVCIXATGARTSSCFSTTAVGCNNSGISSSVXVYQLGNREIVHGAXCRCRSTDCKPCFAVTHLLAWXILNKIQSLXKKKKKKLARAEFGTSLQPGESISF

SEQ ID NO: 199088 - protein, 126 aa, Triticum aestivum
  unsure (1)..(126): unsure at all Xaa locations
  Clone ID: PAT_TA_93506.pep
MTSMITXPIVXPTSVPSLSRRGSSFAVVCSGGKXXKVDKPLGLGXGLXVDIDANGRKVGKKGVYQFVDKYXANVDXYSPIYTPEEWSESGDRYAGGTNGLLIWGVNLAGLLXGGVLLVXXNNALAX

SEQ ID NO: 199089 - protein, 140 aa, Triticum aestivum
  unsure (1)..(140): unsure at all Xaa locations
  Clone ID: PAT_TA_93507.pep
LTSSSTPSLFSLFNPPPPPWVRSSPRPLLPNPPRLRFRGSNRYAQIARVWGPRGQDSVSGPFGLSPDLARXSFXQTLRREXFQDNKLLRXLXSKRGQEXHSXEIITGAIXSCMNKQAKNLGXSLGVNNGKVXHXXLYCYX

SEQ ID NO: 199090 - protein, 97 aa, Triticum aestivum
  unsure (1)..(97): unsure at all Xaa locations
  Clone ID: PAT_TA_93508.pep
QKFEAHEEFQNSQWTXGLCXTLQFVQITGIHWXPNEMTFIELILSKARLFCTLFITHGENCSMSNEDAMNKILSYRRASTCAEILFKGKASVTFFRS

SEQ ID NO: 199091 - protein, 107 aa, Triticum aestivum
  unsure (1)..(107): unsure at all Xaa locations
  Clone ID: PAT_TA_93509.pep
GKLGKLASXXGDVDVSXRXGKVXTIFXVKLTIEYSXKTKDDEEVSGTITVXEVAHDTEXHEYVFXININSNSASKAPVRDXVXSKXIPPLRKXEFXKLGPTLIAEHX

SEQ ID NO: 199092 - protein, 173 aa, Triticum aestivum
  unsure (1)..(173): unsure at all Xaa locations
  Clone ID: PAT_TA_93510.pep
FXMAXGXVXFXLNXXGAQPRXNGKETXXGFPSRRPNLXLFECLLXGXXNXXXAPXPGXGRQLIXQXPXAXRPIPXXGGGXMXLRGRANXQMICPVXXXGVVYYIPPVPXXGGXXPRXXCPXWATGAVXXXTGXDALTLXXXMLTRXLDDXHXTWRPHVXAVPRASPXXDPCFQ

SEQ ID NO: 199093 - protein, 133 aa, Triticum aestivum
  unsure (1)..(133): unsure at all Xaa locations
  Clone ID: PAT_TA_93511.pep
RSRGXSXNPLLRTTNGHXXRQVWEFXPAAXXPXXVAAVDAARRDXTXRRXQMKNNSXLLMRMXXSKSNNXKMNXPPNKLXQHGXHTQEDDVLISXXRXINRCSTXQAQXXQLXGXXXGXLXFXXRFFFDMCLG

SEQ ID NO: 199094 - protein, 110 aa, Triticum aestivum
  unsure (1)..(110): unsure at all Xaa locations
  Clone ID: PAT_TA_93512.pep
XSXVVXSIIPSNFENFNFXLLAXHPNKKXSLXNXXPHXFFESFPQVPXXGNXHWRYXRFFXPCIIFLLQXXXTTMESLRFXNQXVSSCXPXESSXRYWRFEGRXXSKRSA

SEQ ID NO: 199095 - protein, 133 aa, Triticum aestivum
  unsure (1)..(133): unsure at all Xaa locations
  Clone ID: PAT_TA_93513.pep
GNEGAFRDRNAGSAXNXAKPIDEVERQRNRGSXEGRGRGGRSEPRNFXRHSXXXGGGXSEKQAXXGWGANEGKAELAXEQAGEALANAETKDAMXSXGEAKAASGPANDAEPRKYILCPISNNKKKIGSQTQL

SEQ ID NO: 199096 - protein, 59 aa, Triticum aestivum
  unsure (1)..(59): unsure at all Xaa locations
  Clone ID: PAT_TA_93514.pep
ALAXCXXRRXPLXGLVQVXYAGVTNXXFPXVRIFSVPGTSLVCITIVRRRMLSHLXGGT

SEQ ID NO: 199097 - protein, 78 aa, Triticum aestivum
  unsure (1)..(78): unsure at all Xaa locations
  Clone ID: PAT_TA_93515.pep
IXXLIXXPSEPDKXXDWXWVVXDLXXIWWGFSLKTVGXXHXPXKXFGXPLXFFXQFXQKRKEKKKKKKKXKKKKKKKP

SEQ ID NO: 199098 - protein, 117 aa, Triticum aestivum
  unsure (1)..(117): unsure at all Xaa locations
  Clone ID: PAT_TA_93516.pep
FVLEPNGKIFFVVDTKFHLSNWRDVXFMFITASTIRIVDSNDEFHIIXPTVDKISSRQSVEACNTLEHGWXHFQTIQLSHPQVSAASSLIVRTKNGTFYLGPNEMFPNVVKMKIEGT

SEQ ID NO: 199099 - protein, 118 aa, Triticum aestivum
  unsure (1)..(118): unsure at all Xaa locations
  Clone ID: PAT_TA_93517.pep
FTSLCATQAVNDGYAMFNCHGVIFYSESVFASAAKAHSLTLGQVNHYPIEIISSTFSGQSPHRLFPMVLDTEVYQGGPLSXFFVVVDKNGREQGLVFNTQNGYQPCQLIXXEHIWVYN

SEQ ID NO: 199100 - protein, 168 aa, Triticum aestivum
  unsure (1)..(168): unsure at all Xaa locations
  Clone ID: PAT_TA_93518.pep
MPRETEPSLNERQFFTXXLRQQLXXXAXPFDXXRPITLAFAERXGVVDLXLGXTRIHAHVSAEVTQPYPDRXYXXLFTIVTELSPMTTXHLWAGRESTXENGRLPVYFEKXKXVRSGGSLXPEXLCSPXXGXNCWANPGSKSSSWGGNNKWAIPVNWRPQLEPGNKKP

SEQ ID NO: 199101 - protein, 179 aa, Triticum aestivum
  unsure (1)..(179): unsure at all Xaa locations
  Clone ID: PAT_TA_93519.pep
PAHAKPSKTRASHTLXHQQAGXXQRKHNNQMATISAAAATTVVARAAIARPQALGLPQLRTRSERVRCSYSKDAXEATPAAAVRGAGASLLAAXWRGDRVRGAGXWRLVXLTGFXXXGTGLEPWGXKQQPAGGGXSLGRSFGPHPGPLLKRSXXSRASNKDXGXPGGPXRSNXXNKFPR

SEQ ID NO: 199102 - protein, 94 aa, Triticum aestivum
  unsure (1)..(94): unsure at all Xaa locations
  Clone ID: PAT_TA_93520.pep
MAGRKVMSNAGVAAALVXLLXVAAXSGWPGFMSATWTPWSMVNNCRSYCTVXSNXASPSGACCGAVRGAXFXCLCXYKGLLSXDIQNESCTFPV

SEQ ID NO: 199103 - protein, 87 aa, Triticum aestivum
  unsure (1)..(87): unsure at all Xaa locations
  Clone ID: PAT_TA_93521.pep
MAPVXVFGPAXSXNVAXVLVCXEEVGAQYQVXDIXFXXXGAXKSPXHLXRNPFXXIPGFQWGWLFLVHRACKSTLLPQVTKNSCSGT

SEQ ID NO: 199104 - protein, 53 aa, Triticum aestivum
  unsure (1)..(53): unsure at all Xaa locations
  Clone ID: PAT_TA_93522.pep
XKMGPTQXKXSSQDLLXXQVDLWDQSXGFXKSXXLKCAMGLXIPNTXQQXGGG

SEQ ID NO: 199105 - protein, 66 aa, Triticum aestivum
  unsure (1)..(66): unsure at all Xaa locations
  Clone ID: PAT_TA_93523.pep
PPFPTQGLPLPFFGLXGTXAXALYTAAVRSQTLESTARAINALKDLYIKDKKLATIMQTPTLSSPR

SEQ ID NO: 199106 - protein, 156 aa, Triticum aestivum
  unsure (1)..(156): unsure at all Xaa locations
  Clone ID: PAT_TA_93524.pep
NSFSTNXKXFXTFSPLHSRXAXXXEIPRPRGVEKGTPTVLPIQLTLSSNKKKLLRKLGDPYPNPRSGDRLLFGLPLYVHCKSAQRPGVNLSEWGRMKXXFXPSGRRRRCGXRXRSLALVGVGVVGEADEEAAEVGDGAGDAERAGVAVASCRIRHE

SEQ ID NO: 199107 - protein, 160 aa, Triticum aestivum
  unsure (1)..(160): unsure at all Xaa locations
  Clone ID: PAT_TA_93525.pep
PSRFDSHSDXRAWPXCAPDPLXPDXCPPPCSSSXAXVXLXGSPPEXALRFXLXXGHTKVHLRRRSRSXSMVVXXYKRXXXPTPXYXXRNRLPRSPQPRXSLQGWTXAXXGETSNXTTPXXXAXXGVIFALSTGXVGRVXAEITWPWLLGXXPGXXXPTRS

SEQ ID NO: 199108 - protein, 77 aa, Triticum aestivum
  unsure (1)..(77): unsure at all Xaa locations
  Clone ID: PAT_TA_93526.pep
CXHXXXXGXXXPPFXLPQYSSFTPKKRLLLSLQVVSGVPTLAQRMGGHRHEHPKPRSSWTKWXHWSLSSRPWLPPNL

SEQ ID NO: 199109 - protein, 97 aa, Triticum aestivum
  unsure (1)..(97): unsure at all Xaa locations
  Clone ID: PAT_TA_93527.pep
STSPRRRRERSEKMXGRGKGGXGLGKGXAKRHRKVLRDNIXXIXKPAXXRLXRPGXVKXISGXXYXENRXVXXIFLXXVIRDAVXXXEXARRKXVTA

SEQ ID NO: 199110 - protein, 147 aa, Triticum aestivum
  unsure (1)..(147): unsure at all Xaa locations
  Clone ID: PAT_TA_93528.pep
MVQESEFEFIETPKAPSPTFEKFEDCGVRTTSYPSIKNGPLPVDGPGSDSFSNVVLFSFLAGVPTYFSWKIGGGWKTSIFFSLFTTPPILXCFWYISIFLQPTKKMTKRKFLGNPXSEHYLTFKSPTDRAKYSXGXNKNPMGTFQNM

SEQ ID NO: 199111 - protein, 75 aa, Triticum aestivum
  unsure (1)..(75): unsure at all Xaa locations
  Clone ID: PAT_TA_93529.pep
PPXGWGRIXWXEIAXLXGGXRGTPAEAGLGXPGISXSGGFDGNRTGNXQEFLSXAKDGXLSQVWLCVSMVLMXTC

SEQ ID NO: 199112 - protein, 102 aa, Triticum aestivum
  unsure (1)..(102): unsure at all Xaa locations
  Clone ID: PAT_TA_93530.pep
MATNGQSFYELYRRSSIGMALTDTLDDLISDRXIEPQLAMKILANFXRXITEVXXDKVKARLTFKGHLDTXRFCDEIWXXLDKKMLXSXMGNSIQDRYKLDS

SEQ ID NO: 199113 - protein, 166 aa, Triticum aestivum
  unsure (1)..(166): unsure at all Xaa locations
  Clone ID: PAT_TA_93531.pep
VDAGVAVLLTQDKRLIEFPSILLPPNISSGSIVDITVSRNFITEQKSEAAFLALQDSIYESFGKDEPVAPVLRCRNATQTSVVLEWDPIMLATADIISLSLFRNGQKAGNIPKPEVMXKVQKISGLGINTGYNFQLXLRTTXGTLXXXIXVVLRNHKMXGFNGITG

SEQ ID NO: 199114 - protein, 154 aa, Triticum aestivum
  unsure (1)..(154): unsure at all Xaa locations
  Clone ID: PAT_TA_93532.pep
WEVXGHWVVQGAXDVDIGANPSAEGGGDDEGVDDQAVKVVDIVDTFRLXEQPAFXKKQFISHMKRYIKNLTAKLEGDDLDVFKXNVESATKYLLIKLKDLQFLLLARAMHDDGGXVFXYYKGGELLDSTFPVLXTXGLKKQGAQCLKILWGAPK

SEQ ID NO: 199115 - protein, 43 aa, Triticum aestivum
  unsure (1)..(43): unsure at all Xaa locations
  Clone ID: PAT_TA_93533.pep
MGKEKIHISIVVIXHVXSGKSTTTGHLIYKLXXIDKRVIXXFE

SEQ ID NO: 199116 - protein, 76 aa, Triticum aestivum
  unsure (1)..(76): unsure at all Xaa locations
  Clone ID: PAT_TA_93534.pep
PPLGCSTHSRRRHPREPESEADTAAAMRAKWKKKRMRRLXRKRRKMRQRSKYVPWGEGKNHLSTQLFGMAFDSIVF

SEQ ID NO: 199117 - protein, 127 aa, Triticum aestivum
  unsure (1)..(127): unsure at all Xaa locations
  Clone ID: PAT_TA_93535.pep
KXFAKSXFPVXAXILVFASXPXKLVTTSKKXNLILNVDGAVAXVCFVDLMRNCGAFSXEEAEDYLRMGVLNGLFVLGRSIGLIAHYLDQKRLRTGXYRHPWDDITYLLPSLGSSGSLGTEGRVEVQM

SEQ ID NO: 199118 - protein, 154 aa, Triticum aestivum
  unsure (1)..(154): unsure at all Xaa locations
  Clone ID: PAT_TA_93536.pep
PRFIRLRNSASYQQSLGRRPLKPRDSAARLKREFEEEYGPNRLPFYEGGYAQALDLAKAELKFLVIVLFSPEHDETTKFVRDTLLDAHVQAYLSDESSNIILWGGDVRDTEAYQXVSAAVKCSEFPYTAVVGHTPXISSTSKSVIKXLPGSAVN

SEQ ID NO: 199119 - protein, 73 aa, Triticum aestivum
  unsure (1)..(73): unsure at all Xaa locations
  Clone ID: PAT_TA_93537.pep
PXKXXXLLHXRXDPXSSTRTHXXKRXRNXHPRRXGANKRHFVSGLQHTXELELPKKKKKNSRLVLSSCRIRHE

SEQ ID NO: 199120 - protein, 49 aa, Triticum aestivum
  Clone ID: PAT_TA_93538.pep
EVVLCCHREILDDYISQVAIWFNQLIKPVLKENKATIPRFNISSPGFDA

SEQ ID NO: 199121 - protein, 141 aa, Triticum aestivum
  unsure (1)..(141): unsure at all Xaa locations
  Clone ID: PAT_TA_93539.pep
LAGKSPPTDSEHLVLLLKMQIFVKTLTGKTITLEVESSDTIDNVKXKIQDKEGIPPDQQRLIFAGKQLEDGRTLADYNIXKESTLHLVLRXRGXMQIFVKXLTGKNINLEVESSDNIDNVKXXIQGKGGDPPGGKKSLNLG

SEQ ID NO: 199122 - protein, 108 aa, Triticum aestivum
  unsure (1)..(108): unsure at all Xaa locations
  Clone ID: PAT_TA_93540.pep
MFTGHLSHEDFFAQLSLLFESPRQKNHGSVYLTQKPMTYNTTSPAQSKDSLAQENHPTTPLPIIVRASNXKSKEKKDKKIKLSTIVEAXSLEAFFTKYAKVCXGRERG

SEQ ID NO: 199123 - protein, 137 aa, Triticum aestivum
  unsure (1)..(137): unsure at all Xaa locations
  Clone ID: PAT_TA_93541.pep
MPEATLTDGEMIGVAGLGNKGKVGRAKWNEFKVLVLGGIPVTYRAKIWSECSGAAALRIPGYYESLISRPITDDDPAILAQIQMDINRTLTDNIYFRKGTGVNKLNEVLLXYXRRNADVGYCQXMNPYKPLPNYPAC

SEQ ID NO: 199124 - protein, 102 aa, Triticum aestivum
  unsure (1)..(102): unsure at all Xaa locations
  Clone ID: PAT_TA_93542.pep
KPAFXLVLANKRSCDKGEXCEYXLGWVTGGVAAXPKNWDFXKLFPRLXGEVEGDESSVSHIEEVLERAERDIGDKXPPQAVNIDPSYIASLIHAPDWFNSTC

SEQ ID NO: 199125 - protein, 60 aa, Triticum aestivum
  unsure (1)..(60): unsure at all Xaa locations
  Clone ID: PAT_TA_93543.pep
QSXIXGVXMSXSAHSPRSXCAALLPPLQLRQPXCXQIAAXRPCADXRXEFGTSSXRIRHE

SEQ ID NO: 199126 - protein, 147 aa, Triticum aestivum
  unsure (1)..(147): unsure at all Xaa locations
  Clone ID: PAT_TA_93544.pep
SCRIRHEWPSSWARKDNNPVRHALLRCFWPLFLLNAGLALLRLTVMYVGPTLIQSFVSFTSAAERRPLWEGARLVLALLAAKAMEALCSHQXYNFHCQKLGMHIRGALITAXLXRKGLRLSCSARXXXTGLGMIVNYNGRSNASNSP

SEQ ID NO: 199127 - protein, 149 aa, Triticum aestivum
  unsure (1)..(149): unsure at all Xaa locations
  Clone ID: PAT_TA_93545.pep
SKNLRLYLNEHYSNASCGVYPTNEDSEIAILIVANQYSPRNFWNGQWKSLYIYSPATSCLSGQINVDVHYYEDGNVRLLTSKPVSXQVSHDSTETVLKEIKGXVKKYQEELTNGFQNLSEGAFKGVRRXXPVTXRQEXVEWDKDCKAIR

SEQ ID NO: 199128 - protein, 135 aa, Triticum aestivum
  unsure (1)..(135): unsure at all Xaa locations
  Clone ID: PAT_TA_93546.pep
GGFFXRRGXPXFKXFLKRGRGAXNAGXPXPPPLXXQRXGRGGXPXXGVPRPPXGRAPPTPXXPPFGXLXXFPGRKXDGRPSXPPXSXFAXVXRRXPPAAARGEAEXGXWRRTXFXXPPXPPCGATRGRRGXQILE

SEQ ID NO: 199129 - protein, 156 aa, Triticum aestivum
  unsure (1)..(156): unsure at all Xaa locations
  Clone ID: PAT_TA_93547.pep
IMIEYPYVECTSSVIQGLVLFKEMYPKHIRLEEIDSCIQKAADYIESIQWSDGSWYGCWAICFTYGTWFGVRGLVAARRTXXNXLTIXKACEFLLSKXLLPSGGGGESYLSXQDKGYTNLXXNKXQAIXTNWAQLGPNXAXQXXKXSASLKXXXXF

SEQ ID NO: 199130 - protein, 126 aa, Triticum aestivum
  unsure (1)..(126): unsure at all Xaa locations
  Clone ID: PAT_TA_93548.pep
XHXXXFGXTRTFPGXSFERPYFGXXLXXSPLKXXSVTRPLNGXVLXRXGATPKHXXKGPTARXPRGAPRXRRAXFARXXPPTRRARVLGGRTRHPHHRRCRMRPAASXXRREERRERPSRHLVRXW

SEQ ID NO: 199131 - protein, 54 aa, Triticum aestivum
  unsure (1)..(54): unsure at all Xaa locations
  Clone ID: PAT_TA_93549.pep
XATXSXPFSSGGSEGTMRIPLMXWXHQXXPPKSSSSSPXPRGKFAVFXRGGCIP

SEQ ID NO: 199132 - protein, 109 aa, Triticum aestivum
  Clone ID: PAT_TA_93550.pep
DMRRNYPKLSFITQNDAVGLLTLGSRNDPKSELIGESGIKALVDVKKEGELGLAAYFQKEGKIGTLAALGKDGLPPFPCSVNLKKQGADKYQLTAENSYPESYPCRSFK

SEQ ID NO: 199133 - protein, 74 aa, Triticum aestivum
  Clone ID: PAT_TA_93551.pep
AASYLGVIKNSKLEINTQKRIKIQSTPNIFHPASYTMKILNPATFLLISSNLMLSGVEAVYFCRNGFISRYPHK

SEQ ID NO: 199134 - protein, 73 aa, Triticum aestivum
  unsure (1)..(73): unsure at all Xaa locations
  Clone ID: PAT_TA_93552.pep
GXXPXVKPTXPSXRXRXNDFTIRGGXWVTRAPPPRRAEISSLRGGXVLXHSPNFLIXECYTLDHHCISYFIAF

SEQ ID NO: 199135 - protein, 131 aa, Triticum aestivum
  unsure (1)..(131): unsure at all Xaa locations
  Clone ID: PAT_TA_93553.pep
XCRGVSLARRRKESXHXLLPXQXKRXTXXXLPRPPXAAKRDPPFAGRPTIPKPQAAXLCAISRXFPRARXEESAELAARGGADEGGRGGCWICGRLLLHVCGSWYPQSTRLPASSCGRMMMGCGRFSSDLC

SEQ ID NO: 199136 - protein, 98 aa, Triticum aestivum
  unsure (1)..(98): unsure at all Xaa locations
  Clone ID: PAT_TA_93554.pep
MXSCXEFPGXRPXNSXEVVPRXPTXXVVQPXPPTPXXPREAPGAAVGPLGLVLLGPQXXRXHXPRRXGDLEALEDRPSAHDCRRXLVLVVAGGRGSPE

SEQ ID NO: 199137 - protein, 78 aa, Triticum aestivum
  unsure (1)..(78): unsure at all Xaa locations
  Clone ID: PAT_TA_93555.pep
MSCCGGNCGCGTACKCGNGCGGCNMYPEAEAAGATLLVSATATHKASSGGMEMAAXNGGCGCTQCKCGTSCGCSCCSC

SEQ ID NO: 199138 - protein, 89 aa, Triticum aestivum
  unsure (1)..(89): unsure at all Xaa locations
  Clone ID: PAT_TA_93556.pep
MKGTKLAAILILQAVLVMGLLSHVNADFFPKCCNNCRSFSGVDVCDDAHPKCPQGCSACRVVSTSPEMWRCADMKSTVDGTCGXPCKKY

SEQ ID NO: 199139 - protein, 119 aa, Triticum aestivum
  unsure (1)..(119): unsure at all Xaa locations
  Clone ID: PAT_TA_93557.pep
VTIKNKFPIPVIEDLLDELHGAKVFSKLDLRSGYHQIRMNSEDVHKTAFRTFLGHYEYLVMPFGLSNAPGTFQALMNFLFAHYNRKFVLVFFDDILIFSKTLEEHVDHLAQVLXILKRK

SEQ ID NO: 199140 - protein, 61 aa, Triticum aestivum
  unsure (1)..(61): unsure at all Xaa locations
  Clone ID: PAT_TA_93558.pep
SSCRIRXEARALTRARXXLRRLPQXDVLPDADGGRGXACTRRTAAWGRSAKKATPXXSPSS

SEQ ID NO: 199141 - protein, 141 aa, Triticum aestivum
  unsure (1)..(141): unsure at all Xaa locations
  Clone ID: PAT_TA_93559.pep
MSSVSARAPVGALRPGSASSPRFLGDSGRVXLAKSXXRDVAVXXKGSWVPXLPSPAYLDXSLVGDNGFDPLALAEDPEDLRWFVQAELVNXRWAMLGVXGXXIPEVXTKGGVLNAPXWXDXGKEKLIXSSSKLRQSKVNLL

SEQ ID NO: 199142 - protein, 154 aa, Triticum aestivum
  unsure (1)..(154): unsure at all Xaa locations
  Clone ID: PAT_TA_93560.pep
LVPNSARERLIFAGKQLEDGRTLADYNIQKESTLHLVLXLRGGMQIFVKTLTGKTITLEVXSSDTIDNVKAKIQXDKEGIPPDQQXLIFXGKQLEDXRTLAGYNIQXEXTLHLXXRLRXGDANLCXEXSLGRTITLVGGVKTPTTGDSCTGPPN

SEQ ID NO: 199143 - protein, 69 aa, Triticum aestivum
  unsure (1)..(69): unsure at all Xaa locations
  Clone ID: PAT_TA_93561.pep
TPFLSFEXAXLAMEYSXXISICTARXSRVXHWRAXXXTXSPKDFVGSPQRKGSAXXLCWARVTWDLSXV

SEQ ID NO: 199144 - protein, 55 aa, Triticum aestivum
  unsure (1)..(55): unsure at all Xaa locations
  Clone ID: PAT_TA_93562.pep
VYKKSRSFPSRRLLLRFXPPXDLTARKXXWPKPPPXTSXXTSXSPSPTGPGXXXQ

SEQ ID NO: 199145 - protein, 135 aa, Triticum aestivum
  Clone ID: PAT_TA_93563.pep
KPLATAPPEDIVQSEDISRISKKTEKKKKIIKSTDQTLTPAAILREEHIDLSSDEDLADDALEQLIKSKEEAEIFNNLPLFDVAIIHNFIDEWFDTPNINFDDLQLPIGLSVAFNGAIASELAIAQRIVELKHKD

SEQ ID NO: 199146 - protein, 153 aa, Triticum aestivum
  unsure (1)..(153): unsure at all Xaa locations
  Clone ID: PAT_TA_93564.pep
RAEFGTSDNVKANIQDKEGIPPDQXQRLIFAGKQLEDGRTLADYNIQKESTLHLVLRLRGGMQIFVKTLTGKXTITLEVESSDTIDXVKAXIQDKXEGIPPXPXTRLIFAXQGSWDGSHPCRTTSRGVHPSNLGAPPCVVMHQSFERTSTGQI

SEQ ID NO: 199147 - protein, 150 aa, Triticum aestivum
  Clone ID: PAT_TA_93565.pep
RAEFGTRAKSLPSRAQLVGYNHAVAGHDGILCDADGELLIKPCTSTEIDFYETSIAFYPEFVDLMPRFVGTLSLNDQIPNPAIKEDVTNLPPQPNQTSIEESIESLQPGGSTNKDFNFIPELTEGPSLQCMANSTSGHRIATDKAVVLEN

SEQ ID NO: 199148 - protein, 117 aa, Triticum aestivum
  unsure (1)..(117): unsure at all Xaa locations
  Clone ID: PAT_TA_93566.pep
ARVEFXTRFHXAPTHARDKQTXPSGRAXTASHXRAAPPPRRRAPXHHXCRPAIGGGXAVPXLXVHQRGVRXVTGPPARKYPXLXQXXGLRAVAGXPGSQWATXFRPPXRGSWXTXFR

SEQ ID NO: 199149 - protein, 106 aa, Triticum aestivum
  unsure (1)..(106): unsure at all Xaa locations
  Clone ID: PAT_TA_93567.pep
LQIKSTAMPXRSDVTYFGAGPALPSXRKFXKMLQXALVNFXNTGLGPAEHSHRSVLAHXKFLXSXAKSKTLANFLQGPLNNLXTILIQXTARVVXGANFPGGAILT

SEQ ID NO: 199150 - protein, 99 aa, Triticum aestivum
  unsure (1)..(99): unsure at all Xaa locations
  Clone ID: PAT_TA_93568.pep
HQQQLAQWTVKEKNSWDFHIVEIHESFLSETFGNGQAYQXGSRVALCVQXIQYXNXHPVENFNVPGVXTXAQXIQPXRSRVLPNSEKKGXSYEAAPPRV

SEQ ID NO: 199151 - protein, 115 aa, Triticum aestivum
  unsure (1)..(115): unsure at all Xaa locations
  Clone ID: PAT_TA_93569.pep
MAAAFSSTVGAPASTPTNFLGKKLKKQVTXAVNYHGKSSKANRFTVMASXNIDEKRNTDKWKGLAYDISDDQQDITXREGHXVDSLFXAPKGDXNHXGXSLSSYEVRQARGLKEV

SEQ ID NO: 199152 - protein, 91 aa, Triticum aestivum
  unsure (1)..(91): unsure at all Xaa locations
  Clone ID: PAT_TA_93570.pep
MKGTKLAAILILQAVLVMGLLSHVNADFFPKCCNNCRSFSGVDVCDDAHPKCPQGCSACRVVXTSPEMWRCAEYEXSPVDGTCGXYPARKY

SEQ ID NO: 199153 - protein, 138 aa, Triticum aestivum
  unsure (1)..(138): unsure at all Xaa locations
  Clone ID: PAT_TA_93571.pep
XFXEEMDCXRGSXRPXGGTFHSLARPVEASXXSPRFKRGGEPRGQXPPXPRGIRVRAPFLGGEEGDDVXEHGVGEGADVVGASSVFLHTGRGRSXPLRARTPRIHLHEAHGGLGFASVETRGGQCWGRRSAWGLRACG

SEQ ID NO: 199154 - protein, 146 aa, Triticum aestivum
  unsure (1)..(146): unsure at all Xaa locations
  Clone ID: PAT_TA_93572.pep
ASDVFNFNPTNLDPLTETYDLNFYFSYLARWXHLFTVASGXXEKINAYIMGKLESSPAFVIHSPHXLPFHAHITALTXVAPHARRLXTSHXSALNXSLESRXRXNSLLKCPGFGRNLLRYKGAKCPVGRALIIRWLWYKPANSRLG

SEQ ID NO: 199155 - protein, 95 aa, Triticum aestivum
  unsure (1)..(95): unsure at all Xaa locations
  Clone ID: PAT_TA_93573.pep
LMKSWEACRPISLALQGSLHQTIDQHRPQQQKWSLLPYFLARYLLQAFLFEKLGRLGSYLGTFLSSLMLGPLYELXXIIGXIIAGRSSGRPKXQG

SEQ ID NO: 199156 - protein, 62 aa, Triticum aestivum
  Clone ID: PAT_TA_93574.pep
YRRNEALQCSPKILRVKGYWGIWTWTAIIVFFVERGVTWCSPRKPMNLRTCLKRVILEAVHG

SEQ ID NO: 199157 - protein, 65 aa, Triticum aestivum
  unsure (1)..(65): unsure at all Xaa locations
  Clone ID: PAT_TA_93575.pep
RXPVNWPELARSTDEFGGAQLXKAVSVEAGMXALRMGKNKISHEHYVDAIAEVQAKKKDTVNFYA

SEQ ID NO: 199158 - protein, 111 aa, Triticum aestivum
  unsure (1)..(111): unsure at all Xaa locations
  Clone ID: PAT_TA_93576.pep
MDRPAAYRNAXXVIRALQSGGVLXKAFXTXTPPFNQGSXLTAFXXLVHXKIPXTXIXXSAAAARMNNXQVQXVIVGXADRIXANGDTXANXIGTYNLSISXXSSVQVFPRT

SEQ ID NO: 199159 - protein, 124 aa, Triticum aestivum
  unsure (1)..(124): unsure at all Xaa locations
  Clone ID: PAT_TA_93577.pep
MADVERQYALSLFKTKLLESREWEAKLKNLRLEIKGLQKEFDNTEEDVKALQSVGQIIGEVLKQLDEERFIVKASSGPRYVVGCRSKVEKESLXQGTRVSLDMTTLTIMRMLPPEVDPLRLQYV

SEQ ID NO: 199160 - protein, 80 aa, Triticum aestivum
  unsure (1)..(80): unsure at all Xaa locations
  Clone ID: PAT_TA_93578.pep
RSTPFFQXSXRQPXXFRXNPXRXLPEGSSXCPWRFLPRPXXQTXXIPICGXFXLXPXXPLGIFHSXMYAPHRTAERFIDW

SEQ ID NO: 199161 - protein, 102 aa, Triticum aestivum
  unsure (1)..(102): unsure at all Xaa locations
  Clone ID: PAT_TA_93579.pep
XGGPXXLRXRXXGXSDXSXAQVQRGPXFELXKWDRLPXFXLLSHLFPFGXRXLASSSWFXLVQKESMACLCRNWDLVLEEPMKNVITLFLNTNREGLRSLKY

SEQ ID NO: 199162 - protein, 123 aa, Triticum aestivum
  unsure (1)..(123): unsure at all Xaa locations
  Clone ID: PAT_TA_93580.pep
AAKRNGGEKGLLWRLPEVTSREAXQDXXPPPGSGNKGWXRPAPGIRVPSXGWQXIXGXWDFPWNXLKGFREFGRLGLRXIRIWVLGYGFGAKXXIAPWIEKGKRQFKTFGKNIPRKTPKICLK

SEQ ID NO: 199163 - protein, 116 aa, Triticum aestivum
  unsure (1)..(116): unsure at all Xaa locations
  Clone ID: PAT_TA_93581.pep
APGLSLFALASAAPILVRACARAVLARSPPPSPRFAPAWRKLXDXXXAEFKEGFXLFDKDGXDXCIXXKELGXXMRSLGXNPTEXELXDMINEVHADWNGQQLTFSFSNLEWARKD

SEQ ID NO: 199164 - protein, 118 aa, Triticum aestivum
  Clone ID: PAT_TA_93582.pep
DPRGLKIICKNLLIGHLQPWLFDDDEVQTLWKIGVEIDADWRRARDAVQAGERGFPPDLAYKLSANIAECSVAADGVLRGRENRIWVPNYEPLKTAIMQRIHDSQLSGHPGKDNMVSM

SEQ ID NO: 199165 - protein, 71 aa, Triticum aestivum
  unsure (1)..(71): unsure at all Xaa locations
  Clone ID: PAT_TA_93583.pep
GLAXCVDAIXRXXVMRGEVQXXGLWEXSRKXPGVPAXXLGDGKXTSXXEAEAEGXXAARTGAXGXCXIRHE

SEQ ID NO: 199166 - protein, 142 aa, Triticum aestivum
  unsure (1)..(142): unsure at all Xaa locations
  Clone ID: PAT_TA_93584.pep
MAPTVMASSATSVAPFQGLKSTAGLPVSRRSNGASLGSVSNGGRIRCMQVWPIEGIXKFETLSYLPPLXTEXLLKQVDYLIRSKWVPLPXVQXRXGLSSREAKTQPLGTTNXRYWTNVXXLAXFGVERRHRKVXNEVXXVKK

SEQ ID NO: 199167 - protein, 122 aa, Triticum aestivum
  unsure (1)..(122): unsure at all Xaa locations
  Clone ID: PAT_TA_93585.pep
IFVLTNNPEKKVPGGAQSLGXRSKCGGXLXKGXLIPFSXNQINXWPXGFLQTQIEKGGPFSXGGKKXQXPPXGNXXVCXSGLGXXXPXRXGFXFXNPNPGAQXFPRKSQXGQNSXKWXGWVN

SEQ ID NO: 199168 - protein, 93 aa, Triticum aestivum
  unsure (1)..(93): unsure at all Xaa locations
  Clone ID: PAT_TA_93586.pep
MXLPNQNTVDYPXSFKLVIVGDGGTGXKTTFVKRHLTGEFEKKYEPTIGVEVHPLXFNTNCXKIRFYCWDTAGQREIWGALRDGYYIQWASVR

SEQ ID NO: 199169 - protein, 175 aa, Triticum aestivum
  unsure (1)..(175): unsure at all Xaa locations
  Clone ID: PAT_TA_93587.pep
VSLNVTAQFAFXVRLSGLEGLKNCSLAGLPLARDRPPSXRLASGLQVKTGFFKGKVEIPFALVGSCPFPGESTGERPAGGPTFDARDVAGVHHLSERACRXLRLXLXPRTARRPAASASADDALTMNLLARXPXGXGRRTXWDRPVMDAMVCAISSFASLFSSCSVFLLVPNSAR

SEQ ID NO: 199170 - protein, 114 aa, Triticum aestivum
  unsure (1)..(114): unsure at all Xaa locations
  Clone ID: PAT_TA_93588.pep
LVPNSARAYGENIFWGPAGADWXGGDAVKLWVXEKKDYNXGSNTCASGXVCGHYXXVVWRASXNIGXAPVXXNKNXGVFNXXKXXPAXNVVXQKPQLAVNTIKNPLPWMGTNAV

SEQ ID NO: 199171 - protein, 96 aa, Triticum aestivum
  unsure (1)..(96): unsure at all Xaa locations
  Clone ID: PAT_TA_93589.pep
MEDDKKEGKYRGVRKRPWGKFAAEIRDPERXGSRVWLXTFDTAXEXAARAYDRAAFAQKGANAILNFPGEGGEEWGVFFRAAQRGPRKGRPLKRGG

SEQ ID NO: 199172 - protein, 55 aa, Triticum aestivum
  Clone ID: PAT_TA_93590.pep
APPVSMAEKSISDALKCGKCAQKKVSYSQAQTRSADEPMTTFCECTVCGNRWKFS

SEQ ID NO: 199173 - protein, 129 aa, Triticum aestivum
  unsure (1)..(129): unsure at all Xaa locations
  Clone ID: PAT_TA_93591.pep
YXFIFXPRXQYXQKYGEHQHTHNNGRIKNIQYYSVQNKIDAGECESLLKPFVLHVVLMSRHYGSAGSFAEQQGCCRWSAHLVRGCLQRKPVKPRRISISRTEVAEEFFFAILDRSTLCFLPCCISTWIA

SEQ ID NO: 199174 - protein, 108 aa, Triticum aestivum
  unsure (1)..(108): unsure at all Xaa locations
  Clone ID: PAT_TA_93592.pep
GKERGLTRHSFRRERXXFXFTXXQXFXTGKXRELSGXPSVMPXYRXSSFXDPKDRCXXIGYDNTVSLPXGGRGXSEELSKENVKNASSSTGNITLSVXKXKPESXEVI

SEQ ID NO: 199175 - protein, 142 aa, Triticum aestivum
  unsure (1)..(142): unsure at all Xaa locations
  Clone ID: PAT_TA_93593.pep
FPRTLRSRSALSVTHRKXSAMELSLLKPAMEQQRESAGKDGLPPPGSPRAAGXAVRLXRGGXPPAGPARNPPGKPGSPKKXGGKNGGSNEVRWLKAXGFLKTXGTFERRMGGKLISNARXFKQSKLQTKGTNFEPRLXCKEF

SEQ ID NO: 199176 - protein, 84 aa, Triticum aestivum
  unsure (1)..(84): unsure at all Xaa locations
  Clone ID: PAT_TA_93594.pep
PVKLLIGPLTRPKLFQIRMYPLITLGSSASHEVASFRTPNVFXXNHQTCRIKDNFFIKSLSWILXWXXAWXLSFGHGXIXWXNR

SEQ ID NO: 199177 - protein, 108 aa, Triticum aestivum
  unsure (1)..(108): unsure at all Xaa locations
  Clone ID: PAT_TA_93595.pep
RAEFGTSSGGFAPLHTAHSGPLHLLDGFSXAQCVRPRWAARRRPQLERLCILWRPPLQHLGPLEALPCPAEVMDFVLLYFWKCVFTELQSEGAMGVKIACFFSLRYPK

SEQ ID NO: 199178 - protein, 96 aa, Triticum aestivum
  Clone ID: PAT_TA_93596.pep
CLGATYIFTQHNHETNTASSGKKKGKKKKKRTLLYTNYMESESNLAHTPSIDSQTDPLNAQTSTGHCCRYMMEQLLGSSEYPWCTTVCMFAADCCG

SEQ ID NO: 199179 - protein, 162 aa, Triticum aestivum
  unsure (1)..(162): unsure at all Xaa locations
  Clone ID: PAT_TA_93597.pep
LIPKSLDRSVREASQSLFPDTWLAAPDNTAVPTPTSPMVIFPPSGKYGSFSTNYERFSASEITKRSDIESFGRTGFILQLIAAGWHHKSPEQLKEIGDKVXRERIMVMHGTADRMISVHQGRKLIEFLXPGTXIIKEXTGHVFKGEECGYQNKIIXGNVSKE

SEQ ID NO: 199180 - protein, 156 aa, Triticum aestivum
  Clone ID: PAT_TA_93598.pep
KHPVHSNYPQETFLSRKQLRVTSLGTISQLDVEPREVQQTSTTQYSNHSGPFTSTEPPQISSLSLHPSKTPPLSSPLQSSSISNFVGHSRNTNLPPLNPVFGLSLNRLSERDGSAVPMVVYQCIQAVDLFGLEVEGIYRLSGTASHVSKIKSLFDN

SEQ ID NO: 199181 - protein, 65 aa, Triticum aestivum
  unsure (1)..(65): unsure at all Xaa locations
  Clone ID: PAT_TA_93599.pep
MXIFVSXXLRKXPPTXCEMISSVXXSLIPYXRVXMSXLXKFGIXIPGKFWXSCRFGXSSXXXRHD

SEQ ID NO: 199182 - protein, 53 aa, Triticum aestivum
  Clone ID: PAT_TA_93600.pep
RSSSLPYFAQQINRLMSISLARRRCHRSGLGFAMSRSSRTSGGPFSVPSRSAC

SEQ ID NO: 199183 - protein, 103 aa, Triticum aestivum
  unsure (1)..(103): unsure at all Xaa locations
  Clone ID: PAT_TA_93601.pep
IENFTXPRYDPFLAGKDEIFTFQWCRCYRSVYSAYLRKPRRFASRLESKDLTSTSKINDFSSMLDLSFSRESSTSILLHHLASNTDNGVTVKIMEYRDKSGDG

SEQ ID NO: 199184 - protein, 97 aa, Triticum aestivum
  unsure (1)..(97): unsure at all Xaa locations
  Clone ID: PAT_TA_93602.pep
FFFFXFFFFFFFFFFXXKRFXSLSXNFWXTXHRXEQGRNXXXQPLDXPIREIXXVNHVLAXRSECIXQXEVLXXLLLKDAAVGAYRTXXXXRNXAGV

SEQ ID NO: 199185 - protein, 101 aa, Triticum aestivum
  unsure (1)..(101): unsure at all Xaa locations
  Clone ID: PAT_TA_93603.pep
TSAALTGQTTMGTHXATTAAWXNXEDXXFXNTVXSGXXPPLXGVPEEDWFXALPASVPARXXEEVRRHYXXLXEDVGAIXAXRVPLXRXXGEESTPAAAGP

SEQ ID NO: 199186 - protein, 136 aa, Triticum aestivum
  unsure (1)..(136): unsure at all Xaa locations
  Clone ID: PAT_TA_93604.pep
MGLPNQNTVDYPSFKLVIVGDXGTGKTTFVKRHLTGEFXKKYEPTIGVEVHPLDFTTNCGKXRFYCWDTAGQEKFGGLXDGYYIQGQCAKNKFDVTSRXTYKKVPNVGTRDXCXGCENXPLVLVRETKXDVKNKQV

SEQ ID NO: 199187 - protein, 145 aa, Triticum aestivum
  unsure (1)..(145): unsure at all Xaa locations
  Clone ID: PAT_TA_93605.pep
AQSGTRXLGVPFQINXGQPXNXRNPVKVTXIKXXKETFQPWPPTMEAINPFGSQXDSRHKKSPVXGXXFLAXXXQQSXXTKAGAGXNQXXKGXFPWXAAQLSPKXXKKGQPRQNXXSXLKTKIXKSGRXKFGGLIPXRXKGGYKS

SEQ ID NO: 199188 - protein, 156 aa, Triticum aestivum
  unsure (1)..(156): unsure at all Xaa locations
  Clone ID: PAT_TA_93606.pep
PPPRRXAPPIPRXKRXRRRLIRAPRWXNQVPPXVVEPPAPGXRXAQLXXQRXXXPPALPRXRXXRLSRAPAAAXPARPGRRRPPAARKPPPQTXSSSXXXSSSXSGXPSSSSXXGAXPWAAGAGVPXPNCLKTKGFANAGXRRKRRPXKGCXTNLV

SEQ ID NO: 199189 - protein, 95 aa, Triticum aestivum
  unsure (1)..(95): unsure at all Xaa locations
  Clone ID: PAT_TA_93607.pep
XIHXKPXQGYSPDYESTRPFSKXKSLXLVXGXXPRXEKXPAPSGGXALXFKKXLLQXWTGGSKPRLQXLKGIXKSLFTWFNKFQDXSRYWEQPLT

SEQ ID NO: 199190 - protein, 168 aa, Triticum aestivum
  unsure (1)..(168): unsure at all Xaa locations
  Clone ID: PAT_TA_93608.pep
ILGLXPANFXRFNXPXXGVDQXGXKPNPQYXICPPVFFHQXTLDNGPTXFDXXXLQARGXFWLNXFGHFWXXGNPXSXGXRXEPPSXRGGRALTXLKXYPTSQGVXPXAXKXXALXLSXXHXWSSLGTPENXXTXXXLIEXEEVFVVAPXEDHLXTPXXXLXXXPPRL

SEQ ID NO: 199191 - protein, 57 aa, Triticum aestivum
  unsure (1)..(57): unsure at all Xaa locations
  Clone ID: PAT_TA_93609.pep
HXPPPPXKFLXXXLPCPRLXCXPAGRNTXTRXWAPGXPXPGFXGTXGIPXFEFFARP

SEQ ID NO: 199192 - protein, 100 aa, Triticum aestivum
  unsure (1)..(100): unsure at all Xaa locations
  Clone ID: PAT_TA_93610.pep
SCRIRHEXFFFFXFFFFXFSFFXXQXPKTXIXKKLYXVQHKGTYRITKLKCRXXLTXSNLFXXPXKKGGXGXSIXNXIXHQKNXXMGXXGQXAQLSTWGR

SEQ ID NO: 199193 - protein, 52 aa, Triticum aestivum
  unsure (1)..(52): unsure at all Xaa locations
  Clone ID: PAT_TA_93611.pep
TCSPKRNDXXKACVQVLLSSVSSXXDLKXPDTXMIEWVMPPNLLHVSNLLSI

SEQ ID NO: 199194 - protein, 115 aa, Triticum aestivum
  unsure (1)..(115): unsure at all Xaa locations
  Clone ID: PAT_TA_93612.pep
AXGLXXKKMLSTXLXLKGNXYGFXXSXXMSYPTRISSTKSNLQTQQXHQQPIQEXXNQGGSFLNYRXXWEIXXARLXLLWEGXQSNLEAWTIFTSRGVGCNXNCPXQIXLDHXRM

SEQ ID NO: 199195 - protein, 170 aa, Triticum aestivum
  unsure (1)..(170): unsure at all Xaa locations
  Clone ID: PAT_TA_93613.pep
RAXPRGCVSQGXTGRRAKKFNLXASSGGRRXPXXRRXSXVSMASGVLXKRVSLKWGNPGNVRGQLKVGQPAGAXRVXSPGTXNFRTKXXGIXTLPLEETGFYXAXRWPTGREGGRVPGPXXVRPKGKSFKTSKXAQSEKKKQLAVTXMKRXSRLQRGXPKLTLXNLQXNV

SEQ ID NO: 199196 - protein, 105 aa, Triticum aestivum
  unsure (1)..(105): unsure at all Xaa locations
  Clone ID: PAT_TA_93614.pep
FPGXGRNXEXGFXANGGFPWSSQPPDVXXRRAKXGFMXXKKGCCETGTCTTTGXKXXXDAXRLHPPRDRPYXRWXXRTKRLRVIGERPTPSSSXKRXXQQSXPMG

SEQ ID NO: 199197 - protein, 98 aa, Triticum aestivum
  unsure (1)..(98): unsure at all Xaa locations
  Clone ID: PAT_TA_93615.pep
KSXLXWDQLXTLIRXQXPWXLLLRTLFNCXXFSIKXYSFXCYPXLLXXEKFLXGVPGKAXXKPXQGKRIXGYXXXKEGSPFPVXLISXQPLVLPXLVK

SEQ ID NO: 199198 - protein, 104 aa, Triticum aestivum
  unsure (1)..(104): unsure at all Xaa locations
  Clone ID: PAT_TA_93616.pep
GRNPDKXXKVDXGXTPTTIHSPMGLRPSKGXXXSTDNXQAPFKFXKKQFSIHSKPGXPLQTCXINXLXNALMRXVKMGTGRXKERXEREKSXRGXQKXSMXKIX

SEQ ID NO: 199199 - protein, 109 aa, Triticum aestivum
  unsure (1)..(109): unsure at all Xaa locations
  Clone ID: PAT_TA_93617.pep
IWGIKRKVXTGXKDQLEPGIIRAFNPQXPIREQQXKGPLXVGVGVKKVQAMGISVERRGKKXMXLXAKGXNWTQPPLDKIGPLAGKKGXGXWGXNXXNXAKRGPTGXXQ

SEQ ID NO: 199200 - protein, 90 aa, Triticum aestivum
  unsure (1)..(90): unsure at all Xaa locations
  Clone ID: PAT_TA_93618.pep
GSSKNLWXPPAXRSWPNPXQGAXIGQWGXXANVXXDWXQTXWLTXVGXXKXGVTLXPMXATTGFXNNAQXGSXXSSTPSXQXAGXESXXG

SEQ ID NO: 199201 - protein, 54 aa, Triticum aestivum
  unsure (1)..(54): unsure at all Xaa locations
  Clone ID: PAT_TA_93619.pep
XLASXMGXPRTGXPEXAXGFAPXAFVXLGEMEGXGRLXGGVXSXLGDGEMXXHG

SEQ ID NO: 199202 - protein, 80 aa, Triticum aestivum
  unsure (1)..(80): unsure at all Xaa locations
  Clone ID: PAT_TA_93620.pep
XXLGPGPPPXXVFFFFFFFCHLRVWXAXLXVFCXLXIIIYYNPXLITRELATRKLGLLVASRTXVPPHGRSXLNCHLEAN

SEQ ID NO: 199203 - protein, 62 aa, Triticum aestivum
  unsure (1)..(62): unsure at all Xaa locations
  Clone ID: PAT_TA_93621.pep
MATASSLLGSSPXXNPILQNXGXXPXNXXLSXNGSGPRNWGNLPGPEEGPXRXKPKAEEXVK

SEQ ID NO: 199204 - protein, 97 aa, Triticum aestivum
  unsure (1)..(97): unsure at all Xaa locations
  Clone ID: PAT_TA_93622.pep
KTPAAFTALQPDIEVRMXLXHQIGEDXKXKLXXXAVDWXTGEXALQFXEINXDIEEXDXEDXDDDQDRDFNDDDDEESDENDHTXKXKTXTXGCKQN

SEQ ID NO: 199205 - protein, 78 aa, Triticum aestivum
  unsure (1)..(78): unsure at all Xaa locations
  Clone ID: PAT_TA_93623.pep
LSLPLVARXHYIRIQFXQMLKINQXPMHYKDXQSXNPXXKXGINCXGGLVQXDGXXQTPKXXGNTXGGXTTAYEKEXP

SEQ ID NO: 199206 - protein, 109 aa, Triticum aestivum
  unsure (1)..(109): unsure at all Xaa locations
  Clone ID: PAT_TA_93624.pep
LVPNSARREGAHHAAFPLRLTYQMGGLKLITSPRWRPVSRTDTTPHHALRVTKYLPSSAMQQRLMHSDAAPCQYKTDLRMFHFPSRAMGFWLGDVCFLHAKCSAVXCSV

SEQ ID NO: 199207 - protein, 78 aa, Triticum aestivum
  unsure (1)..(78): unsure at all Xaa locations
  Clone ID: PAT_TA_93625.pep
GGDRRAXXSGXTARGXAXXXXASGXRVWARCRPSRLCFRLRGLVRGADGXGWSPTGXXXRFXGTXSXAXRILVXNSAR

SEQ ID NO: 199208 - protein, 165 aa, Triticum aestivum
  unsure (1)..(165): unsure at all Xaa locations
  Clone ID: PAT_TA_93626.pep
CRIXDXGGFPSAMVLXXKFLVKIPAGLXPEQXAXXLLXAGVTVXNPLXHXRLKXPXLPGGILGLXGVGXLGXXXGKSMGHHVTXINSSKKKXGRGPNGPNAVNFVKLPNRTKNWAARPPRPLLFNSNPLPRPKATPLGGLNLGGLVPKNWTGKNVALIGAVYPGA

SEQ ID NO: 199209 - protein, 152 aa, Triticum aestivum
  unsure (1)..(152): unsure at all Xaa locations
  Clone ID: PAT_TA_93627.pep
GFEEFFFGRNSFGPXTAXLPAGXQAVCKXXTGFFKGKVXXPXSLXXGSXPFPGESHPESAGXRAXPLLPXNVPGRPPLEGTRCRXTPLPLSPRTARRPAXSRXRGGRPXDEXVGAXAXRAWETHALXQAGHWTPWFAPISSFASLFSSCSVF

SEQ ID NO: 199210 - protein, 163 aa, Triticum aestivum
  unsure (1)..(163): unsure at all Xaa locations
  Clone ID: PAT_TA_93628.pep
LPLHXHTDALPWXPXPPRPPLPAPLPRTIXXLXXACVWXGGSCENKSVRLGLSVXGGAKAVVWGGATWGNTMRRXTXLXEXXPPSVLVVVLVDXDXDXQAXXGGXKXKKVXXPGGGRLAXRPPXRRQQGAPRTRLGSSXVXXRPAAAQXGXGXXXCKXXRLXX

SEQ ID NO: 199211 - protein, 114 aa, Triticum aestivum
  unsure (1)..(114): unsure at all Xaa locations
  Clone ID: PAT_TA_93629.pep
SILGSYHLVPRAFKSTTNFSSAXDLAPKTXSLKXXMAGTDVXKQLEEXAAERSGIXKXLLAXQXTLXXMAPAVXNMEPXVXKMEPGLASLEPXGQDXXGWRPRVGTGMGQFTXI

SEQ ID NO: 199212 - protein, 121 aa, Triticum aestivum
  unsure (1)..(121): unsure at all Xaa locations
  Clone ID: PAT_TA_93630.pep
GGASEKGQLEAFPPVSVAPSSSSECDICLAEFADGEXVRVLPGCGHGLHIXCVDAWLRTRXSCPSCRASPSMIDTPMQMQVQPAAAAPTVVVVVAGSSMCGRCGELTAPAGARAADGALLA

SEQ ID NO: 199213 - protein, 111 aa, Triticum aestivum
  Clone ID: PAT_TA_93631.pep
SRVHKPVVTALADPCGPKKRVVAENGKILVVDSSGNVYLEQTDEEGENEEILLDPNELIRPTFLDTALCRLPIWAYSSISNRFMQLAPDKEVHDVKFSVDSPAVTSSDNDC

SEQ ID NO: 199214 - protein, 63 aa, Triticum aestivum
  unsure (1)..(63): unsure at all Xaa locations
  Clone ID: PAT_TA_93632.pep
IITLPXGVPSGXFXVXQLLGXIGQGAGRFCLETTLLLSYVYFCQTSDGLEPTEYGNENHWIVG

SEQ ID NO: 199215 - protein, 129 aa, Triticum aestivum
  unsure (1)..(129): unsure at all Xaa locations
  Clone ID: PAT_TA_93633.pep
TGMCAAXSLWXPGFXQXPGXXXHKLLXQEYMXXLLANILLXTNXXATASISKXXXQVNXDDTXYVSTDXRVTGLFKTXRXLVVIDXVNTHELFDVLSAXSWADGVGXKIIKTKGHSTAKKXXXXKIWGK

SEQ ID NO: 199216 - protein, 118 aa, Triticum aestivum
  Clone ID: PAT_TA_93634.pep
PPLFHSGTWVSMPGVIPVASGGIHVWHMPALTEIFGDDSVLQFGGGTLGHPWGNAPGAAANRVALEACVQARNEGRDLAREGNEIIRAACKWSPELAAACEVWKAIKFEFEPVDTIDK

SEQ ID NO: 199217 - protein, 84 aa, Triticum aestivum
  unsure (1)..(84): unsure at all Xaa locations
  Clone ID: PAT_TA_93635.pep
SPTTNVXXGXNXXLSXKWTXXNXGGLANXFGXKFNKISSKKXXLGLTXPGTKGGGPGNQFRPXSGVVITPRSLGRRFXKGRELG

SEQ ID NO: 199218 - protein, 116 aa, Triticum aestivum
  Clone ID: PAT_TA_93636.pep
MLATSRVIGRRCVYHTALTAPNPGSSLLPLSTAICQPFSTSRNRPSQIGRVPLTIPPDVKFLLVQPPKSKYGSVSPLLAQRKVQVEGPLGKLALSIPAFVNVDYDEEYTKSKAGGK

SEQ ID NO: 199219 - protein, 117 aa, Triticum aestivum
  unsure (1)..(117): unsure at all Xaa locations
  Clone ID: PAT_TA_93637.pep
LVPNSARGKTIAPAKRGVXRLIMDADSLPVVVPFVHTGMXDIMPVGKRIPRTXQRVIXVVGDPINFXDLMAENXNDSQHISKSXLXXKXTXRIGXXVXQLXGXVDXLVAXQKGRAPK

SEQ ID NO: 199220 - protein, 94 aa, Triticum aestivum
  unsure (1)..(94): unsure at all Xaa locations
  Clone ID: PAT_TA_93638.pep
MPYLQPPRPHPHPTSRLSRASPPSPFPFFPAGTSRSGRLHXVPXSXXSASRTSTDXIKSLRXITXVKTPXLXRXXICSXXKXXLINTQINGGCV

SEQ ID NO: 199221 - protein, 127 aa, Triticum aestivum
  Clone ID: PAT_TA_93639.pep
VWVCINCGWNEGTNPHEAFLSKWYIGTAREIHRNKLDDIKRDSLDEILYKFSPIFEDVKGLVEEFRDLLFNSNIKTRTGNLEDPNKLYEPIIAAFDRAIEALKISQAKHPENATRNEPESPKQNSVT

SEQ ID NO: 199222 - protein, 171 aa, Triticum aestivum
  unsure (1)..(171): unsure at all Xaa locations
  Clone ID: PAT_TA_93640.pep
KGGRGVGVAXXVEVVEHTGSQPRIRDPPSLPPSFRSQLTPNANANANSKARGKSREGEENPAPFHLPSQAPTTSPPSPTRPHGVXDEEEDGIRPLLPTAASFSAGSNRGPPFRSVPLKXQTPWXGISGGFQLXPAWVPPXGNHXPCPQXQRGXFXKGXDSXRNPKLSXPXG

SEQ ID NO: 199223 - protein, 157 aa, Triticum aestivum
  unsure (1)..(157): unsure at all Xaa locations
  Clone ID: PAT_TA_93641.pep
RAEFGTSRGRGRASRGTRETHTEKEVQKPADDNPSTSEVTEQQTATSGEVEVQVEADSKEPKEKPTRTPRPRRSRGPPADGIPSKTKIMGANLPYDLSEEKLKELFVXFEPITAKIALRPNPRFMXXKLQAPNEPXXXRGFGFISLXPEELXIKGXA

SEQ ID NO: 199224 - protein, 69 aa, Triticum aestivum
  unsure (1)..(69): unsure at all Xaa locations
  Clone ID: PAT_TA_93642.pep
KFIXXNXLKGEVCPKXXXPKKFNXFXKVLQXXXEFLXPILXPKDXKAGXQNNXKGPNMRXSXNAIPLLV

SEQ ID NO: 199225 - protein, 132 aa, Triticum aestivum
  unsure (1)..(132): unsure at all Xaa locations
  Clone ID: PAT_TA_93643.pep
ETKVGFPRGWQGLRGRLRGPNFGQRSFNFPLNNGIWEGNLLGSFRTLLTNPGDSMAGSFFLSPRAIFRNNWKPQICPTFVLCCPTNASCGSKLDCTSVPSKSSWGSTVPQKXQLQSPPFYANKIWYYSGWYR

SEQ ID NO: 199226 - protein, 127 aa, Triticum aestivum
  unsure (1)..(127): unsure at all Xaa locations
  Clone ID: PAT_TA_93644.pep
HNLPVVSFFVPEIKVLGIGLKIXGDFLWTKRDPRSTRVGPEVSRYGRQCRGRALPPPGGSSYLVTCLVDPLDVRHTPKIPIITKTPRKKPRSRVPPSQASVAMKNQSRPSLGTLSEGAIITGGHGGG

SEQ ID NO: 199227 - protein, 62 aa, Triticum aestivum
  unsure (1)..(62): unsure at all Xaa locations
  Clone ID: PAT_TA_93645.pep
SLHLXMGXRFVXGXWVXFCTKLLRRSWAIAYFXIIDNLYDELYVRVXXXWARLMKKIHKDTA

SEQ ID NO: 199228 - protein, 108 aa, Triticum aestivum
  unsure (1)..(108): unsure at all Xaa locations
  Clone ID: PAT_TA_93646.pep
FDFXGQXWKAXXPRXWGFGXXNXNLAKHFWFFXXFPTVXNFLSFSEPKXPLAXLXRRRRSAPPXETATPXTXTPPLXXTXXPCRKSMXPFXPXGCLFXSXGTXSLGAG

SEQ ID NO: 199229 - protein, 86 aa, Triticum aestivum
  unsure (1)..(86): unsure at all Xaa locations
  Clone ID: PAT_TA_93647.pep
XPEATTXSTLAXLHTXLPFSSLPXTDQPXVRXXAGSRDXNDETLXAAARCSCPASPPLLLLXGGGXSGPPRQXXXPHQRXCVVRIK

SEQ ID NO: 199230 - protein, 168 aa, Triticum aestivum
  unsure (1)..(168): unsure at all Xaa locations
  Clone ID: PAT_TA_93648.pep
XPXXXGXGIXGYRAPPPPXXVFFFFFFFLNKNFXSVXIYFXXVWDPHXFPSRGXQXXTTLGXTLRXSFLXVTPPTLXNXXXAPXXVLSHRXPNLTIFCTCAYPTRTXTDAXAXXGRXRXQPRCEVHNTSPPNXGRTLXXPTSVLHPLWSXGGFSPFRLGXXPLVRKLG

SEQ ID NO: 199231 - protein, 125 aa, Triticum aestivum
  unsure (1)..(125): unsure at all Xaa locations
  Clone ID: PAT_TA_93649.pep
SCRIRHEPRQVYLTGEKRREAEMSGRGKGGKGLGKGGAKRHRXVLRDNIQGITKPAIRRLARRGGVXRISGLIYEETRGVLKIFLENVIRDAVTYTEHARRKTVTAMDVVYALKRQGRTLYGFGG

SEQ ID NO: 199232 - protein, 82 aa, Triticum aestivum
  unsure (1)..(82): unsure at all Xaa locations
  Clone ID: PAT_TA_93650.pep
MEGSSNRXPEITIIPAPXTAEGXGGXGXAVXAVKAASKEAIKXGSPSPAKXGXXRXVSLPGWKLXSLCKESXSPPXMXARFP

SEQ ID NO: 199233 - protein, 123 aa, Triticum aestivum
  Clone ID: PAT_TA_93651.pep
LVPLYRTFIDPQRIAAFTRAPPKIFEGANVGCKFELFGGNVAGEYTELLEPTKIVQKWRLDTWPKGHFSRLEIVFDQNDIDNVTVMRVTWSGVPIGHEEVTKKNWKEYYVRSIKQTFGFGAIL

SEQ ID NO: 199234 - protein, 142 aa, Triticum aestivum
  unsure (1)..(142): unsure at all Xaa locations
  Clone ID: PAT_TA_93652.pep
LSQTYVISXRIKFVAXDGVFYXXLNXFFQREXAXKGYXGXVQVRVRPSVTXDIXIRATXXQKXLXEXRXXIRELTXLIQKRFKFPENSSFSLRRQXXNNRGLSGXGQXESVXIQXXKMGSAVRKXCYXVLRIQYGXVGAKGG

SEQ ID NO: 199235 - protein, 124 aa, Triticum aestivum
  unsure (1)..(124): unsure at all Xaa locations
  Clone ID: PAT_TA_93653.pep
MAMDVAFAGSSSSAMDALAASXSXSSAAPADPXHXWQKVTYAKXRXRKPXAVAPAAAAAHDLXGXAGVFYGLDKRSQEXHRAIXAARDSKAGYYDDXDXXAXAARXXWGSRSSDEGSHSERGGQ

SEQ ID NO: 199236 - protein, 88 aa, Triticum aestivum
  unsure (1)..(88): unsure at all Xaa locations
  Clone ID: PAT_TA_93654.pep
RVXCNHCHMGLDGQSFNRXYXMNGLAGRLGAWVTAAMRXNINNAXHLNXAMYTICTRTXPILFLPQQKDXLXCXGCDXTXFEIXKKXR

SEQ ID NO: 199237 - protein, 115 aa, Triticum aestivum
  Clone ID: PAT_TA_93655.pep
RAEFGTRKGRAILETYSGAHLEPDPSTCRFSSSKFYKLRFGPILRELHTKRQVVIYTTEAEYLVTTKKWPQLQRLNSSLQELNITVTAVKPKGSRSLRCLSAGNYTKGGSWEDLG

SEQ ID NO: 199238 - protein, 110 aa, Triticum aestivum
  unsure (1)..(110): unsure at all Xaa locations
  Clone ID: PAT_TA_93656.pep
MPPSVRTXSIXFADLKERXRXLXGXXXEGXGPNGXGIISISDVPDFPXLRRXLLXLAXRVXXLPEDVXKXLXXPDNXXXFGWSHGKXKLEXGKLXTFXGSYXAIPILGCP

SEQ ID NO: 199239 - protein, 68 aa, Triticum aestivum
  unsure (1)..(68): unsure at all Xaa locations
  Clone ID: PAT_TA_93657.pep
GCSCGSNCKCGKMYPDXXEXGXXAAXVAAVVVLXVAPENKAGXFXVAAGQSXEGCSCGDXCKCNPCXC

SEQ ID NO: 199240 - protein, 106 aa, Triticum aestivum
  Clone ID: PAT_TA_93658.pep
TIPFSPARKVSSSDYSKHPRSSPLPTLDDETSVIMFANYHRTLAYLLSFSSISVMAVPAPPAAAVAPMGAAVTIAVSDGGSAYPRANYLNNGKIIGSYTAFPAGGQ

SEQ ID NO: 199241 - protein, 156 aa, Triticum aestivum
  unsure (1)..(156): unsure at all Xaa locations
  Clone ID: PAT_TA_93659.pep
RAEFGTSSLVLDKNAKMHLNFLLASLILATGCDAASTCWYPDGVTSDPSHVPCNQTINTASACCNSHDACSSGLCVSMYGAYRGTCTDXSWNSPNCGSREWPQCITXXSTRRKYNQVYFXFTVWIAXXLNGESYXLVAIQNGIFLLQRPIPSKXIX

SEQ ID NO: 199242 - protein, 58 aa, Triticum aestivum
  Clone ID: PAT_TA_93660.pep
NFSPPWTYLRLLSFSLLLFQSIADPQFCCEFRLMMCLIRKNILALAIGRNTVFIANSL

SEQ ID NO: 199243 - protein, 109 aa, Triticum aestivum
  unsure (1)..(109): unsure at all Xaa locations
  Clone ID: PAT_TA_93661.pep
MEKXIDRQRVLLAHLLPSSSAAPSRISASACAAGDXAAYXRSSCFGXDVVIVAAYRTPICKAKRGXFKDTYPXDLLXPVLKXXLXKTXINPXEIXDXXVGXVGKAKTDS

SEQ ID NO: 199244 - protein, 59 aa, Triticum aestivum
  Clone ID: PAT_TA_93662.pep
KRSRHNLAVVLAHEMRGINSLILTQVVYGRCDAHCMVGWCNRSSSGPICNIDPESFEHT

SEQ ID NO: 199245 - protein, 58 aa, Triticum aestivum
  unsure (1)..(58): unsure at all Xaa locations
  Clone ID: PAT_TA_93663.pep
ITPASLRRALSRLGASRDVGDCRAMIXRFDLNGDGVLTFDEFVHSSMLSRIASRSGRY

SEQ ID NO: 199246 - protein, 141 aa, Triticum aestivum
  unsure (1)..(141): unsure at all Xaa locations
  Clone ID: PAT_TA_93664.pep
MXPTVMVSSATSVAPFQGLXSTAXLPVSRRSNXXSLGSVSNGXRIXCMQVWPIEGIXNFEXTLSYLPPLSTEALLKQVDYLIRSKWVPCLEFXXVGFIFRXHNASPGYYDGRYWTXXKLXMFGCTRRHTIDHSCGSRMPGA

SEQ ID NO: 199247 - protein, 145 aa, Triticum aestivum
  unsure (1)..(145): unsure at all Xaa locations
  Clone ID: PAT_TA_93665.pep
MAALSSAAVSVPSFAAGAXVAAPRSNRMVVRASLGKKAASAAVXMAASAMLLGGXAMAQDVLLGANGGVLVFEPNDFXVKGGETITFKNNAGYPHNXVFDXDAVPSGXDVSXXSQXEEYLNAPGENFSVKLXVPGNXXFYWEAHA

SEQ ID NO: 199248 - protein, 130 aa, Triticum aestivum
  unsure (1)..(130): unsure at all Xaa locations
  Clone ID: PAT_TA_93666.pep
LMGLGSPRAKXPIDGSLVGTIIITRPKSQLSTFVPALNAKYASWITKDSMASGVGVAGILGPVIXSSPQASIVLQGLTLLGLRQHISYGFNACVLVWVYCDARDILLGMGFEVIDAFEELSCDVKDMHVD

SEQ ID NO: 199249 - protein, 75 aa, Triticum aestivum
  unsure (1)..(75): unsure at all Xaa locations
  Clone ID: PAT_TA_93667.pep
MEGXSIRTPEITIVXAXXXAAGGGGGGGALYAVKAASKEAIXPGSPXPGKXXXPGGVSLXXWXLXSLXKESTSPP

SEQ ID NO: 199250 - protein, 92 aa, Triticum aestivum
  unsure (1)..(92): unsure at all Xaa locations
  Clone ID: PAT_TA_93668.pep
RIVXVXXPNXRRAXXXXAXPXTGXXGGKXAGIAPGCSAPSDVXIRXSAHRXXERHRNQAHXVIDPLLHCTILXEIXCXXLXXXLVSLPNXRR

SEQ ID NO: 199251 - protein, 136 aa, Triticum aestivum
  unsure (1)..(136): unsure at all Xaa locations
  Clone ID: PAT_TA_93669.pep
RASWRIISSIEQKXENRGNQAHVASIKEYRTKIETELNKICDXILKLLDSHLVPSXTAAXSKXFYLKMKGXYHXXLAGFKXGAXRKEAPENTLXAYXSAXDIALADLXXTHPXXGWLSTSVVLLRNEQRLPLPQIF

SEQ ID NO: 199252 - protein, 133 aa, Triticum aestivum
  unsure (1)..(133): unsure at all Xaa locations
  Clone ID: PAT_TA_93670.pep
MXTISAAAATTVVARAAIARXQXLGLPHLXTXSGRVRCSYSXDAKEGTPAAAVRGAGASLLXAAGAVTXSAGPALVLVDERMXTEGNGLILGLXNNLLGWXLXGVFGLIWLLYNVYXSGLXEEEEVRRLALIH

SEQ ID NO: 199253 - protein, 50 aa, Triticum aestivum
  unsure (1)..(50): unsure at all Xaa locations
  Clone ID: PAT_TA_93671.pep
FGVNLXCAXDAEEDFSGPGRTXTTALQLLSPASSSSSSSGKARCSLNLDL

SEQ ID NO: 199254 - protein, 75 aa, Triticum aestivum
  Clone ID: PAT_TA_93672.pep
STHSLRTCRPSPKRPSLRFVSPSATYATHPPRSLAAARVQSSCSSSTVWILSRLRDDTPESYLTLKINETRWALI

SEQ ID NO: 199255 - protein, 137 aa, Triticum aestivum
  unsure (1)..(137): unsure at all Xaa locations
  Clone ID: PAT_TA_93673.pep
FPHFAPXQYSHLAGVTGAGVASMEAALANALTKEVVLKLXTLLGXKHKLSKGLKDDIRFIHTELDIILXDMXEHLGDXSAXXRXXVVSMEEMRDXAHDIQXCINRFLPCVXLRGGEXTXVLHRGQRKGVTNNRDPXV

SEQ ID NO: 199256 - protein, 133 aa, Triticum aestivum
  unsure (1)..(133): unsure at all Xaa locations
  Clone ID: PAT_TA_93674.pep
MSCSHLSTAWSSSALAKHLHPPPRLXXSXNLVVRCSLRVLRNRIDSVRXKVRRAQEAVVSSRPFSEALVEVLYNMNQXEIQXEDXXLALNRQARPSXASRSSSSTGERGLWRAPSNKQSGSKGRGAGGNLASF

SEQ ID NO: 199257 - protein, 32 aa, Triticum aestivum
  unsure (1)..(32): unsure at all Xaa locations
  Clone ID: PAT_TA_93675.pep
AYLEIFTLRRYCPGALETPPKWKEIRKLXEVI

SEQ ID NO: 199258 - protein, 160 aa, Triticum aestivum
  unsure (1)..(160): unsure at all Xaa locations
  Clone ID: PAT_TA_93676.pep
QKGLPCIVFTLSFPSCRISCILLFLKKNLRCLGMTKLLVSKGLYMVLDRHGIKIKAEMLNEHIIKKTRDVRNTDLREDAVAIVLHEMVDAYFEEFSKIDTEEWXLFKLTLTLKVMIDPQXGLKAGGPYEMFTHDELIMMGXVTXPKYEXTPDKKTGLGNG

SEQ ID NO: 199259 - protein, 135 aa, Triticum aestivum
  unsure (1)..(135): unsure at all Xaa locations
  Clone ID: PAT_TA_93677.pep
KKNLTNXAXXHVDDXQHAGPEAXAAAAPTATXRXXPQGQRPRRXGGRSRGAGEHXHPGAVHGGHLTDCVLRRXXGAGRRWGCPSSTASIGLGXENXNXARCSMAGPXPGPCWRGRKVKXGRVVQRTXVSPALSGK

SEQ ID NO: 199260 - protein, 99 aa, Triticum aestivum
  unsure (1)..(99): unsure at all Xaa locations
  Clone ID: PAT_TA_93678.pep
VTSFHKRDPFFASVTVFLSKISCTFSFTPCFPRVSLIKCSITLEGFXYLLETKVSTCSSDGSPYLWXGILLKVFVCXKTGLVQFPRVSKXGSSDPXFGA

SEQ ID NO: 199261 - protein, 65 aa, Triticum aestivum
  unsure (1)..(65): unsure at all Xaa locations
  Clone ID: PAT_TA_93679.pep
KFFFPAPVSTSLLHHLARLRKRSQPKEKFRNPQILPTIQNFLCALCVFKLNSLSWGXKIKXGLQA

SEQ ID NO: 199262 - protein, 65 aa, Triticum aestivum
  unsure (1)..(65): unsure at all Xaa locations
  Clone ID: PAT_TA_93680.pep
LQXXTIYLHEGETIXIKTPSLFKNFFVSVGLRYPTGXCXWPTSXXDRTRXKLLLDLXNPFPALAC

SEQ ID NO: 199263 - protein, 153 aa, Triticum aestivum
  unsure (1)..(153): unsure at all Xaa locations
  Clone ID: PAT_TA_93681.pep
XHFSSWVSPTRWAVEAQDHNNFLXACTDFLLNFHPTXPMXNSKILXSSLXCNRLPXASCIXXGDDLNQAPVCLYRVFPXMPPNIAVLQGQQGMPPGLQPRQVDNQGIAXSRFTRDRVLISTKEETPXSCLXNGXCPRTLXGNCHKGFXKXKCP

SEQ ID NO: 199264 - protein, 81 aa, Triticum aestivum
  unsure (1)..(81): unsure at all Xaa locations
  Clone ID: PAT_TA_93682.pep
SCRIRHELKHGVFLKSGXIEXIFLSEKSMSDYKYMGXENPMFMNDHSXLGRXTXVRFKVXGXXXMEAXRQFXLLXXLGXDF

SEQ ID NO: 199265 - protein, 157 aa, Triticum aestivum
  unsure (1)..(157): unsure at all Xaa locations
  Clone ID: PAT_TA_93683.pep
VCSDTKAMIHIGDATYYVSAINYKXSSFWVIDANMDLHNNCPLPRWNPPYQPDNMEIELSPLVHSGACFVKCSHEVKDTGTYMPVACLSTNDSFVYVLTGXXXTYMEYLEPSCGYLGXTPXPWDGLALKNASYAXVVKSXRNGVLXFXXPXPGKNKA

SEQ ID NO: 199266 - protein, 168 aa, Triticum aestivum
  unsure (1)..(168): unsure at all Xaa locations
  Clone ID: PAT_TA_93684.pep
GYSPASPKSSLGFSLFSGEKSQEATCSCTXDKLSGDEXLLSDSFPYKEXLENGVLWEXDXHWVVQGXIDVXIGANPSAEXXXDDXGVDDQAXXKGVDNVDNFRXXEAXPLFXKKQFIXHMXXYIKNLSAXKLEGDDXNAFXKEXWSSAXKYLPKAQRTFKFLWGEKQM

SEQ ID NO: 199267 - protein, 50 aa, Triticum aestivum
  unsure (1)..(50): unsure at all Xaa locations
  Clone ID: PAT_TA_93685.pep
SQDXPRSLXXPLKERRGXHXSTSXXNLWGPSXTLXQXAASXLXYXLMTXN

SEQ ID NO: 199268 - protein, 116 aa, Triticum aestivum
  unsure (1)..(116): unsure at all Xaa locations
  Clone ID: PAT_TA_93686.pep
LVPNSARARAEFGTRGDRPSYLGFAPPRRSPPXRRXXXRRRXRXAPVARRSGSAPLXLGPRRRADRXMINLFKIKGXKKEEAATSNGGXPXXXAXSQRELRXPQKXLHEAXLXAXD

SEQ ID NO: 199269 - protein, 91 aa, Triticum aestivum
  unsure (1)..(91): unsure at all Xaa locations
  Clone ID: PAT_TA_93687.pep
SVRADYXALFNAAEGVTECFNEQQKNQFDVWMLHAVVANDLCTDDSFVFSKAVGKIKDAISALPVATVDDDNDEATALAALAESQSGTTRE

SEQ ID NO: 199270 - protein, 70 aa, Triticum aestivum
  unsure (1)..(70): unsure at all Xaa locations
  Clone ID: PAT_TA_93688.pep
FQQTXXSPPERXXXSPEMCXRGNLXLFYSXPNPWPLXXGGXXXPPPAXTGQRAFQPGGXHLVFRSAPPXA

SEQ ID NO: 199271 - protein, 137 aa, Triticum aestivum
  unsure (1)..(137): unsure at all Xaa locations
  Clone ID: PAT_TA_93689.pep
MANPRVFFDMTVGGAPAGRIVMXELYKDAVPRTVENFRALCTGEKGVGXSGKXLHYKGSSFHRVIPXFMCQGGDFTXRGNGTGGESIYGEKFADEEFRPQXHXSPGXLSMGKRGXQTXNXSQVSSXATVPXLGSREV

SEQ ID NO: 199272 - protein, 128 aa, Triticum aestivum
  unsure (1)..(128): unsure at all Xaa locations
  Clone ID: PAT_TA_93690.pep
MGSFXALPLXALLVLXVXWAWEHLVWXPYAIARRXXAQGIHXPPYRFLKGSXXEVRRVKAXTADVVLDVRXDHNYLPXXAPHFLXWGGQYGEPFLFWVGAKPRXCVFFYXXXXGDFSNKSGHXXXKTR

SEQ ID NO: 199273 - protein, 78 aa, Triticum aestivum
  unsure (1)..(78): unsure at all Xaa locations
  Clone ID: PAT_TA_93691.pep
RLLRGANLSLGGXKDKLCMKFXKILYSSLIIIGALKSFARGGRGGIWPPXSXPXAEHYNXKTKCXTXFXEWXVGQKKK

SEQ ID NO: 199274 - protein, 63 aa, Triticum aestivum
  unsure (1)..(63): unsure at all Xaa locations
  Clone ID: PAT_TA_93692.pep
VDRAPVLLEAPXQASSAXXXPHKXHLCXNTHPLSLSLSLCGVEIVGSERSVAKECCLVPNSAR

SEQ ID NO: 199275 - protein, 145 aa, Triticum aestivum
  unsure (1)..(145): unsure at all Xaa locations
  Clone ID: PAT_TA_93693.pep
LLAPSCVVPNRRPPQRGEAAARHSACPVAPAHPAGXDPMASXRILKELKXLQKDPPTSXASAGPVGXDMXHWEXTIMGPSXXPFTGXGLFLVNIHFPPVYPFXPPKXSFRTKXFXPNINKXGSXCLDILXTSGPGFPIGLKLFGC

SEQ ID NO: 199276 - protein, 55 aa, Triticum aestivum
  unsure (1)..(55): unsure at all Xaa locations
  Clone ID: PAT_TA_93694.pep
GGXAEIRKGLRCASRRVLAETRWRSILATENLKTLAGICSSGRGAPEEEKAACLP

SEQ ID NO: 199277 - protein, 161 aa, Triticum aestivum
  unsure (1)..(161): unsure at all Xaa locations
  Clone ID: PAT_TA_93695.pep
ERTKSRXXFFFFFFXFFFFFFFFXXPYXACXCXXQSFXSSNGGCXIXLISXXXNVQIXKXLSKRSALNTLTTKXVPXLXDPRCRCXTGVLVLXMXXQIQFPRSFMTFXSKXPPWWGNXSWXSCXXGCQVAKSRVFPRAFDXSPXGXXXKKXLGXXIXPQXX

SEQ ID NO: 199278 - protein, 162 aa, Triticum aestivum
  unsure (1)..(162): unsure at all Xaa locations
  Clone ID: PAT_TA_93696.pep
CNLPKIPPPPPPPPPPPLPAQCSASVAASSPXSAPLRXPPASLRPXXSSPPPRXPFPRASASPWRSTWSTPAGSPAPRRSRAPXSSLNSSPPAKPPTPCSPFSPGLGLSGGDIAGRRRPEPRVLWRGAVGTPGPPKRSWGAQTGLRGLVQDFRKGSRPNNPG

SEQ ID NO: 199279 - protein, 51 aa, Triticum aestivum
  Clone ID: PAT_TA_93697.pep
RPSRILQSNTSDFSLYYALSINKPEDVVENKVASCAIAVKLECLTKAQRFL

SEQ ID NO: 199280 - protein, 156 aa, Triticum aestivum
  unsure (1)..(156): unsure at all Xaa locations
  Clone ID: PAT_TA_93698.pep
MAALQTPSPFAGTARRFVPRLRYLLLPTTMSLSSSIVSSRSRDGDGEQPLLPHSSLEIAGARRGLLAGFDSLRRPYRAFPVFASNRHVETIFAGFTRSLPTVXFRRECLRTPDDGAVALDWVSSDDRALPGEXPVLILLPGLTGGKSXDTYVRHML

SEQ ID NO: 199281 - protein, 152 aa, Triticum aestivum
  Clone ID: PAT_TA_93699.pep
MIAPYKTFILALASASLSLASSSAVLDLIPKNFDEVIFSGKPALVEFFAPWCGHCKALAPVWEELAQDFAFAKESIIVAKVDADAEKSLGKRFKIQGFPSIRFFDGKTENPEEYTGNRDLGSLTEVYHEKDPESVQRNQKQAPSEIVFLMAQ

SEQ ID NO: 199282 - protein, 132 aa, Triticum aestivum
  unsure (1)..(132): unsure at all Xaa locations
  Clone ID: PAT_TA_93700.pep
MGLXXCLXGWALXAPXAXIRERXSSGRXXPSRARTAAPAVVSPSPYXSXLVAARXPSRFVCKXCXXVVDEXXLXADEKNWDNMVIXCEXSXVLXXFWXAPWXGPCRMIAPVIDEMXXXYVXXIXCCKMKNRR

SEQ ID NO: 199283 - protein, 93 aa, Triticum aestivum
  unsure (1)..(93): unsure at all Xaa locations
  Clone ID: PAT_TA_93701.pep
RAEFGTSRTVLMTALNKAXGAPGSFLELFLXSFXXXENTXHLVKHLLIMAMGXKAFFRCNAVDPFCXWCXQWXGIXFSAGQKYXKGDXLXMMW

SEQ ID NO: 199284 - protein, 129 aa, Triticum aestivum
  unsure (1)..(129): unsure at all Xaa locations
  Clone ID: PAT_TA_93702.pep
MQIFVKTLTGKTITLEVESSDTIDNVKAKIQDKEGIPPDQQRLIFAGKQLEDXRTLADYNIQKESTLHLVLRLXRGXMQIFXXTLTGKTITLEVESXSXTIHNVXXKIQDKXGIPPGTXKRSXLWENNF

SEQ ID NO: 199285 - protein, 147 aa, Triticum aestivum
  unsure (1)..(147): unsure at all Xaa locations
  Clone ID: PAT_TA_93703.pep
MXPTVMGSSGTSVAPFQGLKSTAGLPVSRRSNGASLGSVSNGGRIRCMQVWPIEGIKKFETLSYLPPLNXEXLLKQVDYLIRSKWXVACLXFSKGGFIFREHNATPGYYEXXVLGKCGKLAMFGVEPTPQXVINEVGRRSKKGVTLA

SEQ ID NO: 199286 - protein, 58 aa, Triticum aestivum
  unsure (1)..(58): unsure at all Xaa locations
  Clone ID: PAT_TA_93704.pep
PXXRXKGXXSGXGXXNXXAWKXLANPLIARRXRGAPLVVLKKNTFFTNGAPRAEFGHE

SEQ ID NO: 199287 - protein, 56 aa, Triticum aestivum
  unsure (1)..(56): unsure at all Xaa locations
  Clone ID: PAT_TA_93705.pep
XXPQXXIHILVXIXHSLXILQKIVLPGHXXPKPSRTDXNILCHXLLXRTISHSGXL

SEQ ID NO: 199288 - protein, 137 aa, Triticum aestivum
  unsure (1)..(137): unsure at all Xaa locations
  Clone ID: PAT_TA_93706.pep
XRVFFFFFFLTKQNHYTPKVKKNFLLVAEGAIAXCVQGXNNXAXTFTTFTSSXVGIVWIXLHXYPLIHDPXEXFFSFLXKQPFFLKXRPAXKXSSRVXTVVNGAXXHPWMGFLGGHQMXQNSAXLLLXGRGGXSPXP

SEQ ID NO: 199289 - protein, 80 aa, Triticum aestivum
  unsure (1)..(80): unsure at all Xaa locations
  Clone ID: PAT_TA_93707.pep
HTRSLWSRTKAXPKLQLRKINDIFLVSATLWLTKNIIAPDLASAHGGFWTQAGTRTNVVYFKYGYTSMLASRKSSNEPTS

SEQ ID NO: 199290 - protein, 67 aa, Triticum aestivum
  unsure (1)..(67): unsure at all Xaa locations
  Clone ID: PAT_TA_93708.pep
XXPSXXLWXRXKPXXNXXIWSSXSXSPXPPARXWPXESEAASXHTRGRRRDGTGAADARANRERPGA

SEQ ID NO: 199291 - protein, 61 aa, Triticum aestivum
  unsure (1)..(61): unsure at all Xaa locations
  Clone ID: PAT_TA_93709.pep
ISLMAXGGSHLNQFCLELRRLAPFRDVGKKRKXKKHLGKKSRLRQWRKETFGNEEGPAMPT

SEQ ID NO: 199292 - protein, 111 aa, Triticum aestivum
  unsure (1)..(111): unsure at all Xaa locations
  Clone ID: PAT_TA_93710.pep
IILPSVLASAYCVDNSGRLTGFHYSTTGAGGAEWYPXEVEGLNMGXQSPPHSPSLAAQASSNQLMSXFQILGMIHQLLNEERQLLEGAAYNIREXCEXRLFXETMRVAFLX

SEQ ID NO: 199293 - protein, 51 aa, Triticum aestivum
  unsure (1)..(51): unsure at all Xaa locations
  Clone ID: PAT_TA_93711.pep
ISFSEXSLNLIETIHVHLYLRLQSLRLSAFLFKDEFLLHPSFPVTMPNYIL

SEQ ID NO: 199294 - protein, 125 aa, Triticum aestivum
  unsure (1)..(125): unsure at all Xaa locations
  Clone ID: PAT_TA_93712.pep
XLTSKXRXLKQVLEPQLSLVDIHNXFAPLVNHXDQAXPGVCLQDLAPVSSPRSMRGAGISQDLALASTGASGSDHYEVRPSPAGISPTRPRAGVVAKVLALAPASSPSGASLSLDGLTSCRIRHE

SEQ ID NO: 199295 - protein, 138 aa, Triticum aestivum
  unsure (1)..(138): unsure at all Xaa locations
  Clone ID: PAT_TA_93713.pep
SCRIRHEAKWEPTPSQPSRLLSSSQQFVPDSXPNPAPSPPESGXESSRELXLMLWTTCXISXMXFRGQXKVVXDRQWXLXTSKLGEITXSKAXRMNDFLYARMNTVPXVXXWDKQSXHHXDNXMGXPXSWXHXTGVFL

SEQ ID NO: 199296 - protein, 82 aa, Triticum aestivum
  unsure (1)..(82): unsure at all Xaa locations
  Clone ID: PAT_TA_93714.pep
FAXXLXLVXIXFSPCSFYLFXGPTXSXPVRSSATFPLAKSFCIPPHLNSFWIRVSFIWYPTHTHTASGTACXTVWCVWISMR

SEQ ID NO: 199297 - protein, 52 aa, Triticum aestivum
  unsure (1)..(52): unsure at all Xaa locations
  Clone ID: PAT_TA_93715.pep
XNPLLNKVDXPAPSAGXTASKKXXXTTSGXKPAAGNXGXGGFNLGGLFAKKX

SEQ ID NO: 199298 - protein, 119 aa, Triticum aestivum
  unsure (1)..(119): unsure at all Xaa locations
  Clone ID: PAT_TA_93716.pep
MSCCGGNCGCGTACKCGNGCGGCNMYPEAEAAGATLLVSATATHKASSGGMEMAAENGGCGCTQCKCGTXSCXCSCCKLLDRSSTICMHRARAIRSILLTTTNVNPPLGAFPPNGKNQG

SEQ ID NO: 199299 - protein, 132 aa, Triticum aestivum
  unsure (1)..(132): unsure at all Xaa locations
  Clone ID: PAT_TA_93717.pep
MAAAGDAGEKKMITLKSSDGEEFEVEEAVAMESQXTIRHMIEDDCADNGIPLPNVNSKILSKVIEXYCNKHVQAKPADGGXAAAXGASDAAAPAAPAXGLKNWDAXFVKVDXATLLSTSWGCTLKQGCGLTC

SEQ ID NO: 199300 - protein, 102 aa, Triticum aestivum
  unsure (1)..(102): unsure at all Xaa locations
  Clone ID: PAT_TA_93718.pep
MLDKLWDDVVXGPRPETXLDXLRRGAATQXLAINTXAGEAIXQSPSMPTTXTXPVTPSVVHTRRAGGXVWGGVFXPXEQTWXTKKLGGXLFRKAKIPHRKMG

SEQ ID NO: 199301 - protein, 160 aa, Triticum aestivum
  unsure (1)..(160): unsure at all Xaa locations
  Clone ID: PAT_TA_93719.pep
SQYAXERKEAIQKTIMSMTLGKDVSALFPDVLKNIATGDLDXXKLVYLYLMNYAKSHPDLCILAVNTFVQDSEDPNPLVRALAIRTMGCIRVXKMVDYMXEPLXKTLRDESPYVRKTAAICVGKLFDLNSTKCLXNXFPGGPPKLKGSRPRSTGALKPPK

SEQ ID NO: 199302 - protein, 54 aa, Triticum aestivum
  unsure (1)..(54): unsure at all Xaa locations
  Clone ID: PAT_TA_93720.pep
RRXGAXXPPXVNAXXPXXXRGXPEFISPTXSSFXAPRFXQGRREIWGGKFFGLF

SEQ ID NO: 199303 - protein, 76 aa, Triticum aestivum
  unsure (1)..(76): unsure at all Xaa locations
  Clone ID: PAT_TA_93721.pep
XSSSRNASALXXRSLSSXFXPRIKHVXRQMGQIITLRPGCVEEYLQSPHIAWPXVFKQMKDXNLGGYTIFQDGATH

SEQ ID NO: 199304 - protein, 59 aa, Triticum aestivum
  unsure (1)..(59): unsure at all Xaa locations
  Clone ID: PAT_TA_93722.pep
MKFFSAFDXWAVFFRREWGRTWXFLAGFAXTGXLXTKXXAXFTEXXLKNSXXXQAHXNK

SEQ ID NO: 199305 - protein, 78 aa, Triticum aestivum
  unsure (1)..(78): unsure at all Xaa locations
  Clone ID: PAT_TA_93723.pep
NEINHQXLELKXGGLFXXKGXDSFQADVEIXFELTSIXKADXFDPSWLLGVQXXCREXGAXINXGIGPXGXXVLXXGN

SEQ ID NO: 199306 - protein, 108 aa, Triticum aestivum
  unsure (1)..(108): unsure at all Xaa locations
  Clone ID: PAT_TA_93724.pep
MXPTVMXSSGXSVAPXXGXKSXAGLPVXRRSNGXXLGSVXNGXRIXCMQVWAIQXIKKXXTLSYLXXLXXGXLLKXXXYLXRSKWVXFPPVQQRVXXSFLEEKAXPXG

SEQ ID NO: 199307 - protein, 114 aa, Triticum aestivum
  unsure (1)..(114): unsure at all Xaa locations
  Clone ID: PAT_TA_93725.pep
MGFGHNDSPTGEALSTKGXEGFXKKFXTTXSHXIGXXIXXAHYQNAMNXLHMQLXXPNIQPSIFSLVKXXPTXXVXSXLXKSKIQYXXXTKIPXEXXKKTKLKKISFPGSGAPD

SEQ ID NO: 199308 - protein, 115 aa, Triticum aestivum
  unsure (1)..(115): unsure at all Xaa locations
  Clone ID: PAT_TA_93726.pep
FXPXCRXGPVVXPPPXFXKXGGGXSFFLXXRXGLFFXSLSFAPPXEVCPXPXFFEKSQXXDVXXXPSCXNXAGXXSRFXXXGKPNTSXMCNFSLMTVFTISXEXHNSIXPXPXSL

SEQ ID NO: 199309 - protein, 109 aa, Triticum aestivum
  unsure (1)..(109): unsure at all Xaa locations
  Clone ID: PAT_TA_93727.pep
MGGXXIVAGLVXSCVXSYACDYIVSXKKIFXXXXPXTVSXKEWFXAXEQRFXXWXXVXGPPVIXKPXXRXNXIXXXLKPLRQGLWGGGTSRGVAKTHVGVGWSPGIFFG

SEQ ID NO: 199310 - protein, 75 aa, Triticum aestivum
  unsure (1)..(75): unsure at all Xaa locations
  Clone ID: PAT_TA_93728.pep
GEIWXXGPPPXXFFXFFXXKSXSXSXDLKXAXYPILXXXMDQCIDMRKLGXIISIXQXTXXNFCNMTNDKQTPXR

SEQ ID NO: 199311 - protein, 164 aa, Triticum aestivum
  unsure (1)..(164): unsure at all Xaa locations
  Clone ID: PAT_TA_93729.pep
LVPNSARAKDPPEKMHRAXWMRVRNAFKPAAVRRQSTKAKRRRRRXQXGHLRXRGASAHQRXXRRRRRXREWFWXXHGRTXRRHPRDPXGHRHXXLXESVGDFINXAPYXLXGWXGTLLPLPFHKKRSPEPPNWGDFSAYXSSXRDCEKXSXYMXPXXSXFRVS

SEQ ID NO: 199312 - protein, 126 aa, Triticum aestivum
  unsure (1)..(126): unsure at all Xaa locations
  Clone ID: PAT_TA_93730.pep
TXPTPSCPDSNPHLPPPSTTAAXRPPVSVSLPRPCPPSAAARAPPXLPPAAPLHLLLPSPLPHRPSHASLCPTQFPSVPLLLPATTCLSSSAQPKRSWRPSEGLGRSSMGQDPARFYQSRTSSSQR

SEQ ID NO: 199313 - protein, 37 aa, Triticum aestivum
  Clone ID: PAT_TA_93731.pep
VSIHTFSLLVIIEILVCRQHPNFKQDSIAEKFYASNI

SEQ ID NO: 199314 - protein, 108 aa, Triticum aestivum
  unsure (1)..(108): unsure at all Xaa locations
  Clone ID: PAT_TA_93732.pep
EKTVFTAYSYSRPDLHQSXVIPTLVYTPDQQSQSVQAITFPEKCLAFADTLFPHPRVEDLVSSQQTCHGYPNGQSSLNTVTMNKWDWPELTIDEVQNAIPIKKTAPRH

SEQ ID NO: 199315 - protein, 82 aa, Triticum aestivum
  unsure (1)..(82): unsure at all Xaa locations
  Clone ID: PAT_TA_93733.pep
PANLINPKGVKHLSFGLPPNKKTFALKEEKNKIHPIPTKQALFLPQTLVSTIKNAHCLRHSILISRGNPLNEXSICLLRWRH

SEQ ID NO: 199316 - protein, 126 aa, Triticum aestivum
  unsure (1)..(126): unsure at all Xaa locations
  Clone ID: PAT_TA_93734.pep
LXGETISLRSSRKICPFVGGPQVRPGKNQSSNFEKIIXXGRRIFLTQGGKXAIGQLXKNXLDSXKLNKTIPGPGXKGLSSWEKIFXGGSRLEMGAEXSTNGYQSKXGFHKDFQRDXQSEEXLKKRT

SEQ ID NO: 199317 - protein, 129 aa, Triticum aestivum
  unsure (1)..(129): unsure at all Xaa locations
  Clone ID: PAT_TA_93735.pep
AHFESKADSGRLQDXPQXAGAIRKGGHIVIKGRPCKVVEVSTSKTGKXHGHAKVSLCCIDIFNGKKLXEDIVXSSHNCDVPHVDRQDYXLIXDITDDGYVSXLTENXNTKDXLXLPTDDXLLGQIKDWI

SEQ ID NO: 199318 - protein, 136 aa, Triticum aestivum
  unsure (1)..(136): unsure at all Xaa locations
  Clone ID: PAT_TA_93736.pep
FWXMSXWKKRXTTHAISKTRKLVCKPRSQLNWVNXASXKLPPFGXFXASXVILXXXGXSLVRVVPKLXGIEGRVRTGEXFEGXGXRXRVKXRPKKGKVSXXRWGPDGLXGWSGGNSNPLAFAPPPGWXDTWGQRXG

SEQ ID NO: 199319 - protein, 194 aa, Triticum aestivum
  unsure (1)..(194): unsure at all Xaa locations
  Clone ID: PAT_TA_93737.pep
GXLLVLGQRSPPPXSSCSPPTPPNXKVTTPXWAWAVPNXLGPAFNRKGNAVGSSCSCTRPGNNKQQTYHYMEGGRRMXGCXSRSLARRPPKXGHRSSPGQRPLPNEAASPPASPNVALQHRQTGKXPTPRCANXGRRPVYVXNXXNGGXTIEGASPNKLXREARKXVLTPXVSRXGEXFXGXAERLGEXKXTGX

SEQ ID NO: 199320 - protein, 142 aa, Triticum aestivum
  unsure (1)..(142): unsure at all Xaa locations
  Clone ID: PAT_TA_93738.pep
SCXIRHERTXXRGFFFFFFFFFGHPRXPXSSTXPXSXXPTASTRRRRXFPQPPPHQSNXPTPGCPXQPXXPXPPLPDXRSPIDACLPDTGQDLAXTXXHYQXGXPIYXXGSRLAGGXXKDGRNTWLGARRASGRDQXXGREL

SEQ ID NO: 199321 - protein, 68 aa, Triticum aestivum
  unsure (1)..(68): unsure at all Xaa locations
  Clone ID: PAT_TA_93739.pep
RXXSGIGGWGRXXXWLPFFKXLVGQIFMKSSRKXPNYLFQXYVVFFRALPSLVPLMPXEGCKDHVSQI

SEQ ID NO: 199322 - protein, 120 aa, Triticum aestivum
  unsure (1)..(120): unsure at all Xaa locations
  Clone ID: PAT_TA_93740.pep
XSXSXXXQCPSFXPXXPIWLGGIKSPGHPYILARLVXQERSNRCXXPKHGAMGSKFFQNLILNHFSARYNCVKALVTRLRIILFDRSTGVDTSTNPFADEVYXLILKAFDDEIKGIKCEY

SEQ ID NO: 199323 - protein, 98 aa, Triticum aestivum
  unsure (1)..(98): unsure at all Xaa locations
  Clone ID: PAT_TA_93741.pep
RPRRLLFXEDEMKSKAGKERWRKFMMATTIEWTDYSFGTIVRSNPKWEYGNXEPIFVPRMQFXYAIEIARNRHGLNDWIHEKYQKEQENLRLEAVAKE

SEQ ID NO: 199324 - protein, 59 aa, Triticum aestivum
  unsure (1)..(59): unsure at all Xaa locations
  Clone ID: PAT_TA_93742.pep
VMARCRQNHQRCLKTLVEGXDVDKTPKRWXQTYLMGQNTLILNKIRFHPKYSKYNHIXH

SEQ ID NO: 199325 - protein, 162 aa, Triticum aestivum
  unsure (1)..(162): unsure at all Xaa locations
  Clone ID: PAT_TA_93743.pep
RSEPYWGYLAKXPFXNKYSSDWGQLQNASYTDITQLIKKGFTVRFPVDTNGMSLSEELRKNINTCLXSSTSYFKEQISGGNIVSWTXAFFWIEXHXLKCMXQSFNLXTRXVLXXLQPIXTIICPKFLFVPSRLLXAPLAWGGXSXPTKYWETKDQKLMLVEK

SEQ ID NO: 199326 - protein, 197 aa, Triticum aestivum
  unsure (1)..(197): unsure at all Xaa locations
  Clone ID: PAT_TA_93744.pep
XXKXXSRGGGALDXWIPGCKLVXNXARVEFFFYQGSHTHKYMGSPPRRRSCSSMAXGGTPHGVGPELPADLVLAIFALLPSDADRVRFRAVCQEVGRRWRRSGARRPWLRRLPHRPLRXGRRPCRPSGSPKPGHSCRFARRRSLPGAWEVTSXSFPRANPRXSPNPLRGVXQRGINXWVKPRSTGPGAIPLPSQSPF

SEQ ID NO: 199327 - protein, 154 aa, Triticum aestivum
  unsure (1)..(154): unsure at all Xaa locations
  Clone ID: PAT_TA_93745.pep
SCRIRHEPRLAPPSNHFLLPRPSLPCPSHASSLGPSSPRRPTTNTAAEAPPPWTPGPKXVPLLLLTFPPFRFPLPWALSSRHSLCRSKLRPXQEHARRHGRRRNSATSPLRLSRRPCRRPRQVPLRSCSVSCPNPHEXEXPPXLPRGRQQEEQD

SEQ ID NO: 199328 - protein, 125 aa, Triticum aestivum
  unsure (1)..(125): unsure at all Xaa locations
  Clone ID: PAT_TA_93746.pep
MRTWKWEKEIQQGRLNEREKRPGWMKPSAVRWIIAFFKQFYNSVGKPDYQVLRSAFVLRHYPNRPDFDFHKYMVRALEXDFKEVVGISWYLWLFVIXFLLLNINGWXTYFWXLSFLPLIPLLIVG

SEQ ID NO: 199329 - protein, 149 aa, Triticum aestivum
  unsure (1)..(149): unsure at all Xaa locations
  Clone ID: PAT_TA_93747.pep
MKPSAAVLAAIVALLLVSAVRGDDACRSPESAAQDRARANPLKIAAFFSILVCGAMGCSLPVLGRRVPALRPEGDVFFLVKAFAAGVILATGFIHILPDAFDNLTSDCLPSDGPWKDFQFPFAGLGXAMVGAIGTLVVXTVATGYFTRA

SEQ ID NO: 199330 - protein, 71 aa, Triticum aestivum
  unsure (1)..(71): unsure at all Xaa locations
  Clone ID: PAT_TA_93748.pep
SILVTKHTKSHPAWXVMGINMGPIKDNIKRKATDEPNEIPNTKRXKDXIQSARKIKLPSNLPFQEKTCYNL

SEQ ID NO: 199331 - protein, 162 aa, Triticum aestivum
  unsure (1)..(162): unsure at all Xaa locations
  Clone ID: PAT_TA_93749.pep
TPPRWXXFALANSALLVSGASAEGAPKRLTFDEXXSKTYMEVKGTGTANQCPTIDGGVDSFPFKAGKYEMKKFCLEPTSFTVKXEGIXKNEPPAFHKTKLMNRLTYTLDXWKGPLEVXPDGNLKFDEKDGIDXRASPVXLPXGERVPFLFNXKQLVXTGKAR

SEQ ID NO: 199332 - protein, 60 aa, Triticum aestivum
  unsure (1)..(60): unsure at all Xaa locations
  Clone ID: PAT_TA_93750.pep
LAGXGGVSSXRRRLQYTRGGXXEXPALGXSSAMVXRXRGRGPERERLVXNSSTSLXPGGS

SEQ ID NO: 199333 - protein, 104 aa, Triticum aestivum
  unsure (1)..(104): unsure at all Xaa locations
  Clone ID: PAT_TA_93751.pep
KITGLFXSTTKMRPFQLLSXIAVFIGLXTXEAASYWXXXGTPIPNXKVRDAVNLAFYYAPGSFHDYPSVSKRKISRGWKKAXTTVSTNNFHWKLARXRSRLPIF

SEQ ID NO: 199334 - protein, 79 aa, Triticum aestivum
  Clone ID: PAT_TA_93752.pep
MPGQSLSKGTTAGRPATSTTAAATAACKSVRTAKNEEPAWDMEAFPQFCMTCEKQFLHSQTTLLYCSDRCRLRDQAGAI

SEQ ID NO: 199335 - protein, 67 aa, Triticum aestivum
  unsure (1)..(67): unsure at all Xaa locations
  Clone ID: PAT_TA_93753.pep
LTTLHQIPAQHSHXATPKQKEALHVPLIQIFXSIRASLPTNAPLQRHTERXQEMVKCYSATPNTSSA

SEQ ID NO: 199336 - protein, 114 aa, Triticum aestivum
  unsure (1)..(114): unsure at all Xaa locations
  Clone ID: PAT_TA_93754.pep
LDQEAXEDCLGXXAAXXHPXXSPLNTAFTQKXFXFNCTPTLTXTXTISXXXSIIECXXFPTAQKFIFSXILARYXXSFNFXXSXXKTXIGXVXIXXEXGXPXHNTSTPHRAXYR

SEQ ID NO: 199337 - protein, 85 aa, Triticum aestivum
  Clone ID: PAT_TA_93755.pep
SCRIRHEDKFKGRISGQAEQDEIKGRISGQVEQDEIKGRISAHVKYEIKGRIKERITASAQKHSVIILLLTVLNDKTPFFIKKKK

SEQ ID NO: 199338 - protein, 91 aa, Triticum aestivum
  unsure (1)..(91): unsure at all Xaa locations
  Clone ID: PAT_TA_93756.pep
MQDSEVVLEPPVEPQSRHVVYCGVCYLPPEYCEFXGTVKKCQEWLXKTHPXMFHQVVGRRFIIKRLPLSVHALKSREKLSIPGKKQAATWS

SEQ ID NO: 199339 - protein, 157 aa, Triticum aestivum
  unsure (1)..(157): unsure at all Xaa locations
  Clone ID: PAT_TA_93757.pep
MAPTVMASSXTSVAPFQGLKSTAGLPVSRRSNGASLGSVSNGGRIRCMQVWPIEGIKKFETLSYLPPLSTEALLKQVDYLIRSKWVPCLEFXKVGFIFREHKCVXPGNYDGRYWDNVXKLXMFRGAPTPTQVIQTRWXEGQRKEYPDXYVRIIXVTM

SEQ ID NO: 199340 - protein, 157 aa, Triticum aestivum
  unsure (1)..(157): unsure at all Xaa locations
  Clone ID: PAT_TA_93758.pep
PGCRLVPNSARSNLWLTSFENPRPPPAHLPPEFPTAAAAPPSRRHAPPPEXHTPPPPLRHALSFYIPXPLSRPAXSPPFPRTLSFAVGDYLVDTCGAHPPRQLKVSATLSHLKVPRQGPTRVLAFLAGRASDVAGASAKGNPKLWCRRNPPGPLGVR

SEQ ID NO: 199341 - protein, 88 aa, Triticum aestivum
  Clone ID: PAT_TA_93759.pep
LVPNSARARAGHLDTIPVNKILQWESDFISHLKTSEPEILATIDKEGALSKDLETKLKSIITTFTKRFQLKNLTACPTVFSFVQICLN

SEQ ID NO: 199342 - protein, 99 aa, Triticum aestivum
  unsure (1)..(99): unsure at all Xaa locations
  Clone ID: PAT_TA_93760.pep
RFTTPIFHLDSXXASPXQDQGXAXRAPARPKIAPSKPAVPQQXSRPASTLAHPPTAXPPSSAGPRNARSNCLNGGRCCDWLIHWKVPLVAFSADLKRVG

SEQ ID NO: 199343 - protein, 84 aa, Triticum aestivum
  unsure (1)..(84): unsure at all Xaa locations
  Clone ID: PAT_TA_93761.pep
RERTRVRASPPVPARRSSPRRRPRGSAAAPVGRRSGXAPXAPLDAAELRPRPXXGXLKXEKPFXXSXGQKXGRTQXXQMXGPPC

SEQ ID NO: 199344 - protein, 145 aa, Triticum aestivum
  unsure (1)..(145): unsure at all Xaa locations
  Clone ID: PAT_TA_93762.pep
XPGNXRGPPPXCFXKXLGCXPLXTXXWLESXLPTXXFLKPXREFXRGFKLCGAEAXLNAMSEVHLDRQGLTXXVHPSPRLDSQFITXIHRAPLPHRKLPQLIINPEVTPKPSLMLLTNKINSNSNSNNFQQTSNKPAQPRQKPAA

SEQ ID NO: 199345 - protein, 85 aa, Triticum aestivum
  unsure (1)..(85): unsure at all Xaa locations
  Clone ID: PAT_TA_93763.pep
HFPISIWQASNDFIKKYSTPSANLYKSVYRGSTFLAFSGSAHAXTISRHTAASSRQLQSPPSLGGCAHGLHDRRRVTRRLCDPAA

SEQ ID NO: 199346 - protein, 50 aa, Triticum aestivum
  Clone ID: PAT_TA_93764.pep
YLSVSHGSQTCDSSSICTVNLNSKMMIRIKFYMLRPVWLAWLEYGKFTCR

SEQ ID NO: 199347 - protein, 118 aa, Triticum aestivum
  unsure (1)..(118): unsure at all Xaa locations
  Clone ID: PAT_TA_93765.pep
MSQLDAFFGQVDFCSNHFIERLRKAVAIPSISADEERRPDVIRMGSWLAQELTALGAAVXLRPLGKXPHKEHLELPPXVVAARYGNDXXKRXIPKXYGHYDVQPCQATEXRVGPQEAF

SEQ ID NO: 199348 - protein, 153 aa, Triticum aestivum
  unsure (1)..(153): unsure at all Xaa locations
  Clone ID: PAT_TA_93766.pep
XSFAXGCSSHSAGLXVVRDXRXXRAXEAAXGRRACXXDRXXEGXLGXNLXAXXXLHGXRGRXXEXRPVAXGSRDHRRPGTXRAVKDXPAIXSXAXXPLPALPCPCARRNAAEWGRRARGRRRXKRGEDGRGEXEGPRAPRKTDGERXVPNSAR

SEQ ID NO: 199349 - protein, 71 aa, Triticum aestivum
  unsure (1)..(71): unsure at all Xaa locations
  Clone ID: PAT_TA_93767.pep
WSPXLXGGQHVXXPFWXHVXEXKPXPXRGXNRPGETTTXTVKKXRXTVXPLLLXLPXPIVVEVRWFLXTLW

SEQ ID NO: 199350 - protein, 95 aa, Triticum aestivum
  unsure (1)..(95): unsure at all Xaa locations
  Clone ID: PAT_TA_93768.pep
PKSLSKLXSLRFXRLXXXKLXGSXXRELGKLSXLKVIVLSXKDLCGTIXVDGPFSSFXLXSFSEXXXKLXXPXLXGVXSXDFSVGEHPTPQCTWE

SEQ ID NO: 199351 - protein, 65 aa, Triticum aestivum
  unsure (1)..(65): unsure at all Xaa locations
  Clone ID: PAT_TA_93769.pep
MGQXAXSANNVIIXEXNKXLNPGDDXXLXVGAXXXLLFFVGXYALYLYAQXTLPXXKKXASLQKE

SEQ ID NO: 199352 - protein, 106 aa, Triticum aestivum
  unsure (1)..(106): unsure at all Xaa locations
  Clone ID: PAT_TA_93770.pep
MAQXERVGWRELQKXSXHKISFHXTXXXRRXXXRQXKKGPXRRPXGXREANELXRXFXPVEXXLIERXIXGRGXXXDPRRRPERVSEXXPVARGXSDEXXXLGXYP

SEQ ID NO: 199353 - protein, 92 aa, Triticum aestivum
  unsure (1)..(92): unsure at all Xaa locations
  Clone ID: PAT_TA_93771.pep
LVXNSARAXXPEEEKKXFLXXIXEKLPGXHKKXEDAAPVXVXHAGPXTMNAPAPAAEEVSNPDAKEKKGLLGKXMDKLPGXXKTGEGXKAAP

SEQ ID NO: 199354 - protein, 63 aa, Triticum aestivum
  unsure (1)..(63): unsure at all Xaa locations
  Clone ID: PAT_TA_93772.pep
RXGPPXDLTMCXKXQVQPFXEPDSDAPXPSFTFKLXHXVPERVISSQAPIXSFWSKLIMAXLX

SEQ ID NO: 199355 - protein, 92 aa, Triticum aestivum
  unsure (1)..(92): unsure at all Xaa locations
  Clone ID: PAT_TA_93773.pep
GTKVFFCEDPPXXPSKGGGAFLEVFXSGPXSLCXPQCXXFGLERTYCRFVVLXQDQEAGEVPTNMLKWINSXQYGEEEXEWSLHHSRSXIAH

SEQ ID NO: 199356 - protein, 76 aa, Triticum aestivum
  unsure (1)..(76): unsure at all Xaa locations
  Clone ID: PAT_TA_93774.pep
FPXPAGGTRRQXLXXXGXFPRXXQLCIXAXLTXRXSVYATCSLLLTKGYRXXILSHTXXWHMXCXXGXRXXILSQI

SEQ ID NO: 199357 - protein, 145 aa, Triticum aestivum
  unsure (1)..(145): unsure at all Xaa locations
  Clone ID: PAT_TA_93775.pep
QEISKDXVLRCGIFLWSSXKTMPSFTSRMTALRRDGDELYETLVKLKRDLXNXRQRTTRXRQXANMSXVPRAMGQNIGGFQTLRGXYWXPYSLHHGNXMFNSIXYXQXXYXYMGXXRVXETXEXLNXPCXYGKHVSISTXNNGXX

SEQ ID NO: 199358 - protein, 135 aa, Triticum aestivum
  unsure (1)..(135): unsure at all Xaa locations
  Clone ID: PAT_TA_93776.pep
XXGKSXPLLDPXPNLLKXLPPXXERPQXYXFFXGQPPXHLVXRGFEXFLFPPPXXNVPHFVGNXIELGPALWKAXPLLNDGNSCWWGPRYTVGXTRIKCPPRFCRFMGRNXKGSCQIVEAELCPDKLIVWDXNNF

SEQ ID NO: 199359 - protein, 75 aa, Triticum aestivum
  unsure (1)..(75): unsure at all Xaa locations
  Clone ID: PAT_TA_93777.pep
IPGPFEISRSTIPLFIVKITLNPEILXDFSSQLYPFPETPCLLYMCVPTALTAAKHMQNRRRXVGYFXILXLIFA

SEQ ID NO: 199360 - protein, 61 aa, Triticum aestivum
  unsure (1)..(61): unsure at all Xaa locations
  Clone ID: PAT_TA_93778.pep
ELSGFPRAGRNXHXGGSGQAKMGINLLLKQVEWETKCXXCLVGXQDHXNSITXLSYVCPXX

SEQ ID NO: 199361 - protein, 101 aa, Triticum aestivum
  unsure (1)..(101): unsure at all Xaa locations
  Clone ID: PAT_TA_93779.pep
IIATMGLRXWASSXXQXPQDFXXRGXGRCARAXPSPNNSPXXLXGLXTLPPTRGXKXXGXCGXIGXXGHTQGAXPGXXVPXAARDPXKXXPKGGXSNRGRV

SEQ ID NO: 199362 - protein, 53 aa, Triticum aestivum
  unsure (1)..(53): unsure at all Xaa locations
  Clone ID: PAT_TA_93780.pep
SVAEXRERRFYSKSKIQNTGTNHAXFWXAKINRRPXKSLRLPKWXYSTPSAKA

SEQ ID NO: 199363 - protein, 130 aa, Triticum aestivum
  unsure (1)..(130): unsure at all Xaa locations
  Clone ID: PAT_TA_93781.pep
KSQRSWEXSNNNEMEAXXVSLLPPGGXXTRRAGXVTFXXVETKSXGXAGXESASTXARPXSRNQKKXLSXRLQPSSGGNFKQXRPXAGXQKPVDGRQXSFVGXXXKGXXALHQXXKXGSNLKRPXFVXGG

SEQ ID NO: 199364 - protein, 74 aa, Triticum aestivum
  unsure (1)..(74): unsure at all Xaa locations
  Clone ID: PAT_TA_93782.pep
RPCSXXAGGGTKXXGXXXXXPRDDEEESNXXDPRGTAPXRPHXDDXXXLXDDSSEPLRXGQLXVYXRSCXIRHX

SEQ ID NO: 199365 - protein, 171 aa, Triticum aestivum
  unsure (1)..(171): unsure at all Xaa locations
  Clone ID: PAT_TA_93783.pep
AIVAGLVAPAKPLGLSGARRRQHRGRWRVAAAAAAGVDLKALGSAIDKKDSQEARQALDELKELGWAKRWXSSQPYMSRRXTSLRELXNLGIKNAENLAIPXSVRNDAGFLFNGRPATTGFLGVLARQAPRGXWGFFRPYFDXEXISLLVLSQSGSNISKVLLQGCKIGFF

SEQ ID NO: 199366 - protein, 73 aa, Triticum aestivum
  unsure (1)..(73): unsure at all Xaa locations
  Clone ID: PAT_TA_93784.pep
MNTANIITXIGSLNIDLXTLTPRIPSGGETITASSFSSWPRRKRXXSSYRMRSTFSSQTNVXTPSYPYSRYYR

SEQ ID NO: 199367 - protein, 98 aa, Triticum aestivum
  unsure (1)..(98): unsure at all Xaa locations
  Clone ID: PAT_TA_93785.pep
FFDNWAEIFPRPPIVKGPKKPVPLEFAQTQGHGLGNKKPGRSFALLALLFDLLPQGYASYLFEVFDPSEPQSXMSGAXXQTIEDIVIPPSMRDSMYYI

SEQ ID NO: 199368 - protein, 74 aa, Triticum aestivum
  unsure (1)..(74): unsure at all Xaa locations
  Clone ID: PAT_TA_93786.pep
RAEFTRAPSPSPAVIPGGRKTPELXXXAXVXPMXTVGQPAGQSTXXKXLXFFXSXGAVQTFXLGGTVVRVPRSF

SEQ ID NO: 199369 - protein, 95 aa, Triticum aestivum
  unsure (1)..(95): unsure at all Xaa locations
  Clone ID: PAT_TA_93787.pep
PPXPXXRGCPIFLGXGXPGCGXLFXXLPPTXGGRGGFSSKGGFKXXXPXXGFPPXXDXFKXNAXXXRAXXDXXIGGNWXPAPPXSFFFFFFXHQS

SEQ ID NO: 199370 - protein, 51 aa, Triticum aestivum
  unsure (1)..(51): unsure at all Xaa locations
  Clone ID: PAT_TA_93788.pep
KGDLSGXTFPSTPXKTQXSIFFXVLASFXIXKPLXXLYSXFYXXPPGSXIP

SEQ ID NO: 199371 - protein, 118 aa, Triticum aestivum
  unsure (1)..(118): unsure at all Xaa locations
  Clone ID: PAT_TA_93789.pep
MAASMITSPIVAPTSVPSLSRRGSSFAVVCSGGKKIKXDKPLGLXGGLTXDIDANXXKVXKKGVYXFVDKYGXNVDGYXPIYTPXEWSESGDRYAGXKTGLLIWGVNLAGLLRGGVLL

SEQ ID NO: 199372 - protein, 137 aa, Triticum aestivum
  unsure (1)..(137): unsure at all Xaa locations
  Clone ID: PAT_TA_93790.pep
MDKSDMGKESADKQTSSLATDLQYIPYDHSLERKYLPSIKALIAKDLSEPYSIYVYRYFLSQWKDLCFMALSPTTQALIGVIISKLEVHVSHSPATFRGYIAMLAVSSEHRNHXIATSLVREXIDAMIXRGARRGLV

SEQ ID NO: 199373 - protein, 103 aa, Triticum aestivum
  unsure (1)..(103): unsure at all Xaa locations
  Clone ID: PAT_TA_93791.pep
HSHKNGSTIHINFTDWLPFIFSTLGMLIINSIEKTRLSADSFSYSGGDVAWKARVVLFLGFASLAGGMAXGGIXVLVLKYVLGNAVWASLYMGVANIFLLTPL

SEQ ID NO: 199374 - protein, 50 aa, Triticum aestivum
  Clone ID: PAT_TA_93792.pep
LETIDSRLRKVELLSNYLLTILTPAGTDEAFRMAIRNCAIDRLNKVSRLD

SEQ ID NO: 199375 - protein, 123 aa, Triticum aestivum
  unsure (1)..(123): unsure at all Xaa locations
  Clone ID: PAT_TA_93793.pep
SSSSPHLCRDKNESCAYEWXRTLLRPXPLSCASINPPAFXLSXTRPDNTXTKKCSAFGSRTQEXRXGIHRWXRSQRPXGGVMGLXPLGAXXVGASRGXPXWXPGRSXQXLXGAGXRVXPQRKD

SEQ ID NO: 199376 - protein, 54 aa, Triticum aestivum
  unsure (1)..(54): unsure at all Xaa locations
  Clone ID: PAT_TA_93794.pep
XFFFFFSQIVILPXTEXSVFYRXXSHRXXXVRGXYCNYLXQXGGYPXXHXGGXI

SEQ ID NO: 199377 - protein, 125 aa, Triticum aestivum
  unsure (1)..(125): unsure at all Xaa locations
  Clone ID: PAT_TA_93795.pep
CFGGGPLIFLSQYRLLVCRRADRNVFKIAEXDFVWNYISSRKEFDALKXGKSMNXPLLGLFAESDXPYELDRRNLNDVYPSLDEMTRTALKALEMATKNSDKGFFLMIEGSRIXHAGHLVPNSAR

SEQ ID NO: 199378 - protein, 147 aa, Triticum aestivum
  unsure (1)..(147): unsure at all Xaa locations
  Clone ID: PAT_TA_93796.pep
PTSTTYPFLHRSTISSASHSICLHQDLLLGLIAFIFPPIAVWVKRGICSADSLINICLCVLGGIPGLLHAWYIIAKYPENDHVGVADPEATPVTYVVIHDPHGQNRVXNPTTRQVNVGYATMSPAGIQSNLMANHQAKSNRWKWGSC

SEQ ID NO: 199379 - protein, 119 aa, Triticum aestivum
  unsure (1)..(119): unsure at all Xaa locations
  Clone ID: PAT_TA_93797.pep
KKLTCVEQNINRQKSTRKLRKKTNKTKRENRNLKWKNEXTKKPMQKNRNRESRKKQRNPMKSKEETKISKENRKRKAKNNKSXERKKWASSPRQASVSSVGITPLYSTPISRLVARCGA

SEQ ID NO: 199380 - protein, 147 aa, Triticum aestivum
  unsure (1)..(147): unsure at all Xaa locations
  Clone ID: PAT_TA_93798.pep
TTRNEVHNFTLCNDPSAXSPTXTLLRLLLPLNDQVWXTFRXXGECYHSPRASPKASLSHSIGSXSDGRCVQRAGTXSAQADDLRLLXIPRXRAIIAMLYPQARQSLTRLPRSFDQGGXSLXLSVXRACGPXTSKGXHRPVIASKPTG

SEQ ID NO: 199381 - protein, 54 aa, Triticum aestivum
  unsure (1)..(54): unsure at all Xaa locations
  Clone ID: PAT_TA_93799.pep
VLEEIXLQIGXLLEXLKLLHAQLIHVDARGAPHGFLXPDPGGXGRGGWGERRRR

SEQ ID NO: 199382 - protein, 145 aa, Triticum aestivum
  unsure (1)..(145): unsure at all Xaa locations
  Clone ID: PAT_TA_93800.pep
FVIINQKGIDPLSLDVLVKNGIFALRRAKRRNMERLQLVCGGTAQNSVDDLTLDILGWAGNVYEHTLGEEKYTFIEDXKDPKSVTILIKXPNSHTITQISDAXVRDGLRSVYXNMIVDKSVVPGGGAFXVACAAHLNSXNFPQDS

SEQ ID NO: 199383 - protein, 108 aa, Triticum aestivum
  unsure (1)..(108): unsure at all Xaa locations
  Clone ID: PAT_TA_93801.pep
MGRRPARXYREXKNXPYPKSRXCRGVPDPKIXIYXDVCMKKKGXVDEFSHCVXLVSMXEXENXSXEGSFXDAPLLLCXKYXXQSHXXKRDAFXPQRRGTRFPCGSVQD

SEQ ID NO: 199384 - protein, 130 aa, Triticum aestivum
  unsure (1)..(130): unsure at all Xaa locations
  Clone ID: PAT_TA_93802.pep
SCRIRHEKESVGLACANLHTLSRQKIFPALLEESELFGRDSGTLLTWPILYESIAFVHGVKGKTRVVINMECELVGVVLRHEDNIELCLELLHDDNKVSHEGNSLDSEEFVGYQCSQATFRRFTCFGIXP

SEQ ID NO: 199385 - protein, 71 aa, Triticum aestivum
  unsure (1)..(71): unsure at all Xaa locations
  Clone ID: PAT_TA_93803.pep
AGGGTLLRNKWDSPGAAXSWPNSXXSWGITAVQEESSXASISSAPXYLAWXQXVVFXXEXNDXRVXXQRSP

SEQ ID NO: 199386 - protein, 78 aa, Triticum aestivum; identical to SEQ ID NO: 106962
  Clone ID: PAT_TA_93804.pep

SEQ ID NO: 199387 - protein, 129 aa, Triticum aestivum
  unsure (1)..(129): unsure at all Xaa locations
  Clone ID: PAT_TA_93805.pep
IRGSSRELGXFRKLLARXXXPAAGXPPVXXVVSDVVMXFXMEGANXLXLTYVQLWXASGIXXLGXXQXRLLIXRGIVPLKNGEQLXNXXLXTXVGDVPGLXGIXXKEXPSFISNKPGEYIMLTSEKSQP

SEQ ID NO: 199388 - protein, 156 aa, Triticum aestivum
  unsure (1)..(156): unsure at all Xaa locations
  Clone ID: PAT_TA_93806.pep
XPRRLSIPLAPRXKKQALAAAPPPQRHTPPYLTAATKTSPKPAAIDDATLTPSSAAAAAGLQATRCPPLSRTTPPYLLPFLPASXYGGERAGMMEAVGSGDATSARXAISRHRGGGQSRPNDAAXSVPADXFTGWGKAQPHXFLKGXKRDVGXNXS

SEQ ID NO: 199389 - protein, 149 aa, Triticum aestivum
  unsure (1)..(149): unsure at all Xaa locations
  Clone ID: PAT_TA_93807.pep
FSAPGKKKAGTINPPGVCPLGGRGNPDLQCSVGAIECPLSPWDXWGDSRWDLDFKAAXRLGALFNLKWLSDGAFNPPRMGTSHLPQRGSPPPPMLHCYRGAWXLLLRRTNHQLNAENGXTGNAGLGLSQNGGPNGICPKGRQKVNLEFA

SEQ ID NO: 199390 - protein, 58 aa, Triticum aestivum
  unsure (1)..(58): unsure at all Xaa locations
  Clone ID: PAT_TA_93808.pep
HRXPSAPRAFGXXXSLSXLYPSFPXXSLSDGARAGIRARXCSPGESHLVXRSXPAHRG

SEQ ID NO: 199391 - protein, 102 aa, Triticum aestivum
  Clone ID: PAT_TA_93809.pep
TTIYLFRLVPLRKYQRNTFRHTCINTRKGNLQLQHEDTSYNKQSALSANCHTHKPFILTMQVLSQVHPYFFSQLSFRHSSAALLQLFYRWPSTPQFLHRAVF

SEQ ID NO: 199392 - protein, 87 aa, Triticum aestivum
  unsure (1)..(87): unsure at all Xaa locations
  Clone ID: PAT_TA_93810.pep
PKAAIRRRAAADQRDKVANARPSSTRAAGAGGSSSTMLRLYTDESPGLKVDPVVVLXLSLXFIFXSVVSLHVIAKVTRKFSKLGSKI

SEQ ID NO: 199393 - protein, 123 aa, Triticum aestivum
  unsure (1)..(123): unsure at all Xaa locations
  Clone ID: PAT_TA_93811.pep
ATMASYDKTIQXSRXTSXRAXAGGRRXARXTEXSXWFLXKIXPPRGSPEMXXPXPSSXLSXVXXGRAEEIDKLRAALGNWGALPGCXAGXWXLAFLPXXIEGKMRGLQNFXTXEXEKGSXQNN

SEQ ID NO: 199394 - protein, 62 aa, Triticum aestivum
  unsure (1)..(62): unsure at all Xaa locations
  Clone ID: PAT_TA_93812.pep
QVHPNQLRSILQWXLWXDPVHARNQEKESPTLKECFKYLTLXKXXLFLKWXQEVNXKXLXPV

SEQ ID NO: 199395 - protein, 140 aa, Triticum aestivum
  unsure (1)..(140): unsure at all Xaa locations
  Clone ID: PAT_TA_93813.pep
SDEIVWQVINQQFCSFKLKTTKEKNFCRHEYNVTGLCNRQSCPLXNSRYATIRSNPDTXXIYLXMKTIXERXHTPSKLWERIKLSQXYAKGPSSVTKGLILKVSYSTKWKQTPFNKGVMREDLLEGSGKKLSGVGGPKFF

SEQ ID NO: 199396 - protein, 87 aa, Triticum aestivum
  unsure (1)..(87): unsure at all Xaa locations
  Clone ID: PAT_TA_93814.pep
GKLRLXXLFLEXFXYAMPTVMILGYLGCWVXRKNXDVRRLVAYNPKDXAVRRPDXLERTRKRLEAANXELIRSEXXKXQIXVRALGR

SEQ ID NO: 199397 - protein, 88 aa, Triticum aestivum
  unsure (1)..(88): unsure at all Xaa locations
  Clone ID: PAT_TA_93815.pep
LVPNSAREKLSAPNPSIDAKKAKPPKPVERETAVAAAKKPKPKPKPKEXKEGKEVSAKKTKKQKESNEIDEIFEATKSDKKRKLAGRG

SEQ ID NO: 199398 - protein, 62 aa, Triticum aestivum
  unsure (1)..(62): unsure at all Xaa locations
  Clone ID: PAT_TA_93816.pep
DPLSFXLXNXXCXHLFXPXXPSXXFLLLVLVEGNPXLALXPWXPRRRXAXKSXRRKXPXLLP

SEQ ID NO: 199399 - protein, 77 aa, Triticum aestivum
  unsure (1)..(77): unsure at all Xaa locations
  Clone ID: PAT_TA_93817.pep
LXXLPXTKFXLXXXARKKIPXGVNXGESXQENQETSPPXLGGNRLMTXAGSVXXHXPXVTFPQTNGFTSQVXGYGGY

SEQ ID NO: 199400 - protein, 130 aa, Triticum aestivum
  unsure (1)..(130): unsure at all Xaa locations
  Clone ID: PAT_TA_93818.pep
SXRIRHEAQQXXTMGXXXSXVSXLAGGXLARRXAFSINFXNGGRVSARNPLXTRNLLRNGRINXMTFPXDWLRXXLNVIGFGLIXWVGAXXNPLVNXNXXDGGLLXQQXRGRSANSPHPRVSIEXXXGCL

SEQ ID NO: 199401 - protein, 165 aa, Triticum aestivum
  unsure (1)..(165): unsure at all Xaa locations
  Clone ID: PAT_TA_93819.pep
XXTSTRGEVARIHSXGXTPQFVXXLGEIAPXAXWXXTXLWRXXLXTCICNXTXPGXSPIYNTGLXQVPGYSXIXFPPLXSFRSLTVLGVIXLSCAHRARMKSLSAETVVAXSYLLXQMXRXXEEPELXXDXLLPAXHLRXGSPPTAHRXSPXFLPRSERPRIRSP

SEQ ID NO: 199402 - protein, 134 aa, Triticum aestivum
  unsure (1)..(134): unsure at all Xaa locations
  Clone ID: PAT_TA_93820.pep
MAPTVMASSATSVAPFQGLKSTAGLPISRRSSSAGLSSVSNGGRIRCMQVWPIEGIKKFETLSYLPPLSTEALLKXKVDYLIRSKWVXCLEFSXVGFRLPVSTISFPPXXYDGXDYWDKCGKLAFFRVRPTTKV

SEQ ID NO: 199403 - protein, 107 aa, Triticum aestivum
  unsure (1)..(107): unsure at all Xaa locations
  Clone ID: PAT_TA_93821.pep
SCRIRHEVRVGSMGAPRQVAIDDAASLTDPAVVGALQFPLIAKPLDVDGSVSSHAMSLIYRRAGLAALQPPLVLQXKFVNHGGVLFKXYVIGGATPTRAGLPGRCRR

SEQ ID NO: 199404 - protein, 85 aa, Triticum aestivum
  unsure (1)..(85): unsure at all Xaa locations
  Clone ID: PAT_TA_93822.pep
TRIIIHLXIISRSXSRIVGSRSGRNMSQPRGXQLNEIRXWXGLRIAKXPLXGGEIIWXNFSXGXEXSFQXXXSXXGGPRXFSSEK

SEQ ID NO: 199405 - protein, 68 aa, Triticum aestivum
  unsure (1)..(68): unsure at all Xaa locations
  Clone ID: PAT_TA_93823.pep
HPREPESEADTAAXMRAKWKEEKDEEAQXETPKDEAAIQCXRLXRXGXIIXHPXLXXXEGXRYGLXIP

SEQ ID NO: 199406 - protein, 101 aa, Triticum aestivum
  unsure (1)..(101): unsure at all Xaa locations
  Clone ID: PAT_TA_93824.pep
SSQETKFQMGLIQIHKTYLHHEITIQSLTQAVGPTPSPSEDXSSILKDKPGSDXNETNKLILGFYGEXNKQXXGFQGQIKIKPGPGXLNXXITKQXFSXPG

SEQ ID NO: 199407 - protein, 107 aa, Triticum aestivum
  unsure (1)..(107): unsure at all Xaa locations
  Clone ID: PAT_TA_93825.pep
FNSLTLLLDRQIPAILSYVEGEEYSGQQAKQQLIRNGSNTVAYFRDFLGQDFESIDRSNGRASXQPLKHEXTIAFXIKDKVGDEESLLSIHEIVTPTNPTGFQSAIL

SEQ ID NO: 199408 - protein, 161 aa, Triticum aestivum
  unsure (1)..(161): unsure at all Xaa locations
  Clone ID: PAT_TA_93826.pep
SLRPASPLSLPPNPTLRTPPYPAAISFAAGSSPGMTAAGFLVGFLLGLLALTEAEAATLLWFVLRLRRRRGSGGLGRLLSVSSLAPTCGSASRWXRGAALQGRIGAGPLFPNMVQQLAVGVEGVLANGRKLPGPVQGLSKCSILXWNFSXKTVGPXRRSPM

SEQ ID NO: 199409 - protein, 162 aa, Triticum aestivum
  unsure (1)..(162): unsure at all Xaa locations
  Clone ID: PAT_TA_93827.pep
APXSIWXYGPDRPKYLXPFSEQTPSYLTXEFPGDYGWDTAGLSADPETFAKNRELEVIHSRWAMLGALGCVFPEILSKNXIKFGEAVWFKGGAXIFSEGGLDYLGNPNLVHAXSILXIWAVQVVLMGFNXGANRVGXXGPXRRXLDIIYPRGGAFEPNFGLR

SEQ ID NO: 199410 - protein, 118 aa, Triticum aestivum
  unsure (1)..(118): unsure at all Xaa locations
  Clone ID: PAT_TA_93828.pep
GEFXNXKAKGPXXSSXXRLXPSGGXVGXEXXGGNTKREQNNYQMLNGDGRVXRXXRGHRAXRHQXGRDVARLRGLLRXXAGXXGXVXRXTVRDVARAVVKDSFEGSLXXGKSIWAXGV

SEQ ID NO: 199411 - protein, 116 aa, Triticum aestivum
  unsure (1)..(116): unsure at all Xaa locations
  Clone ID: PAT_TA_93829.pep
XPVNYPMRVIGRPRVKRLQQFRMGNCSKPQKXGYPGVKVQMNIKXPNKGSGCTLGVFSAQVANESLYQMGXXDRAKQVSGSQIYPVQSXKITFNGNQYXXSVGFXLLSEKNGEYXY

SEQ ID NO: 199412 - protein, 165 aa, Triticum aestivum
  unsure (1)..(165): unsure at all Xaa locations
  Clone ID: PAT_TA_93830.pep
GRVRGRIRNEQXQNXSEPKQTRAQVXWGGKXPRKQXGFQGWLRKAQPLTGGVKKPQKIQSPGTGWPPEKSRRYQXSNRTPGSGKLPIPNVLGSXKLRKXFKIRPTXLIRLQSGXLQGIGWGLTPSPSSXTTKLMRYPRLSGGSNSXKKIFKLARRLRGGXAQRXN

SEQ ID NO: 199413 - protein, 117 aa, Triticum aestivum
  unsure (1)..(117): unsure at all Xaa locations
  Clone ID: PAT_TA_93831.pep
XAIGXXSTQDLLXLSKQSSMXPIEPXRQLLKRXYCDFDGYCXKTSWDVWGXWVASTINXITXSPXGFXFXGQXKTSAXQTRXXPQCXGXEXVTKLLVPXXKIXXINXXXXGAXXGXX

SEQ ID NO: 199414 - protein, 93 aa, Triticum aestivum
  unsure (1)..(93): unsure at all Xaa locations
  Clone ID: PAT_TA_93832.pep
IKPVXSLFRXXYNSLEPXFEPFYXFXTXXPVACXNVSXXSXXXGNSAXQAGSCXAXNPXRKYRSXGHTXSXXENVRVXSEXXSFLSQXNCVCX

SEQ ID NO: 199415 - protein, 52 aa, Triticum aestivum
  unsure (1)..(52): unsure at all Xaa locations
  Clone ID: PAT_TA_93833.pep
XNREEPXXPEKXPXFLXPXWPFWAXXAXPTPARFRSLPWXVVPSTLAXPXXR

SEQ ID NO: 199416 - protein, 87 aa, Triticum aestivum
  unsure (1)..(87): unsure at all Xaa locations
  Clone ID: PAT_TA_93834.pep
VLPSHEATLXDMSSXTPRENXTTFXAHRGXVLCXRAAAGXXSPXEXIFTITVVAWXCLSGSARGVXFYTPXERXRGRGVLXVXSCRI

SEQ ID NO: 199417 - protein, 179 aa, Triticum aestivum
  unsure (1)..(179): unsure at all Xaa locations
  Clone ID: PAT_TA_93835.pep
REILQSSQLGPPNPISRLLLPRKHGAQGREXAAAEKKPVGTGKKPXAXKRVXGKDGGGXKKKKKGXKKVETYKXYIFKXXKASXXPDIXISSKGMSIMXSFINDIFEKAXGESGKLARYNKEXNINSREXXNGVXLVLPXEVAKXXRLPGGTKGSPKFNSSLNCRKLLLFRKVRKSSIG

SEQ ID NO: 199418 - protein, 163 aa, Triticum aestivum
  unsure (1)..(163): unsure at all Xaa locations
  Clone ID: PAT_TA_93836.pep
MGTNAXGVSPSSFAGKGVKXLXSSGLFGEXRXTMXXTAGKXXPVSSGNPWXXSDRVLXLGPLSGXPPXSYLXGEXFPXXXGWXNAGXSGXPXIXXKKREWGXXCRWGXLXALCCVFPELVPRKGXKFXKGVCXKAGPKFXRXGVQXXGXXTRQIQGLALGSRV

SEQ ID NO: 199419 - protein, 146 aa, Triticum aestivum
  unsure (1)..(146): unsure at all Xaa locations
  Clone ID: PAT_TA_93837.pep
CFHQHWDSRCPPPLHASSGIWXSRPWKEPSVCXGRVXARDESLHCTTXWXCCCCXFXVLYFGXLQTQXHISQGHSLGRXVVXXEQXQLQYWDKKYFNKGXTXKRXGPXXIGGQTKLPKLXGEYTXVXKPLXGRSWPDXXTXXXSRG

SEQ ID NO: 199420 - protein, 99 aa, Triticum aestivum
  unsure (1)..(99): unsure at all Xaa locations
  Clone ID: PAT_TA_93838.pep
RGAXRXGGGXPIXARRPAQSGXKQXSRAXXXLPPKXXLPPSIXSSEQLAXNQXSHLPIKXYYDWXLVSNFQRGWVPSALXGEQXMGPXLTXXPPXTGXI

SEQ ID NO: 199421 - protein, 88 aa, Triticum aestivum
  unsure (1)..(88): unsure at all Xaa locations
  Clone ID: PAT_TA_93839.pep
MGXKWVXXEVXPLFAXXGVGIXICAFSLLRNITGNPXVXVNXMGXATGVLXNHXEXXXYAEHGSRAYVQDKXTPEIMPRINKFFNKPK

SEQ ID NO: 199422 - protein, 73 aa, Triticum aestivum
  unsure (1)..(73): unsure at all Xaa locations
  Clone ID: PAT_TA_93840.pep
LRLAXLLAGGXALPXRTLPXXXRLPRPRRGRRPXLRGXRRILLXGXPRPLXLXPXIRRRAXLRDGRLQRERDA

SEQ ID NO: 199423 - protein, 99 aa, Triticum aestivum
  unsure (1)..(99): unsure at all Xaa locations
  Clone ID: PAT_TA_93841.pep
LVPNSGRARAEFRATLPPDPSGLXGCFXDVGXCCLTFFCPCXNFGRXAAIXDKGXTXCFVXSGSGYLLLNWMTGLGXXHSFRYRXXLREXYXLQXENLP

SEQ ID NO: 199424 - protein, 90 aa, Triticum aestivum
  unsure (1)..(90): unsure at all Xaa locations
  Clone ID: PAT_TA_93842.pep
RVYALTKTXELXRRYFPXCXQVXXKXLXXGLPDGLDAFXQQNGTXDEQQVXKXRXXDVXEDVXXTXNKNTADNXMFXXLSSKSXSSAMKR

SEQ ID NO: 199425 - protein, 100 aa, Triticum aestivum
  unsure (1)..(100): unsure at all Xaa locations
  Clone ID: PAT_TA_93843.pep
FAIVQKYLIESYDSVFMSAYLRFESKRMATKSRQKFQWCIIWGVIFLLPINQFLAAARGGGPGTQFALKVSPYYXAAHWAVRFNNGPXTGEKTLXGYPKL

SEQ ID NO: 199426 - protein, 80 aa, Triticum aestivum
  unsure (1)..(80): unsure at all Xaa locations
  Clone ID: PAT_TA_93844.pep
ETXAXRRGHXFQXHXTXEPPGDICPLLXAXGDSLXPXPGXLFXXPXXDLVSDXPAGAGAIXGSLGATIXFSVAXSSXGIR

SEQ ID NO: 199427 - protein, 47 aa, Triticum aestivum
  unsure (1)..(47): unsure at all Xaa locations
  Clone ID: PAT_TA_93845.pep
XSAXTIFSLCXGXNXAHLVXFVXPPPSIISXXNFFXHYFLPAVXCLG

SEQ ID NO: 199428 - protein, 88 aa, Triticum aestivum
  unsure (1)..(88): unsure at all Xaa locations
  Clone ID: PAT_TA_93846.pep
MGSISHDXXGCIYXMXLAXXAVLPMTLXNAIQLGMIEILXXAXGKMLSPSEXGAQLPSTGNTEAXAIXDRMXRXLASHNIVXXQVEER

SEQ ID NO: 199429 - protein, 143 aa, Triticum aestivum
  unsure (1)..(143): unsure at all Xaa locations
  Clone ID: PAT_TA_93847.pep
VRLAXCCSPLSWXLSCNAPQSPSCKRGGSKKLLRIXLKQXSLKAXXXXGPEAKXESXVXEWXPXVAFXPXRNXPXVXRGASKKGXANFLXXWXRPLXKXRXRGXXQTGKXFXETKPGXGGGVKQIXXGGXKXXXPEXWGSFPW

SEQ ID NO: 199430 - protein, 113 aa, Triticum aestivum
  unsure (1)..(113): unsure at all Xaa locations
  Clone ID: PAT_TA_93848.pep
SGKLSTAREIAXGXKKIVSQHQHQDNHERPVXGTNATIRTPXMFLPTHPMMIAKLFXHETETISIHRSSSDDSDTKXEIQFRMRSSRKXACSPGVRGTSQTTTTMXSSIXHDK

SEQ ID NO: 199431 - protein, 146 aa, Triticum aestivum
  unsure (1)..(146): unsure at all Xaa locations
  Clone ID: PAT_TA_93849.pep
MAPTVMGSSATSVAPFQGXKSTAGLPVSRRSNGASLXSVSNXGRIMXMQVWPIEGIKKFXTLSYLXPLXTEXLLXQVDYLIRSKWVPCLXFXKGGFIFREHNASPGYYDGRYWXNVETAYVXGATTXTQVIXKVGEVNKXYPDAXX

SEQ ID NO: 199432 - protein, 80 aa, Triticum aestivum
  unsure (1)..(80): unsure at all Xaa locations
  Clone ID: PAT_TA_93850.pep
LVPNSARETXRPPARIPFXFRFXIRSRPDPSPXPGRXAXSRAXPWARRXGAAXTAPSRGCXPGXPAXXKINXXVKLRLRR

SEQ ID NO: 199433 - protein, 77 aa, Triticum aestivum
  Clone ID: PAT_TA_93851.pep
PSPNERAHAIEINCFNSHSLEVYAIRGLRCKISVVCHPLTDYESAFYCTNAFLVWDLDKKYLAWTFEFIRTFYLTIW

SEQ ID NO: 199434 - protein, 106 aa, Triticum aestivum
  unsure (1)..(106): unsure at all Xaa locations
  Clone ID: PAT_TA_93852.pep
AEAVXSGAKMXKSRSVFXGSRYLXSLPLVPRSTXCEAFATITSSQKITKVQIRDEGGNWETCXHEKTTTYDSDEEGRXYAPKASGPSCDCLKFQVESKEVSISGIC

SEQ ID NO: 199435 - protein, 100 aa, Triticum aestivum
  unsure (1)..(100): unsure at all Xaa locations
  Clone ID: PAT_TA_93853.pep
SCRSCRIRHEQTSSLSNIHTSLLSSIQTSFISTAQFIISIMPVSLSRALFDLGLDEHLAAFSXAGYSSWEKLTTITEQELARSTFAPVTXESYKGALRDH

SEQ ID NO: 199436 - protein, 167 aa, Triticum aestivum
  unsure (1)..(167): unsure at all Xaa locations
  Clone ID: PAT_TA_93854.pep
RAEFGXKSTRIPXVSQLDAPXRIPPIPLLFLAEGKTQLPDXANXPDFGTLAXAAGMXKEPPFSLPPXGLXPSXXGXRXHPNPGXGXSPPTXFAAPRPSNSSGRQTXGPSCPSIXPLNXTPSXPSSTGXNRXXQAPPSXDEXXXPSRELGDQXXXQIWGGXKXSILTR

SEQ ID NO: 199437 - protein, 164 aa, Triticum aestivum
  unsure (1)..(164): unsure at all Xaa locations
  Clone ID: PAT_TA_93855.pep
LVPNSARGNISPSAGMKDEDRIELINRQRSTIYTDGPSFASDGGFEEAAGRSQCNTQPGNGLRGHSPRAYEQIKTHAMSENGQSQGEPKLVNTQVSGQQKSRANSVSSPSXPLGSYSIFDSNNQQSNRTSTSSPVESPXREERQSSSSGVAPIGTRPSGTNYEC

SEQ ID NO: 199438 - protein, 123 aa, Triticum aestivum
  unsure (1)..(123): unsure at all Xaa locations
  Clone ID: PAT_TA_93856.pep
MGSPGWGFKNLLTKYTIVQAWAPTWMGSSGNSVAPFQGLKXSXXGLPVXRRSNGARLGSVSNGXRXKCMQVWXIEXIKKFETLSXIANAQQGRASSKQVDYLIRSKVGWLAXXSSTRVGFIFR

SEQ ID NO: 199439 - protein, 145 aa, Triticum aestivum
  unsure (1)..(145): unsure at all Xaa locations
  Clone ID: PAT_TA_93857.pep
MGVVVTNLLLLLAKGLPYSALAVFSPDFSFFLACGAGADVTFPSDNPTRTFVRXDXYLSQGRPAAVSANASSXXGSNPLXAAARADXSXFSXRLAXPAKGGXSSFLVLXLHFFPFRPRLLLQQTSAQRLGPRTKTWLAAFLRGRG

SEQ ID NO: 199440 - protein, 124 aa, Triticum aestivum
  unsure (1)..(124): unsure at all Xaa locations
  Clone ID: PAT_TA_93858.pep
NNGPGLVXSSKXXLAMFALXINMXVGXDVSAQXXPQDFVNLHXRARXVXGVGPXXWDNNMXXXVXDWGAXXPGDCXLQHSGGXFXEKIFXGXXXXWTAADAVXLXWVXDKQHYHLVSNNXYXGK

SEQ ID NO: 199441 - protein, 119 aa, Triticum aestivum
  unsure (1)..(119): unsure at all Xaa locations
  Clone ID: PAT_TA_93859.pep
LVFQAHLGSTPRKVGSRFEALLPYGIIIXMFGITGAGMSKIRHMQNGGKRARHSIDQWDRQMMDRDRRLTGWLRGQTDSPTAPKGYELEQSMEIRKAYYLRSLTLFSSNKEARIRRRKI

SEQ ID NO: 199442 - protein, 121 aa, Triticum aestivum
  unsure (1)..(121): unsure at all Xaa locations
  Clone ID: PAT_TA_93860.pep
XVDKFGHFNPFSLGRKTLPLTLXGPEARAGPNSAPPRVXSXGGENLXXXRXPPPQGRXXXDPPRKNIRGRGEAXPFXFPLXXGGEIVYFFXFXFLGFSXSRXXLFVSIFVCSFLINQKLNF

SEQ ID NO: 199443 - protein, 145 aa, Triticum aestivum
  unsure (1)..(145): unsure at all Xaa locations
  Clone ID: PAT_TA_93861.pep
QFRFGLGKIGGFYQNQGAQRAPHSXKDIXXYXWIDFXLSFASXSRSFGELQEXXPKAXRKPPXELRXPDKIRGRAVTLGKMXQSGRPXAGVXEGGHGRXCCPWXCCSWRPRKVPPRVTGPLGFVTSLISCYQQLPSRXPLPKLKG

SEQ ID NO: 199444 - protein, 122 aa, Triticum aestivum
  unsure (1)..(122): unsure at all Xaa locations
  Clone ID: PAT_TA_93862.pep
MGKIKIGINGFGRXGRXVAXVALQSDDVELVAVNDPFITTEYMTYMFKXDTVXGHWXKHNDXKLKXDKXTLLXXEKXXTXVFXVRXPEEIPLGEAGAXYLVGQRVVLTDKQRLAQFRGGKKK

SEQ ID NO: 199445 - protein, 71 aa, Triticum aestivum
  unsure (1)..(71): unsure at all Xaa locations
  Clone ID: PAT_TA_93863.pep
TNKRLIFXGKXLXDXRTLXXYXXQKESTLHLVVXHXGXMXXFLXTLXGKTNXLVGXVLXPPINNVXXKXHR

SEQ ID NO: 199446 - protein, 72 aa, Triticum aestivum
  unsure (1)..(72): unsure at all Xaa locations
  Clone ID: PAT_TA_93864.pep
LRWVSVXXRRAXXPPRGSARRGHPXFAPPGXPWXXRPXXCPXCCLWGWXCPXGEAEXLVXGGGAFALVPNSA

SEQ ID NO: 199447 - protein, 70 aa, Triticum aestivum
  unsure (1)..(70): unsure at all Xaa locations
  Clone ID: PAT_TA_93865.pep
TPFXPGKAXPVXMGSLLAXFTXSXAPPPPAXAAIGAGTMFIXGXRLXLPSISPLLXLWMNLEDFLACVGS

SEQ ID NO: 199448 - protein, 156 aa, Triticum aestivum
  unsure (1)..(156): unsure at all Xaa locations
  Clone ID: PAT_TA_93866.pep
KPLEXSEMHVDAKRAKTLVSALLNVTRRINTKAVGRNVQLVAVSKLKPASDILALYDSGHRHFGENYAQELIEKSTXLPKDIKWXFIGGLQSNKCKSLAXSIPNLSSVSSXDSAKKGNLLNLGPRLXSWTXIQWNIHIQVNNSTWRPQKSRVSLPG

SEQ ID NO: 199449 - protein, 134 aa, Triticum aestivum
  unsure (1)..(134): unsure at all Xaa locations
  Clone ID: PAT_TA_93867.pep
PCEYIHLTSIKKIQHEIHSVSYETKLGWHSPSMHFCAPFLPSSLARWPLCFSIPGGLLIFASLGGHKRSQICNDDPAQAGSYMHRGCPLYTLCLHMTGQGPRSGAPNVGWYKQTTLRSLTHLSLNGPIXTSIWS

SEQ ID NO: 199450 - protein, 160 aa, Triticum aestivum
  unsure (1)..(160): unsure at all Xaa locations
  Clone ID: PAT_TA_93868.pep
LVPNSARGLLDEDEAFESDVSDDEASPHTAPESTRPRFSHFIKALSADFERNRGKDNSDRPIEWQKSNTAAQAVEFXXLEFKRAGDENMNITINLFRDETPERFLLRPALAEILDTDVATRAEALMGVWDYIKVMXLQDDDEKRSFECDKRLKSPSPNVI

SEQ ID NO: 199451 - protein, 34 aa, Triticum aestivum
  Clone ID: PAT_TA_93869.pep
FHTHSSLSRCYMRNNFRDLNGLNNFNADLLYDFA

SEQ ID NO: 199452 - protein, 136 aa, Triticum aestivum
  unsure (1)..(136): unsure at all Xaa locations
  Clone ID: PAT_TA_93870.pep
ENGEXKASDPSCGDPPSDVVPPLPPELVXHNRACTPTXANXXSAKXXTSASSASGTRFSPSKXXSPTPKQLTFRHGGAKWTAXGGTGXQCNKXXRXTSXSSSQKSKNXLXXXELLARGTXQLXGXGXXLXPWLNSG

SEQ ID NO: 199453 - protein, 148 aa, Triticum aestivum
  unsure (1)..(148): unsure at all Xaa locations
  Clone ID: PAT_TA_93871.pep
LVPNSARAASTSAAQXSXPSLPRTKHQQWRPRXPTPRXRFPRSNNPPTVPRPPPPGGSXSRATPRSDTRXCSKSDALYQYILETKRVPXPXTSCMKGAPAEINRXPTNGXWMTXSGGTKGQFLKHCWXKLXRGAXKEPMGXLGGLKTG

SEQ ID NO: 199454 - protein, 109 aa, Triticum aestivum
  unsure (1)..(109): unsure at all Xaa locations
  Clone ID: PAT_TA_93872.pep
MAPTVMASSATSVAPFQGLKSTAGLPVSRRSNGASLGSVSNGGRIRCMQVWPIEGIKKFETLSYLPPLXTEALLKQVXDYLIRSXWVPCLEXSXXSGFIFREAQCVLPG

SEQ ID NO: 199455 - protein, 65 aa, Triticum aestivum
  Clone ID: PAT_TA_93873.pep
LKGRLQDIRREQIWQREREAEFRDQSETTNARVVRWTLIQLLVLGVTCTWQLSHLRNFFIKQKLT

SEQ ID NO: 199456 - protein, 101 aa, Triticum aestivum
  unsure (1)..(101): unsure at all Xaa locations
  Clone ID: PAT_TA_93874.pep
PRPRGYFXSXPDVXPASSPRRQLRLXWETRYLSRFLPRGLGRKLYLYCPPNQSRDTHVPQPRIPRRRRGRLREFRGIASCSCGVVDVSRWSLNGTSSSDEG

SEQ ID NO: 199457 - protein, 62 aa, Triticum aestivum
  Clone ID: PAT_TA_93875.pep
VSVLAHEFPARLVRTFVSESICIFIAKAAIKQLALKLTANSMYGCLGYRKSRFYAKFLGLCT

SEQ ID NO: 199458 - protein, 164 aa, Triticum aestivum
  unsure (1)..(164): unsure at all Xaa locations
  Clone ID: PAT_TA_93876.pep
LXPNXARATNQVPKPNXXRXRNHCCHXPXLXXSKQTEGKEKVICXRNGLRWELPPGKXHXVCLPYPGARGKQPXMLNVGKXXPTPGXRRQLRXQRSXNXRGLVXSPRGLXFXGRGSXGPFGFRQTNPPTGPXRXVXXEQXXVXPKXKXPAXPXXVPNNXXNLXL

SEQ ID NO: 199459 - protein, 92 aa, Triticum aestivum
  unsure (1)..(92): unsure at all Xaa locations
  Clone ID: PAT_TA_93877.pep
MMAWWRKXVVFPARRALAAVSXRVRSRKTGSGXSILKLHXDVQTCGYKDVQVMFEMLTSELEDPRRASNNKAPGPPSAWALPGSSISGPGGK

SEQ ID NO: 199460 - protein, 120 aa, Triticum aestivum
  unsure (1)..(120): unsure at all Xaa locations
  Clone ID: PAT_TA_93878.pep
RLNMRLTITSSSMRACVADRVDRLCQASLLKLSQIETSPSHNNPHATPTPVDMAAAERHLQEXAWXFPPNXLIGPTMYPFXTSPISSLQHDIEQTPTNVAXRYSXGXIWXQFRKGXXPXK

SEQ ID NO: 199461 - protein, 68 aa, Triticum aestivum
  Clone ID: PAT_TA_93879.pep
RRFSDCIEAFASFITSHLRLYIYDAIYTREEIKSKFSKPGSWLMGGFCSNGAQNLREGRRLLVPNSAR

SEQ ID NO: 199462 - protein, 135 aa, Triticum aestivum
  unsure (1)..(135): unsure at all Xaa locations
  Clone ID: PAT_TA_93880.pep
FPXPXFXXNRAXGGRXQRLQERQQRFXVPEEGKSXPPMAADTSLGRGRESXRDGGSAVAKDPERDDDDVGGXPQDAGTGEEENGGERCDGDEGXCARRGHQDGHDHGDRXCPEEGAVHLGEDVXGHERGEDGVQG

SEQ ID NO: 199463 - protein, 154 aa, Triticum aestivum
  unsure (1)..(154): unsure at all Xaa locations
  Clone ID: PAT_TA_93881.pep
LVPNSARGTGAGMGTLLISKIREEFPDRMMATFSVVPSPKVSXDTVVEPYNATLSVHXLVENSXETFCIDNEALYDICMRTLKLSNPSYGDLNHLVSAVMSGVTTCLRFPXGKLNSDLRXLAVNKXPFPRPQFFKXVDFAPLTNRGAHSFRXVT

SEQ ID NO: 199464 - protein, 109 aa, Triticum aestivum
  unsure (1)..(109): unsure at all Xaa locations
  Clone ID: PAT_TA_93882.pep
MAEVDQFDSALDLLRRLDPKHTASHLNALIDLVPALTEDLLSAVDQXPLSIARCQTTGRDYLLCDYNRDGDSYRSPWSGAFESPRGGKWGLVVSTKLSNNDWRRRGRRS

SEQ ID NO: 199465 - protein, 115 aa, Triticum aestivum
  unsure (1)..(115): unsure at all Xaa locations
  Clone ID: PAT_TA_93883.pep
LVPNSARAPTTTTSRSVSADHSAQDRISSAQSALHLLWSGLLLIVLTCTRTLSFLLAAVKPKGMADKVVATYYYPPMEVAAAELGHTAGSKARRRWPQQAHRHECGRXARTSSRG

SEQ ID NO: 199466 - protein, 152 aa, Triticum aestivum
  unsure (1)..(152): unsure at all Xaa locations
  Clone ID: PAT_TA_93884.pep
RAEFGTRFLAGKGDGNIRYFEYENDKFEFLSEYKSPEPQXGIAFVPRRGINVHENEIMRAYKTVNDTYIEPISFTVPRRAEVFQXDIYPPAIGLKPXALSASEWLGGNDGIPAKIDLESIYEGNAPVEISTQYVPPTVVSVPATRAISVGRK

SEQ ID NO: 199467 - protein, 99 aa, Triticum aestivum
  unsure (1)..(99): unsure at all Xaa locations
  Clone ID: PAT_TA_93885.pep
MRSRKPYRIXLVGVVCDAYLXVVRGIXRAVXTGRAVRVKSQXLQSHKRFATAFRGYCGVXDNARXLXHQLHGCPKVLWWXDGEEATCWWTPEGDGAGSG

SEQ ID NO: 199468 - protein, 139 aa, Triticum aestivum
  unsure (1)..(139): unsure at all Xaa locations
  Clone ID: PAT_TA_93886.pep
TGPLAXPXPXKRLIXQGTXPPKRVAXQHPRXKGRDRARRGATIGHQCGRAPQXPLPPRIVSHRNTIAARHGRRRRLAVVVLLHTRGCSTCHGGARNPCDRGSRSRPPLALEQXRSSPFAAMAAVVCGEDAPVAWLASPL

SEQ ID NO: 199469 - protein, 82 aa, Triticum aestivum
  unsure (1)..(82): unsure at all Xaa locations
  Clone ID: PAT_TA_93887.pep
MSNDAEHDTTFESADAGASLTYPMQCSALRKNGFVVIKGRPCKIAEMSTSKTGXKHGHAKXHLVAIDIFTGKXLEELCPSTQ

SEQ ID NO: 199470 - protein, 42 aa, Triticum aestivum
  Clone ID: PAT_TA_93888.pep
VPISPSLKVLFHKSQTTTLSPYKSLLFGLDGTYRDFFKSLSQ

SEQ ID NO: 199471 - protein, 94 aa, Triticum aestivum
  Clone ID: PAT_TA_93889.pep
MKLSFRDLKQNKFIIEAEPSDLISTLKAKIAEEKGWDASTQKLIYSGKILQDANTVESYNIEERGFIVCMTAKPKAIPPIPASTAKAPSTSNTQ

SEQ ID NO: 199472 - protein, 119 aa, Triticum aestivum
  unsure (1)..(119): unsure at all Xaa locations
  Clone ID: PAT_TA_93890.pep
QQWQRKTTRPPQFKLMLILLVLLVFVGGILARGPSTCVNNPAVQARLPTDPWWWVRTHGPFIREPNKMFLRRPIGMCMFVLIGVCICDLVYKXNKSXCVPKLIXKIXPXGGGPXNQXXP

SEQ ID NO: 199473 - protein, 88 aa, Triticum aestivum
  unsure (1)..(88): unsure at all Xaa locations
  Clone ID: PAT_TA_93891.pep
RTGRECWCGPGDSICNVPLGADFHYDLGICCRLSGRRGPSKATTIWFGEIPSPVRIPLNTLSQHSAETPPXLDSKVRNRXSNFSRNYI

SEQ ID NO: 199474 - protein, 148 aa, Triticum aestivum
  unsure (1)..(148): unsure at all Xaa locations
  Clone ID: PAT_TA_93892.pep
SNTFRPGPGAARXRAGVSVHVAGATFLTEXLGRRRQRHGVAXPRPLRAPDAAPPPPSASPXKVSRSASLRPPAXRGPSVFGXRALRVPXPGVDLSKVAPLQPPLVRQXNVKQPPXVSRAXKEQSXNEYXNRXVNXAIXGETGXRPVPA

SEQ ID NO: 199475 - protein, 140 aa, Triticum aestivum
  unsure (1)..(140): unsure at all Xaa locations
  Clone ID: PAT_TA_93893.pep
KPFLXLXLLHPPXSCFIHLSXVQXXALXLVXPXXXFXCRXDEALSPXSFXLXRPLTXGIFGSYLVFRVCLDLVPLAQPAPKQCFTLRCPVNCCASTHFGENQLALGFEWHFTPNHNSSADSSTSVGSDLCLVSSCRIRAR

SEQ ID NO: 199476 - protein, 112 aa, Triticum aestivum
  unsure (1)..(112): unsure at all Xaa locations
  Clone ID: PAT_TA_93894.pep
FTMSNSAIAAITGSGSSKTRMDTSSIESNSKTRQITEDREFVYGATSADASGTGGDKRTRLPFVGEEESSTRHGGIARSRGESEAIPXEVIGQVDKSQGVVRSISXPKRTCG

SEQ ID NO: 199477 - protein, 182 aa, Triticum aestivum
  unsure (1)..(182): unsure at all Xaa locations
  Clone ID: PAT_TA_93895.pep
LFERGXWNXFXRDPIGSAGRAAPXXSLGIGSWERKAHSIIXLGPTXLXFQPXXRRXRPAGPRASLGPAILLLRATQRGPSGPLMLAISGTFVFGSVRLPXTFAXGFPPWGGDRRLFVASWAPRPPCPLTFSLGLPTSFENRSCXACPKASRGXSSKNGPXTNXXTXPVSFLGRESSIQDXAA

SEQ ID NO: 199478 - protein, 69 aa, Triticum aestivum
  Clone ID: PAT_TA_93896.pep
EPSQNSEIKYISQQECVAVVESGNRRSWNGVYWLSNDTQYVTQLEKKNGEISPFIVQIEEPNFHCSINY

SEQ ID NO: 199479 - protein, 87 aa, Triticum aestivum
  unsure (1)..(87): unsure at all Xaa locations
  Clone ID: PAT_TA_93897.pep
RKVGVTGKYGTXYGASLRKQVKKMEITQHAKYVCTFCGKTSVRRHSVGIWDCRSCHKTVAGGAYTVSTPAAAAMRSTLRRLREIAEV

SEQ ID NO: 199480 - protein, 91 aa, Triticum aestivum
  Clone ID: PAT_TA_93898.pep
FQRASSAGIVHNCDEIDLDSNDEENKSTDIVQNSDEIDLNIQSDDDKPVDSTMNHIIAAHVDQGKDSLKGKEKQTVSVVPPNIRSQLPSRI

SEQ ID NO: 199481 - protein, 132 aa, Triticum aestivum
  unsure (1)..(132): unsure at all Xaa locations
  Clone ID: PAT_TA_93899.pep
GTARTTVGKYICRLSPCFIEGSTRGTTLLNLPLGFTFSYPATQNYINHGILQXRWTXGFXIDHVEGHDVVPMIESXLEKXHVPIKLTALINDTTGTLIASSXYTDXKMKIXCIFGTXCNAAYMEDCGSIPKA

SEQ ID NO: 199482 - protein, 59 aa, Triticum aestivum
  Clone ID: PAT_TA_93900.pep
LLNVLLFCLYIFNTKADEVESSPACSPLPPRPGLLSLPLICCPHSPDPAAAPICRRQYR

SEQ ID NO: 199483 - protein, 60 aa, Triticum aestivum
  unsure (1)..(60): unsure at all Xaa locations
  Clone ID: PAT_TA_93901.pep
MXFHXIKVPNPILXMDXDDMTXXFWQSINDKLIFPFLDLHINYFXLGVLHPDATDXKVTL

SEQ ID NO: 199484 - protein, 59 aa, Triticum aestivum
  Clone ID: PAT_TA_93902.pep
KLPMFGCTDATQVINEVEEVKKEYPDAYVRIIGFDNMRQVQCVSFIAFKPPGCEESGKA

SEQ ID NO: 199485 - protein, 154 aa, Triticum aestivum
  unsure (1)..(154): unsure at all Xaa locations
  Clone ID: PAT_TA_93903.pep
GHQSKAYLRERKSPLAQRQQMPQDLSHPRPRFQGRLSATTTLLVVLPPAPRQFTRRKLRLYSKPKESGLQTPQARLEIGSTVLKTLXSVILSMKTTDNKEYLDADKRVSEGRPRPLPAHWNHTKCRQASLPRPIXHQVNNNXTLSTXQXGGGGG

SEQ ID NO: 199486 - protein, 116 aa, Triticum aestivum
  unsure (1)..(116): unsure at all Xaa locations
  Clone ID: PAT_TA_93904.pep
GFRQARVGQRRXXXRXTRRRRRPRRAVAEEGGPXCXRGXRPTPRTCSXTARXSTXLTDHVEDXXXDSSRVQIRHXXLLAXIQQXXDXRNANXDLKGXKXLLXLXXNXTLYPXXXTI

SEQ ID NO: 199487 - protein, 101 aa, Triticum aestivum
  Clone ID: PAT_TA_93905.pep
EISCTRQGNVSTNRVDKLLSIFVLIFAVVCSLWANTRSDQTCRRYGMLFGVLILCAQHERHLLKARAEHPFSLSTINLGMEYSLKAELSQNRFSVLEKKNL

SEQ ID NO: 199488 - protein, 135 aa, Triticum aestivum
  unsure (1)..(135): unsure at all Xaa locations
  Clone ID: PAT_TA_93906.pep
SCRIRHEKVLPSLTXAFDVGNLTGDDPLVELATELLAVLTENGSEPLPSGYVAASLPKLXRLLMATSEGGVLRAGAEAVKFMLMHDHQQVFAWRDEEXRSGLEVCLVLIDKLPQPFSPKDNAAXKKXGGLNPILI

SEQ ID NO: 199489 - protein, 138 aa, Triticum aestivum
  unsure (1)..(138): unsure at all Xaa locations
  Clone ID: PAT_TA_93907.pep
APTPKEATMYYDPCFLHYSDADLRASDDTAXASAFSTAYSANATAEPARFDRVVAALLNATADYAAYNSSRMRLYASGVVPFDREIPEVYSWAQCTPDLTPARCRDCLANMIQELGTPLYSVGARALGIRCXXRYQKH

SEQ ID NO: 199490 - protein, 74 aa, Triticum aestivum
  Clone ID: PAT_TA_93908.pep
PLSIGFIIRLPSTVYLHVSCFQYVTIVAKDNTIIHHLLWRPFNPGKDLWPSKFQWDLREPSSHASQLSSSYISI

SEQ ID NO: 199491 - protein, 39 aa, Triticum aestivum
  unsure (1)..(39): unsure at all Xaa locations
  Clone ID: PAT_TA_93909.pep
FYPFLPLFXFIXYNLXHFLSIXNKYXIFXTYNSLSXLPN

SEQ ID NO: 199492 - protein, 159 aa, Triticum aestivum
  unsure (1)..(159): unsure at all Xaa locations
  Clone ID: PAT_TA_93910.pep
RAEFGTSSSGSPSIRTSPKSAAVDRRRRHGPYQARPPASPTGGKAPRKQLATKAARKSAPTTGGVKKPHRYRPGTVALREIRKYQXKSTELLIRKLPFQXRLVREIAQDFKTDLRFQSHAVLALQEAAEXAYLVGLFEDTLSHPRETASPPKDQLARIP

SEQ ID NO: 199493 - protein, 178 aa, Triticum aestivum
  unsure (1)..(178): unsure at all Xaa locations
  Clone ID: PAT_TA_93911.pep
VILYTAXGXIFFLXGVLGMGLXYGSNEPGITIWKRLINQSYPATLXEILLXFWASLLAYACPNCRIIPLHYVGYQDTPWGKGTLVHGMPFAGEILIKIGDALWGEFGKHWECPQAKQRQVSPQASKGFPIETPKLAPNLAWGWYPPKRPKGFFPFQPKGPFQTLFLPNFGFKGGGGGG

SEQ ID NO: 199494 - protein, 142 aa, Triticum aestivum
  unsure (1)..(142): unsure at all Xaa locations
  Clone ID: PAT_TA_93912.pep
LTLQASPPLPICSLDKANVLASSRLWRKVVSEVMANEFPQIKLTHQLVDSAAMLIVKTPTALNGVILTSNLFGDIISDEASVIPXSIGLLPSASLSGLPDGTGRCNGIYEPIHGSAPDISCQGIVNPIGTILSAAIIXGGGG

SEQ ID NO: 199495 - protein, 85 aa, Triticum aestivum
  Clone ID: PAT_TA_93913.pep
VERITGLFLVLPMIVRIKKMTERAKRILDAAYPIFAHHRRHFNIDARGSLSVIIGSYLFFHCILICCIFSSVDCRYLGILIDFWF

SEQ ID NO: 199496 - protein, 126 aa, Triticum aestivum
  unsure (1)..(126): unsure at all Xaa locations
  Clone ID: PAT_TA_93914.pep
GPDPAGDDXPSPAMDLPLALAXLLLILLVXLAAPPAVLLIALQXXSPPPPSGGXPXLTPAXSXGXPRAARXXXAXGPEXGXXGGXKDXRGXRARTGXYHXXXNSPETRAPPPPGGGPXQGGDARGG

SEQ ID NO: 199497 - protein, 142 aa, Triticum aestivum
  unsure (1)..(142): unsure at all Xaa locations
  Clone ID: PAT_TA_93915.pep
HYIXPYFQHIXTTNXTLTNLIXXSIFXFXFNSFXSXPSPIPXNXPXIHPFSKTLTSTFFXHYXLXKSFTLFLPNFPSIXSQLFPYLYLLSXIKKTLSXXLXXIFPXXTPXTXLHHLSSSKIFPXIFNPXXPPPVLGLXRXXF

SEQ ID NO: 199498 - protein, 60 aa, Triticum aestivum
  unsure (1)..(60): unsure at all Xaa locations
  Clone ID: PAT_TA_93916.pep
PLHHPPLISIXTXXXSXPNHPITSNPLSQLPIHLXLPXQSLPXQLSIQFPQHPISPLLSL

SEQ ID NO: 199499 - protein, 79 aa, Triticum aestivum
  unsure (1)..(79): unsure at all Xaa locations
  Clone ID: PAT_TA_93917.pep
LRTSIXGXXLGPPGPPPGSFFXFSXXXTDFLXRIXEXLPVFKXPIFVFGRSPWRSPHCVXIXQLKLNHSSSSPALLNIS

SEQ ID NO: 199500 - protein, 69 aa, Triticum aestivum
  unsure (1)..(69): unsure at all Xaa locations
  Clone ID: PAT_TA_93918.pep
SLLVAPXPLFLGGGRRSPPIVHPTLRFLALTXRXWEGGFXTNKQRTLIFFDFGGGPCGEEEGEXLLXLR

SEQ ID NO: 199501 - protein, 129 aa, Triticum aestivum
  unsure (1)..(129): unsure at all Xaa locations
  Clone ID: PAT_TA_93919.pep
XPFXPFPVWFDHRNGSSHPQXQDYPPCLXALGKRTGLVILLXPAQDFFTIPXKERXXAXXNXIXLSFLLPVAPSQPGVGFPGKSXGGXPFCXIWIXXXVXXIALFYLGXPPNLLFWRPLPTLPXFARTL

SEQ ID NO: 199502 - protein, 60 aa, Triticum aestivum
  unsure (1)..(60): unsure at all Xaa locations
  Clone ID: PAT_TA_93920.pep
QLHXXILCNKHLLVSRTPXIPKIXRXFALQTXXGHLHRAKVTKKKTGDYFSPRAEFGHEL

SEQ ID NO: 199503 - protein, 96 aa, Triticum aestivum
  unsure (1)..(96): unsure at all Xaa locations
  Clone ID: PAT_TA_93921.pep
ARSGPIXGTKNXIPNXFQNKKFXKGWQRTXANNVGWRXVALNXPGEGFXKWXAKGGXIGXTKFQLXRXNKQRLKYLXXGXANKLXGCXLGFKXNPG

SEQ ID NO: 199504 - protein, 135 aa, Triticum aestivum
  unsure (1)..(135): unsure at all Xaa locations
  Clone ID: PAT_TA_93922.pep
MAPTVMXSSATSVAPFQGLKSTAXLPVSRRSNGASLGSVSNGGRIRCMQVWPIEGIKKFETLSYLPPLXTEXLLKQVDYLIRSKWVXCLXFNKXGFNFREXNASPGXYXXRYWXMWKXLPMFGXNXATQVDPGWE

SEQ ID NO: 199505 - protein, 144 aa, Triticum aestivum
  unsure (1)..(144): unsure at all Xaa locations
  Clone ID: PAT_TA_93923.pep
CSDGRVIVDFLNXKXGLPFLAXSKXNSADXKKXXNMGINGAXAMXAPFFRSLGLSDKIWXNGXIXFXLQWXQNIXSSVCGKQLQELTGXTRSSSSXEFGGKDYNAXLFXNYNTGQGXTYAPXXVGDQPAVGKLVGAGGPGWPGG

SEQ ID NO: 199506 - protein, 100 aa, Triticum aestivum
  unsure (1)..(100): unsure at all Xaa locations
  Clone ID: PAT_TA_93924.pep
HYRAXWXPXPPXSFFFFFXPLIIXTXKHRRGXFXTXAIKXVLPHXTTXXLXFLPLAIIVDAYVQCXXASVINDKNECNVVGXMQGLQSFSXXVELEDTII

SEQ ID NO: 199507 - protein, 134 aa, Triticum aestivum
  unsure (1)..(134): unsure at all Xaa locations
  Clone ID: PAT_TA_93925.pep
KDTCFVAXXLAVVGFGLGIMAPARVGRFQMSNLSXPSKEDXSIEKTGAWXNTWXXLLRHASVYGVAAXYCLXNNSCSPISNKMGKQXSFPXLEQMTXFTSTSQMLLEXLPGGAAKSLIXPXXGVEXXXQXWEGP

SEQ ID NO: 199508 - protein, 96 aa, Triticum aestivum
  unsure (1)..(96): unsure at all Xaa locations
  Clone ID: PAT_TA_93926.pep
FRNLADPLISLETLGKHPVSELLEFGQKTGRTVXISKDGWVKDTKVDVFVDGVLVASATYAQKKEIASNRAAKXALDKLKEMSGXXDVQSSPXXSS

SEQ ID NO: 199509 - protein, 106 aa, Triticum aestivum
  unsure (1)..(106): unsure at all Xaa locations
  Clone ID: PAT_TA_93927.pep
IVMRRXEXFXPYXGASIYVYKFVQXXXNXQXMXIQLAIEAFGXPXNSTLLXVXHTVLTHYWSXQLRGLGNXHGASSFSTPXXTTXGXFSGXXSKGPXPSXSGQGKA

SEQ ID NO: 199510 - protein, 96 aa, Triticum aestivum
  unsure (1)..(96): unsure at all Xaa locations
  Clone ID: PAT_TA_93928.pep
ALSTLTSLPFFKAVMLQSATNSRIKLTGTQASQQVLLGLXSGFLDHVXKNNLKLXLVLGXTNPRAMGMFRGCHSFKXGPNPTWGITXPISDENGEV

SEQ ID NO: 199511 - protein, 173 aa, Triticum aestivum
  unsure (1)..(173): unsure at all Xaa locations
  Clone ID: PAT_TA_93929.pep
IXGXIPXNLNSLRPHPXFXPIFXPPXRXXDRXFXGRXXPQKPPRXSPXQTTLFFIXLXGFQGCLLPSXXPXFLASRXIWGGPXQXRGAGGGQKPXSXRPXXPFRTFGILPLPXTXGAXLPGXXXKXLPFXXRDXNLTLAFILXRRXRPXTXFFFRPXGPXERKKGKGXQRXVP

SEQ ID NO: 199512 - protein, 91 aa, Triticum aestivum
  unsure (1)..(91): unsure at all Xaa locations
  Clone ID: PAT_TA_93930.pep
XPPFLTSFDISDVPVKCGLNCWLIAIISLLIISNSEVQSLQVLGSFLPISAVLISLKRAFFCNEIFWMSPQTDHPAVANVVSNFGKNVTND

SEQ ID NO: 199513 - protein, 67 aa, Triticum aestivum
  unsure (1)..(67): unsure at all Xaa locations
  Clone ID: PAT_TA_93931.pep
FCSXIXXXLLLLXPPTRPLWFPXGKLLCLRDFASYWLGPAAXSKVGLAPWRGSQPARRVQLVPNSAR

SEQ ID NO: 199514 - protein, 138 aa, Triticum aestivum
  unsure (1)..(138): unsure at all Xaa locations
  Clone ID: PAT_TA_93932.pep
MXXATMALSSPAMXGTPVKASRAAPFGEGRITMRKTAGKPKVAASXKPWYXSDRVLYLGPLSGXPPSYLTGEFPGDYGVGHRGGSPPTPKTFXKNRELEVXHCRWAMLGALXCVFXXSLXARXXVXFXEAVXVKXGAP

SEQ ID NO: 199515 - protein, 123 aa, Triticum aestivum
  unsure (1)..(123): unsure at all Xaa locations
  Clone ID: PAT_TA_93933.pep
SCRIRHEATSTXSARSRSSPLTPKPKYVRVSVIIHAYVRACVXVCVGXIXIRXQMXRTYVNKHTXRPACIXAGLCXRVNVCKXXYXXFGXQNLXPTKKKKKKTXGGXRDPIXPXMXXIKRAQM

SEQ ID NO: 199516 - protein, 106 aa, Triticum aestivum
  unsure (1)..(106): unsure at all Xaa locations
  Clone ID: PAT_TA_93934.pep
QGKXXAMXEXXASMGCIXTLXSCSMFKXXXXEGXRGXXNGGGSFRVPGXQIXGWKRGPGRAPPETPXHXLRGEXRGXXPSXLPSNSAXXSKXQARSXNKSSPFQXW

SEQ ID NO: 199517 - protein, 82 aa, Triticum aestivum
  unsure (1)..(82): unsure at all Xaa locations
  Clone ID: PAT_TA_93935.pep
LVPNSXXASVVAXAIAVPPPPPRRIPKRPRPRXLRXXSPSPRSSPXXESXXXVVSVXDPXXPRXXGVVXAXSXFXFWXLSFG

SEQ ID NO: 199518 - protein, 70 aa, Triticum aestivum
  unsure (1)..(70): unsure at all Xaa locations
  Clone ID: PAT_TA_93936.pep
PREXXPPXWXPLVEXQVXRIGTQLHTLTTPXSSLASLSHXGWLVLYVLPLVILLHFSNLLSFTXRQRATY

SEQ ID NO: 199519 - protein, 76 aa, Triticum aestivum
  unsure (1)..(76): unsure at all Xaa locations
  Clone ID: PAT_TA_93937.pep
NSFEIRLRXLSELFEXASPRRPRAGFQQRSXIDSIISKASSLXTVQLLEELGTEDEGXITAEVEETENEIXQIESN

SEQ ID NO: 199520 - protein, 78 aa, Triticum aestivum
  unsure (1)..(78): unsure at all Xaa locations
  Clone ID: PAT_TA_93938.pep
MAPTVMGSSAXSVAPFQGLKSXAXLPVSRRSNXAXLXSVSNXXRIRXMXVWAIEGIXKFXXLSYLPTXXKXXLLKARL

SEQ ID NO: 199521 - protein, 118 aa, Triticum aestivum
  unsure (1)..(118): unsure at all Xaa locations
  Clone ID: PAT_TA_93939.pep
AGGXALLRNXWDSPGAGXGNXGTREKXNQRGXXXPRXKRXLSKKXPXARDXKXXKXXSSKWWGXGFWXTQKEGCGXNKMGFNLFXLKQFXXKGXSXAKPTRXXPGAXGKPLFGQKLXS

SEQ ID NO: 199522 - protein, 99 aa, Triticum aestivum
  unsure (1)..(99): unsure at all Xaa locations
  Clone ID: PAT_TA_93940.pep
XXXTXPGLLXVGFXFXXXPXLENLXGLXNQNFCKKLKLLAQXLPANWCRXLKRLSTXRFAFPPFQXVPPXXGINXPFAETILTFANFSKFPVVFXPPXF

SEQ ID NO: 199523 - protein, 50 aa, Triticum aestivum
  unsure (1)..(50): unsure at all Xaa locations
  Clone ID: PAT_TA_93941.pep
FXGXPFVXFLSPGAAGGGLPGXVRGLHGRKMRXGGGSLAAXACPAREEEG

SEQ ID NO: 199524 - protein, 87 aa, Triticum aestivum
  unsure (1)..(87): unsure at all Xaa locations
  Clone ID: PAT_TA_93942.pep
LEFSKXGFIFREHNASPGYYDGRYWTMWKLPMFGCTDATQVINEVEEVKKEYPDAYVRIIGFDNMRQVQCVXFIAFKPPGCEESGKA

SEQ ID NO: 199525 - protein, 133 aa, Triticum aestivum
  unsure (1)..(133): unsure at all Xaa locations
  Clone ID: PAT_TA_93943.pep
MTEISNHQRGNIVSINALGIGRLHGKNAIVTGAAGGIGLETCILFAKEGANILMADISRAXLKKXYSKITKLVPSAIRVETKICDVSKEANVKAIVDHXDSWGRXLGIKFXINAGIMHADDKRRHLIQNNLGI

SEQ ID NO: 199526 - protein, 51 aa, Triticum aestivum
  unsure (1)..(51): unsure at all Xaa locations
  Clone ID: PAT_TA_93944.pep
MSTAELAVSXAALXLSXDGLXITAXKLXTLXKXAGXVDVXPIWAKLFXKAL

SEQ ID NO: 199527 - protein, 66 aa, Triticum aestivum
  unsure (1)..(66): unsure at all Xaa locations
  Clone ID: PAT_TA_93945.pep
FSXPNAQXGRXXRXLWXPGGQLLXPXXATXDXVNQLPPNQRVRGXNFAGXPIXKXXXAKRVVLKLK

SEQ ID NO: 199528 - protein, 78 aa, Triticum aestivum
  unsure (1)..(78): unsure at all Xaa locations
  Clone ID: PAT_TA_93946.pep
TNXRRVPIAXAVRVQLDLELFCPCTSSDPAXXPIGSWRLPXGXGGKPLSSTRPNPRPSQEGEGSRAAAARTSCRIRHE

SEQ ID NO: 199529 - protein, 55 aa, Triticum aestivum
  Clone ID: PAT_TA_93947.pep
IRSVHNKSRFYTTRRLYSACVEERKVTFTGTGSYRQRTPNGVQPHGVYPNTVARI

SEQ ID NO: 199530 - protein, 105 aa, Triticum aestivum
  unsure (1)..(105): unsure at all Xaa locations
  Clone ID: PAT_TA_93948.pep
FSALLLGSASLRKLQPRSNIYISYPLFLERPKHLVXRWSKSGDVEPDVLXQPXVXHAXLPTXLCIDSGXXXRRVXLXVXLXERALLRXXAVLXXPANLXSLGXXP

SEQ ID NO: 199531 - protein, 168 aa, Triticum aestivum
  unsure (1)..(168): unsure at all Xaa locations
  Clone ID: PAT_TA_93949.pep
MAPAVMASSATTVAPFQGLKSTAGLPVGRRSSGSLSSVSNGGRIRCMXVWPIEGIKKFETLSYLPPLSTXXLLKQVDYLIRSKWVPCLEFXKXXFVFREHNXSPGYYDGRYWXMWXKLPMFGCTDATXVXNQVXEXKXEXPDXYVRXXGFXKXXQVECVXFXXLXXNG

SEQ ID NO: 199532 - protein, 47 aa, Triticum aestivum
  unsure (1)..(47): unsure at all Xaa locations
  Clone ID: PAT_TA_93950.pep
YLCVLPAYQAICNXSXSXXXEXXTLXNLFIXPAYNXLDMQRVTAPXI

SEQ ID NO: 199533 - protein, 140 aa, Triticum aestivum
  unsure (1)..(140): unsure at all Xaa locations
  Clone ID: PAT_TA_93951.pep
QRVPKEFRRLWPGSSKRIEIPFRSHTKNPALNPDVEKLEPQVKEPKPVAXEXSGAVSQNEALQRRLQLLEEEAEEAXDKNLRETNEKLRQTDVKAGHFERKVQALENDRDQWEQKFEEMSKKYAAAQKELDDFQQEIGNM

SEQ ID NO: 199534 - protein, 81 aa, Triticum aestivum
  unsure (1)..(81): unsure at all Xaa locations
  Clone ID: PAT_TA_93952.pep
MSCCGGNCXCXTACKCXNGCGXCNMYPEAEAAGAXLLVSAXXTHXXSSGXMEMAXXNGGCGCTXCKCXTNCXXSCCKLLDH

SEQ ID NO: 199535 - protein, 62 aa, Triticum aestivum
  unsure (1)..(62): unsure at all Xaa locations
  Clone ID: PAT_TA_93953.pep
ELYTSATNHKYIKRXGRLHLXSXXNIKWXGIENYRXEGXXFXXQQTMXVWCXXKRXPKGLRV

SEQ ID NO: 199536 - protein, 96 aa, Triticum aestivum
  unsure (1)..(96): unsure at all Xaa locations
  Clone ID: PAT_TA_93954.pep
DQSRLVEHHGIPLPIVPXGRISCAXXGTLPLYRLELTPSQLQTVNPPEPPLLDSSAEVLWKHACMCILDGLXLPVAWSSVLLVXLHVSAREVSGPC

SEQ ID NO: 199537 - protein, 68 aa, Triticum aestivum
  unsure (1)..(68): unsure at all Xaa locations
  Clone ID: PAT_TA_93955.pep
MSAMTAXVPFWRAAGMTYIGXXSKVCAXLVXXCLKXPFXTEVSSREKXHFSLSXWXDXKQXEGHWAHR

SEQ ID NO: 199538 - protein, 90 aa, Triticum aestivum
  unsure (1)..(90): unsure at all Xaa locations
  Clone ID: PAT_TA_93956.pep
FVWIXLSPVDPLRQLYIHVLFDRPNXGLRXHPSLRSHTLXXPXXRTTVXNISXGXGSVDESLHVYQXIPCTSRVSSXKHAQLRRYKSSCS

SEQ ID NO: 199539 - protein, 114 aa, Triticum aestivum
  unsure (1)..(114): unsure at all Xaa locations
  Clone ID: PAT_TA_93957.pep
FLLGIFEWRPPFIEXTXYFCRRCAGAPIAVPIIXEXDXXKXXPXQLPKXALYGEKXXXXFSPRXRNYPNXSRPNRPAGSGYWKXTGADKPVGTPKPXAIKKALXXYAGKAPKGE

SEQ ID NO: 199540 - protein, 66 aa, Triticum aestivum
  unsure (1)..(66): unsure at all Xaa locations
  Clone ID: PAT_TA_93958.pep
AAXPAPGRSSRXSTXXSPCSAAXSPPPPRXRXRAPPPRTXXSQPGXRPRPRACSQQWTXPCSLXCF

SEQ ID NO: 199541 - protein, 72 aa, Triticum aestivum
  unsure (1)..(72): unsure at all Xaa locations
  Clone ID: PAT_TA_93959.pep
YTXDLTPKLGRXNKKPGCXEIKIXSINGLXXNFFQYXRYXXXQKSPKNXXXTYXIXXPRXSXGGKXPXXRVF

SEQ ID NO: 199542 - protein, 143 aa, Triticum aestivum
  unsure (1)..(143): unsure at all Xaa locations
  Clone ID: PAT_TA_93960.pep
MAPTVMXSSATSVAPFQGLKSTAGLPVSRRSNGASLGSVSNGGRIRCMQVWPIEGIKKFETLSYLPPLSTEALLKQVDYLIRSKWVPCLEFXKVGXIFREXXASPGYYDXRXYWTMWKXLPMFXCXPXATQVINEVGGRSKKE

SEQ ID NO: 199543 - protein, 68 aa, Triticum aestivum
  unsure (1)..(68): unsure at all Xaa locations
  Clone ID: PAT_TA_93961.pep
MMKRSISPPTDLLGQVGRMKFVRPLYRKLNQVDRXLALETFEKNKDFYHPICRQQVEKDLKELVEEIV

SEQ ID NO: 199544 - protein, 95 aa, Triticum aestivum
  Clone ID: PAT_TA_93962.pep
SHETRVPHTIIKPSLSKVSPTLIHQEPQQRELKKMAKTQKNTSTRLLYLLTLVKILSNIVFHSQYIPLFVGNYRVNIHPWTSIIICKIFNWKTPV

SEQ ID NO: 199545 - protein, 129 aa, Triticum aestivum
  unsure (1)..(129): unsure at all Xaa locations
  Clone ID: PAT_TA_93963.pep
MAPTVMASSXTSVAPFQGXKSXAXLPVSRXSNGAXLGSVSNXGRIRXMXVWXIEGIKKFETLSYLPPVKXGRASSSRSXYLIRSKWVPCLEFSKVGXSIFXVXXASPGYYDXRVLGQWEGCLVCTGPQG

SEQ ID NO: 199546 - protein, 70 aa, Triticum aestivum
  unsure (1)..(70): unsure at all Xaa locations
  Clone ID: PAT_TA_93964.pep
LDHVKKLQREGNLDAIVDRNLNNXFDRQEVEMMMQIALLCTQGXPEDRXSMXEVXRXLGRGKPWRLGREE

SEQ ID NO: 199547 - protein, 82 aa, Triticum aestivum
  Clone ID: PAT_TA_93965.pep
MGATYLKRVKPGFFSFFLHFFILFVFFLCFLIIFFLWFLYLFLVFIFLSSLFLFVFILHFLYMSTTFFNICLTFFLYGFNIF

SEQ ID NO: 199548 - protein, 70 aa, Triticum aestivum
  unsure (1)..(70): unsure at all Xaa locations
  Clone ID: PAT_TA_93966.pep
MXGLLXLVXPXEXGGXXRXHMPDREQRRRGGXPXDHPGRGRXRHXRCPXXXFXRRAPFLWTAAARAEFGT

SEQ ID NO: 199549 - protein, 63 aa, Triticum aestivum
  unsure (1)..(63): unsure at all Xaa locations
  Clone ID: PAT_TA_93967.pep
SQILYNQMGINYNXSXKXGDFLFXHDQGQXFNXSVGSXTXTXTXLRFFXXXSRSNYQKXFPNG

SEQ ID NO: 199550 - protein, 121 aa, Triticum aestivum
  unsure (1)..(121): unsure at all Xaa locations
  Clone ID: PAT_TA_93968.pep
MSANPYNHNDSSQTEHDDLIDPDDAGIDDLDDPLHPTSSRAPLAGNISQXSSNQADNYFTSRIPGEDRRAPQNTIXDESVWETLXRGPTVPIWAKDARRXLYPKKTFRXGKNFFCKDNTIS

SEQ ID NO: 199551 - protein, 64 aa, Triticum aestivum
  unsure (1)..(64): unsure at all Xaa locations
  Clone ID: PAT_TA_93969.pep
QASRQTPSPLSXGMDADADTVVFEAPGHFRFYTSGRIEGLNRXXILPAGVDEGTGRHLQVXSSS

SEQ ID NO: 199552 - protein, 106 aa, Triticum aestivum
  unsure (1)..(106): unsure at all Xaa locations
  Clone ID: PAT_TA_93970.pep
RLAILSPEPRPARRYFLNESSLXPLPRWDFLXXYXQASSFFTGVQTFYASEDPKNIFIKQLXHQEKSPNFIWMRXMMDPLGAXMGRRCSAIPLLQWVGKMNGXHQI

SEQ ID NO: 199553 - protein, 68 aa, Triticum aestivum
  unsure (1)..(68): unsure at all Xaa locations
  Clone ID: PAT_TA_93971.pep
LVPNSARXXXVAQPSFHRIXRNIGTEIXSTHFQSVQLXYLSXQSXIXVSPNNTIDXHCXFXSPXXPGP

SEQ ID NO: 199554 - protein, 59 aa, Triticum aestivum
  unsure (1)..(59): unsure at all Xaa locations
  Clone ID: PAT_TA_93972.pep
XLKEXKGGPPNTFLXQXXPPPPXNLXDQLANXPSXCAXSKFPXXRDAEXTSLAWGSVRX

SEQ ID NO: 199555 - protein, 110 aa, Triticum aestivum
  unsure (1)..(110): unsure at all Xaa locations
  Clone ID: PAT_TA_93973.pep
NPTPSXXGRNFPAITRXTPRSERTPXIVXPXXXFRGXXSRGPATPRXXFVXXRAALXLALXXPRARXGEQPXPGXGRPPGPAWTAAVPWSPXPXGISPXRLSSXXCSESX

SEQ ID NO: 199556 - protein, 140 aa, Triticum aestivum
  unsure (1)..(140): unsure at all Xaa locations
  Clone ID: PAT_TA_93974.pep
WRLSKAGQRRWGQLRGLSGLRQWGEKRNXPIDKXRHNWDXXDIPLVKXNGGKIKXSXGRXKFXXGSGXNQLXPGXDLWXXPLXXPPNSGGQKRLNXPFVLGTRITQXMKREGGKQXENIPRMGNTGAYQRGVXTGPKIKG

SEQ ID NO: 199557 - protein, 84 aa, Triticum aestivum
  Clone ID: PAT_TA_93975.pep
LVPNSARDPIQSPSDLTGKPPIEAKPRLSRPPPQGMRCQRLIPPFCLLFIDYIIVDSPRLLLVFVSCSYIINLCRLLLIPFDCC

SEQ ID NO: 199558 - protein, 93 aa, Triticum aestivum
  unsure (1)..(93): unsure at all Xaa locations
  Clone ID: PAT_TA_93976.pep
LVPNSARXSFPFLLFSKXGKGXGLXXFRXXXGXLGGXSXSVRXXGEGXXGEAXXGPXGLEKRVXLSGXXAPPWWXVKGLXPSKXGRKISPQFG

SEQ ID NO: 199559 - protein, 64 aa, Triticum aestivum
  unsure (1)..(64): unsure at all Xaa locations
  Clone ID: PAT_TA_93977.pep
SSVIERSAHNYLFCSSFYLPTHYRVQSIFTSIYNQLSTNAVSLDHXKKKKKXXXKXXKXKKXKK

SEQ ID NO: 199560 - protein, 78 aa, Triticum aestivum
  Clone ID: PAT_TA_93978.pep
KQKGKLYNKNKNKIVHRHIIYQNFQKKISYSVSIFVELNKIRKNSNKSKSATALLKSNKNHFQNTKINSNLFLSNFLL

SEQ ID NO: 199561 - protein, 72 aa, Triticum aestivum
  unsure (1)..(72): unsure at all Xaa locations
  Clone ID: PAT_TA_93979.pep
MXGKXXGPAIGIDLXXTYSCVGXWXHERVXIIANDQGKRNTPSYXXXTXNEXGVIGRRAXNQXXMNPXNLRC

SEQ ID NO: 199562 - protein, 87 aa, Triticum aestivum
  unsure (1)..(87): unsure at all Xaa locations
  Clone ID: PAT_TA_93980.pep
PMSCSQQISXNLSSVSCDGRMNVVLYYFVPIYNSCFQVIMICXNFXYDSKVWXGVGMKQKRESGDLCKAPIRPSYPXXMGPWGLXXL

SEQ ID NO: 199563 - protein, 83 aa, Triticum aestivum
  Clone ID: PAT_TA_93981.pep
SSVMNFCISLYIYMWTKSSSHSSPCGAFCVIGSSSAATCDLSESGANIKFQNPAPGPVLPPLSYRVPLPPFPLPVPPLAPSPL

SEQ ID NO: 199564 - protein, 73 aa, Triticum aestivum
  unsure (1)..(73): unsure at all Xaa locations
  Clone ID: PAT_TA_93982.pep
SYSXRGGPVGGIFLFFVALFIFFCFLLYFLILYAFSFRKIINFLLMPLVFKFENTFLFFCFLCCFISRAEFGT

SEQ ID NO: 199565 - protein, 153 aa, Triticum aestivum
  unsure (1)..(153): unsure at all Xaa locations
  Clone ID: PAT_TA_93983.pep
MPRYHFPFCXAKRXLGKWPVLSLGGGXVETXXHIYLEEFAXGTVGSREQLAIGEFAQALLVIPKTLAINAAKDSSELVAQLRSRHALSQRIQDGDASEDEKXIAKKKNYKNYGLDLAEGKVVDEIKMGVLEPSMSKIRQLKSAVEACIAIMRI

SEQ ID NO: 199566 - protein, 134 aa, Triticum aestivum
  unsure (1)..(134): unsure at all Xaa locations
  Clone ID: PAT_TA_93984.pep
SVAPFQGLKSTAGLPVSRRSSSAGLGSVSNGGRIRCMQVWPIEGIKKFETLSYLPPLSTEGLLKQVDYLIRSKWVACLEXSKDGFGFRXHNXSSPGYYDGRYWXMWXXPXFGCTRLPHTRVVKEGTPGRLCPPA

SEQ ID NO: 199567 - protein, 91 aa, Triticum aestivum
  unsure (1)..(91): unsure at all Xaa locations
  Clone ID: PAT_TA_93985.pep
SDECXLXSIAXQWRXEXIXFRXSCRIRHELVPNSARASEGYELPPPLSAIENNSHSSDYDVANRHRYPLARFLDRNRLRHAPPDERIAALR

SEQ ID NO: 199568 - protein, 44 aa, Triticum aestivum
  Clone ID: PAT_TA_93986.pep
LNGLGFASPSSFYGRKFKCLAHTTIHLFPSSKFDAGCPSQDTYP

SEQ ID NO: 199569 - protein, 85 aa, Triticum aestivum
  unsure (1)..(85): unsure at all Xaa locations
  Clone ID: PAT_TA_93987.pep
MAAEPEQAPAAQEAXVHIVYVDRPEDADPEEFHIXTLAPVLGREEKGKGAVLYHYXHAXASXFSRKAHQRSKSRDLKSEAAPFLL

SEQ ID NO: 199570 - protein, 165 aa, Triticum aestivum
  unsure (1)..(165): unsure at all Xaa locations
  Clone ID: PAT_TA_93988.pep
DYGWDTAGLSADPEXTFAKNRELEVIHSRWAMLGALGCVFPEILSKNXIKFGEAVWFKAGAQIFSEGGLDYLGNPNLVHAQSILAIWAXXVVLMGLXIXGYRVGGXPPRRGASXIIYPGRGLSNPFGLARNPPPAEAQRAEAQRNGPPRHVQWFFFLARIQPGKG

SEQ ID NO: 199571 - protein, 75 aa, Triticum aestivum
  Clone ID: PAT_TA_93989.pep
VSQNTYRKMAYKKNPSPIPRSLLRKILPLIALFILVSALSFICYQIYRTILKISSATSRKNAKTKHEHFEGRSQT

SEQ ID NO: 199572 - protein, 105 aa, Triticum aestivum
  unsure (1)..(105): unsure at all Xaa locations
  Clone ID: PAT_TA_93990.pep
LPTIPSKRHRCKGGGVGMRGIVSTLAMSSTEGYMLAAGTWTRWVGLYDAGGLGGTIATWSVADAADNVAGILXSGVSEVIWSACGRYLCVVERMXRGILVYESRA

SEQ ID NO: 199573 - protein, 44 aa, Triticum aestivum
  unsure (1)..(44): unsure at all Xaa locations
  Clone ID: PAT_TA_93991.pep
FXLARWTXPKSXIKYFRGIXNXIXNYMNIXQXQIXNELNSXSQK

SEQ ID NO: 199574 - protein, 104 aa, Triticum aestivum
  unsure (1)..(104): unsure at all Xaa locations
  Clone ID: PAT_TA_93992.pep
LSLVPXFRXKLNIKFQTRXEFPKKARMXNATXDQITSELNETSLXTNETNDVPAINTTVSNTASEXLDNXWQTXQXTVXPSSSXNXNPXMLVSLSPRXTXXNXY

SEQ ID NO: 199575 - protein, 141 aa, Triticum aestivum
  unsure (1)..(141): unsure at all Xaa locations
  Clone ID: PAT_TA_93993.pep
MDPDEEVEFDLSPFAIVYKSGRVQRSGLTSRKSPGTDATTGVTSKDVVIDAGTGLAARLFLPKSVPESXKLPVLVYFHGGAYVAESXSPPGTPXXVNALVAAARVVDVSVEYRLAPGXXAPGYRVGHAPLGQAKLRLGGAG

SEQ ID NO: 199576 - protein, 161 aa, Triticum aestivum
  unsure (1)..(161): unsure at all Xaa locations
  Clone ID: PAT_TA_93994.pep
MAPTVMASSATSVAPFQGXLKSTAGLPVXRRSNGASLGSVSNGGRIRCMQVWPIEGIKKFETLXYLPPLSTEALLKQVDYLIRSKWVPCLEFSKVGFIFREXHNASPGYYDGRYWTXMWKLPMFGXCTDATQVINEGRRSKKGVPLTPYVPQSSGIPTTIA

SEQ ID NO: 199577 - protein, 104 aa, Triticum aestivum
  unsure (1)..(104): unsure at all Xaa locations
  Clone ID: PAT_TA_93995.pep
MARRGGGGRRSKVMPNLGADREGTRXLNLTVLRXLDPAVADILVTAAKRHRLQASXKDTVRWSHKGVEGSLFXVKRNTQPTFQFLIMNRPNXQKNLVEDLLXGF

SEQ ID NO: 199578 - protein, 75 aa, Triticum aestivum
  unsure (1)..(75): unsure at all Xaa locations
  Clone ID: PAT_TA_93996.pep
LHCRYPLDIVKTKNTXLQSSKGTEVDSYNGMAGCFKKIIRNEGFNRLYRGXXAPIIMEAQKRATKICPPMNSGGA

SEQ ID NO: 199579 - protein, 181 aa, Triticum aestivum
  unsure (1)..(181): unsure at all Xaa locations
  Clone ID: PAT_TA_93997.pep
RWAGIRPPSPVRPPGNPKQFQRRERTNWRSDRKPLRGRACRCVPTKRGSAPVGQRTGWAKRGGVEATLLMNRRXQVGQAPGKPSXTAGCSGNERXNGAQAWAVRGKRAGKQGAXAACYKVAGGKQRGQLSRPPKXSRKLREKGPGGAGNKXLLFGPVPNVPTERTGLLLRAVGFKGGVVFC

SEQ ID NO: 199580 - protein, 119 aa, Triticum aestivum
  unsure (1)..(119): unsure at all Xaa locations
  Clone ID: PAT_TA_93998.pep
MSAAVAAGQYTPAGAVAAKRGRRLDFAAAGAKPYHQAASRRKQQVRFPLPLGDMXACSAGGNFTPXXXTXXPGEDVTXKGYSFSQQGTXXXXCILSANXVXSXVTLRSKXXPXGGXXTY

SEQ ID NO: 199581 - protein, 74 aa, Triticum aestivum
  unsure (1)..(74): unsure at all Xaa locations
  Clone ID: PAT_TA_93999.pep
LRKXPPLNXDIFGVTRQSGVXXXGVDSAKLFPXGVKSILTCFGGYXVLLGECQRSFLCFXPGHVKIFPHYQKMI

SEQ ID NO: 199582 - protein, 64 aa, Triticum aestivum
  unsure (1)..(64): unsure at all Xaa locations
  Clone ID: PAT_TA_94000.pep
MGLXGEKXAXXAVXXHRLXTVVPXXVXEVEGYXLGDXDLXXRLHYLRGVXYHPXGGGVATGGQG

SEQ ID NO: 199583 - protein, 122 aa, Triticum aestivum
  unsure (1)..(122): unsure at all Xaa locations
  Clone ID: PAT_TA_94001.pep
KRNKIXGRLSXLXSXLRALRGXARXNQKTLMSLRXEXPTSLSSNPSMSPNDKLKLKKXGPXSSXELSSRAIPAVTDDEGXSPXPGIVGPFLSLDATXXQPARGXXKLLGEXVLGKERPGGER

SEQ ID NO: 199584 - protein, 185 aa, Triticum aestivum
  unsure (1)..(185): unsure at all Xaa locations
  Clone ID: PAT_TA_94002.pep
GTKIXLLRWFPSAPXVGPHKPTKIAALCSLPLKQNFDSWIQGPMQKQGQRAKRCCPLGKIILMKQRXLQRWVNXMGTDKPSWFYGDLPPSLGLDWXNKGXEKECGXPFAXXLQFEXKEWLSFRVNKXVAFVPPGWVVPXFGAXPPIDFPRGSWVXXRTFXXKIARSFXPXKGWWNQSALEQSXKG

SEQ ID NO: 199585 - protein, 81 aa, Triticum aestivum
  unsure (1)..(81): unsure at all Xaa locations
  Clone ID: PAT_TA_94003.pep
KSWXLHXGGAAAXRTNGXPXGLQGSXPXFXTKXKXXELLSXALPXFLPFXPPKKRGXGCXRXRXLNXGPSXXPFGQKADPL

SEQ ID NO: 199586 - protein, 99 aa, Triticum aestivum
  unsure (1)..(99): unsure at all Xaa locations
  Clone ID: PAT_TA_94004.pep
YVELACXTVARAGFPFLFKRINTPGEGXQWXGNLEATGXDTAKVESQKCFHGXDSMGKALPXAGLAXXXPXXKXXGGXXSPXXGXSGVRXESXFPRGGX

SEQ ID NO: 199587 - protein, 145 aa, Triticum aestivum
  unsure (1)..(145): unsure at all Xaa locations
  Clone ID: PAT_TA_94005.pep
SPRXRGGPALELSGXPPGAAKARXRNSXXEAHQDYNSXWQASCQVSKKWXMGGEHXRXFLMNTXXPTTNIYISRVKKFIYTSSLPKAGGPKPSPPTKGNTAVRRESKKATRNPSKYRIGXVGPARGAFXAAGGWLXGXQGTSGDR

SEQ ID NO: 199588 - protein, 78 aa, Triticum aestivum
  unsure (1)..(78): unsure at all Xaa locations
  Clone ID: PAT_TA_94006.pep
TRSFITTVFPSLSFXTSSFKLAHHFLFANLPIRXFKFTRSGKXXLXPTQVSNFLPXAVVSXNXFXSGGERPXIXPXGI

SEQ ID NO: 199589 - protein, 86 aa, Triticum aestivum
  unsure (1)..(86): unsure at all Xaa locations
  Clone ID: PAT_TA_94007.pep
EKKRGLEVPGIFLLDNFQGXLXVNIPPFPFPRFNGTKVPFLVGQFGGCSCKTMGPLPLFKRLSXIFGIKQLKSSPCKMXKNSXFLS

SEQ ID NO: 199590 - protein, 76 aa, Triticum aestivum
  unsure (1)..(76): unsure at all Xaa locations
  Clone ID: PAT_TA_94008.pep
MXAGGSLXSSHPWTVRQRXAFNXGSXCKPGSKRLWGCCKXPKSQXPVTIGNLGGEKSPXXGRXFWXNVXTIDKSLV

SEQ ID NO: 199591 - protein, 67 aa, Triticum aestivum
  unsure (1)..(67): unsure at all Xaa locations
  Clone ID: PAT_TA_94009.pep
ELSGFPGAGXSXPNSGTKXFCAFCQNMNGKGVNGXYKXYXYFXLXFFLVGLGSLCINLMGXGLKQLX

SEQ ID NO: 199592 - protein, 103 aa, Triticum aestivum
  unsure (1)..(103): unsure at all Xaa locations
  Clone ID: PAT_TA_94010.pep
ACGDYXXIEDRXNVGWTLPGKILXGTYKLRAKFSRSGTKXKGSFSLKKGRXSSGIWEELRXNFQLAFMGGXNHWGSMDSFMXVXGGQSKQXNGXITIKGSINX

SEQ ID NO: 199593 - protein, 122 aa, Triticum aestivum
  unsure (1)..(122): unsure at all Xaa locations
  Clone ID: PAT_TA_94011.pep
MGNAXSAMLXNIXQGSNFXRDEVDRIRKRFVKLDKDNSGTIERDXFLXSLPQISSNPLATXRLIAIFDXDGGGDVDXLREFVSGLSAFSXVXGNKEQKASIXHLKYMIWDRXGYIGNGXPLC

SEQ ID NO: 199594 - protein, 77 aa, Triticum aestivum
  unsure (1)..(77): unsure at all Xaa locations
  Clone ID: PAT_TA_94012.pep
GXEXIPPLPKIXSRARVSSIXTQPRNDPNSXPEETAIGMRXQQKKKGKXXEKXELLXXNPANLXPNSARASSRIRHE

SEQ ID NO: 199595 - protein, 79 aa, Triticum aestivum
  unsure (1)..(79): unsure at all Xaa locations
  Clone ID: PAT_TA_94013.pep
MSCCGGNCGCGSACKCGNGCGGCNMYPEAEAAGATLLVSATATHKASSGGMEMAAENGGCGCTNCKXCGNNCXCSCCSC

SEQ ID NO: 199596 - protein, 103 aa, Triticum aestivum
  unsure (1)..(103): unsure at all Xaa locations
  Clone ID: PAT_TA_94014.pep
TPLNRNPDFFXXSFLAPXVLYRXQPXXNPCLTEPRYSLLLXVPFPIQSNXQXPSTQRLGXXXCXXWRLXLACPQRACFQLXAEPDALSLAPVVPLRTLSPPXX

SEQ ID NO: 199597 - protein, 137 aa, Triticum aestivum
  unsure (1)..(137): unsure at all Xaa locations
  Clone ID: PAT_TA_94015.pep
LLPVADMGFDRRSVVRAPARARIGPPRSGSPLXXTFKXMWVGFQRLKNXLLKGLGPPLXXLCXGXSQFGFLQQQKNKXLSLRTSGKXKIXGGREGAXLXWLREPNRXXNRGPEXLFRXFXXKNQPSSXRFSTRXCDR

SEQ ID NO: 199598 - protein, 135 aa, Triticum aestivum
  unsure (1)..(135): unsure at all Xaa locations
  Clone ID: PAT_TA_94016.pep
MSQTNGLTKLAYSRTWHHISATKPHXSSSTIRPRVAPTSPEITPPSLXRLXASRIAVLLMGXKHKPIWDPSXTDCGDYVIVXTNCAHLHTTGKKAXWQXLYYRHNTDPXGLKANQWVAWIGLGWGGRVLTQGQSG

SEQ ID NO: 199599 - protein, 142 aa, Triticum aestivum
  unsure (1)..(142): unsure at all Xaa locations
  Clone ID: PAT_TA_94017.pep
DXLXPTILDCKPVXXCPPNVPLLLRDQKGPXFXPKGCFWICYLGSRKNKGGIARRGVAXRPSPACLLFDEFPMAGVSLSXXPSPLVXYFIXPLXPVLRVGLRXSVRTRXXXPVPXAXRXEXFPRPALCRESLLVXEIPCHPG

SEQ ID NO: 199600 - protein, 113 aa, Triticum aestivum
  unsure (1)..(113): unsure at all Xaa locations
  Clone ID: PAT_TA_94018.pep
PLARYXKXXNXSITXXTIXRXLRXTXKXAGXLNXGPYTTXXXXPQIGKKSKEXFSTQVXKVFVGKTXGDAMXWGKKVLXGWKTASXCWGXSXTXVPFFIFXNXPXGXKKNWXG

SEQ ID NO: 199601 - protein, 87 aa, Triticum aestivum
  unsure (1)..(87): unsure at all Xaa locations
  Clone ID: PAT_TA_94019.pep
FFPCTLTXDGXDSCLSSSPASXALSRHHRARLTLRQILXPVAADXRIXTQEKEVGLEKXQRSXGGGXQXXASXLXRSXCCRXRRKEG

SEQ ID NO: 199602 - protein, 88 aa, Triticum aestivum
  unsure (1)..(88): unsure at all Xaa locations
  Clone ID: PAT_TA_94020.pep
RFPXXPPTXKRXXFPKXSXCPLXTKDRAGARRPPXPPRTPSEIELXGAXAGRXWETHHXCDXPVMDXMVCXITSXASLFSFFAXCFPR

SEQ ID NO: 199603 - protein, 121 aa, Triticum aestivum
  unsure (1)..(121): unsure at all Xaa locations
  Clone ID: PAT_TA_94021.pep
PRPNXXPRPLXKPLXPLXGGRXXPNLTRAFXXEKVPSYXRRPYRXARPPRAWXVPXRXQXPAFPRKLGALGXSCNTSFSPVDPRTAQXIFXSPNPDGLECPMAGERDLGVASDDGWALVXP

SEQ ID NO: 199604 - protein, 119 aa, Triticum aestivum
  unsure (1)..(119): unsure at all Xaa locations
  Clone ID: PAT_TA_94022.pep
MGFLYVQFRATAYYFILPTLXYIVIKGMFIAFGQNSATVQAVGLLLIEAITLXAASVIRPWMDKSINSFNVAIAAVNFLNTIFLLIFTDIFNQPGIVTGVMGXIFFIYKWFSRPTDLKF

SEQ ID NO: 199605 - protein, 55 aa, Triticum aestivum
  unsure (1)..(55): unsure at all Xaa locations
  Clone ID: PAT_TA_94023.pep
SLXPLPRFFPARXSRXRRXRXSGPXRGGAAXAGAGESXGGGPPGXSXTSXRLSWR

SEQ ID NO: 199606 - protein, 181 aa, Triticum aestivum
  unsure (1)..(181): unsure at all Xaa locations
  Clone ID: PAT_TA_94024.pep
LEFGTREVQDKEGIPPDQASVSSSLGKQXLEDGRTLADYNIQKESTXLXLVLRLRGGMHIFVKTXTGKTITLEVEXPRDTIXXVKXLXSKDKEXIPPDQXKRLIFAGKQAWRDGRTPGLTTTSKKEXTLHLVXLRLRGXMQNPLSRPSPGKTITLGWPLTINVGRKFQATRGSPRAKALFL

SEQ ID NO: 199607 - protein, 95 aa, Triticum aestivum
  unsure (1)..(95): unsure at all Xaa locations
  Clone ID: PAT_TA_94025.pep
MPXNXGKGXKNRKRXKNEXGDXKRELVFXEGGQEYXXVTRMXGNGXCEGICVHGXKXLXXIRGKXHXKVXWFAXRXHXXXXLRXXQERQGPASSS

SEQ ID NO: 199608 - protein, 82 aa, Triticum aestivum
  unsure (1)..(82): unsure at all Xaa locations
  Clone ID: PAT_TA_94026.pep
PXXFXIXLXFXXYXPPQXFFLENLKLKYXARVLPXYLXLREKSLCRKRRTREASXSILQRSKSVVFKASXGAHSXLFSEPQX

SEQ ID NO: 199609 - protein, 73 aa, Triticum aestivum
  unsure (1)..(73): unsure at all Xaa locations
  Clone ID: PAT_TA_94027.pep
RVWAWLINPSXPEFFADRTKTMGGXAVXNNVRRXGTXLAXSXSSSSSXAXXPPXGGAXLPGMXSXSXGGGXXQ

SEQ ID NO: 199610 - protein, 93 aa, Triticum aestivum
  unsure (1)..(93): unsure at all Xaa locations
  Clone ID: PAT_TA_94028.pep
PXISPDKXIFXLXXPPXLXSEXTFCRXEXEGEXIXLAGEXXIDAPXQIXQFFXFPXPGPPPRGGXXRPPPXGGXRIHPPRRDGXGTXVSXRQX

SEQ ID NO: 199611 - protein, 124 aa, Triticum aestivum
  unsure (1)..(124): unsure at all Xaa locations
  Clone ID: PAT_TA_94029.pep
MVLQKDIDLLNPPAXLEKLKHKKKRLVQXPNSFFMDXKWXGXFNITTVXXXSXTXXXWPSWAXXGSXKQXGWGRASXXXGVPSRKGGTNRGLKWGPVFGGVGGKIEMGEITFGKIWPPREFNGS

SEQ ID NO: 199612 - protein, 159 aa, Triticum aestivum
  unsure (1)..(159): unsure at all Xaa locations
  Clone ID: PAT_TA_94030.pep
SCRIRHEPMPPKPFNPPRPSNSVASTPVRVGDSGKERASRINKLTPASGSSRSQKMKASSSKGIKKKPRISAASLARLPSLSPGTSDDGDSGPDLNPEEELXEEEGDDIFXEVIETSTRSRIHDSSRSTRTRVTSYNERDXPRERIGQEVCHSKAXSRQ

SEQ ID NO: 199613 - protein, 70 aa, Triticum aestivum
  Clone ID: PAT_TA_94031.pep
TGSPGCRNRHEPCRIGTRRELISSFFLYFGLLFQVTGRRSGSLQDPSFNRSFPVISPELGATAANLKIQG

SEQ ID NO: 199614 - protein, 67 aa, Triticum aestivum
  unsure (1)..(67): unsure at all Xaa locations
  Clone ID: PAT_TA_94032.pep
PFTKLXLTLHPCLWXQXLHYQKIINXLXSIPSSSARELXIPTXXHXXXGXXXTYKXXFGXQXWXGXX

SEQ ID NO: 199615 - protein, 147 aa, Triticum aestivum
  unsure (1)..(147): unsure at all Xaa locations
  Clone ID: PAT_TA_94033.pep
PPQXXFCXGPXLFSPPRXLTPXHPXEIGPRHTLEQTQFLEVXPEEGXPPIRXLRGGDXLIXVARTXSLXRRAXPSXXIDGRPFAPYAPEEREXGGQPKPFPLPXQXGVWNPLTXPXLXSXRNFCLXFCSXHLRCGIGXGPCXPGETH

SEQ ID NO: 199616 - protein, 56 aa, Triticum aestivum
  Clone ID: PAT_TA_94034.pep
PPPEMAKVIRKPMLLSTPMIRAPSPALGRRNLALKLSSMLTERSIEYCVSQLGESR

SEQ ID NO: 199617 - protein, 49 aa, Triticum aestivum
  unsure (1)..(49): unsure at all Xaa locations
  Clone ID: PAT_TA_94035.pep
YVLPKXLDEKXAGLHLGKLGXRLTKLXKSXSDYIXXPIEXPYKPAGXRY

SEQ ID NO: 199618 - protein, 76 aa, Triticum aestivum
  unsure (1)..(76): unsure at all Xaa locations
  Clone ID: PAT_TA_94036.pep
TXXXFXRXWXQXAAAAQEEXHPPXLNFSAIARSARLIPXLSSRAIRYXEAXRGGEVARHLLLXTRAXVVLVXXGAP

SEQ ID NO: 199619 - protein, 99 aa, Triticum aestivum
  unsure (1)..(99): unsure at all Xaa locations
  Clone ID: PAT_TA_94037.pep
EFVPMXXVFFXFFLXSWCXQXXGXXKFKIHGXXPSPPYKXXPSHXKFXISQLFXLIYLPLCXAMHLDVPKYVNNAXFPLFEQNKXGSXLGXMPLKHLFL

SEQ ID NO: 199620 - protein, 79 aa, Triticum aestivum
  unsure (1)..(79): unsure at all Xaa locations
  Clone ID: PAT_TA_94038.pep
QXLWXNVIXDYNWCPRYGQYXRPGVRAXHQRGISRINNPSTXNKFSDXYSIQXXYXPHSXSRLLLGCXAIXKXPRGRXG

SEQ ID NO: 199621 - protein, 67 aa, Triticum aestivum
  unsure (1)..(67): unsure at all Xaa locations
  Clone ID: PAT_TA_94039.pep
XVPLVPNSXRVKKHXSNKXPKKVIKNKVWXRXIWRAFVGTLGEAXIKVXXXDSISEKNNXNPYEDEL

SEQ ID NO: 199622 - protein, 154 aa, Triticum aestivum
  unsure (1)..(154): unsure at all Xaa locations
  Clone ID: PAT_TA_94040.pep
LVPXFGTRTASLNXEAAXREGRERSEEAWAPGTSSVRFPKEEESKRRHPRGCPVGREKRRHCWXRGRGSHXRXLAVSFLGLKHXLDXHRGKAXXISXSLVSPGFFXXRRIKPFXETXRQKQQXXRDXRSHFXQGXXKNXQGPLVPTXXPRXGXW

SEQ ID NO: 199623 - protein, 92 aa, Triticum aestivum
  unsure (1)..(92): unsure at all Xaa locations
  Clone ID: PAT_TA_94041.pep
FQDSTTKPTRTTTELSPGFVMSSDLKLGGLXLSSRRGFGLYTSQKGYNRVLPKCEXXQELVLCVSSRTFRARLHPLSSLLCRPLLPSGRHSR

SEQ ID NO: 199624 - protein, 66 aa, Triticum aestivum
  unsure (1)..(66): unsure at all Xaa locations
  Clone ID: PAT_TA_94042.pep
VXCQLSKTRSNQXLSKLXSTXMGSXXRXPTEXXXXALFFXGXGGHQKXIRLPWLPRRRRHLQXLGV

SEQ ID NO: 199625 - protein, 111 aa, Triticum aestivum
  unsure (1)..(111): unsure at all Xaa locations
  Clone ID: PAT_TA_94043.pep
MSPQRXLAGCXSXGITESNLDWAIQKEKNKTSXGRXRTRGXLMXKAXSVLNSRSXASXKNXKWXXSWXSNKRXTPGESQGXTRVFPKXNKPNFLPFWGXKXXMVQXGVXRG

SEQ ID NO: 199626 - protein, 149 aa, Triticum aestivum
  unsure (1)..(149): unsure at all Xaa locations
  Clone ID: PAT_TA_94044.pep
LWKAGSTTXTINVXMKXMXEDDEKDAVFFRLEALGYRVGQGLVXRFSRERQRFIDTLDVIKFICKDLWQLLFKKQLDNLKTNHRXXYVLTDHXFRPFARMSTXAGGQAGIRAXPKLWXFXAXNIRXXLXNMGYPMTVQAKTKRSYPGNI

SEQ ID NO: 199627 - protein, 190 aa, Triticum aestivum
  unsure (1)..(190): unsure at all Xaa locations
  Clone ID: PAT_TA_94045.pep
WPNXGKRARPSLQGVNSSQSKKNRXGGAXXAXGRKQFPSPXKLSNXRAGPGAXXTSXPLPXPSLTREGDVLXGGEXGGAGAGRWLFXXKGGXXGQDLXGHPSTGSKFIKQTGXARXTAQKXXNKVQXLWXRXGAXKAPQSGVGXTXDGSXSXPRPPKGGTPXPRXGXWXWGKAKEKXXGWSXLSXXPXAK

SEQ ID NO: 199628 - protein, 100 aa, Triticum aestivum
  unsure (1)..(100): unsure at all Xaa locations
  Clone ID: PAT_TA_94046.pep
INRSRIYLQHSSPTLXQPIILQEGXLPPHQLLXSQGNLARNENETITIKMIRQNFSSRSXNFMKGKKLPLGLXHGFITKKNAKASSQGXAKPXSKVTXKL

SEQ ID NO: 199629 - protein, 137 aa, Triticum aestivum
  unsure (1)..(137): unsure at all Xaa locations
  Clone ID: PAT_TA_94047.pep
MASPPPPGPAAAAHSVFVYGTLMAEEVVRVLLXRVPPSSPALLPNHQRLSIRGRVYPAILPVDGSKVPGXVWKGXTDRELDVLDIFEDEEYVRETVXILLNDSAGXRWSPYAYIWGNVDDPDLYGEWDFXEWXESAS

SEQ ID NO: 199630 - protein, 155 aa, Triticum aestivum
  unsure (1)..(155): unsure at all Xaa locations
  Clone ID: PAT_TA_94048.pep
PTGIPPITCLQLKKFSAWAIKKGELLSRWKVEVNNSXXTVIASSKSAPXDVFAVGYEDGSIRIWDSKISKVIVVFNXHRSAITSLQFDSSGFRLASGSKDTDVIVWDVIAEVXLYKLRSHKDQITGLYFIRLDDKEKISEDGEELSPNNDSISSE

SEQ ID NO: 199631 - protein, 133 aa, Triticum aestivum
  unsure (1)..(133): unsure at all Xaa locations
  Clone ID: PAT_TA_94049.pep
RAEFGTRLAAASFFVWGRRXFAEVREDWEDEFGPHRFAYKDLFRATDGFKNGNLLGAGGFGKVYKGVLPGSNLEIAGKRVSHDSRQGIREFIAEVVTIGRLRHRNLAQLQGYCRRXGEXLLGHDYMEKGPDKV

SEQ ID NO: 199632 - protein, 105 aa, Triticum aestivum
  unsure (1)..(105): unsure at all Xaa locations
  Clone ID: PAT_TA_94050.pep
SCRIYELVPNSRXVGXXRCLPFXXKARYXXQKPLVLVXXDLCGPXTPAXPGGXRYIXLLXDDXNRXXRVLLLXSNDXAXQXIXNASKRXQKVXCGHKGWWLNPLV

SEQ ID NO: 199633 - protein, 67 aa, Triticum aestivum
  unsure (1)..(67): unsure at all Xaa locations
  Clone ID: PAT_TA_94051.pep
QXYCNPYQAXLTFXDDXLLGTKAVXRPRXIDXXXGPXFXAXCXKXQXKNVGIPXCEXGAXSKSPXYA

SEQ ID NO: 199634 - protein, 82 aa, Triticum aestivum
  unsure (1)..(82): unsure at all Xaa locations
  Clone ID: PAT_TA_94052.pep
SLSKGPXRXENPLGVXLXLPSKFXAPGHWXDLVGTSXTVYSXMPHXASIYGTRSLXIAYXVKRHFWRXXVXVKWGXCLWXQI

SEQ ID NO: 199635 - protein, 115 aa, Triticum aestivum
  unsure (1)..(115): unsure at all Xaa locations
  Clone ID: PAT_TA_94053.pep
VVVIVATVRALKVHGGGPPIVPGAALNKVYAQENVEILRTGCVNLRKHISNAKIYGVPVVVAINKFETDTDAEIQVIKRXEQXQAGAEDAIPANHWAEGGKXGAIELSKGIIARM

SEQ ID NO: 199636 - protein, 91 aa, Triticum aestivum
  unsure (1)..(91): unsure at all Xaa locations
  Clone ID: PAT_TA_94054.pep
MXPKKIRCSFKDCRDGVQRIVGDCGFCSGHFCGKHRLLXDHKCXGLEDCXKQSHERDAXKLHAERTHAIKGGQSNIKSNIVEINGANRWVG

SEQ ID NO: 199637 - protein, 71 aa, Triticum aestivum
  unsure (1)..(71): unsure at all Xaa locations
  Clone ID: PAT_TA_94055.pep
LVPNSARVDVNXDGRXXKXELRQAIRRRGCWFATVRAGRAVRRADRDHNXYVDDAELENLVAFAREHLGMN

SEQ ID NO: 199638 - protein, 153 aa, Triticum aestivum
  unsure (1)..(153): unsure at all Xaa locations
  Clone ID: PAT_TA_94056.pep
LDQGTSNDIQVASRYFELATRYGHIEAFYFLAELMEKGIGRDRNCGLAAAYYKSVAEKVEPLLSSFTEANSAYDNGHVELALIDYLHAAEQGWEKAQANVAYLLDEQRXLLKLPTWXSITNPRPEVMKNGGLALTHWXRSARQSNIDSLVKMG

SEQ ID NO: 199639 - protein, 110 aa, Triticum aestivum
  unsure (1)..(110): unsure at all Xaa locations
  Clone ID: PAT_TA_94057.pep
AAXNNATKKYSALCQXIHXYVRDVVFXGDVVGSPWASGKGXAVRGGACLXGDGXNXGGGHKXDALPXAPAGRXGXQXXXLRPPTGALPRKXTLTXSGXGGEXGXIRLETX

SEQ ID NO: 199640 - protein, 135 aa, Triticum aestivum
  unsure (1)..(135): unsure at all Xaa locations
  Clone ID: PAT_TA_94058.pep
MGDSSSSXSYIXMVHHLIEKCICFNLNKEGCMEALEKHAKINPVVTATVWKELXKENKEFFESYNRDRVERNIQAXTMERIQXMLSDAGASKDLRRRGARRRAYVQSSCMHPLNFQPPFNWGSNYVQGNFLIAPP

SEQ ID NO: 199641 - protein, 96 aa, Triticum aestivum
  unsure (1)..(96): unsure at all Xaa locations
  Clone ID: PAT_TA_94059.pep
TXRWXRPIQHIFSLFVSLFHXPXKTFGVYLSYCGGXFESCXSPPKXXRDYKXXXFWAXPSXRXVLXNXXSXRFGXRLACPSQXXXXXPQXLKPKFL

SEQ ID NO: 199642 - protein, 75 aa, Triticum aestivum
  unsure (1)..(75): unsure at all Xaa locations
  Clone ID: PAT_TA_94060.pep
ERRFHFPNGKSSLQAKLAKRNLLGHVFHNIERRLSXVLTPEAPTGSRSAEXTTQQVPGVYWKRGPTQKEAXWEDT

SEQ ID NO: 199643 - protein, 131 aa, Triticum aestivum
  unsure (1)..(131): unsure at all Xaa locations
  Clone ID: PAT_TA_94061.pep
MAPTVMASSGTSVAPFQGLKSTAXLPVSRRSNXASLGSVSNGGRIRCMQVWPIEGIKKFETLSYLPPLSTEALLKQVDYLIRSKWVPCLEFSKVGFIFREHNASPGYYDGRYWXTMWKLAMFGCTDATQSD

SEQ ID NO: 199644 - protein, 114 aa, Triticum aestivum
  unsure (1)..(114): unsure at all Xaa locations
  Clone ID: PAT_TA_94062.pep
RTXIPRPKGMCWGISRTDXLXSLAXVKKVHLPLLRXLHSXGLKWAHKFXXEDASXXVQXWGNNRFRPSGKLHLHVIKPRISTHPSLEKQRSNWELPHQVEIFPXFXLKGXGAXV

SEQ ID NO: 199645 - protein, 79 aa, Triticum aestivum
  unsure (1)..(79): unsure at all Xaa locations
  Clone ID: PAT_TA_94063.pep
LPSXSPPPLPCXSPTRPRAKXETYXRARXGXPRXXRCGATACRGXSGXAXAPPXXRSKRXSNXLVLKGGGLHLTYXSWL

SEQ ID NO: 199646 - protein, 91 aa, Triticum aestivum
  unsure (1)..(91): unsure at all Xaa locations
  Clone ID: PAT_TA_94064.pep
LVPNSARAQPHHGMHTTHPWXARVWSGDAARAXSKRQRGRRAWPYSWXKKQGGRARQRAWRXRGLRRDARAXSMADTRGDKXNXRXXXXTR

SEQ ID NO: 199647 - protein, 143 aa, Triticum aestivum
  unsure (1)..(143): unsure at all Xaa locations
  Clone ID: PAT_TA_94065.pep
XPQDWPRLCVCPTSXVAAGAXQRALLQREGERPPSGTXRQPVKVASAPANGXPNEKLRINRXNMSTXVFXPFXNRXXXANPXSVLKQSCHATGGXFQAIXVGGARTRFNXPKGXNXGXQGSPRXXPXNQXSXQSVXDFXCSAF

SEQ ID NO: 199648 - protein, 159 aa, Triticum aestivum
  unsure (1)..(159): unsure at all Xaa locations
  Clone ID: PAT_TA_94066.pep
LVSSANSXVNMLETILIAVKAIXTAVVFVARSGRTASEXXIKCXKLSDRVKTLXTILSHYRRXNRDGPXMGTALDXLGVALXRXAXXRXSPTRAPPVXRFVSXFXXEGPXRARXRRPRRXKAASGTXSXPXKMMGILGKPWAXHRXAIXXKQLXQSXGP

SEQ ID NO: 199649 - protein, 53 aa, Triticum aestivum
  Clone ID: PAT_TA_94067.pep
KNVKLKKRNKKKHIFFLNKISFSSMIQTIQVRGRRYSKPLKTYEKNITQKTRD

SEQ ID NO: 199650 - protein, 60 aa, Triticum aestivum
  unsure (1)..(60): unsure at all Xaa locations
  Clone ID: PAT_TA_94068.pep
FLVXXQEQXRGPRXFLFXSIFXPLXLXPDISAXGTRYFRIVPHEXLSFPSCGIGXXLAAR

SEQ ID NO: 199651 - protein, 78 aa, Triticum aestivum
  unsure (1)..(78): unsure at all Xaa locations
  Clone ID: PAT_TA_94069.pep
MSCCGGNCGCXTACKCXNXCXXCNMXPEXEAAGATLLVSATATQKASSXXMEMAXENXGCGCTXCKCGTRCXCSCCSC

SEQ ID NO: 199652 - protein, 131 aa, Triticum aestivum
  Clone ID: PAT_TA_94070.pep
HLNKLIIERLPLALPPFSQNPSVYATGLLHFAPIYIAFEELWDNILHPSQCSSSLRSSFPPISFTGLPNPYTGNPSSPISDSSLPDIPRICSRSLLWSSTSGDYYVLDYALISKKINKRFKNKSCSVPQEL

SEQ ID NO: 199653 - protein, 154 aa, Triticum aestivum
  unsure (1)..(154): unsure at all Xaa locations
  Clone ID: PAT_TA_94071.pep
XSLFRXLNNNSEPXEQDCSYSXINDNLDLGCAIIXETVATRKXVEMIDGEIKHPFSQLRRQKELLGSGYYDAFPYTQGLARVPDALXPKPTGHLCAXQQRVYEDFITVWHSQSSQNAGATTSATAVTAAPGNSSIPRLYSLVPNSARARAEFGT

SEQ ID NO: 199654 - protein, 150 aa, Triticum aestivum
  unsure (1)..(150): unsure at all Xaa locations
  Clone ID: PAT_TA_94072.pep
PSQEITIARASCSGPEMDGPCNKALRREAAACVCQGEDDHPDAASCTSPSGASSGSSSCSLASDLGDGSSYSPPDDHSSGSSSASSSTLQLDSEAEGPLYELSSLLAQLPAXERVVQVLPKGSPNHSHRYLMLQCLQRPWERXVXYNKRD

SEQ ID NO: 199655 - protein, 80 aa, Triticum aestivum
  Clone ID: PAT_TA_94073.pep
MLIAASAVFLYYTAWTLLMPFVDSDHPLQNLFPPRVWAIRIPVILILLGSAVVGSFLSVVMIRSNRKRSAKAKISSKKKI

SEQ ID NO: 199656 - protein, 61 aa, Triticum aestivum
  unsure (1)..(61): unsure at all Xaa locations
  Clone ID: PAT_TA_94074.pep
SKYKSSLDAFXXILKXEXXKSLFKGXXXNILRAXAGAXVLSGYDQXLXILFFGKKYXSSGA

SEQ ID NO: 199657 - protein, 99 aa, Triticum aestivum
  Clone ID: PAT_TA_94075.pep
RAWDTTGKIDGGDSCKRIIVAPAMNTAMWNHPITAKQIKVLEIEWGIVDGNSTTNEGTTHGWFEVLRPMEKILACGDVGIGAMRSWEEIVVIIEQRLGL

SEQ ID NO: 199658 - protein, 101 aa, Triticum aestivum
  unsure (1)..(101): unsure at all Xaa locations
  Clone ID: PAT_TA_94076.pep
GHXPXSRGTDVSXLPAXXLXPAFXLHEDRRFHQRRXSXDTGVRDXXASXSXEXTGXVAAXXDXIAFXARXAPERDERDRRXXRGGPAPLFXKYRSCXIRHE

SEQ ID NO: 199659 - protein, 152 aa, Triticum aestivum
  unsure (1)..(152): unsure at all Xaa locations
  Clone ID: PAT_TA_94077.pep
FFCESQDAELRASLAQHSNAILTAVVQGVRKEEPNPEVRLAAIYALGDSLEFVDSNFKNEGERNYIMQVICEATQSPDIRIQQGAFGCLNRIMALYYEFMRFYMEKALFGLTISGMXSAEEDVAKLAVEFWSTVCEEENSXIRDDNAQIENA

SEQ ID NO: 199660 - protein, 149 aa, Triticum aestivum
  unsure (1)..(149): unsure at all Xaa locations
  Clone ID: PAT_TA_94078.pep
MMVQPQPPHTTYLSQPSCSNLHGRNTRHRSLLSPTHILSGQRELATHPRPRRSQALQRXNSXPRSRAAMQPWRRPLELQVVGXXASMERSPGLSTQRSSTXASEVXAGLQSSFXXAIARRELCQXWELKXXGDAKQLRREPSELWPELQ

SEQ ID NO: 199661 - protein, 141 aa, Triticum aestivum
  unsure (1)..(141): unsure at all Xaa locations
  Clone ID: PAT_TA_94079.pep
MSKQYLNSKTIXDAHATDIFTLAVTRSHILSASGASSIKVYDTTDSDYPLSQTLSGAHPLGCHHIVTSRNGNRAVSAGFGGEXKIWDYXESXGWVSAGDIVDGNKXAKIWAIALXEDGLTLASTSXTGRINVWDLPNGHKK

SEQ ID NO: 199662 - protein, 107 aa, Triticum aestivum
  unsure (1)..(107): unsure at all Xaa locations
  Clone ID: PAT_TA_94080.pep
FFFFGHLGDLLRXXVRPXVXAXPSXRIFKGRXERTGPDKSVRXYQXVKPXLRTXRFHGAKXLXKXRXVFPGXPPPSPLSITLPWXNPNPGAGNINRLPFRGTXQKCL

SEQ ID NO: 199663 - protein, 63 aa, Triticum aestivum
  unsure (1)..(63): unsure at all Xaa locations
  Clone ID: PAT_TA_94081.pep
GRSXCERTTFLLIXYRTXRFILGLLXGGXXXPSHLXNFFXXSPXFLFQSVLTVTXTRITVCIK

SEQ ID NO: 199664 - protein, 132 aa, Triticum aestivum
  unsure (1)..(132): unsure at all Xaa locations
  Clone ID: PAT_TA_94082.pep
MITSPIVAPTSVPSLSRRGSSFAVVCSGGKKIKVDKPLGLGGGLTVDIXANGRKVGKKGVYQXFVDKYXANVDGYSPIYTPEEWSESGDRYXGGTTGXLIWAVTLAGLLXGGXLLVYNTRSRRLREHLRVTQ

SEQ ID NO: 199665 - protein, 79 aa, Triticum aestivum
  unsure (1)..(79): unsure at all Xaa locations
  Clone ID: PAT_TA_94083.pep
MXAALSLRAPFSLRAVAPPAPRVXLAPAALSLAAAKXVRGARLRAQATYKVKLVTPXGEVELEVXPDDVYILDXAEEEG

SEQ ID NO: 199666 - protein, 135 aa, Triticum aestivum
  unsure (1)..(135): unsure at all Xaa locations
  Clone ID: PAT_TA_94084.pep
YNSTQGHNLCQERLVNSISLLDMTWVSDPDYQLLELRLSCEAFYVVHMYNEKPTSNLLSQLTLQSFLDLNPQMDKAILVPWEMSTYTILHGIQEVQNNTLLANNLMRYLDSGRAQIIINSXNKLKEDGXXHSKRA

SEQ ID NO: 199667 - protein, 115 aa, Triticum aestivum
  unsure (1)..(115): unsure at all Xaa locations
  Clone ID: PAT_TA_94085.pep
LVPNSARXXLSPSLXPSSSXSXKXIRRXXGESERNTCLFAFEXRAXAXXMGXXKRVXDXXXQEXRPXRXEXDGAXGLLLHXDPGGHXDEASAKXCSWCWKPLLXPXXARXRLKRG

SEQ ID NO: 199668 - protein, 101 aa, Triticum aestivum
  Clone ID: PAT_TA_94086.pep
LISMAIIAGAKTIHQVHATWKAGFMPVMKVSWISSPLALAFAQQFLPEHAWVPFFNIIGFFIGTYVNSVTKKKRLAALRKKHHDDNRKIRPDDGYGGNPKY

SEQ ID NO: 199669 - protein, 112 aa, Triticum aestivum
  unsure (1)..(112): unsure at all Xaa locations
  Clone ID: PAT_TA_94087.pep
RRXNXFKPITLEGXXFPXLGXSLIXFXDFLVSNGNPPGIVTLVXHXKNAIPAEXXQPVIXSGKKSLTYKMPFVIAFSAXFGVGVLFDQLVLSRYFGKSYLRFSDXPTNKLLL

SEQ ID NO: 199670 - protein, 70 aa, Triticum aestivum
  unsure (1)..(70): unsure at all Xaa locations
  Clone ID: PAT_TA_94088.pep
KLKRWAYKMXIQKKEXILINLEDIVPELSQRLKQKDSENCVAQKSKIVHGVGIKSESLKSSQXKTLLTQL

SEQ ID NO: 199671 - protein, 101 aa, Triticum aestivum
  unsure (1)..(101): unsure at all Xaa locations
  Clone ID: PAT_TA_94089.pep
RLYIPRLSPRVLSLVMEDCXVEISPDNFGSLAWRWFEHRCGVLDLMVEVLLDLNLHKMYLMLMMMILLXRAHASLMTRSAPMTRPSXWTRXKYFRPRXQLR

SEQ ID NO: 199672 - protein, 149 aa, Triticum aestivum
  unsure (1)..(149): unsure at all Xaa locations
  Clone ID: PAT_TA_94090.pep
AFELIVKQQIKRLEDPSLKCVSLVYDELVRILSQLLGKQLFRRYPGLKEKFHMVVINFFKKVMEPTNKLVKDLVAMESCYINTGHPDFLNGHRAMAIVNERHSATKPVQVDPKTGKPIXQQLLQAQXTTPNPDPLNDSNGGFFGSFFAS

SEQ ID NO: 199673 - protein, 89 aa, Triticum aestivum
  unsure (1)..(89): unsure at all Xaa locations
  Clone ID: PAT_TA_94091.pep
MKGTKLAXILILQAVLVMGVLSHVNADYFPKCCNNCRSFSGVDVCDDAHPKCPKGCSACRVVSXSPEMWRCADMKSTVDGTCGGPCKKY

SEQ ID NO: 199674 - protein, 125 aa, Triticum aestivum
  unsure (1)..(125): unsure at all Xaa locations
  Clone ID: PAT_TA_94092.pep
PQCLREGNKKTFFANXPKSCKRMKRTDEHVTSYLFAELGTSGSVDGSRRLVIKGRFQQKQIENVLRRYIMEYVTCKTCRSPDTELNKGENRLYFITCNSCGSRRSVTAIKTGFSAQVGKRRRQQG

SEQ ID NO: 199675 - protein, 164 aa, Triticum aestivum
  unsure (1)..(164): unsure at all Xaa locations
  Clone ID: PAT_TA_94093.pep
PLTQLPGSSAQHSEKMPPPIPNVAPSPFTPLDMPPPPLSPPPLPVSEPPSVPPPPSSPPAQPSTDPCNSQKPCPQPQWQGSLTKSGIHYCTIYASRIELDACRYESTVSEPSXWASRLDVLKRTAFQXHAKTIISNGPPNKKRSLGGFEWSKGPGIYLLSGKLE

SEQ ID NO: 199676 - protein, 61 aa, Triticum aestivum
  unsure (1)..(61): unsure at all Xaa locations
  Clone ID: PAT_TA_94094.pep
GXGVSAGMSSFVRRVXPXPRRQRRRRALPLLRHRHARCTHDQKRKGDAHTHTHLDQTRIYP

SEQ ID NO: 199677 - protein, 51 aa, Triticum aestivum
  unsure (1)..(51): unsure at all Xaa locations
  Clone ID: PAT_TA_94095.pep
HLPXRPXIXPXQXDRPAPRHRFASSSGCRSLAGVRLSMIGXDGEARPXFGT

SEQ ID NO: 199678 - protein, 66 aa, Triticum aestivum
  unsure (1)..(66): unsure at all Xaa locations
  Clone ID: PAT_TA_94096.pep
RLXLSTRAHKHFHGXXLPSSXNPPPPRLLRTLRXVXVXKVDRAXXKAXVLGXRXXEXAXTXEXGGG

SEQ ID NO: 199679 - protein, 58 aa, Triticum aestivum
  unsure (1)..(58): unsure at all Xaa locations
  Clone ID: PAT_TA_94097.pep
MKSTVVALLLLVAVQCLALGPGTXAGXKPRRTRQGDYLXRLRGSPSSRXSWEXLAGRG

SEQ ID NO: 199680 - protein, 74 aa, Triticum aestivum
  unsure (1)..(74): unsure at all Xaa locations
  Clone ID: PAT_TA_94098.pep
TXVANXEAXAALKSIIPPXLWYLSLHPLDXLTETVYFEDIDPTQQARAQGATAMDEDDEDGHPAGAERVQCASQ

SEQ ID NO: 199681 - protein, 62 aa, Triticum aestivum
  unsure (1)..(62): unsure at all Xaa locations
  Clone ID: PAT_TA_94099.pep
QYPPPQAIATXTPAPRATPATSSKRERQHKSCQEERISSWATLTKSYQWEANGWGLXGXGGG

SEQ ID NO: 199682 - protein, 160 aa, Triticum aestivum
  unsure (1)..(160): unsure at all Xaa locations
  Clone ID: PAT_TA_94100.pep
MXPTVMXSSXNSVAPFXGLKSXAXLPVSRRSNGASLXSVSNGGRXRCMQVWPIEGIKKFETLSYLPPLXTEXLLKXVDYLIRSKWVPCLEFSKXGFIFREHNASPGYYDGRYWTMWKXPMFGCTDATQVINXVEEVKKXEYPDAYVRINRXSTTMRQGAV

SEQ ID NO: 199683 - protein, 131 aa, Triticum aestivum
  unsure (1)..(131): unsure at all Xaa locations
  Clone ID: PAT_TA_94101.pep
MGPTXMASSGXSVAPFQGLKSTAXLPVXRRSNGASLGXVSNGGRXRCMQVWXIEGIKKFETLSYLPPLXTEXLLKXVDYLIRSKWXVPCLEXFNKXGFIFREHNASPGYYDGRYWTMWELPMFGCTGRHTR

SEQ ID NO: 199684 - protein, 130 aa, Triticum aestivum
  unsure (1)..(130): unsure at all Xaa locations
  Clone ID: PAT_TA_94102.pep
MAPTVMASSATSVAPFQGLKSTAGLPVSRRSNGASLGSVSNGGRIRCMQVWPIEGIKKFETLSYLPPLNTGXLLKQVDYLIRSKWVPCLEFNKVGFIFREHNASPGYYDGRYWXTMWXKLPMFGCNRHNK

SEQ ID NO: 199685 - protein, 154 aa, Triticum aestivum
  unsure (1)..(154): unsure at all Xaa locations
  Clone ID: PAT_TA_94103.pep
MXPTVMXSSXTSVAPFXGXKSXAGLPVSRRSNXASLGSVSNGGRIXCMQVWPIEGIKKFETLSYLPPLXTXXLLKQVDYLXRSKWVPCLEFXKXGFIFREHNASPGYXEGRYWTMWXLAMFGCTRRXTKVXNEVGXXKKGXPDAYVRNXSGFDX

SEQ ID NO: 199686 - protein, 154 aa, Triticum aestivum
  unsure (1)..(154): unsure at all Xaa locations
  Clone ID: PAT_TA_94104.pep
VSDKIKLIDNLLGKVDSLIICGGMAFTFKKTLENVNIGDSLFDKAGSETVGALVEKAKKNKVKIVLPVDYITADKFAKDAKTATATDEEGIPXGWMGLDCGKKSIELYKAAIGEASTILWNGPPGXVFEFDAFANGTKETPICSGRPAQQRKCD

SEQ ID NO: 199687 - protein, 95 aa, Triticum aestivum
  unsure (1)..(95): unsure at all Xaa locations
  Clone ID: PAT_TA_94105.pep
ALFLIILQHKGPTSSGQVFGFVAAGTEIINALPSLDSKIMXETAAKDIKIDPTVQVDLSTIPISPDGGNXDESKNKXXENVKSLDEQITSISRPX

SEQ ID NO: 199688 - protein, 156 aa, Triticum aestivum
  unsure (1)..(156): unsure at all Xaa locations
  Clone ID: PAT_TA_94106.pep
SSSLRKYXXPMXVQPAXKPGLASRPRXSLPKPSXXPSSSSSSGLXPLXXKRXALRSLRXLXAAAAGGAVXAGEPYXGLGDEEPLGGERDAGTVAGSEEYKXXVPEKQXPMLXVKFXWMGEKQSXXXLAKMXPGVGNXPLARTNFLGRGEKFNGGTG

SEQ ID NO: 199689 - protein, 67 aa, Triticum aestivum
  unsure (1)..(67): unsure at all Xaa locations
  Clone ID: PAT_TA_94107.pep
PLPCVTTTGKNREKPMSNQVYFHHSMGTISPPESDVWVLLYSNQLSPSHEWDRCSSYPVSTHXIGPD

SEQ ID NO: 199690 - protein, 77 aa, Triticum aestivum
  unsure (1)..(77): unsure at all Xaa locations
  Clone ID: PAT_TA_94108.pep
GGGRGXGAGGSVGRGGRGGGGRAAAGGGGGXGGGAGSGSXEGVGGGKRHGGGCGRWSEXGGGDGRAWTSRRRGEECG

SEQ ID NO: 199691 - protein, 80 aa, Triticum aestivum
  unsure (1)..(80): unsure at all Xaa locations
  Clone ID: PAT_TA_94109.pep
LQEFGTNSCRIRXXRERYLPCICHIYVDHTSHCYNSTFILETFAQPCRQKMYLKGEDVLXHNTKRKLLGYYPRRPIIIIL

SEQ ID NO: 199692 - protein, 76 aa, Triticum aestivum
  unsure (1)..(76): unsure at all Xaa locations
  Clone ID: PAT_TA_94110.pep
XSXXGIIXPPSXXVNXKLRXSHPXVXXPXLREXVVSPPGXQPSFPNSGHGASXPNFXQRAFASPGGTHLVFRSRPA

SEQ ID NO: 199693 - protein, 82 aa, Triticum aestivum
  unsure (1)..(82): unsure at all Xaa locations
  Clone ID: PAT_TA_94111.pep
LEXXPGLVLGNPFXPAXLASSSYGKIQSCCKHTGLSFTFLSRIGDNVQQADYHNGLLYEAYFSHNSHFSKFCTYTDHALFEG

SEQ ID NO: 199694 - protein, 157 aa, Triticum aestivum
  unsure (1)..(157): unsure at all Xaa locations
  Clone ID: PAT_TA_94112.pep
LSHLKIDVPSLIRHQHXISPRSSLSDYLSTYRLALVVSIPLLFSLILFWPLTHLKATLVLYYNFFPMVYLGFVVGVFCLPARGLAASGRSQFLSMLRRISIGGLALSKNMKFADILLAXDVLTSYSKVLSDFFAAIWALASSTLTGDASACAGRTLS

SEQ ID NO: 199695 - protein, 177 aa, Triticum aestivum
  unsure (1)..(177): unsure at all Xaa locations
  Clone ID: PAT_TA_94113.pep
GEXEEATMGANXSPMGVSXXCPWALAPSPIGIVARXSTRCPKAPPVPKGQSPDLEGKADRLKGGLGXSXSXREAQXCPGXXTXEXERXLVGGQRXWXVTKVSHIXXSGEGKXPXPGLPALPPREXSXPPGXTFRPXLAPXLXXVXKVRXARFKXGXLLXXNSXXGGSFXTPKXXRRL

SEQ ID NO: 199696 - protein, 139 aa, Triticum aestivum
  unsure (1)..(139): unsure at all Xaa locations
  Clone ID: PAT_TA_94114.pep
LVPNSARXGFDTDIGXFIESSSVSXPLXPMXSSLVNHDVVRDETFLPXQIFVLGGFALRANSFXHLEQDRRXHPWXSRXGLXGLNYTADIRGDLIFDGFEPRPGAPHGHEGHDLFLASGNXQXXPSKRXPPTIXFGXPL

SEQ ID NO: 199697 - protein, 146 aa, Triticum aestivum
  unsure (1)..(146): unsure at all Xaa locations
  Clone ID: PAT_TA_94115.pep
MAXEKESXXVPLNQXAAEXVDPXDPGKSPPRPXSPXTSXRKXCCAVLQEXWCPRKFMTXCVGLFPVAFTXFFITWGFVQFVDGFFNPLYAKLGXQXILXLXFLXSLGNSIFLAGKYLFLSXGGVQLAFWVGNGFKEKCPILWEATY

SEQ ID NO: 199698 - protein, 139 aa, Triticum aestivum
  unsure (1)..(139): unsure at all Xaa locations
  Clone ID: PAT_TA_94116.pep
RGTKLAAILILQAVLVMGLLSHVNADFFPKCCNNCRSFSGVDVCDDAHPKCPQGCSACRVXSTSPEMWRCAXDMKSTVDGTCGGPCKKVLIGSCRHDMFPPKNKNKKLKAKMSKRHPCLCVCVWAKQLYTNMSSSSCVF

SEQ ID NO: 199699 - protein, 132 aa, Triticum aestivum
  unsure (1)..(132): unsure at all Xaa locations
  Clone ID: PAT_TA_94117.pep
RDVAGPDRPGKPFRXWLTKRNPXGRRTHSLAXTPXGGRSXAIGXLPPVLNEGXXKARGXWSILXTXXHXDVCXPCAARQAGHHGVFALSPRSLVEKEPIXRXGTIYXFLXTVSXCPXFLMMMLCXCFXPEFP

SEQ ID NO: 199700 - protein, 107 aa, Triticum aestivum
  unsure (1)..(107): unsure at all Xaa locations
  Clone ID: PAT_TA_94118.pep
MSQEGQTRAVLIQDTPRWLLEFQKLEKEDLIVLITPVANPVSQDYTDISDPFEPLXRSISSRHAKIAHVPYIQRKGLTSTHVGFIEXCKLIIFCLLPQPDRSLQATH

SEQ ID NO: 199701 - protein, 118 aa, Triticum aestivum
  unsure (1)..(118): unsure at all Xaa locations
  Clone ID: PAT_TA_94119.pep
TNKYPLGRTKKRAXTSVVVLNCSCXSQLFLPXSXXLQHHPRAERGEEKXSAMXADGEKWXXLXVDFXAGSRXALQWXADNXLRSGRQPAPPAXPQGXXLXAGGDPPLGXLRLXFXXPL

SEQ ID NO: 199702 - protein, 104 aa, Triticum aestivum
  unsure (1)..(104): unsure at all Xaa locations
  Clone ID: PAT_TA_94120.pep
SHCRFHQEXSLFPPDFQCKKXPKSPSSLSVEKRVPKTLYHLPRTRKIPKVTIKKGNCAXPKIHTSTGAVETPKSEHKNVGSPGXVNSSENPLHLNTNLIDKNRX

SEQ ID NO: 199703 - protein, 80 aa, Triticum aestivum
  unsure (1)..(80): unsure at all Xaa locations
  Clone ID: PAT_TA_94121.pep
FVRIVYLVYPYGRFLGLNRSPVNPKNQLRMLQNGPLRLSCALRSMNKTPYTITIRIELNCAILTPLTHXGSCPFQFRSSF

SEQ ID NO: 199704 - protein, 112 aa, Triticum aestivum
  unsure (1)..(112): unsure at all Xaa locations
  Clone ID: PAT_TA_94122.pep
PNLNPAFGXNNPPFRQAGRXXRKEGPATGXGPFPKQXCXKPGMGEMGTAALVSGXQINXGRXCGXXNAASVEPATTLAXRPLXRPGXPFRXFFPFLFSAXRFRPGFSPGQSF

SEQ ID NO: 199705 - protein, 141 aa, Triticum aestivum
  unsure (1)..(141): unsure at all Xaa locations
  Clone ID: PAT_TA_94123.pep
VLWEVDGHWVVQGAVDVDIGANPSAEGGGDDEGVDDQAVXVXDIVDTFRLQEQPAFXKKQFISHMKRYIXNLSAKLXGDDLDAFIEKMLTSATKYXLLXKLKXPSVPLVXEXMHXDXXXGVXAYYXGGSWXXPTFLYXXHG

SEQ ID NO: 199706 - protein, 75 aa, Triticum aestivum
  unsure (1)..(75): unsure at all Xaa locations
  Clone ID: PAT_TA_94124.pep
MPPQRIQXXTXSRGXRPNLGXFSSHXKXXIXGXPNVGKSTXFNKRTKXSIPXXKFPIWXXMEPNEXRXHVPGERI

SEQ ID NO: 199707 - protein, 131 aa, Triticum aestivum
  unsure (1)..(131): unsure at all Xaa locations
  Clone ID: PAT_TA_94125.pep
MSTTQHPEICWAQRSHVXDPEKNLLYLTIVATDVPKESMKMEINPQSISFTGENPKTKINYXFKIELYRRNRHRSYQGLCTPRGVFKLTLRKKXLHKEYWARLXKDSKKNASIKTDFDKWVDEGFTRASAF

SEQ ID NO: 199708 - protein, 83 aa, Triticum aestivum
  unsure (1)..(83): unsure at all Xaa locations
  Clone ID: PAT_TA_94126.pep
VXDVVGWKTKAPCNVDLDAXGDGVPXDESGXGXAGRGTEXLREDGGEDEEXHRRGXXXAAAEVVAXVVRRASTRASLLPVSXV

SEQ ID NO: 199709 - protein, 81 aa, Triticum aestivum
  unsure (1)..(81): unsure at all Xaa locations
  Clone ID: PAT_TA_94127.pep
LGGLPXGRRXFRARAGRHRGEKSAQEARDGRLXXPPSARLISXGRVRVRGRKGLTXRFRLXPRTRAKKFCTXALVREFGTS

SEQ ID NO: 199710 - protein, 191 aa, Triticum aestivum
  unsure (1)..(191): unsure at all Xaa locations
  Clone ID: PAT_TA_94128.pep
XXKNXLKIFGPKPXHSRKGPXSFEXEXACWRAFXQSIPPKSLXLVISXKVPFIQEGGKIALFVPGIGGSIPLNAHPRQRPIFLFVLSWTLVLLSVAWDGTGAWPGLGCAWADRLRXDGRRLNSPGGARGWKKPEVGLTSRGVAPATSALGALAPPAWRRSPPDGPPGPDGLSSTTEXXLIFSFSRXRRRLX

SEQ ID NO: 199711 - protein, 160 aa, Triticum aestivum
  unsure (1)..(160): unsure at all Xaa locations
  Clone ID: PAT_TA_94129.pep
TGMXQFLAWNSTSSSWNVFIEXPNPSCDRYAYCXPFGYCDATETVPKCXCLSGFEPDGVNFSQGCRRKEELTCGGGDSFSTLSGMKTPDKFVYVRNRSFDQCEAECRNNCACTAYAFSNMKNGSTSSDQARCLIWLGELVDTGKFRDGSGENLYLRLASS

SEQ ID NO: 199712 - protein, 71 aa, Triticum aestivum
  unsure (1)..(71): unsure at all Xaa locations
  Clone ID: PAT_TA_94130.pep
MSSVXXGDXXGXFFGFLGAXAALVFSXMGXXYGTAXSGVXVXSKGKSMRPXVXMXSIXPXRQXGEVGNPLN

SEQ ID NO: 199713 - protein, 153 aa, Triticum aestivum
  unsure (1)..(153): unsure at all Xaa locations
  Clone ID: PAT_TA_94131.pep
RIRVPLRKIIXXRLTHRHRRXASGSLTTSPLKSPLKIPLNDDVQEKGKRLQSRYAXQDIQMNQIKAAASPIRKHANLXQAISSPPRTKPKTPRRSSDEKDPDDELFKVVGNAVTPMKRVPILANFEEWMKMATDNKINATNSWDFALIDYFHD

SEQ ID NO: 199714 - protein, 156 aa, Triticum aestivum
  unsure (1)..(156): unsure at all Xaa locations
  Clone ID: PAT_TA_94132.pep
LVPNSARARAEFGTRGEEHPLTIWTSTLKRTIATARHLPVAYNQLQWKALDELDSGVCDNMTYAEIKEEFPEDFEARDHDKYNYRYRGGESYRDIVXRLEPIIMELERSENILIXTHQAILRCIYAYFMNKDXXXSPWMNVPLHTLIKLTPNAYGL

SEQ ID NO: 199715 - protein, 118 aa, Triticum aestivum
  unsure (1)..(118): unsure at all Xaa locations
  Clone ID: PAT_TA_94133.pep
LPARGWIFDTASRSYKSEREPLTGXIXDWVXDVAWSPTFLQKSYIASASQDKTVRIWTSXPSQPGNWNSKVLQFEVVIWRVSWSLSGNVLAVSGNDNTVSLWKEDLKGEWNCVKTIEE

SEQ ID NO: 199716 - protein, 166 aa, Triticum aestivum
  unsure (1)..(166): unsure at all Xaa locations
  Clone ID: PAT_TA_94134.pep
HSLLLHPSRXHTPPXSPSXIGRRLRLXLLPSHSREXXTPRGPPLDRLFLPSXQIHGARALTLARDPXLCLGXWXGHXLCXWWTPAGPLRFLPRPHXAGPLPAGYXAWLGSRRQEXSQXLAASPXSIKXFLGXEPGXXXLSLPGPLSQXXKATXTRLNLKAXFFNPX

SEQ ID NO: 199717 - protein, 119 aa, Triticum aestivum
  unsure (1)..(119): unsure at all Xaa locations
  Clone ID: PAT_TA_94135.pep
MASRFHSNLHQRSDPRDALFENYQPTAGGSAGKARRSPAPPGEMRGAGAXSMSGSVGYDTXPRWNGWADVGQXGGAVGFXTATPNKQGQYSDXVLSSLESQNDSQVXGIIGKVRQLKSI

SEQ ID NO: 199718 - protein, 62 aa, Triticum aestivum
  unsure (1)..(62): unsure at all Xaa locations
  Clone ID: PAT_TA_94136.pep
VVISVNRFAIQYSVEXPWNVTRRQAQNLLTVLXXEVWNNYSRMEYFFFYSLLSGFLGLIXKF

SEQ ID NO: 199719 - protein, 150 aa, Triticum aestivum
  unsure (1)..(150): unsure at all Xaa locations
  Clone ID: PAT_TA_94137.pep
HICXXRXEXTPGNXFXPXXXAGGXDXXRXAQIEARXRTGXTTPAVCCXSPRXQPGAXXSTSXRRXAPAXAPRXRSPRXPRRVGTHQPRGRRRQGSPPWRPWSSCTSPSRSXSXAGADLXPAXWRWRXGRRXWXPRRRXMVXIWLLCFALL

SEQ ID NO: 199720 - protein, 116 aa, Triticum aestivum
  unsure (1)..(116): unsure at all Xaa locations
  Clone ID: PAT_TA_94138.pep
LSLSLVAAAVVAQEDNGTWVGPTHPISPLALHPSPTSYTTSTIYTTTVFTVTSCAPAVTFCPERXSVVTKTVSLYTTVCPVSKRGSPXPPPEPTPTSFVSTVKTIVRTVTSCPPSA

SEQ ID NO: 199721 - protein, 155 aa, Triticum aestivum
  unsure (1)..(155): unsure at all Xaa locations
  Clone ID: PAT_TA_94139.pep
SLDRQVLLKKLRDVLDTLKGRVAGRNRDDADEAISLVEALAVQLTQREGELIYEKAEVKKLASFLKQATEDARKVAEEERALALAEIEKSRAAIEKVEKALQEQDSASSXREXEXIEELMKXIREARRIKMLHXPCKVXXMQFELGTAVHLSKKH

SEQ ID NO: 199722 - protein, 54 aa, Triticum aestivum
  unsure (1)..(54): unsure at all Xaa locations
  Clone ID: PAT_TA_94140.pep
RGVNTTPPIGANWXPGPPSRXNDKCASKISRGAHDDEISCFGRQRVINLDSDSS

SEQ ID NO: 199723 - protein, 58 aa, Triticum aestivum
  unsure (1)..(58): unsure at all Xaa locations
  Clone ID: PAT_TA_94141.pep
VGXTVCXPQNTXXYVRERPRWMXXXSWYGVTGREVXCPRXPACQXXPRRRVRPSXMXW

SEQ ID NO: 199724 - protein, 151 aa, Triticum aestivum
  Clone ID: PAT_TA_94142.pep
MIENDKYGNGPESDSDSGAGSDCHEDNTVQPLKSSLKSVTIQAPIVKTILPPQTEPKDLDVKSLTPLTPEIIARQATINIGTIGHVAHGKSTVVKAISGVQTVRFKNELERNITIKLGYANAKIFKCDNEECPRPGCFISYKSDKEVDPPC

SEQ ID NO: 199725 - protein, 62 aa, Triticum aestivum
  Clone ID: PAT_TA_94143.pep
DHANSRIPEEYLVCYQMSQLNWVIIKMLYRYLRRCLLSWHGSRLGFFTPCIREVSPRAEFGT

SEQ ID NO: 199726 - protein, 51 aa, Triticum aestivum
  Clone ID: PAT_TA_94144.pep
GFALLELEITRQSRVPLCSKLRSERKILISWRCLFAHESISALWSNFFIQS

SEQ ID NO: 199727 - protein, 89 aa, Triticum aestivum
  Clone ID: PAT_TA_94145.pep
QESTKSSKGSNTLAARKPYQSKSLYNLSLVISSYPNEGEKKFAPTIGNYIWQAGWKFVGKTSLKNGRKRQERPSHTNNGLSPGQNKRQI

SEQ ID NO: 199728 - protein, 61 aa, Triticum aestivum
  unsure (1)..(61): unsure at all Xaa locations
  Clone ID: PAT_TA_94146.pep
PRPERRPEDXEQQRAQLVEQARLXRLRRRSXRXHASSXAXAREPGXSNLRRRGAGRGGTAA

SEQ ID NO: 199729 - protein, 159 aa, Triticum aestivum
  unsure (1)..(159): unsure at all Xaa locations
  Clone ID: PAT_TA_94147.pep
AAVQSPARSPPPPAAMASTFSGDETAPFFGFLGAAAALVFSCMGAAYGTAKSGVGVASMGVMRPELVMKSIVPVVMAGVLGIYGLIIAVIISTGINPKAKPYFLFDGXYAHLSSXLACXLAGLAAGMXIXIVXDAGVRGNAQQSXLFVGMXILIXIFGR

SEQ ID NO: 199730 - protein, 163 aa, Triticum aestivum
  unsure (1)..(163): unsure at all Xaa locations
  Clone ID: PAT_TA_94148.pep
FFFNLXNQNRASFSFEKNSCFIHSTRLQRVPXQRKGIHXKATAGQRADPHQNTSPSPEHXEAXEDAMLTXMXAEVASPPCLRIQELXESTDPRGXKLLLHPTLPPSXRXAKTPTXPRMQPTXGWXNHHQPTSLLTPXQEGEHPHGGKAXGLKIAASRKPPATP

SEQ ID NO: 199731 - protein, 98 aa, Triticum aestivum
  unsure (1)..(98): unsure at all Xaa locations
  Clone ID: PAT_TA_94149.pep
YXXEMXTXXPXLQAKYPXKPXSIXLKTIQRSYMXAPIILNKPYLXENSLXSXRPXXXRIXRGALXYGXMQDYRNVSEXXVLRGXADXSHGSSXKSNRM

SEQ ID NO: 199732 - protein, 74 aa, Triticum aestivum
  unsure (1)..(74): unsure at all Xaa locations
  Clone ID: PAT_TA_94150.pep
IHPDVETGQTGGPRPSRXHGHXCKNELSGVXXLGWQVXPGARXSGWXWRXRRAXPERASARDRSLLWRACXTCV

SEQ ID NO: 199733 - protein, 84 aa, Triticum aestivum
  unsure (1)..(84): unsure at all Xaa locations
  Clone ID: PAT_TA_94151.pep
KTXWXQGXSXXRDSMCVWGHVQPSKVQRGVPPQGXSXTNKLNGGGQXAWLRSSNNXRXKPSKXXSLGSMXXGXTXSQTGQPPSR

SEQ ID NO: 199734 - protein, 63 aa, Triticum aestivum
  Clone ID: PAT_TA_94152.pep
LCPFTRHMVSDVENLQIVYFFLSNKHFESKSLVLRNTRLMHAPAQKSPRNLFLSVQVQLALDS

SEQ ID NO: 199735 - protein, 80 aa, Triticum aestivum
  unsure (1)..(80): unsure at all Xaa locations
  Clone ID: PAT_TA_94153.pep
FFFFFFFXVRDCPYIIVYNYLECKYWILSLISLTALTEATDLIKGPHEGAALPQACRVCIVCREFSTCLKRLHLVPNSAR

SEQ ID NO: 199736 - protein, 158 aa, Triticum aestivum
  unsure (1)..(158): unsure at all Xaa locations
  Clone ID: PAT_TA_94154.pep
HPWXASIPCRAAPCSXGXRLXXRKXKATGAXSFGXRASXFXDGXGLXLGLXQKPXXIISXEWAENFXLLSYEELXAYLXSQQXEAXRSTFPRCRXIKGXAPXRGHVTPVPDGHKRASXGGGLXGTFHSXXQGPPXLVDXNSQXXSXGRXXKXELXEGG

SEQ ID NO: 199737 - protein, 99 aa, Triticum aestivum
  unsure (1)..(99): unsure at all Xaa locations
  Clone ID: PAT_TA_94155.pep
SCRIRHENLRSIKPLDVESIINSVKKTHRLLAVESGFPAFGVGAEILALTMEYGFDYLDAPXQRITGADVPTPYAQGLEDLSFPNETLVENFAKKLLKI

SEQ ID NO: 199738 - protein, 130 aa, Triticum aestivum
  unsure (1)..(130): unsure at all Xaa locations
  Clone ID: PAT_TA_94156.pep
MXQKDAANGNGXNXRPPXNPSPIRFSKFFXANMXXLVTGGAGFXXSHLVXKLMENXKNEXIVXDXFFTGXKDNLXKWXGHPXIVXIRHEVTXPMXVGXGXKSTKLACPASXIFXXHKXCXDIKTXGHLGW

SEQ ID NO: 199739 - protein, 141 aa, Triticum aestivum
  Clone ID: PAT_TA_94157.pep
QNFTRLNWITYHLKSKDESGSCKLRDLHNVAQNWRETRLNTDEKVAPLRLIYQLDDENSLVERNIFNSSPSVEVIEELMHKANAFVAQKIFKGLPEKAFLRRQSAPKPGRLQTFAERMNLIGHVIDTTSSGSVQNSLFKIE

SEQ ID NO: 199740 - protein, 72 aa, Triticum aestivum
  unsure (1)..(72): unsure at all Xaa locations
  Clone ID: PAT_TA_94158.pep
ILPWVXLXKXCPXXRXELPSDETKNLXEPNNVGXLESKHXXXRTDXPXNNGGGSNTXDREGSNRXWAPXSXV

SEQ ID NO: 199741 - protein, 71 aa, Triticum aestivum
  Clone ID: PAT_TA_94159.pep
AVGRPAQKFTMGRLILFIQIDAADKTDCCGLVEVLILLRKSKGFIPCIGYALISDFQALDLSYRSCRIRHE

SEQ ID NO: 199742 - protein, 93 aa, Triticum aestivum
  unsure (1)..(93): unsure at all Xaa locations
  Clone ID: PAT_TA_94160.pep
MNRGGPRKVLLPPINLIFKLLQQRSTVIVWLYEQLATRIEGKIRGFDEFMNLVLDDAVEVRQATKTKRXKARRSLGQILLKGDNVSLIQSLNG

SEQ ID NO: 199743 - protein, 54 aa, Triticum aestivum
  unsure (1)..(54): unsure at all Xaa locations
  Clone ID: PAT_TA_94161.pep
XVPNXARARAGQDYSSSXXPRAPAEKIKQVSXXHAQSRXKLSSLXRLPTXIVGX

SEQ ID NO: 199744 - protein, 79 aa, Triticum aestivum
  unsure (1)..(79): unsure at all Xaa locations
  Clone ID: PAT_TA_94162.pep
HERQLLEETDMSPADVAENLMPMSKKKKKDPNMCLAGLIAALKQAKKDAVTTAAVAKAKEEEEAEAKKAXEKEEPKEDK

SEQ ID NO: 199745 - protein, 163 aa, Triticum aestivum
  unsure (1)..(163): unsure at all Xaa locations
  Clone ID: PAT_TA_94163.pep
ARXCRIPERXXVWWLLNKXIGNHPTKQSKRANLXWQDWQENGRGGNLVNLPNXXQCXGFPNPXPKSQMLAQCSRGFEGRGLLTSSPWLASSCCXSRTPKLTXGREGXTXPPAGGRLAPTATGLXXXRXXARXXXQXGRGXATXXTPSTKKWELXXNKWXXXQN

SEQ ID NO: 199746 - protein, 100 aa, Triticum aestivum
  Clone ID: PAT_TA_94164.pep
EGPVWTPSRMAEVLGVNVLMTKRSFCQGNFGHAGITEVFFLKPDYSVMTCLLMGKRLGTLASRINLGLERRWTFGMGLFTSSLRAHRRGESLLIGDIRYG

SEQ ID NO: 199747 - protein, 141 aa, Triticum aestivum
  unsure (1)..(141): unsure at all Xaa locations
  Clone ID: PAT_TA_94165.pep
MASMXTSPIVXPTSVPSLSRRGSSXAVVCXGGKXXXVDXPLGLGGXLXIDIDXNGXXVGKKGVYQFVDKYGAKVDGXKXNLHPKEWXESGDRYAGGTXGXLIWGGQPPPGLLGGGGGPPRLQKKLRRGKEKDLVKKAGSCL

SEQ ID NO: 199748 - protein, 52 aa, Triticum aestivum
  unsure (1)..(52): unsure at all Xaa locations
  Clone ID: PAT_TA_94166.pep
GSGGSVIALAFNLXVYXGSXGRWXXXVHLXCFXVRVSXMCWFEKYGVPLFIT

SEQ ID NO: 199749 - protein, 140 aa, Triticum aestivum
  unsure (1)..(140): unsure at all Xaa locations
  Clone ID: PAT_TA_94167.pep
IDKAXGAXTRVXVAPSPSXVAXXASRNGRYALAHVGPAXRTHPLLKLXRRNYXVAGSSGGGKVSPRPWXEXQRIXXGVCXPXEGVXKRWTSMGPSXSGEXXNLSXRXTXIXGXSSPGTPVGXAXXPPSSKGQWEXPXSXK

SEQ ID NO: 199750 - protein, 46 aa, Triticum aestivum
  unsure (1)..(46): unsure at all Xaa locations
  Clone ID: PAT_TA_94168.pep
XFXXERDSXWGFXXYXLQVGVCXIXGYFXXINQGXXVFLLKKKKKN

SEQ ID NO: 199751 - protein, 78 aa, Triticum aestivum
  unsure (1)..(78): unsure at all Xaa locations
  Clone ID: PAT_TA_94169.pep
GXRLIIXEXGGSXPFXXEXXXGXXLXSVXPGEXAXEAAVLXXPPXISLSSCTETXRLGXSYSXSXVEPNPNRTRTRTG

SEQ ID NO: 199752 - protein, 142 aa, Triticum aestivum
  unsure (1)..(142): unsure at all Xaa locations
  Clone ID: PAT_TA_94170.pep
TGDLEXFNFTGAXGVXMAMYNTNXSIPXFAXAXXAIXYXKKWXLXLNXKNTXLNKYXGRFKDIFXPDLXKLAGXSKYEAXAGIWDEXXLTQRHGCLCXLXNERXGYVWXLQXNYXGRLCXNDFLXSKXFXLLWGLMTSVIDC

SEQ ID NO: 199753 - protein, 86 aa, Triticum aestivum
  unsure (1)..(86): unsure at all Xaa locations
  Clone ID: PAT_TA_94171.pep
FXRXVXRRWRXAETXRDSSLMSQXXATEXNPPGRGPPPXTXNPGAPPXGAAHRGPSXPRPSSXXGRVGLRCXAXRAMRCEGELPSG

SEQ ID NO: 199754 - protein, 67 aa, Triticum aestivum
  unsure (1)..(67): unsure at all Xaa locations
  Clone ID: PAT_TA_94172.pep
GRAXTXPRXXVXXPXXCXPLXXEPSLLPRGVHVVGXHFCXGFKNXKAGGGSSCPGERSCRXVPNSAR

SEQ ID NO: 199755 - protein, 93 aa, Triticum aestivum
  unsure (1)..(93): unsure at all Xaa locations
  Clone ID: PAT_TA_94173.pep
MGIDLVAGGRNKRTKRVAPKSDDVYLKLLXKLYRFLVRRTKSKFNAVILKRLFMSKTNRPPLSMRRLSNFMKGXGGEEHCCGLVVQSQCVSHQ

SEQ ID NO: 199756 - protein, 153 aa, Triticum aestivum
  unsure (1)..(153): unsure at all Xaa locations
  Clone ID: PAT_TA_94174.pep
ADAADPRIVATIDEISATTPDPARRRDRVTQDDQATLLYSSGTTGPSKGVVATHRNLISMVQIVMNRFRLEDSDTTETFLCTVPMFHVYGLVAFXTGLLGCGATIVVLSKFELPEMLRCINAYGVTYLPLVXAHPRPPWFAPKGGASGNCAVS

SEQ ID NO: 199757 - protein, 108 aa, Triticum aestivum
  unsure (1)..(108): unsure at all Xaa locations
  Clone ID: PAT_TA_94175.pep
MAXKRILKELXDLQKXPPTXSCSAGPVXXDMFHWQXTXMGPSDRPFXGEPNFWLNIHFPPXYXXRXXRKGXFPHQRXFHPQHQXXGGEFGLHFTMPPFGRKGWNFSTQ

SEQ ID NO: 199758 - protein, 94 aa, Triticum aestivum
  unsure (1)..(94): unsure at all Xaa locations
  Clone ID: PAT_TA_94176.pep
XRGFFFFFFFFFFFLRNLIHLLYIFCGEIXSPIHVLWLQLTNQDGTNSSWFHDTXXRSYXQQYKQPRRYFDWXXXTVPIYXXQXTSIWYTHNLN

SEQ ID NO: 199759 - protein, 126 aa, Triticum aestivum
  unsure (1)..(126): unsure at all Xaa locations
  Clone ID: PAT_TA_94177.pep
WXRXXHEXSFXPXPHXXGXGGGRKARXRAFAXXAEIGGQXPIHIKITVKXTVPVXHGTSSPDSKKACPWFGXXKNCXXGKTGFQPNPERXPXLXKNGXPXWGXGXTLQNTGXXKXSXXXRGXXKXK

SEQ ID NO: 199760 - protein, 129 aa, Triticum aestivum
  unsure (1)..(129): unsure at all Xaa locations
  Clone ID: PAT_TA_94178.pep
SFPFLAAAAASPLEADPTMADVDVDTEVAAGAQPKKRTFRKFSYRGVDLDALLDMSTDDLVQMFPARARRRFKRGLKRKPMXLVKXLRKXKKDAPAXEKSXPVRTHLXGXIIVPEMNGQPLSGXYNGGG

SEQ ID NO: 199761 - protein, 135 aa, Triticum aestivum
  unsure (1)..(135): unsure at all Xaa locations
  Clone ID: PAT_TA_94179.pep
MAPTVMXSSATSVAPFQGLKSTAGLPVSRRSNXASLGSVSNGGRIRCMQVWPIEGIKKFXTLSYLPPLSTEALLKQVDYLIRSKWVPCLEVXSKXGFIFRAHXRISWGXXIVXXWXMWXAALCFGCPHKVSTRGP

SEQ ID NO: 199762 - protein, 86 aa, Triticum aestivum
  unsure (1)..(86): unsure at all Xaa locations
  Clone ID: PAT_TA_94180.pep
LXQXXPFLXIFGXPRARDXPRXWTXLRMXXIWLXGEKFFNTXKXPXVWKXSGAREHLAXDFLXRYIGRXATYINXXWILRASEQXX

SEQ ID NO: 199763 - protein, 85 aa, Triticum aestivum
  unsure (1)..(85): unsure at all Xaa locations
  Clone ID: PAT_TA_94181.pep
MRLAGQIARRWKAXDVYAPHDLHQAEQVKFRQRVDASTDIFDALDMNPLEHYRXFSLMSEWMTPMGRIKSRKETGLRPVNQRRIA

SEQ ID NO: 199764 - protein, 115 aa, Triticum aestivum
  unsure (1)..(115): unsure at all Xaa locations
  Clone ID: PAT_TA_94182.pep
MVAAALLRRSPAARALLSPALSSRLVASKPHSSSPAPPPPSSXXAKHXXTFSIYPLGTRDSPSTKPTSKGLTTGGTSPDMRAPMVAPTRSKIKRNPNPVRGGAGAPLNNLATCLQ

SEQ ID NO: 199765 - protein, 79 aa, Triticum aestivum
  unsure (1)..(79): unsure at all Xaa locations
  Clone ID: PAT_TA_94183.pep
XSNTGXRMEISPXTYLHSSASLGSKPRKEQHKRHRVYTGXAPHCGVIPYPSVWCGGLPLGLMMMNNTRKNXLARVCSWL

SEQ ID NO: 199766 - protein, 99 aa, Triticum aestivum
  unsure (1)..(99): unsure at all Xaa locations
  Clone ID: PAT_TA_94184.pep
MANPLDTDIGSELFSSYEAELKLVQADLNQKLDQIPDLGGEPRKAXITSAERTIDEANEILDQMRLEKQNIPSSITTGGWVNASTIMNRTLYTARKGGE

SEQ ID NO: 199767 - protein, 131 aa, Triticum aestivum
  unsure (1)..(131): unsure at all Xaa locations
  Clone ID: PAT_TA_94185.pep
LVPNSAXGHVQADCPTLRLNGASISGLCYSCGLPGHLARTCPSPGSHLAVSGAGRSYSSPRTGFNGGFNTRGYLSGPRSATCYKCGGPNHYARDCQAQSMKCYACGKVGHISRXXSSPNGGXPLNTSGQDL

SEQ ID NO: 199768 - protein, 126 aa, Triticum aestivum
  unsure (1)..(126): unsure at all Xaa locations
  Clone ID: PAT_TA_94186.pep
EDPSRTRQXKPIFLKSIYPXFCKNXXQPGTRLPLNQLLDSFREKLGRILPXPIGXTTHSRQDSKSRXPSLGQXXXPXTSWXSPXXKQXXVSCQGXVXNXFXSLXXXAXLXXTRIXPTKSXQXRIWR

SEQ ID NO: 199769 - protein, 90 aa, Triticum aestivum
  unsure (1)..(90): unsure at all Xaa locations
  Clone ID: PAT_TA_94187.pep
AQGXNXRQEGVXWTTRPXAIRMXLAEDGPXPMXGGDAXHXHEHGXPPXSSXVIAXGDADAAALHRCVSPRTQTXMXIFPAAQLXXPNSAR

SEQ ID NO: 199770 - protein, 126 aa, Triticum aestivum
  unsure (1)..(126): unsure at all Xaa locations
  Clone ID: PAT_TA_94188.pep
LTLDTACKPQKIPRLMHHRCEFSQMKYLQLRLVYIEEFDTLSLISFMRSAPFIEKLELHFCFPXYVRLAQELEPIRKLPEHLFNNLKSLHVTGFKACIGQVELLXHXVENAPAXEVLTDKSSKISP

SEQ ID NO: 199771 - protein, 78 aa, Triticum aestivum
  unsure (1)..(78): unsure at all Xaa locations
  Clone ID: PAT_TA_94189.pep
PXASASAVXSSIRPTSTSPWPXRXVXXPXLAPEXPXPXXLGLXFTGSXRRASGRPRRGRGGRGGHARRRSRLVPNSAR

SEQ ID NO: 199772 - protein, 87 aa, Triticum aestivum
  unsure (1)..(87): unsure at all Xaa locations
  Clone ID: PAT_TA_94190.pep
HAAVGSQAPNSYQTLNQKIPQKNPQNHXKKSTFRSXMAAAXGELGVXGGXPRXXXPLLXXRRLLRSRGHXXXVGDLDLERAGTRSSS

SEQ ID NO: 199773 - protein, 106 aa, Triticum aestivum
  unsure (1)..(106): unsure at all Xaa locations
  Clone ID: PAT_TA_94191.pep
QGCLSAIFIPRDYTTLNKKQTTKSEMTMEEEGRIPAVIFSTNLVVKDSPKVKIQPTPNDRIDFFLTESLVRRSSAGLILVGTPALQETSRLLTTKKIIKTIQPHXI

SEQ ID NO: 199774 - protein, 121 aa, Triticum aestivum
  unsure (1)..(121): unsure at all Xaa locations
  Clone ID: PAT_TA_94192.pep
MSGRKXTXEPKEENVTLGPAVREGEHVFGVAHIFASFNDTFIHVTDLSGREXLVRITGGMKVKXDRDESSPYAXMLASXDVAVKXCXELGITALHIKLXATXXNKXKKTPRSCKAALPSTF

SEQ ID NO: 199775 - protein, 132 aa, Triticum aestivum
  unsure (1)..(132): unsure at all Xaa locations
  Clone ID: PAT_TA_94193.pep
RAXFGTRIIIPVSCGHRCLCLKSRALELSSITRLKIHARRFRLFNSSTXLPKPITFVTHXXVAAIHLNGPTKENITLNGPPNPSHPGGXFXTMXAEXSXXTYXXLXGVSKXALGXXCQXASXXGSFFSDLTP

SEQ ID NO: 199776 - protein, 48 aa, Triticum aestivum
  unsure (1)..(48): unsure at all Xaa locations
  Clone ID: PAT_TA_94194.pep
VLLYYVEXMXILAHWXPLLTQVTPCTVLPILFCYLKGPRHELXPNXAR

SEQ ID NO: 199777 - protein, 128 aa, Triticum aestivum
  unsure (1)..(128): unsure at all Xaa locations
  Clone ID: PAT_TA_94195.pep
QPRIITMXSAGRRPTVAHAGSLSSSSSRGVINEQAPSALEPARRRXPXAGLWXLSTPKXAPAVPVXGVGGLGKTLTPGAVGWAPLKVTXXAYPTGLGWXXPXXLRRGGGGNPPRXPKDXLSPPKKXXC

SEQ ID NO: 199778 - protein, 88 aa, Triticum aestivum
  unsure (1)..(88): unsure at all Xaa locations
  Clone ID: PAT_TA_94196.pep
FPKGSYPKAINHXALLPFLCIPRGIEQXTTIPDEGTWLPKRLAKLVVSXPYXWXQFCWLVDRIXCKKLSXWXNNXQGHAWWHVLMGXN

SEQ ID NO: 199779 - protein, 146 aa, Triticum aestivum
  unsure (1)..(146): unsure at all Xaa locations
  Clone ID: PAT_TA_94197.pep
DLCSLKSIXALXXXLVNXTLFPDSRDEQLSYGFTEIHASRAQCHTKKNEEQRMEGGNQSIRIPRIDILFLTAGIGGWSXGINWFSAMKDMCLDVVEAVTWPKYKIAKVGXLRRDHXXEPXKKKRAWPXGAXLLQPMEAIRGTLLEK

SEQ ID NO: 199780 - protein, 150 aa, Triticum aestivum
  unsure (1)..(150): unsure at all Xaa locations
  Clone ID: PAT_TA_94198.pep
LVPNSARGETLLVSLVQLGHDHIISEGLRRFDTLIHDHNSSILSPSTRKAAYLSVMQNVSSSNRSKYDSLRQLYKDLGDEEEKLRVLGTLSSCLDKDIVLESLNLIFTNEGPNYHAVYVLKXIGIDARETTWSWLKENWDRVLKGVPKRL

SEQ ID NO: 199781 - protein, 99 aa, Triticum aestivum
  unsure (1)..(99): unsure at all Xaa locations
  Clone ID: PAT_TA_94199.pep
LXFSRTYNSXESMFAFHKCPGDGGAKSSTKPTPSLSLSLSPSSFPNLDIGGNSFRKAEVLIFLTDPDXEELLLLVRXCGLFILCXPAKAVSKSLLTVSL

SEQ ID NO: 199782 - protein, 55 aa, Triticum aestivum
  unsure (1)..(55): unsure at all Xaa locations
  Clone ID: PAT_TA_94200.pep
LLRRXGDVAQXPMGSIAQKSHLGNCHDCSSRRHPSGRCHLGXLVFLKXFXLFSSP

SEQ ID NO: 199783 - protein, 134 aa, Triticum aestivum
  unsure (1)..(134): unsure at all Xaa locations
  Clone ID: PAT_TA_94201.pep
MGXXFSSTVGXPASTPTNFLGKEXSRKQVTSAVXYHGKSSNANRFTXVMAAGNLXEKRNTDKWEGLAYDISXDQQXITKGKXIVDSLFHAPTGDGTHEXVLXSYEYVSQXLKEVRLLQTPWGGFYNLLLSWECC

SEQ ID NO: 199784 - protein, 109 aa, Triticum aestivum
  unsure (1)..(109): unsure at all Xaa locations
  Clone ID: PAT_TA_94202.pep
VTSYFXXXANFXXFLXSSTLQKSPECFMGXRNXKXSXIKLXNQTMNSKTLLRPLQKVXKIPKRSYTXTKTXXNTTLNRETMLXSMTTLKRPXTSSRIPRXLLXKRNRRA

SEQ ID NO: 199785 - protein, 71 aa, Triticum aestivum
  unsure (1)..(71): unsure at all Xaa locations
  Clone ID: PAT_TA_94203.pep
XLAERQPDCAVNQXKSSLIMQVCRNFRTXKLASTNXIRXXSIRRVSNIAITRXXKPILXTQGGXSSIGXHT

SEQ ID NO: 199786 - protein, 159 aa, Triticum aestivum
  unsure (1)..(159): unsure at all Xaa locations
  Clone ID: PAT_TA_94204.pep
PRPRXGGATXPGGIXXXGSGFXLGXXPSXXRXXWXXXGKXITXSFPVXAARPGGXXPPXSASXIPVLXIALPQXCAPLXTGNSPPGHALDIERGAGXXHTAAGSXAXFPQVQEAGVPVPQVRSTCKLRRXCLXIKLCSLRLCEARPXCAGXPDHPVGDL

SEQ ID NO: 199787 - protein, 65 aa, Triticum aestivum
  unsure (1)..(65): unsure at all Xaa locations
  Clone ID: PAT_TA_94205.pep
LVPNSAXIRPLXLXRIRRNRGGXFSXPPPPPRXLPPRALPPLRARGEXVLIAQKXLTFXXXNMYF

SEQ ID NO: 199788 - protein, 89 aa, Triticum aestivum
  unsure (1)..(89): unsure at all Xaa locations
  Clone ID: PAT_TA_94206.pep
MKXTKLAXXLILQAVLVMGVLSHVNADYFPKCCNNCRSFSGVDVCEDAXPKCPKGCSACRVVXTSPEMWRCAXXKSNVDXNCGGACKKY

SEQ ID NO: 199789 - protein, 74 aa, Triticum aestivum
  unsure (1)..(74): unsure at all Xaa locations
  Clone ID: PAT_TA_94207.pep
SAAXSHDWTCMATCLDLFIQLLAFLVHRLHXELLLPXXFFPTPLSRVXTRETICXCFISFTRLXSCSRAEFGTS

SEQ ID NO: 199790 - protein, 58 aa, Triticum aestivum
  unsure (1)..(58): unsure at all Xaa locations
  Clone ID: PAT_TA_94208.pep
SGXKPGIRGPSMVXGXLXXVLGGXXYXXQXSAGRLKGFFPXRRGRALQQCRRGFSSSL

SEQ ID NO: 199791 - protein, 116 aa, Triticum aestivum
  unsure (1)..(116): unsure at all Xaa locations
  Clone ID: PAT_TA_94209.pep
RAEFGTRRAGDCRLQHSGGPFGENIFWGSGQSWTXADAVKLWVDEKQNYHLDSNTCDAGKVCGHYTQVVWRKSTRIGCARVVCTGNRGVFITCNYNPPGNFNGERPFAFLTLDAEA

SEQ ID NO: 199792 - protein, 161 aa, Triticum aestivum
  unsure (1)..(161): unsure at all Xaa locations
  Clone ID: PAT_TA_94210.pep
RAEFGTNLRRLTGRLPELYRGEASPPWAXCGCGLTCSVXCVXKTDVRLLLHQRHLRRXPPRLLHSXXRXRPLSWGXPSQAAESLXPEXXPSSRHXVHHXLRLXXAXXXPKSSTXDLLXWAPACQXIGPDGTSAPGLVXLXXLRRASXLXWXXGXRXLLXRX

SEQ ID NO: 199793 - protein, 75 aa, Triticum aestivum
  unsure (1)..(75): unsure at all Xaa locations
  Clone ID: PAT_TA_94211.pep
MGSLVAVQPVAVXGLXGXSISGRKLAVRXXSAAVSRSTRMVLGGXVVAKYGEKXVXFXLEDIANXRGXWDLXXSD

SEQ ID NO: 199794 - protein, 90 aa, Triticum aestivum
  unsure (1)..(90): unsure at all Xaa locations
  Clone ID: PAT_TA_94212.pep
MKGTKLAAILILQAVLVMGVLSHVNADFFPKCCNNCRSFSGVDVCDDAHPKCPKGCSACRVVSTSPEMWRCADMKSTVDGTCGGXPCKKY

SEQ ID NO: 199795 - protein, 177 aa, Triticum aestivum
  unsure (1)..(177): unsure at all Xaa locations
  Clone ID: PAT_TA_94213.pep
IGGXXXXPPQHPHLCGCKLPXQPPFCPGXSGKVCFXSPKDWLSFLXFXRPHPQXVFQPGXXGRXRSQGFAPXNPPRKIVSSNXNXPPXGSXXGPGKSAGAAFAXRPSPXXKPWPXFVCPXPPPGPDHRPTARGAGFARLTEXLAGFFLRXRRPPPTXIDLLXSAEHCKXALGRSHDX

SEQ ID NO: 199796 - protein, 130 aa, Triticum aestivum
  unsure (1)..(130): unsure at all Xaa locations
  Clone ID: PAT_TA_94214.pep
SCRIRHEETLSYLPPLSTEALLKQVDYLIRSKWVPCLEFSKVGFIFREHNASPGYYDGRYWTMWKXLPMFGCTDATQVXNXGXGGQRKEYPDAYVRIXGFDKHRQGGQASSPFKQPGLAGGPGQGPKTSS

SEQ ID NO: 199797 - protein, 144 aa, Triticum aestivum
  Clone ID: PAT_TA_94215.pep
SAINEYLPIDKSSWNIRIKFITSVISVTLQHLILGIFEPSSSSKLTQPPQLNIFVNPSTRRRGKNTTNNNLHQSSADLMGDSCFSYSKGIHANNPQLPSSSPFFSLPTQAKPTFPTSQAKPTFPTSQAKPTLPTSQAKPTLPTS

SEQ ID NO: 199798 - protein, 78 aa, Triticum aestivum
  unsure (1)..(78): unsure at all Xaa locations
  Clone ID: PAT_TA_94216.pep
VEATXNLXXMNQGPNXXHXSXSYARAXQNTXLKTWGGRPENVKAAQEALLXRSKANSLAXQLGKYTSDGEAXEAKEGM

SEQ ID NO: 199799 - protein, 58 aa, Triticum aestivum
  Clone ID: PAT_TA_94217.pep
VLANFATHENHRQVTIFLRNYSILFLICSSNFLESPRVILSYEMLQTSHVFLRIILRT

SEQ ID NO: 199800 - protein, 74 aa, Triticum aestivum
  unsure (1)..(74): unsure at all Xaa locations
  Clone ID: PAT_TA_94218.pep
PPFFCLPWRKRDAQTQSNAHXSSPPAEXSGEXIRXPQVGXPXVVSPTVPXMYPXXVPGMFSQQGMDXLVPNSAR

SEQ ID NO: 199801 - protein, 114 aa, Triticum aestivum
  unsure (1)..(114): unsure at all Xaa locations
  Clone ID: PAT_TA_94219.pep
SXLXLXPRRPCFLGGGEEHRXILTRLPPVTMLEXHPGLLAHLRRHQRALXRREAAALAPPESXSVAVVPFVLRXSXPASLEEGPHGSARERACGRGRGACDARGIRTGNVRRRF

SEQ ID NO: 199802 - protein, 77 aa, Triticum aestivum
  unsure (1)..(77): unsure at all Xaa locations
  Clone ID: PAT_TA_94220.pep
XYRCGRIDLXVEGDDEANFNIKKAERFVAVAXWCLQEEPTMRPTMLKVTQMLDGAVQIPTPPDPSSFISSLLVVPAC

SEQ ID NO: 199803 - protein, 88 aa, Triticum aestivum
  unsure (1)..(88): unsure at all Xaa locations
  Clone ID: PAT_TA_94221.pep
LKTALNHPIHRTHQSQAXXIILIKASRRVNTKSTNIDIPIATMSLFPRAFLHQDQSSSPTIFRLIDEIDQVLPRCGPKHPSNHXVXHT

SEQ ID NO: 199804 - protein, 107 aa, Triticum aestivum
  unsure (1)..(107): unsure at all Xaa locations
  Clone ID: PAT_TA_94222.pep
MVFFPLLVGAXLDGLXXLQXRXGXDDPNYPYYXKLRCEXCGEXSAKNXCVSLXXVXQLPTXKXXANLLQXCKLCXXXGXIXXXPGXGXTXXGEQSQKGGXRPVLMGF

SEQ ID NO: 199805 - protein, 93 aa, Triticum aestivum
  unsure (1)..(93): unsure at all Xaa locations
  Clone ID: PAT_TA_94223.pep
GGXARGTFCFXQKFFVHRDFLLXVXLFCKXQTPYIFPFXRYWKEGHFVXLGAIQKLKPFXLXRTGPFVVFCPSRTTSFAHVGDXPDFVHXXXA

SEQ ID NO: 199806 - protein, 146 aa, Triticum aestivum
  unsure (1)..(146): unsure at all Xaa locations
  Clone ID: PAT_TA_94224.pep
MAPTVMASSATSVAPFQGLKSTAGLPVSRRSNGASLGSVSNGGRIRCMQVWPIEGIKKFETLSYLPPLSTEALLKQVDYLIRSKWVPCLEXSSKVGFIFREHNASPGVLRWPGTGTMWECLLFGIAPDANASDTRWEGGPETLDAL

SEQ ID NO: 199807 - protein, 144 aa, Triticum aestivum
  Clone ID: PAT_TA_94225.pep
DLHVHQFITFFQASESLRPAFEGFVSGIRSPVCIVADAFFGWTADVARAHRAFHAVFLTGGAFGFAVFFSVWEHLPHTLAAGDEFPLPDFPNVVLHRTQIPRYMLPATGSDPWTGFFRRVISLCRKDRCGPWSTLKKLGGGPGT

SEQ ID NO: 199808 - protein, 146 aa, Triticum aestivum
  unsure (1)..(146): unsure at all Xaa locations
  Clone ID: PAT_TA_94226.pep
INAHHFYPQLLMVDGNGLLHPRGFGLACHLGVLADLPTIGVGKNLHHVDGLDQSEVRRQLEAEGNCNKECISLTGQSGTIWGAAMRSSPGSLRXIYISXVGHRISLDSAIGIXEVXCRYRVPXPTRQADIRSKVFLQXHQXFHAVK

SEQ ID NO: 199809 - protein, 77 aa, Triticum aestivum
  unsure (1)..(77): unsure at all Xaa locations
  Clone ID: PAT_TA_94227.pep
QLQCALEWWQLSKTIIGVLVKCLSQAKLGSGLGIRAESGRRLLSLLWINFGLMIVSVDGPSXPXFQKKYLSGNQHQR

SEQ ID NO: 199810 - protein, 77 aa, Triticum aestivum
  unsure (1)..(77): unsure at all Xaa locations
  Clone ID: PAT_TA_94228.pep
IICCLYQLYYLLQILNVGTRLFLAQSYKRQLTINMLKWENLSGVNRVRETFSIAQFHIKYYTPIKVYDVTIKCXIYG

SEQ ID NO: 199811 - protein, 80 aa, Triticum aestivum
  unsure (1)..(80): unsure at all Xaa locations
  Clone ID: PAT_TA_94229.pep
MSCNCGXGCSCXSNCKCGKMYPDXTEQGXAAXQVAAVXVLXVGPXKKEGQXXVGXXQSGXGXXCRDKCKCNPCNCCMHSL

SEQ ID NO: 199812 - protein, 138 aa, Triticum aestivum
  unsure (1)..(138): unsure at all Xaa locations
  Clone ID: PAT_TA_94230.pep
DKRHVAIVXTASLPWMTGTAVNPLFRAAYLAKSSKQYVTLMVPWLCKSDQELVYPNNMTFSSPXDQETYIRNWLEERVGFKTDFRISFXPGKFHKERXXXIIPAGDTSQFIPSXEXDIAILEEXEHLNLGTIMEPLGL

SEQ ID NO: 199813 - protein, 113 aa, Triticum aestivum
  unsure (1)..(113): unsure at all Xaa locations
  Clone ID: PAT_TA_94231.pep
NGWGNNEAQMYTQNLANCFFTSDNKLVVRAISKPDAAEDKYTSXRLVSRQTLARDRGCVTANLTAPSXQGIWPTFWMLPSKPSTWPVDGEVDICELWNGNAKNHNCVQWYNDG

SEQ ID NO: 199814 - protein, 150 aa, Triticum aestivum
  unsure (1)..(150): unsure at all Xaa locations
  Clone ID: PAT_TA_94232.pep
LVPNSARAPVSAHLLRLRRRTHRGSSDSSDQERPAGRKSTYAGGXEMGLTFTKLFSRLFXXXEMXILMVGLDXAGXTTILYKLKLGEIVTTXIPTIGFNVXTVXCTKNINFXVWDVXGQDXIRXLWXRHYFXETHKGSSIFLKQIGTVCA

SEQ ID NO: 199815 - protein, 54 aa, Triticum aestivum
  Clone ID: PAT_TA_94233.pep
NQQVSLKMADLIKTRIHDDINIVAREWTHSSKVSDNLMVPVVRLDDKFKSMSEV

SEQ ID NO: 199816 - protein, 92 aa, Triticum aestivum
  unsure (1)..(92): unsure at all Xaa locations
  Clone ID: PAT_TA_94234.pep
TIYNHAFILTGFKPKHLSQKQQTFSQXYXSYLNSGXRPDQQQQQGRGDRRKNYTNGDQSIVANSLLASRWXDCSIAMNRXPRPSCRRRRRAV

SEQ ID NO: 199817 - protein, 132 aa, Triticum aestivum
  unsure (1)..(132): unsure at all Xaa locations
  Clone ID: PAT_TA_94235.pep
FSSAQPLDRIASTVAAVMEEPPLTXXRNKAXXIGXPPTPREALKTSSLSLQRKKLGSHFLESDERRRFYNASSSSAAXGTTPLDIRGLPIPXRDLPXTGGWVXGFFXFXQPNXGXGWXTKGLNXNNGWSSCS

SEQ ID NO: 199818 - protein, 108 aa, Triticum aestivum
  unsure (1)..(108): unsure at all Xaa locations
  Clone ID: PAT_TA_94236.pep
LXPNSARXPIXSGPITSPEPXTKPXXXXIHAGXTRRXLDSSRRXNNQPLIGSIFLSXPIXXDSXKKGGAGGXIIYIIRQSXTKCSGFNYPRRXTAAMXXHXARSRPAT

SEQ ID NO: 199819 - protein, 53 aa, Triticum aestivum
  unsure (1)..(53): unsure at all Xaa locations
  Clone ID: PAT_TA_94237.pep
PDQCHSNPTYPLYPNPIAAAAXMAXMAXIPSDXVSXNXHXNXNXASPPLXNLP

SEQ ID NO: 199820 - protein, 69 aa, Triticum aestivum
  unsure (1)..(69): unsure at all Xaa locations
  Clone ID: PAT_TA_94238.pep
QIXNXLTTVYKIFXISTKXXGAXFXNLIKFSXKLXKSPPPPTPXXKXLXFTKSLTLFHHLHFSPFLFSX

SEQ ID NO: 199821 - protein, 71 aa, Triticum aestivum
  unsure (1)..(71): unsure at all Xaa locations
  Clone ID: PAT_TA_94239.pep
IHLXFIIILKMXXXHTXYTCLXRVPIXNNIMKLLSLKXFFFFXFXQGPSXPIHMGCFHPLCISXXQILPLF

SEQ ID NO: 199822 - protein, 124 aa, Triticum aestivum
  unsure (1)..(124): unsure at all Xaa locations
  Clone ID: PAT_TA_94240.pep
EEHXEXDLISTGTAXRSVDTRSMDGTTSKRQRKEPRPKRVTGPSDPFAVMLQDVNIHLNNXTQYVGTIGSIIVSINGXXSSXKRILXXKSXEXAITXLARLTLLPGAXIVCRLAXRILPXSXQX

SEQ ID NO: 199823 - protein, 147 aa, Triticum aestivum
  unsure (1)..(147): unsure at all Xaa locations
  Clone ID: PAT_TA_94241.pep
RAEFGTSRDEIYGPYDNSFLQSNVPKQHTKSPIVTGTSVIAVKFRDGVIIAADNLASYGSLARFTNVKRLRKFADTSVVGFGGDVSDMQYLDRLLGSLAIDEAYNSTGHTLNAKNIHTYLSKXMYKRRXEFNPLXNQILVAXLDDER

SEQ ID NO: 199824 - protein, 89 aa, Triticum aestivum
  Clone ID: PAT_TA_94242.pep
LTSFRFPGGLSSRSLVCRFATQTVIIIVVTMGFNRRITRVHAAKNTGGWGEASGGQHGLHSERERGQYHAHQHGQVLEVSHCCWKEACV

SEQ ID NO: 199825 - protein, 66 aa, Triticum aestivum
  unsure (1)..(66): unsure at all Xaa locations
  Clone ID: PAT_TA_94243.pep
YTYXXIYXSXTYILXTIYTSXQXXIXXPKKRVFLSLSXKGAXXNLSQGGELXSRLPLSSQXXPRPX

SEQ ID NO: 199826 - protein, 77 aa, Triticum aestivum
  unsure (1)..(77): unsure at all Xaa locations
  Clone ID: PAT_TA_94244.pep
FGXKXDIIFIGDLFGKXLGKIFXXRNXSLXLGXXKXGVXXGXRRVVXLLGIDENXCREESLLEVDRXXXLKIXYSAW

SEQ ID NO: 199827 - protein, 133 aa, Triticum aestivum
  unsure (1)..(133): unsure at all Xaa locations
  Clone ID: PAT_TA_94245.pep
SCRIRHEALEDIFKKEDLSTSNKDSSLHEFAAVPRRVTTLLAPRRTPAVLAPNGNSNSSITIFALNGFQXISNKNYIGLTRKLSPDIXIAMADIPYGSGPGVKRVAKMVRRTQSLGINDSRKIESGLHFAAIP

SEQ ID NO: 199828 - protein, 96 aa, Triticum aestivum
  unsure (1)..(96): unsure at all Xaa locations
  Clone ID: PAT_TA_94246.pep
PFSSXPNVPXHSSXYLILTFLGQXCLFHLSLPIXLFLGDYVGXSLTAPINXGWVRXISLYLSXAIYDFLXQXXLSITXRAXTSKSQNXXXTDYXTR

SEQ ID NO: 199829 - protein, 140 aa, Triticum aestivum
  unsure (1)..(140): unsure at all Xaa locations
  Clone ID: PAT_TA_94247.pep
DLDATRVGKSAVIKTSTRQTIFLPLIGLVSPENLKPGDLIGVNKDSYLILXTLPAEYDSRVKTMEVXEKPSEKYTHXXGLDKQIEXLVXAIVWPXKEAERFXKIGIKAXKGXLMYGPPXYGKKXSLXGAVXXSKQDXTFP

SEQ ID NO: 199830 - protein, 72 aa, Triticum aestivum
  unsure (1)..(72): unsure at all Xaa locations
  Clone ID: PAT_TA_94248.pep
LISSYIKHIHIXYXXTINQYSFITHLXSYPSTIYPNSQXQYXXLLXXXLXYXYLSPHQXXFXSPEXPPPXLP

SEQ ID NO: 199831 - protein, 71 aa, Triticum aestivum
  unsure (1)..(71): unsure at all Xaa locations
  Clone ID: PAT_TA_94249.pep
APFEWXLLLRLLRVXRVLXXINMXXIIKRXAHAGEVVHVXXPEXFVDXENAXXLCIILNLPCLHLIXXEPE

SEQ ID NO: 199832 - protein, 65 aa, Triticum aestivum
  unsure (1)..(65): unsure at all Xaa locations
  Clone ID: PAT_TA_94250.pep
PQILTLXHNXLNFLPLHXSXTISPTKXHLPHIXIHLXTTYSFLXXFHPEKXXXLXPEXXPHXHHP

SEQ ID NO: 199833 - protein, 55 aa, Triticum aestivum
  unsure (1)..(55): unsure at all Xaa locations
  Clone ID: PAT_TA_94251.pep
FFFLKXNVNYXLIFMSCDQXYNXGSXXXHXKNNTTXXPLPNNXNFVXXLQQXYIS

SEQ ID NO: 199834 - protein, 113 aa, Triticum aestivum
  Clone ID: PAT_TA_94252.pep
MAEKSITPPISATRLNQIANDACQAALGSVEYYEHSKTEAWNTMIINSILRSLVSESPTTSDANPSYKYTVNSTIIQHLVPTTAIQRAKAMQESPQQSINNTNRCFRYQRKFG

SEQ ID NO: 199835 - protein, 44 aa, Triticum aestivum
  unsure (1)..(44): unsure at all Xaa locations
  Clone ID: PAT_TA_94253.pep
ISHPNNHXXNPLLGPLPSPXTKGXPQXPLSXXXSSTFSXIISSL

SEQ ID NO: 199836 - protein, 104 aa, Triticum aestivum
  unsure (1)..(104): unsure at all Xaa locations
  Clone ID: PAT_TA_94254.pep
MSELTHPTIKDGWFREISDMWPGQAMTLKVKNIIHHEKSKYQDVLIFESTDYGTVLVLDNVIQCTERDEFAYQEMITHLANELTPKIPKKVLVIXGGGDGGVPP

SEQ ID NO: 199837 - protein, 146 aa, Triticum aestivum
  unsure (1)..(146): unsure at all Xaa locations
  Clone ID: PAT_TA_94255.pep
SCRIRHQERTSWENVCIVPGGRAGLIRIAAVLNNAYLGFFIPDYTAYNEMLSLFKNFAAIPSPLEEQDGYHIHPNXIAEEITXGVSVILTSNPXRNPTGKVVKNPELAXIXDLCRGRATLIXXXFYGXGITISGLGRELIKWPPKC

SEQ ID NO: 199838 - protein, 83 aa, Triticum aestivum
  unsure (1)..(83): unsure at all Xaa locations
  Clone ID: PAT_TA_94256.pep
LVRGRAXASXTIGHTAHTAHIGPLTSXLKPYXLDSIXXXGPTAIAPSSPSXAPGPGVRRPEKIKESGPGSVEXLLXSQXGFVL

SEQ ID NO: 199839 - protein, 79 aa, Triticum aestivum
  unsure (1)..(79): unsure at all Xaa locations
  Clone ID: PAT_TA_94257.pep
LRICNXGVGXQLXLXLSHFFLIALPXAPXEEANXXLEXQFNFVRLFXSASDIRWMXXPLLXDLXLGHRXLXXPRSXEXN

SEQ ID NO: 199840 - protein, 68 aa, Triticum aestivum
  unsure (1)..(68): unsure at all Xaa locations
  Clone ID: PAT_TA_94258.pep
PXSGNPSGALXLFFXXGDXEAGERDXVEVFXLPHGXXXDXSQKGPLGXRQWQPCPVPFXVLGLXKRAR

SEQ ID NO: 199841 - protein, 118 aa, Triticum aestivum
  unsure (1)..(118): unsure at all Xaa locations
  Clone ID: PAT_TA_94259.pep
NXGANXXTQTLXQPGXSDLXXSFKRYKXSVLGEXIPPRVSKXXVFQMXMIVRATKKGYHIEEGPITFXXRXSGISKLXGXXIXGYLXGXGYPVAHKRGKNGMEDWYDKTPREFSVFTT

SEQ ID NO: 199842 - protein, 126 aa, Triticum aestivum
  unsure (1)..(126): unsure at all Xaa locations
  Clone ID: PAT_TA_94260.pep
RXPRXXRAPGXGTPXLPPRXELHXXXARAGRXXYLMLPXVNRPXAHQRRXXRXRPAFXPAXPRRTGEKEAXLPXXSRAXWPGPRPAPXCXSXRFXXRSPHWGXGXIQXNLLLXKVFFWPKPQXPQP

SEQ ID NO: 199843 - protein, 86 aa, Triticum aestivum
  unsure (1)..(86): unsure at all Xaa locations
  Clone ID: PAT_TA_94261.pep
FFFFSTAEXFIKXXKVXXXNKPQTNTQXXAEXSFYSKLXXHSSPXVAKPRILAQEXXLFLHLLWGSXTNPXQXDPXSSCXIRQEGG

SEQ ID NO: 199844 - protein, 52 aa, Triticum aestivum
  unsure (1)..(52): unsure at all Xaa locations
  Clone ID: PAT_TA_94262.pep
LPRRSQKKXSRVXPMGNCXSXERKICCRXPXGNXSPSSXKXXTGPCSPRXWA

SEQ ID NO: 199845 - protein, 183 aa, Triticum aestivum
  unsure (1)..(183): unsure at all Xaa locations
  Clone ID: PAT_TA_94263.pep
PGLQXVXSLLXEXGVTVGGTNHXHXTKXLXDSIAAGNXPEWXXYIXTIDXXHXDRFDFXPLXVNKTWPEDVVPLXPVGXXVLNXNIDNFFSENEQLGFCPGXXVPGVXYXGDKLLQXKXFSYSGTXXXPPGGPTTCWWPXANXXKCSHHNNHYDRVKKXMHRDXEXDXFPPKXXXPQSKEAPX

SEQ ID NO: 199846 - protein, 193 aa, Triticum aestivum
  unsure (1)..(193): unsure at all Xaa locations
  Clone ID: PAT_TA_94264.pep
EFXNEGQXHQTXRPFDQPMAYTLXAXTXQSNXXGHGFRAGQRXRSXENNPQXHPRVGKKVLGWVGQHQSTAXKLWDKVPSLGLLSGKGVGYGDXFNKAKGNHFWEXWWFXILRKSCGXFDPXLKKARTXYLSNPTKXQDCKTQINXTLLPXLGLFXRXPPGKGXAIPKSFPLXRNAAPXGFXXKGKPQPGKXN

SEQ ID NO: 199847 - protein, 109 aa, Triticum aestivum
  unsure (1)..(109): unsure at all Xaa locations
  Clone ID: PAT_TA_94265.pep
KYXYDVFXARVKXAXSFPXPKXHXLSATKXXDLLGXLHXLXXLDKPGXXEIXXFXLCINFSTNSXMGHXLXXNXQXIWXWEKKSIPRNLLCACWAXMQRKFFPXKSLMT

SEQ ID NO: 199848 - protein, 61 aa, Triticum aestivum
  unsure (1)..(61): unsure at all Xaa locations
  Clone ID: PAT_TA_94266.pep
RCIXCVVGSVXIILHAPKEREINSSGGNMAFCNSTRFXCLFMCXCGWGXFFDFPGCQXPWX

SEQ ID NO: 199849 - protein, 149 aa, Triticum aestivum
  unsure (1)..(149): unsure at all Xaa locations
  Clone ID: PAT_TA_94267.pep
KXXLXXPXNRLXLXGQSXFVFXPHFPXQXLGLXCIXLARFXXGFVXIGXXTRXXLWRLXPSXSENXXFGLXHLGQSXXNQRPHPLPXRXGIAXXGMAAERPRGESPVAPGARRGNRXRCPVVSRXIGRSFXCPPXSLLWXLGXENLDGF

SEQ ID NO: 199850 - protein, 171 aa, Triticum aestivum
  unsure (1)..(171): unsure at all Xaa locations
  Clone ID: PAT_TA_94268.pep
XXTPGIXLSXQDLLQFYPFPXLXSRGNYPSFGXGKXSSPFGXDRNFXSPAGSXPNFKGGGXFSXGNQTKDPRRKEELXEGXPVXSQEDSFTFMPTYFLRGGSKGLXGFSPRGRELXXPXAXXRTXLLEXPGLPXFKGXHSPKDSRRQFFLXSVERFXXSGFPSPGEPFVFG

SEQ ID NO: 199851 - protein, 218 aa, Triticum aestivum
  unsure (1)..(218): unsure at all Xaa locations
  Clone ID: PAT_TA_94269.pep
PPGXXGNXGXRRKNQAXLTPLXFXIPXFPIXNSXTANQMXWPXKDXXLXLPLGREWAVFAXXTAFKRVNLQTSRXXKGGVXXLKQXTTTSLGWSRQRNSNVGXMKXRLXSTXNPNRNERGPRVXQRAGXXLLXXSXXGPIXXPWXSGXTNVIQPPNANREPGXFNXVGGPLNNWXAQPPGXXXLKXLXKXPPPGXPPXRSSXNAXXQGPWXEXXPPPG

SEQ ID NO: 199852 - protein, 74 aa, Triticum aestivum
  unsure (1)..(74): unsure at all Xaa locations
  Clone ID: PAT_TA_94270.pep
KVLIRTDKGRPGPPRKXXNNMXGPXLNKTQWSXSEKXXRLITPXYXITRANXFTKKQXPGVLXRXXLXTGEXKS

SEQ ID NO: 199853 - protein, 53 aa, Triticum aestivum
  unsure (1)..(53): unsure at all Xaa locations
  Clone ID: PAT_TA_94271.pep
ESGQXKLRPGFXAFKXXEPPLSXVKXXGLLPVPAKGXDXPFFSSXGAPTFRSF

SEQ ID NO: 199854 - protein, 141 aa, Triticum aestivum
  unsure (1)..(141): unsure at all Xaa locations
  Clone ID: PAT_TA_94272.pep
MGKPRVFFDMTVGGXPXGRIVXELXXDXVPRTVENFRALXTGEKGXGKSGKPLHYKGXSFXRVIPDFXCXXXDFNKXNGTXGEVHLRREXRPTKKFVHKHTKXGILSMGKAGPNXNXSXXFIXTRPLQIGRPESLVLRRRS

SEQ ID NO: 199855 - protein, 93 aa, Triticum aestivum
  unsure (1)..(93): unsure at all Xaa locations
  Clone ID: PAT_TA_94273.pep
VRKLXXPGTXLGQIXEPGSLQIPEKVGSLIAPPPQIGRLCGQTLXIFSEVISSXIFHEQHTCDVPPVLFAQXVYLGLAFGKLLATCTLYLYNF

SEQ ID NO: 199856 - protein, 104 aa, Triticum aestivum
  unsure (1)..(104): unsure at all Xaa locations
  Clone ID: PAT_TA_94274.pep
RTSLXXTSFGSSIXWDFTHPVLGNVTGGXCPMXLSQAGAXLXTPFTSFPGFRQQVXSHVGHLVXTTGGRVAPRRXCTXKWEEXPSCRNSXQXGEPISXGGAPPX

SEQ ID NO: 199857 - protein, 118 aa, Triticum aestivum
  unsure (1)..(118): unsure at all Xaa locations
  Clone ID: PAT_TA_94275.pep
CPNFAKKKXWCKXXPKGXXGKXLSKXLXXXQPXGAPLWEGXLQXNXAGSPPXKLRXLRPRXGEAXPGRQRPPRRRKNSKKRVLQLKSRVRPKKRGKRXGAAQKERRXPSSNPXXXRPV

SEQ ID NO: 199858 - protein, 85 aa, Triticum aestivum
  unsure (1)..(85): unsure at all Xaa locations
  Clone ID: PAT_TA_94276.pep
WGSVPXDRCPXMTXDVXFXRXFAGGSXMLVPNQRXSWXAPXHXVQQXISPLTXLFLLRAPNPGLXXQKPWXTXPSKSXXDLSXXX

SEQ ID NO: 199859 - protein, 90 aa, Triticum aestivum
  unsure (1)..(90): unsure at all Xaa locations
  Clone ID: PAT_TA_94277.pep
NXTXPCFPIXTPPLPXGXGVFESELXCFPXIXLPETXLWXAXSPXIFFGCVXFXILSEXLSLXRQXLTLXAGIRQALXXPGGXHLFXERP

SEQ ID NO: 199860 - protein, 122 aa, Triticum aestivum
  unsure (1)..(122): unsure at all Xaa locations
  Clone ID: PAT_TA_94278.pep
KXEXPXXHXSASPSLLLXPPPPXXFKVSXSSSQXLSPSKEEFLWVEGTAVLXKXGLXQREEXGXXFXXKSLGFVALXGSCWAWFVQGNGEGQSLXFMKDXXSXAPXXXPPXLLRXLLYYXYG

SEQ ID NO: 199861 - protein, 88 aa, Triticum aestivum
  unsure (1)..(88): unsure at all Xaa locations
  Clone ID: PAT_TA_94279.pep
XXTPXLGGXLGXXGPPXGGFFFFFFVPXLRXPXGVXXKFLCPGEKIXRXTXIIWGXRQVXKXPDLKLLAQFFXXKXTCLRXEKGEPLD

SEQ ID NO: 199862 - protein, 127 aa, Triticum aestivum
  unsure (1)..(127): unsure at all Xaa locations
  Clone ID: PAT_TA_94280.pep
AGGREERXSAKKLGPFSRASXQXQVXRXRRSXLSRKDGXGGDEPPPLXXRSPRXPXRPXCTGGGAXPPPXXRRXPAHXXQPPAVAAGXHHHGSLXVLNXFPPLFPLSVSSSLRAVAXWTVGAGXNXL

SEQ ID NO: 199863 - protein, 36 aa, Triticum aestivum
  Clone ID: PAT_TA_94281.pep
FTYFRLLSFNVYIAMPFLSLMKSLFFRNCYINIKRQ

SEQ ID NO: 199864 - protein, 103 aa, Triticum aestivum
  unsure (1)..(103): unsure at all Xaa locations
  Clone ID: PAT_TA_94282.pep
MACTQENAMATDESTADHRGSRPSSHDMDLSGDDHVPKARKPYTITKQREKWTEEEHKRFLXGLXLHGRAWRRIQRAHRHQDGQVQIRSHAQKXLLGQQSRPG

SEQ ID NO: 199865 - protein, 156 aa, Triticum aestivum
  unsure (1)..(156): unsure at all Xaa locations
  Clone ID: PAT_TA_94283.pep
MDAALSHTPQWVIDLNSTPIKPKFSSTPDPPGYTSTSQKKHQSLSKATDFISPSPADKDVLKLKKAWELALAPVKQLPMTAFMMYMSGNTLQIFSIMMVVMAFKTPFMGLLATNQVFEKFESDGTKSQLVMXKIVYISMQILALALGIWKVNGMGL

SEQ ID NO: 199866 - protein, 106 aa, Triticum aestivum
  unsure (1)..(106): unsure at all Xaa locations
  Clone ID: PAT_TA_94284.pep
PPPXVGPSAPVIDGGPAYPXVIPLFAFVXRPSPGLPRNYQIRXRCILLRTKCNYLXSSAAKVLFXGSNSSIKNSGHFXPXGLFXPRKRRLDQRVEKVTPKSEGASE

SEQ ID NO: 199867 - protein, 151 aa, Triticum aestivum
  Clone ID: PAT_TA_94285.pep
RAEFGTRNTPDPTRLISERSTTPKSSTPKPHPRSIPPKSIVKTTRFELTENVRKPSSAAQKMSERRSSSVSPKMIRPPPRDLESISRIDASLVFEHFTTSDAWELGSSLRSRLLPIPTPVVINISLGQPKANYISFRHSQWVSCPDNETLG

SEQ ID NO: 199868 - protein, 72 aa, Triticum aestivum
  unsure (1)..(72): unsure at all Xaa locations
  Clone ID: PAT_TA_94286.pep
LLAEIRXRSPNPXXRTNKXRSIRLKFFLGXGRGGXFFXNPPQXXLXGEKXGGKGQKGPKPPXGXPGNPKXGE

SEQ ID NO: 199869 - protein, 76 aa, Triticum aestivum
  unsure (1)..(76): unsure at all Xaa locations
  Clone ID: PAT_TA_94287.pep
GYLYSYIYHLIVISNSPYRIYHVSWXIYKQWKKVLFLMFIRVMSCFVEYVRATLIRFAPQVLQFRSICTGSRVLEI

SEQ ID NO: 199870 - protein, 78 aa, Triticum aestivum
  Clone ID: PAT_TA_94288.pep
LGHPMFSSIATNHAWMMLSNNFHDSDRKHIINRRKHTRTNSSIRSPTRIEANSQQWWPKTPVKMFFYHATETNSFRTR

SEQ ID NO: 199871 - protein, 66 aa, Triticum aestivum
  unsure (1)..(66): unsure at all Xaa locations
  Clone ID: PAT_TA_94289.pep
DSELPSLHQQFRREFYENYSSPLPFCCQIEARSNXSLGPSLKNGGIHDVDNASTIFVDVVFLRLRH

SEQ ID NO: 199872 - protein, 82 aa, Triticum aestivum
  Clone ID: PAT_TA_94290.pep
VHGEDNNYLATARVKDGLFYFNVVNSTPKSLISSRTLLSSHRPSFSNLTSSTALITKGKSPISCNNYSSFSNVHSAALTKKA

SEQ ID NO: 199873 - protein, 56 aa, Triticum aestivum
  unsure (1)..(56): unsure at all Xaa locations
  Clone ID: PAT_TA_94291.pep
LKNRIHEVLPLVSSPQTVSLKNMFLGYHDCPXPTLLTVPFRPHSCLSSSRSATVVT

SEQ ID NO: 199874 - protein, 141 aa, Triticum aestivum
  unsure (1)..(141): unsure at all Xaa locations
  Clone ID: PAT_TA_94292.pep
XAEFXTNSXLPHLPTTGSPRRAPPPLPXMXSGRRLLSPPRPHLAGLPLNPPFFPRXTLSLPSTSSKRRXRCEARGSILETMRQRASRSGPSSKFVYVPTVIVDLVLRSHTCSEEXAPSSPTWSVAPRCSLGRSRLLELKQL

SEQ ID NO: 199875 - protein, 92 aa, Triticum aestivum
  unsure (1)..(92): unsure at all Xaa locations
  Clone ID: PAT_TA_94293.pep
MTRAQQTISIGLLASSLYLALFLGLIPMPIIIQRDIIPILPXWATVSFGAYLLGKLGYGVLTFNDATHAHKELIGQITQARKELKILGVEVD

SEQ ID NO: 199876 - protein, 57 aa, Triticum aestivum
  unsure (1)..(57): unsure at all Xaa locations
  Clone ID: PAT_TA_94294.pep
YKXNGPXPLIGLRXGNXRSLPFQRGLXVKRRGFPVKAAGFKRGXSXGXGXXXRGGKG

SEQ ID NO: 199877 - protein, 108 aa, Triticum aestivum
  unsure (1)..(108): unsure at all Xaa locations
  Clone ID: PAT_TA_94295.pep
KLXGKLPGHXDTEGEHVTGXPAXAGPASVQTHXXHHDTDVVXXKXDGDVKTEAAPAVXPEXXKKGFLXEKXKEKLPGGHKKPXDAAAVXVXHAAPSTXHAPXAXPPGG

SEQ ID NO: 199878 - protein, 69 aa, Triticum aestivum
  Clone ID: PAT_TA_94296.pep
RRKLIILYIPKSAVPGLAGLCKRFRRVAKVSASVLVSLLGEYYTHRILCLYPNTMRPQLAYDLSVTGIA

SEQ ID NO: 199879 - protein, 153 aa, Triticum aestivum
  unsure (1)..(153): unsure at all Xaa locations
  Clone ID: PAT_TA_94297.pep
PXKKIGRXGRTFGGXXSFSGGFRPLGQPTFFGVAERRPPAGAAGTSARSSFVVVDAVRSRRRRPALPGGDVRPGDPVAAAEGGELGRQDEEKHRQQLQGAAGVPHHAKDRGGWEGRSGLAGRPASRKRRGRFCTCARNCVCMDAQLAAERSVW

SEQ ID NO: 199880 - protein, 107 aa, Triticum aestivum
  unsure (1)..(107): unsure at all Xaa locations
  Clone ID: PAT_TA_94298.pep
LVPNSARAGLLELTAHGTPKSRVKAHALLDLLRNXPYSRLKLQPNTLENIVSNIASQIDGEDCGGKXKKMLAEMVKVSMEHSLRHLXRRASFARLLLQPSTCFACLQ

SEQ ID NO: 199881 - protein, 143 aa, Triticum aestivum
  unsure (1)..(143): unsure at all Xaa locations
  Clone ID: PAT_TA_94299.pep
LGLGIAGVLLAAKRLKRPARPDHGAFVSLLELLPPPQPPPPQARHPLTDLSFAIADAFHVSGYITSFGNLEWXKTHDAXTQIXLGVSTLGXTGGAICVXGKTXIXEDGIXVSXGXRNXHFGXPTNPXXSGXVWMPLDFLFGNF

SEQ ID NO: 199882 - protein, 135 aa, Triticum aestivum
  unsure (1)..(135): unsure at all Xaa locations
  Clone ID: PAT_TA_94300.pep
MYLNRLPSRSIPSRSINQISRAVASSPKTRLGFLGSYQNSVKTNQVRCLRPFSSTMRSRLRDYFPRXDHEHIKEDWRLLGXTSKTNPKEASATNISKCPXGPPKXFPNCXALYLRRIPPLNTDXATGYXHHPVXX

SEQ ID NO: 199883 - protein, 70 aa, Triticum aestivum
  unsure (1)..(70): unsure at all Xaa locations
  Clone ID: PAT_TA_94301.pep
MLVYQDKLSGDELLSDSFPYRELENGVLWEVDGHWVVQGAVDVDIGANPSAEXGGGDDEGCRLTKPLKGG

SEQ ID NO: 199884 - protein, 109 aa, Triticum aestivum
  unsure (1)..(109): unsure at all Xaa locations
  Clone ID: PAT_TA_94302.pep
SPXLEPQLSHYGTSLKNHIPVNSPEINGVRLVCSTTLETLLQAAWDSIPSEELLSLIGSMHERCVALIKANGGYTKYEDGEDTQNMYYAFILVASHTESFDVDFCNIEQ

SEQ ID NO: 199885 - protein, 69 aa, Triticum aestivum
  unsure (1)..(69): unsure at all Xaa locations
  Clone ID: PAT_TA_94303.pep
FFFFXFFFXXCFLHMSPEEDPNLILPGDWRSEIPYTVGYNQLKCTSISPQKKITSITRWFYRSRAEFGT

SEQ ID NO: 199886 - protein, 63 aa, Triticum aestivum
  Clone ID: PAT_TA_94304.pep
MSPSNVLAAKPRQESTVARLLGSGSAGIAELAVFHPVDTIAKRLMSNQSRISSVSQLNGVIFV

SEQ ID NO: 199887 - protein, 46 aa, Triticum aestivum
  unsure (1)..(46): unsure at all Xaa locations
  Clone ID: PAT_TA_94305.pep
QIYLXFEEICFLTREIWMVLFWRNLAILRIRFLNFNLHITKFSLGA

SEQ ID NO: 199888 - protein, 55 aa, Triticum aestivum
  unsure (1)..(55): unsure at all Xaa locations
  Clone ID: PAT_TA_94306.pep
QTFXEXXXFFPXNYXXVSCIXTGPLKXNGVXLXPVNARYXIATSXXINLTXIXXN

SEQ ID NO: 199889 - protein, 44 aa, Triticum aestivum
  Clone ID: PAT_TA_94307.pep
FFFFLSILPFIQSPNNKLMHDSTAHVRRKYTWPQREQAHLWFTY

SEQ ID NO: 199890 - protein, 58 aa, Triticum aestivum
  unsure (1)..(58): unsure at all Xaa locations
  Clone ID: PAT_TA_94308.pep
RAAXAKIXNXRXGXRLLRWMXKSLNPVQHWXLFPLKGGXXPXELXXLRNRLSRKXVNH

SEQ ID NO: 199891 - protein, 90 aa, Triticum aestivum
  unsure (1)..(90): unsure at all Xaa locations
  Clone ID: PAT_TA_94309.pep
MAAAAPADAKAEAAKMDLLEDDDEFEEFEIDQEWDDKEDGNEAVQXQWEDDWDDDDVNDDFSLQLRKEAGGKEHSKRTFPTKSVYNFILH

SEQ ID NO: 199892 - protein, 94 aa, Triticum aestivum
  Clone ID: PAT_TA_94310.pep
LASFVIQENSRHNAQIEHLPLSSARRRSHDGEIERWRRWRGTRGAKGNQMQGTAVRRSSLPATRPRLALPRGSAAAAAPKSEALDLGRGGRWER

SEQ ID NO: 199893 - protein, 136 aa, Triticum aestivum
  unsure (1)..(136): unsure at all Xaa locations
  Clone ID: PAT_TA_94311.pep
MDFFEPLRFSFLLQWPCPLFKLYINHGSPADSWITYCTAYMDXDILIYSDNLCDHRKHVRIVLQRLREHGLQVDIXKCDFETTQVTYLGLIVSTRGISMDPKKVACIQEWPTPRSVRDVQSFLGFANFYRRFIPEF

SEQ ID NO: 199894 - protein, 84 aa, Triticum aestivum
  unsure (1)..(84): unsure at all Xaa locations
  Clone ID: PAT_TA_94312.pep
GLEIVELLLGFPTSFSHRLYLVLTGYXTKNXPCPISSRAQRDYFGAHTFQIKPEFANEKYKVGENIHVNWTGRGGNVSASTYQA

SEQ ID NO: 199895 - protein, 114 aa, Triticum aestivum
  unsure (1)..(114): unsure at all Xaa locations
  Clone ID: PAT_TA_94313.pep
MNDPSQGIQRELLPHIHLLSTYRFPQFPQIHPEKISEWLQAAPKISRDQAPFYWTYLDRPQDMTILLVXQSMALGPEFPSDGYIWTPQEMAFQIQVDGGYTLEMYQHKAGYAPG

SEQ ID NO: 199896 - protein, 79 aa, Triticum aestivum
  unsure (1)..(79): unsure at all Xaa locations
  Clone ID: PAT_TA_94314.pep
MDDRKQVPRSSNYSKFLPRKRPALIIGPQLRIHSYFNRSLIXLSSFKVKKIGLSLATWQSLAXXLPXVLVNXILXKRXN

SEQ ID NO: 199897 - protein, 80 aa, Triticum aestivum
  unsure (1)..(80): unsure at all Xaa locations
  Clone ID: PAT_TA_94315.pep
TPXSSXXAXXAPRPNXRWXXAHXQPAPALXXAPSXAAKGRSPVTAAASMLGXGRRTGVDSAWSIVRXVGGGRXSCRIRHE

SEQ ID NO: 199898 - protein, 75 aa, Triticum aestivum
  Clone ID: PAT_TA_94316.pep
EIGGRAVRLDYATPKPDRGASGGRGGGGGGRGRGGFGDRGGRGGRGGSRGGPRGGRGGSTNRGGFGDFKGQKKTF

SEQ ID NO: 199899 - protein, 98 aa, Triticum aestivum
  unsure (1)..(98): unsure at all Xaa locations
  Clone ID: PAT_TA_94317.pep
MAPTVMASSATSVAPFQGLKXTAGLPVSRRSNXASLGSVSNGGRIRCMQVWPIEGIKKFETLSYLPPLKHGRASSXQVDYLXRSKXGCPCLQFSKXWV

SEQ ID NO: 199900 - protein, 83 aa, Triticum aestivum
  Clone ID: PAT_TA_94318.pep
SCRIRHEEGLVLVLVAYLGPTVVAPLHRFALGYAKRSMAACLCLMAVYALLSGAQQLFSLAAATVYYYQAMESKEVIDDLWLC

SEQ ID NO: 199901 - protein, 113 aa, Triticum aestivum
  unsure (1)..(113): unsure at all Xaa locations
  Clone ID: PAT_TA_94319.pep
RSRPPGPVQHIYNIMSSLSPRGLFNIRSLMNRSWSRSLAPPTSRVIQTKASQGAPGDEPAKTNLDLHKLARFEKTSYFESRNASSTMESEINTNPISEIAXPAHSNFSSTGAA

SEQ ID NO: 199902 - protein, 147 aa, Triticum aestivum
  unsure (1)..(147): unsure at all Xaa locations
  Clone ID: PAT_TA_94320.pep
WTAVFKFGGPMYKEWAESQINKIKNILNSARADHTEAVKSRIESVKQLGGVVDITKTLFEVSKETAKLEAQAFELEQKTALAAEAKAVLDSWIRYEGQVKLREQKELSEKVIANVXKELQNPKFXKQILQQSXLGRPKESYKSKGTI

SEQ ID NO: 199903 - protein, 88 aa, Triticum aestivum
  unsure (1)..(88): unsure at all Xaa locations
  Clone ID: PAT_TA_94321.pep
LVPNSARGXAEPGRXTIPSPPFPKXQRWRTVXXTHXSCKXLXDSSSLPXASLRVFVXAXSALLMPTYEEALHHKQATLSQXLGISVPI

SEQ ID NO: 199904 - protein, 110 aa, Triticum aestivum
  unsure (1)..(110): unsure at all Xaa locations
  Clone ID: PAT_TA_94322.pep
RAALSHKTSSSAKIEFEAFQNDQLFPEPTIESQAFSCLPPKSTHPGIPNWASXFQQLSLVQPQLHTSTFQVSQTQGYHGTDXQQFLNKNIPTSTXLKGFRSMGLSXKLRV

SEQ ID NO: 199905 - protein, 67 aa, Triticum aestivum
  unsure (1)..(67): unsure at all Xaa locations
  Clone ID: PAT_TA_94323.pep
SCRIRHEXREREGKAIWAAXIXGGDXGLLWRLPXVTSMXLXHHXXLLRXXYXXXGSXDRCRXSSSRX

SEQ ID NO: 199906 - protein, 112 aa, Triticum aestivum
  unsure (1)..(112): unsure at all Xaa locations
  Clone ID: PAT_TA_94324.pep
SRVFFFFFFFFFFFFFXGAPLXXXLRGYFAXFLRESCLAPLXIXYLPTCVGFGYRYPFVXXRXRLFLGVWXXLXTSAPVTPGMXPSXGEXXLXVQRGLNTSXXCNPLVXPGP

SEQ ID NO: 199907 - protein, 79 aa, Triticum aestivum
  unsure (1)..(79): unsure at all Xaa locations
  Clone ID: PAT_TA_94325.pep
LRVHFTWWETSTLLGPREKRSWLNCRTSNRSDEIGLYVIRKKFFVMXAICKKNKSERTYRADNCIWGKCLGSAEIHPND

SEQ ID NO: 199908 - protein, 64 aa, Triticum aestivum
  Clone ID: PAT_TA_94326.pep
TVPGAKVTTYNYSNVIFRNDMSFSDDTCALIFSPHNLFYPFILQSSHFFLELLHFGPARAEFGT

SEQ ID NO: 199909 - protein, 79 aa, Triticum aestivum
  Clone ID: PAT_TA_94327.pep
CGNTYNGWDDMVLKGNPEISKFIAYYTKGETVVAVATMGVDPVVMQASELMRINAMPSKSELLNDVDILKIGISREGKM

SEQ ID NO: 199910 - protein, 141 aa, Triticum aestivum
  unsure (1)..(141): unsure at all Xaa locations
  Clone ID: PAT_TA_94328.pep
MAPTVMASSATSVAPFQGLKSTAGLPVSRRSNGASLGSVSNGGRIRCMQVWPIEGIKXFEXTLSYFANRSTREALLKARSNYLIPPPKWGALGPPSSSKGLGFNPSRGNKRNPPGTNARYWDCKPGMGGNRTPNKVDVGVK

SEQ ID NO: 199911 - protein, 127 aa, Triticum aestivum
  unsure (1)..(127): unsure at all Xaa locations
  Clone ID: PAT_TA_94329.pep
KSGKPLHYKGXSAFHRVIPDFMCQGGDFTRGNGTXGGESIYGEKFADEKFVHKHTKPGILSMANAGPNTNGSQFFICTVPCNWLDGKHVVFGEVVEGMDVVKNIEKVGSRSGTCSKAXVSSPDCGQL

SEQ ID NO: 199912 - protein, 76 aa, Triticum aestivum
  Clone ID: PAT_TA_94330.pep
AERSNADDVAQRSRVRNKTCLGTKGLQMISVHHFMRLDMLHGQALFLYHAGHYFDPIPRPLLVRDSYGSIPTVPVL

SEQ ID NO: 199913 - protein, 72 aa, Triticum aestivum
  unsure (1)..(72): unsure at all Xaa locations
  Clone ID: PAT_TA_94331.pep
IHKLLNLEKIXNRIFXPWRXEKAEIEGIRDCANLCLIIVNKFFAMIRPPKLVYNFWNTIREDKYAWCRIRHQ

SEQ ID NO: 199914 - protein, 59 aa, Triticum aestivum
  unsure (1)..(59): unsure at all Xaa locations
  Clone ID: PAT_TA_94332.pep
WSIXEQRGIXSXGTXNGFXGMDDXXTXKSXNSGTXCCKXSCKPXRWPGGCQNXXVLXLS

SEQ ID NO: 199915 - protein, 167 aa, Triticum aestivum
  unsure (1)..(167): unsure at all Xaa locations
  Clone ID: PAT_TA_94333.pep
ADRASNLTDAAVDSLVQSINVADGVKARFFTNILALAESAGEKVLAFSQYLLPMKFLERLLVKTRGWHVGKEMFVIRGDSKCTMEERELTVAQFNNSADAKVLFGSIKACGEGISLVGASRVVILDVHLNPSVTRQAIGRAFKPGQQKKVFVYRAXXQXDSRGENNP

SEQ ID NO: 199916 - protein, 112 aa, Triticum aestivum
  unsure (1)..(112): unsure at all Xaa locations
  Clone ID: PAT_TA_94334.pep
MSESLLRPAGSHGGSIELKENTIIVVLGASGDLAKKKTFPALFGLYRNQXFLPNDIQIVGYARXKMDHERVSETSQSYIKXPXXGARNNKLGRILVGSYVKANMISDSFAFT

SEQ ID NO: 199917 - protein, 106 aa, Triticum aestivum
  Clone ID: PAT_TA_94335.pep
SCRIRHEAGSIVSRNRNIVLRATLPLAIGLTAGWALLPNSLQNISNLAWKYEQKFPVIAESHIRSREAVEKTWMIARARSQQASDIVNEGVSATRNAVEGWVKKGK

SEQ ID NO: 199918 - protein, 100 aa, Triticum aestivum
  unsure (1)..(100): unsure at all Xaa locations
  Clone ID: PAT_TA_94336.pep
MAETVXRCFVGGLAWAXXDXNLXQAFSQXGXILXAKIIXXRXTXRSRGFGFLTFXSEXSXXXAIQEXNGKXLDXRXITVXEAXSXPLWRXXAXRXGYXFS

SEQ ID NO: 199919 - protein, 174 aa, Triticum aestivum
  unsure (1)..(174): unsure at all Xaa locations
  Clone ID: PAT_TA_94337.pep
ILWAFYTFIQGLFATGLWVLAHECGHQSFSTSKILNDTTGWICHSALLVPYFSWKISHGKHHXATGNMERDMVFVPKTREVFASRVGKFLHEIDXLTEEAPIMTLLHSIAQQLXGWPLYXLFANVTXHDFHERQXEGXLVKGXXNGFXNGXNQFDSXXXTILNPNGPPQLRGAR

SEQ ID NO: 199920 - protein, 159 aa, Triticum aestivum
  unsure (1)..(159): unsure at all Xaa locations
  Clone ID: PAT_TA_94338.pep
MINXLLTLFYXQTDISFILLANPNKNIWEKQRSSVNTHHXGVLDSSGYFLGSDNLTFKATDLGSXVMRRLTLNYDGNLRLYSLNKSDGRWSVTWMAYPRTCSIRGLCGMNGICVYTPRPACACAPGHEIIDQRDRSKGCRPKFNLSCDGQEMFVKLHNT

SEQ ID NO: 199921 - protein, 60 aa, Triticum aestivum
  Clone ID: PAT_TA_94339.pep
DSLVVVSIFSCYYSSVPHVLRKHKILLLLLQFSMHRICFISPKFQNPPCYEMTNDMMEMS

SEQ ID NO: 199922 - protein, 53 aa, Triticum aestivum
  Clone ID: PAT_TA_94340.pep
KPDSELLSQPVCRTQTIDNEHDICLRKEVATLHHAWDRSTTTRPKGLVPNSAR

SEQ ID NO: 199923 - protein, 71 aa, Triticum aestivum
  unsure (1)..(71): unsure at all Xaa locations
  Clone ID: PAT_TA_94341.pep
MEAEKPWACCSSTVCKESLPPVCRCLDKVKECAARVQAVRXVRGQATSSATTGYRXRPKGPCXXKXEWCNA

SEQ ID NO: 199924 - protein, 95 aa, Triticum aestivum
  unsure (1)..(95): unsure at all Xaa locations
  Clone ID: PAT_TA_94342.pep
MTMTEDHTVGHTSSVRNASATREEMSQARLPIQYRDGCAGLLIPLNRCRFKEYYLPWKCENERHSYEKCQXYDEFLMRVAKMDELRAAKGGKRSN

SEQ ID NO: 199925 - protein, 85 aa, Triticum aestivum
  unsure (1)..(85): unsure at all Xaa locations
  Clone ID: PAT_TA_94343.pep
PANICILCCSTXNLTSSTCVTIFGICTTFXVLMCDXLSYNRSSNSIALGXXATXXKSHLDQNPVXAXGXSRMGKRGXLGPXLGGX

SEQ ID NO: 199926 - protein, 147 aa, Triticum aestivum
  unsure (1)..(147): unsure at all Xaa locations
  Clone ID: PAT_TA_94344.pep
REPNPNQELRRWPWPSPCSGTTPPAXTCKRXXSTXTTSSSXTTXPSRATPPPPSXPSSPXXPNRSPPPFSSPXXTTSSTLNSSKAARLRRDSGPXXSPETXELPRLSPXRGKXSLPFRRRPSXPPPXGXGKPRPPAPAEGTRKGGRA

SEQ ID NO: 199927 - protein, 118 aa, Triticum aestivum
  unsure (1)..(118): unsure at all Xaa locations
  Clone ID: PAT_TA_94345.pep
SCRIRQRILNEIHSGTCGHHASSRAIVSKAYRAGFYXPRANKMAKDIVDKCEGSQFYSNMSHKPASALKTIPLVWPFEVWGLDMVGPLKTGKKVVSLICSWQVDKFXKWIEXKPNKEP

SEQ ID NO: 199928 - protein, 151 aa, Triticum aestivum
  unsure (1)..(151): unsure at all Xaa locations
  Clone ID: PAT_TA_94346.pep
APXAXGGXVGEXFEXXNQRGPXDPGGKXRXXGXSXEXWXLTPFXGGSQGXXXPXXKISXPXPPLGGGXDPRXXAXVRFKGKSGHARXPRHXKPXXXFVDXDVTPIRLDDEKXRXSFISPIRVCVCVCARARXPFXXSXLGLXHFXXXKKKK

SEQ ID NO: 199929 - protein, 112 aa, Triticum aestivum
  unsure (1)..(112): unsure at all Xaa locations
  Clone ID: PAT_TA_94347.pep
GKRRPXWXXGGAGLPXQRXVELSTPGRGDGTGALLAGRGRRARADGLXARRXHRLTAPPPPAAAGLGAGTMVISGVRLXLPSISPLPMLWMNXEDFLASCRIRHELVPNSAR

SEQ ID NO: 199930 - protein, 75 aa, Triticum aestivum
  unsure (1)..(75): unsure at all Xaa locations
  Clone ID: PAT_TA_94348.pep
MSCNCGSGCSCGSDCKCGKMYPDLTEQGSAAAQVAAVVVLGVAPENKAGQFEVAAGQSXEGCSCGDNCKCNPCNC

SEQ ID NO: 199931 - protein, 127 aa, Triticum aestivum
  unsure (1)..(127): unsure at all Xaa locations
  Clone ID: PAT_TA_94349.pep
LVPNSARAPTVMASSATSVAPFQGLKSTAGLPVSRRSNGASLGSVSNGGRIRCMQVWPIEGIKKFETLSYLPPLXSTEALLKQVDYLIRSKWGALPXSSARLGFIFREHKRXPWGTTIGRVGMLEAA

SEQ ID NO: 199932 - protein, 47 aa, Triticum aestivum
  unsure (1)..(47): unsure at all Xaa locations
  Clone ID: PAT_TA_94350.pep
XSEHXCLFLTXLXTIHXINTXXNSCDXLNQKNXHRXLFLMTYYNLRT

SEQ ID NO: 199933 - protein, 98 aa, Triticum aestivum
  Clone ID: PAT_TA_94351.pep
MGTIYVDTTLGLDNETASGSETKPYKSLAYAYIREGGIEGKTCLVRASNPATVIDDPKIDDGHIWKEPAKSAIKKAQSALDAHKKKLLKQQQGRHTGS

SEQ ID NO: 199934 - protein, 83 aa, Triticum aestivum
  unsure (1)..(83): unsure at all Xaa locations
  Clone ID: PAT_TA_94352.pep
RARTVRRGRGKFXQALVKWTGWVEPXWEXXEYVSDTEALRIFEDTYGPITTNNGPSNNSGRYVGAEPHVQRSRERRQGNTRRY

SEQ ID NO: 199935 - protein, 102 aa, Triticum aestivum
  Clone ID: PAT_TA_94353.pep
TPGTPPPPSPSPPCSAASTRPRASSPEKQAPNPSPAGGRTEGGGGQRSEPVEQPRRGTASDWEAVGSGGREIIGREVRKGGWVDPIGREVDDGLGVEVNDYH

SEQ ID NO: 199936 - protein, 157 aa, Triticum aestivum
  unsure (1)..(157): unsure at all Xaa locations
  Clone ID: PAT_TA_94354.pep
LVPNSARGHRAPMASCWGRFGLAALWHRLRHLFLARRRARHGRSILGAGGLNYDPLSYAQNFDDSSLELHEAGLHXQVRARPQRLLAXAGMXKNERANSSGAPVAIREDXFCQFXGPLCAPXSGKKXLINPRIFXKMYMYXMSSGVXQVXFPFYSRV

SEQ ID NO: 199937 - protein, 117 aa, Triticum aestivum
  Clone ID: PAT_TA_94355.pep
MPHTAEAESDEIVESRLAVSDHKISGPDNSNRAHLELGITLALFLWPSLTLAVSAAWGGPDSASKREWFASETIDLVAANPDAYEWIERIFGKCYARLILKVEWIKCSMKKPMGRLI

SEQ ID NO: 199938 - protein, 95 aa, Triticum aestivum
  Clone ID: PAT_TA_94356.pep
MADNDEDTLAPNSEPLDLVRLCLDEVVFVKLRGDRELKGRLHAYDSHCNLVMGDVEETVYVMDDDEDDTLKKVHKKLEMLFVRGDSVVLISPRGT

SEQ ID NO: 199939 - protein, 109 aa, Triticum aestivum
  unsure (1)..(109): unsure at all Xaa locations
  Clone ID: PAT_TA_94357.pep
SCRIRHEASFSLHNVVLRHDIPNSARGTVSESYPHLIFEGFTSKLGLRIVKILKHLFPPREAITNRSKMGSRVVTFKNVKDSIELRHHVFVKTSYQXVKLAEVGPENDK

SEQ ID NO: 199940 - protein, 128 aa, Triticum aestivum
  unsure (1)..(128): unsure at all Xaa locations
  Clone ID: PAT_TA_94358.pep
MLNITNRCSYTVWPAAVPIGGGVQLDPGKTWILDVSGLTSRGRLWARTGCSFDGRGDGSCXTGDCGGTLACTDYXXPPVTLAEFTTGHXXXDDFFDISLVXGFKRAMDFLXVPTKGGXGCYXGXXCET

SEQ ID NO: 199941 - protein, 100 aa, Triticum aestivum
  unsure (1)..(100): unsure at all Xaa locations
  Clone ID: PAT_TA_94359.pep
LLPNSARGXQLPFSHPSSXILPSLSYRAASSEAMKFLVESGDXXGXXGXSYRIRAGQGXRXAAXPARXRLPLGPLXXFRGECTPXTRCXVTXLLVRXXGR

SEQ ID NO: 199942 - protein, 151 aa, Triticum aestivum
  unsure (1)..(151): unsure at all Xaa locations
  Clone ID: PAT_TA_94360.pep
RALPADPKPRRRLCGSKSHGSGPHGSISLTPSAPRTHARHPQPSSSVCDLDRPCSPPPASTSPETEASPPSNHGCLAHRRARRSINLAGPGARVACLGSSATRTAQAPSAPSAPATATAXXXWQRASLPVSGTSRXAXSALGCSATPRXFT

SEQ ID NO: 199943 - protein, 95 aa, Triticum aestivum
  unsure (1)..(95): unsure at all Xaa locations
  Clone ID: PAT_TA_94361.pep
EYVSILQWMSFTNGEIASSFSGWLLPIYGRTQYNKKVVDESLKATNRVLETLEEHLLHNTYLIGDILSLADIFCIGIMXKGFQYQFXKXWXAXNP

SEQ ID NO: 199944 - protein, 100 aa, Triticum aestivum
  Clone ID: PAT_TA_94362.pep
CGWRQPRASASCASASPCLPLTPASLTEPGTRHSRRQRPCSPTSVMAHHHQISHRQTPSVLILDTVWSAASTPTSWTSQRQAPPPPAPSPTSSEPRWSSS

SEQ ID NO: 199945 - protein, 76 aa, Triticum aestivum
  unsure (1)..(76): unsure at all Xaa locations
  Clone ID: PAT_TA_94363.pep
FFFFFFFFFFFFFFFFFXRRHSLSLFLGRGGRAYSYRTNKNSWLHLHLPHGTNYLPIYLFYHIAILNTLHHWLEFL

SEQ ID NO: 199946 - protein, 102 aa, Triticum aestivum
  Clone ID: PAT_TA_94364.pep
LVPNSARARAEFGTRFEYVNSNTFFLQSSSNIEKCNIGQNCAPSYLKYKNMCSVYMSIEHSTHFVLLRVSQTMGPERWKEPCHCRAFVHTLCIGRCLMGEDD

SEQ ID NO: 199947 - protein, 95 aa, Triticum aestivum
  unsure (1)..(95): unsure at all Xaa locations
  Clone ID: PAT_TA_94365.pep
HQKSLFQLKEESSGYQVLASLFLMSKTFLSLIGRNMSEHCSKIPGWASLFKIEVYRTQKPSGIEPPRKSTPXSXRLGRRKNIXQRXXSXPGVXNF

SEQ ID NO: 199948 - protein, 135 aa, Triticum aestivum
  Clone ID: PAT_TA_94366.pep
EQLLTEISTLASVYHKPPETFIGQGRYGADAIQHAAIQEQRENAVENPIAASTVVSSQNNADNLLDIDFDGTVPVSPGIPVSANRFKAEALAVTTKGLSIPKSEAAPASSGLNDMMGLFDLNVHKPPYQCSYVQV

SEQ ID NO: 199949 - protein, 71 aa, Triticum aestivum
  unsure (1)..(71): unsure at all Xaa locations
  Clone ID: PAT_TA_94367.pep
ASAKYLINIDNLLLSAGRPRNERTYLFQTEITPXISLSXXIGXYSSKTQPICIHLVILHQPEKDSXMLXWF

SEQ ID NO: 199950 - protein, 127 aa, Triticum aestivum
  unsure (1)..(127): unsure at all Xaa locations
  Clone ID: PAT_TA_94368.pep
RAEFGTRSSARVPSDMGAVVSRASSTLDPSTTTTRAPTAVSFSQLITLTASQLPSGWAGGSLNLRKQRLMSCVKPAPSTPAIRRQRIVTASAQALGVTYVTKHHLTWKLPKVTWIRPXXLKSGNNRV

SEQ ID NO: 199951 - protein, 55 aa, Triticum aestivum
  unsure (1)..(55): unsure at all Xaa locations
  Clone ID: PAT_TA_94369.pep
NNYKWEIHDDLPXSVVLXTFGAGEAKIXSNPKPKXLXXNFWKXRVKNLGPGNLXP

SEQ ID NO: 199952 - protein, 96 aa, Triticum aestivum
  unsure (1)..(96): unsure at all Xaa locations
  Clone ID: PAT_TA_94370.pep
METGAKAPXKAGRRAGGGGPXKKSVSRSVKAGLQFPVGRIXRYLKHGRYAKRVGSGAPVXLAAVXXXSXXELLXLXGNXAXENXKKRDXXGSSPNQ

SEQ ID NO: 199953 - protein, 65 aa, Triticum aestivum
  unsure (1)..(65): unsure at all Xaa locations
  Clone ID: PAT_TA_94371.pep
XCXIRHESVKLCGTSFRVXEXPTVSIYLMLPWRIRXXXYHFXGXGSVRGXXXNXRFXXSRGXSVS

SEQ ID NO: 199954 - protein, 88 aa, Triticum aestivum
  unsure (1)..(88): unsure at all Xaa locations
  Clone ID: PAT_TA_94372.pep
MKGTKLAAILILQAVLVMGVLSHVNADYFPKCCNNCRSFSGVDVCDDAHPKCPKGCSACRVVSXSPEMWRCAXMKSTVHGTXGGPCQK

SEQ ID NO: 199955 - protein, 91 aa, Triticum aestivum
  unsure (1)..(91): unsure at all Xaa locations
  Clone ID: PAT_TA_94373.pep
MKGTKLAAILILQAVLVMGVLSHVNADYFPKCCNNCRSFSGVDVCDDAHPKCPKGCSACRVVSTSPEXMWRFXXFKSNVDXNLAGGPGKKY

SEQ ID NO: 199956 - protein, 108 aa, Triticum aestivum
  Clone ID: PAT_TA_94374.pep
MNTNINPATSSTLHSQHSQLPKEWDRRRGSNDPQEQDSIPVVYRSTPIAKSWAHFVAGGIGGMAAATLTAPLDVLKTRLQSDFYRAKISRSRVGPEESLARRRKASLR

SEQ ID NO: 199957 - protein, 104 aa, Triticum aestivum
  unsure (1)..(104): unsure at all Xaa locations
  Clone ID: PAT_TA_94375.pep
SCRIRHEASPFRLPSSHRAPRRRRRLLHTRPARRGRVLLRAARGEISAGLCCARRPLXEGXXGGGWXAGSQXXLTGXWSXGVKXKEQNGEFSXSPXXXGGQFYX

SEQ ID NO: 199958 - protein, 138 aa, Triticum aestivum
  unsure (1)..(138): unsure at all Xaa locations
  Clone ID: PAT_TA_94376.pep
MASPAPATAKPIALRRPPVPVRGGFCPARPSMAAAAGRFRVSASASASDVPDFLSSDWLETRKKKPLGPRLNFNAEEAVXYQLEALKYNDKPRPDYGVEVMXRFARAFDPFEKVKLNFGTXSFDXWGNFEXFPGGNIN

SEQ ID NO: 199959 - protein, 125 aa, Triticum aestivum
  unsure (1)..(125): unsure at all Xaa locations
  Clone ID: PAT_TA_94377.pep
SITLGKRQILPLRTSYIATFSTLCSRRTKFQNSLSERLPARTRFAPSPTGNLHLGSLRTALFNYLIAKATRGKFILRIEDTDXSRTVPGAIEKLCAXLRWGGLKRDKRAGPQTAGPFKNLKRLLL

SEQ ID NO: 199960 - protein, 70 aa, Triticum aestivum
  unsure (1)..(70): unsure at all Xaa locations
  Clone ID: PAT_TA_94378.pep
PALWQTADLSIXLGFERRCIKSGTVTLSLXHAATLSIHISQKSQQSSLPNKALSLIDXKNPSNLSTPKQT

SEQ ID NO: 199961 - protein, 86 aa, Triticum aestivum
  unsure (1)..(86): unsure at all Xaa locations
  Clone ID: PAT_TA_94379.pep
LAMAAARTYVDFVPSHELVEDAAKQTLVVNLPGFKKEHLRVHDRQLRPAXGQRXAAASRAASVSXVPXXSSRSPRAAXPCGIXXRF

SEQ ID NO: 199962 - protein, 95 aa, Triticum aestivum
  Clone ID: PAT_TA_94380.pep
MGKEKTHINIVVIGHVDSGKSTTTGHLIYKLGGIDKRVIERFEKEAAEMNKRSFKYAWVLDKLKAERERGINIDIALWEISKTNQSNLRLDSLGH

SEQ ID NO: 199963 - protein, 61 aa, Triticum aestivum
  Clone ID: PAT_TA_94381.pep
SCRIRHEGQTQHSLSSASTLSATSSVRDCPPMTVTYRLQGLDGEATEPMIKELDSCRIRHE

SEQ ID NO: 199964 - protein, 59 aa, Triticum aestivum
  Clone ID: PAT_TA_94382.pep
YTEVKAVLYMQLHKFPRLKILRFLLNSSFLTHAAIKGSRVESKFVYYFLSGTLGLISNL

SEQ ID NO: 199965 - protein, 59 aa, Triticum aestivum
  unsure (1)..(59): unsure at all Xaa locations
  Clone ID: PAT_TA_94383.pep
EKTHINIVVIGHVDSGKXSTTTGHXXXKLGGIDKRVXQXFEKETAXNNKKSFKXYAWVL

SEQ ID NO: 199966 - protein, 134 aa, Triticum aestivum
  unsure (1)..(134): unsure at all Xaa locations
  Clone ID: PAT_TA_94384.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQXLIDITDDGXVSLLTESGNTKDDLKLPTDDVLLGQIKTGFC

SEQ ID NO: 199967 - protein, 52 aa, Triticum aestivum
  Clone ID: PAT_TA_94385.pep
IIQFNSIQVFDNGFLVSFYAFCGISYGWSQLSLHAEILAGYAGPASCRIRHE

SEQ ID NO: 199968 - protein, 52 aa, Triticum aestivum
  Clone ID: PAT_TA_94386.pep
KLSTFQCIFCTNGLSRHQCIFCTDGVTLCSLYMASDCCYLICNANMTAMCTL

SEQ ID NO: 199969 - protein, 140 aa, Triticum aestivum
  unsure (1)..(140): unsure at all Xaa locations
  Clone ID: PAT_TA_94387.pep
MAPTVMASSATSVAPFQGLKSTAGLPVSRRSSSAGLSSVSNGGRIRCMQVWPIEGIKKFETLSYLPPLSTEALLKQVDYLIRSKWVPCLEXFSKVGFVFREXNKLPRGTNDCRYWDNVGKLAMFRGGTTLQKVLNQGGRE

SEQ ID NO: 199970 - protein, 56 aa, Triticum aestivum
  Clone ID: PAT_TA_94388.pep
ATSSNNNNIFQHKRNLKTGIPESLASMQKQRDIINPRYPRPFSRRQQRVSSPSSPD

SEQ ID NO: 199971 - protein, 66 aa, Triticum aestivum
  unsure (1)..(66): unsure at all Xaa locations
  Clone ID: PAT_TA_94389.pep
MXGIMHKIEDXLXMGGGSXXHKKDEEHNKAXEHXKKDRXHNKDGXHXEGMMXKIKDXIXXXGHXXG

SEQ ID NO: 199972 - protein, 176 aa, Triticum aestivum
  unsure (1)..(176): unsure at all Xaa locations
  Clone ID: PAT_TA_94390.pep
GNEDLESCYLKDIGKLFQLRYLRIRASNNITLPEQIGELQLLVILDLLNCYDISELPSSIAKLRNLKWLLAHRVKLPNGVCNMQALESVSLVVVDYTTPVTALQELGSLTKLRSLGLDWRISDAHKDKMTYADXLVSSLXGKLGNSNLRSLTLIXPWPLDFLXDSWWPPPHQPSRN

SEQ ID NO: 199973 - protein, 106 aa, Triticum aestivum
  unsure (1)..(106): unsure at all Xaa locations
  Clone ID: PAT_TA_94391.pep
SCRIXNKVPNSERXIXXXLPFKLIIMTLLGPXDEXYPDMDVXDKFTMSHIQXGFKICARXLPISTSXSIDXXSEXLXXPVQEXXFGXNYFSIEHIXXXLXDWFYRF

SEQ ID NO: 199974 - protein, 140 aa, Triticum aestivum
  unsure (1)..(140): unsure at all Xaa locations
  Clone ID: PAT_TA_94392.pep
MLPPPPPRNTRTCPSPAADRPTLPMPPAAPXPGPVPRLGRPAGAAAGGGAPPPPSLHPLALRLRGDVPPLATPAPRLRRRSHPPPHPAAPPPLPRLPTGALLPARRPPIPLVPHPRPGGGRHAPLRLKRPTNPPSGGAPS

SEQ ID NO: 199975 - protein, 130 aa, Triticum aestivum
  unsure (1)..(130): unsure at all Xaa locations
  Clone ID: PAT_TA_94393.pep
LXDDFIEKDRARGIFXIQDWVAMPGVIPVASGGSHVWAYXPALTEIFGXDSVLQFGGGTLGHPWGNAPGAAANRVALEACVQARNEGRDLAREGNEIIRAACKWSPELAAACEVWKAIKXEFEPVXTIDK

SEQ ID NO: 199976 - protein, 152 aa, Triticum aestivum
  unsure (1)..(152): unsure at all Xaa locations
  Clone ID: PAT_TA_94394.pep
MEGAFVVVGRGRHGHGTATGQTSGGSTRRWGSREGHDRVKLVLASILTDGLLSAASVKPRLRVCKRRPQAHPGDCHPSKLHHRHPSPVPRSDGVSTXVSPXRKRKKETXRHLXXXGRXKRMILTXLXSFFRGXSQFGPKGVPSAXLRKXXXP

SEQ ID NO: 199977 - protein, 109 aa, Triticum aestivum
  unsure (1)..(109): unsure at all Xaa locations
  Clone ID: PAT_TA_94395.pep
LSLGKIDKVKKLLXFAYTPPSSLAVYHRNLVLASHLLDSHVALNLLLDSLLDKSAYGTIRMVDPDLQNAEELLEQDIRNLQDKLATLDLHELQTRNVRRDQIVERWSRR

SEQ ID NO: 199978 - protein, 183 aa, Triticum aestivum
  unsure (1)..(183): unsure at all Xaa locations
  Clone ID: PAT_TA_94396.pep
EMVIRLQERIRQLGEMKTYLLINSNYLKAEDSEDIQTLERDLNNCTNELFFMMKAITTSQRKYDSSKTSGLLRWNISSQQIVWHLIRENNEPLLEFQLQRAEYDRTDNSDGSHINLMQVGKIIGLNLLPXDAIYPXIFAPYSDXDGKSNDXIKQXMLRVYWDMLESIASIXVMGHFEGNLXPL

SEQ ID NO: 199979 - protein, 92 aa, Triticum aestivum
  unsure (1)..(92): unsure at all Xaa locations
  Clone ID: PAT_TA_94397.pep
SSQLGRPGQEDAPALVNYLVGENPITAAAGRVHSIVLMSKGEVWAWGSGRNGRLGLGSSXDEAEPCLIDTLEGVEVLQVATGMDHNLILVKE

SEQ ID NO: 199980 - protein, 117 aa, Triticum aestivum
  unsure (1)..(117): unsure at all Xaa locations
  Clone ID: PAT_TA_94398.pep
LLLHSRALHPTSSIFPPQLSCPLKSSLPPQLSLHTTARLTPLPWRQSNPWLASPLSSFGQVNQDSXDLIXXNKLQXPTXXFLQXQKVNPPLNPKKRXKGENEXGGNLPRLKENPXXV

SEQ ID NO: 199981 - protein, 153 aa, Triticum aestivum
  unsure (1)..(153): unsure at all Xaa locations
  Clone ID: PAT_TA_94399.pep
LVPNSAREKKDKRYGGLRRLRXRARKQLTLKNKKNNFIFRLHTVPQADYKNGFTXNIYRSQRALRSNRRRTYQDXEEKNSSFHLRRNTGPKYSRWXVYWXNXGQXVHPQRXEXSIXSXCLXFQRTXTXHPXGXGXQXIGXXPPSXFXXFXNTT

SEQ ID NO: 199982 - protein, 120 aa, Triticum aestivum
  unsure (1)..(120): unsure at all Xaa locations
  Clone ID: PAT_TA_94400.pep
QSAAGLNLINANSEFDYSSDLIPGPELATKNQKPFASKISRNTVKSFSISVHVASRAQAGCKLETITSSSSSHAHSAXLELKISLHLCWRDKTLKRKQLRVFPAPVSXLFKAIPDAXXXP

SEQ ID NO: 199983 - protein, 111 aa, Triticum aestivum
  unsure (1)..(111): unsure at all Xaa locations
  Clone ID: PAT_TA_94401.pep
TCXQVESFFYLFLPKNCLWVGTGIGISRSPLLGGRAXRAAWSCLIKASLSSMEDPAFAGTVFTVRSALRTDALAAYSLLDIRRISFSEGDRVGISSLPIXRPILARERAAR

SEQ ID NO: 199984 - protein, 72 aa, Triticum aestivum
  Clone ID: PAT_TA_94402.pep
FTSALTDSSIVLILYKSLGPSLRMAAMDHPLFSAWRGCDNFYSLYYSYFQFEGDRRLLVRIIRSLTTSSSRS

SEQ ID NO: 199985 - protein, 125 aa, Triticum aestivum
  unsure (1)..(125): unsure at all Xaa locations
  Clone ID: PAT_TA_94403.pep
PYSRDQSMPAKYPQFILLGDSLVEYSSYLQDGFCFGAALAKHCARRLEVVNRGLCGYNTXIELHILHELMPSPDEARVRLCASFVRXPTMXVSPDDARQXAYSPFDXLQSRTIPGXIYYPMPPXQ

SEQ ID NO: 199986 - protein, 134 aa, Triticum aestivum
  unsure (1)..(134): unsure at all Xaa locations
  Clone ID: PAT_TA_94404.pep
METALKSWEAENSIGLIDPHRDALYTYDSAEQKAIGLSTPWTKDPSYFKNVRISAVALLKMVMHARSGGSIEVMGLMQGKILGDTFIVTDAFRLPVEGTETRVNAQDEANEYXVTYLQXCREQGKLENAVGWYH

SEQ ID NO: 199987 - protein, 62 aa, Triticum aestivum
  Clone ID: PAT_TA_94405.pep
SLRGPFPDPSAPARPLARSRFPASACRSPLRAPERRSRSSKPGRARSSPSINYFSSCRIRHE

SEQ ID NO: 199988 - protein, 123 aa, Triticum aestivum
  unsure (1)..(123): unsure at all Xaa locations
  Clone ID: PAT_TA_94406.pep
MANPRVFFDMTVGGAPAGRIVMELYKDAVPRTVENFRALCTGEKGVGKSGKPLHYKGXSAFQRVIPDFMFQGGDFNRGNGXTXGESIXXQKFXXEKFVQKQXKARDSXQXATXGPTTXGSQXF

SEQ ID NO: 199989 - protein, 161 aa, Triticum aestivum
  unsure (1)..(161): unsure at all Xaa locations
  Clone ID: PAT_TA_94407.pep
MAPKAEKKPAAKKPVEEEPAAEKAEKAPAGKKPKAEKRLPAAGKTSAKDGDKKAKKKSKKSVETYKIYIFKVLKQVHPDIGISSKAMSIMNSFINDIFEKLAGEAAKLARYNKKPTITSREXQTSVRLVLPGEXLAKHAVSEGXKAVTKXNSSRFARPPQW

SEQ ID NO: 199990 - protein, 112 aa, Triticum aestivum
  unsure (1)..(112): unsure at all Xaa locations
  Clone ID: PAT_TA_94408.pep
EHGIALLCAMARNVAQADASLKAGKWARTKYVGVSLVGKTLAILGFGKVGSEVARRAKGLGMHVIAHDPYASADRARAIGVDLISMEXAMTTADFISLHKPLNPFKKQRLTN

SEQ ID NO: 199991 - protein, 80 aa, Triticum aestivum
  unsure (1)..(80): unsure at all Xaa locations
  Clone ID: PAT_TA_94409.pep
LXXNXARDQTLISPSTYHGQAXTPARARCTPTSPPSKHPAHXXGPAMEVEAFPIGFTRGVRGALXSXAMXHXPGGXAQGL

SEQ ID NO: 199992 - protein, 111 aa, Triticum aestivum
  unsure (1)..(111): unsure at all Xaa locations
  Clone ID: PAT_TA_94410.pep
IFTPLHPDEQDGCYEIDDPVIAFHQNHRRKLLLVAAAEVGLPAEGIGLERPHXRRHCSPRGWXSRRRGSPADPXASRLLAXXEDXRGSVXTXTAQPRXXPHSGSSXRAFXS

SEQ ID NO: 199993 - protein, 129 aa, Triticum aestivum
  unsure (1)..(129): unsure at all Xaa locations
  Clone ID: PAT_TA_94411.pep
RAARAEFGTRGGVTGDGPLRLPQLTSYTDVFGEWTPGKGPICGFCGDECKDGKVETLKDGFKVCSTCCKTNSAKKEEANKCSIVKXENSDNQAXNSWTXSXTXLLLXGXLKHGXDWDFINQQVXTKNKT

SEQ ID NO: 199994 - protein, 127 aa, Triticum aestivum
  Clone ID: PAT_TA_94412.pep
RAEFGTRRTKRFHRHQSDTYKCVDPSWRKPKGIDNRVRRRFAGQIAMPSIGYGSNKKTRHMMPSGHKAFLVHNTRDIDLLLMHNKTFAAEISHSVSVEEKRISNHSAWLRELKCLKTNLLKRNQPTK

SEQ ID NO: 199995 - protein, 68 aa, Triticum aestivum
  unsure (1)..(68): unsure at all Xaa locations
  Clone ID: PAT_TA_94413.pep
LFGKLPPPPGXFFFXFFFFFFFFFFFFFFFFFFFFFFFFFFTNINLDHGIEAFIIEDIHQDKRLFLTD

SEQ ID NO: 199996 - protein, 144 aa, Triticum aestivum
  unsure (1)..(144): unsure at all Xaa locations
  Clone ID: PAT_TA_94414.pep
SSSPLFANAPPEKKGVKNFAIDFLMGGVSAAVSKTAAAPIERVKLLIQNQDEMIKAGRLSEPYKGIGDCFGRTIKDEGFGSLXXRGNTANVIRYFPTQALNFAFKDYFKRMXNFKKDKGMVTGKWFGGNLAFWWCCLGASLALL

SEQ ID NO: 199997 - protein, 101 aa, Triticum aestivum
  unsure (1)..(101): unsure at all Xaa locations
  Clone ID: PAT_TA_94415.pep
KPRGLHTNTXKLIYWAKGKYCILSASQXISTRKSNQFHFELNYFSGGCRQDPDNQRMLLFTLRKASQTPIPVSQTTCRVTQTCRSFRPSGTGRTGQFLDST

SEQ ID NO: 199998 - protein, 72 aa, Triticum aestivum
  unsure (1)..(72): unsure at all Xaa locations
  Clone ID: PAT_TA_94416.pep
HDSXFXDSVVXPGLPQSFXHSAKPEVAMRKERGEDAAXXSVQRQAAXYLPXVDLXAXTAGXDXPGSXWFLFC

SEQ ID NO: 199999 - protein, 73 aa, Triticum aestivum
  unsure (1)..(73): unsure at all Xaa locations
  Clone ID: PAT_TA_94417.pep
GYAFFLXGFDEGXKILVVLSTDDCNVHAPKLTRCRSNILLKETRYVMTPFIPTGISMLQAAELGGKAQIWPEL

SEQ ID NO: 200000 - protein, 74 aa, Triticum aestivum
  unsure (1)..(74): unsure at all Xaa locations
  Clone ID: PAT_TA_94418.pep
MVKAVAVLTGSEGVKGTIFFTQEGEGPTTVTGSVTGLKEGLHGFHVHALGDTTXMGCMSTGPHFNPAGHXHGAP

SEQ ID NO: 200001 - protein, 144 aa, Triticum aestivum
  unsure (1)..(144): unsure at all Xaa locations
  Clone ID: PAT_TA_94419.pep
CRIRHEIQSSPPTISPGNLRSERSEGSLVLLLKMQIFVKTLTGKTITLEVESSDTIDNVKAKIQDKEGIPPDQXQRLIFAGKQLEDGRTLADYNIQKEXSTLHLXLKGSVGGMQIFVKTLNRXXNITPRVVQDHFTIRADSKQK

SEQ ID NO: 200002 - protein, 144 aa, Triticum aestivum
  unsure (1)..(144): unsure at all Xaa locations
  Clone ID: PAT_TA_94420.pep
DVLAPLSRAHVGSPAAAAASARPYVLHRFNWRTIRRRGAGLRCRRRLLSARGERPAPDDDXDDEELAGFDAAVALFNGGEYHACHDVVEELWYSAEDPARXLLHGVLQCAVXGFHHLFQPTNRGRHDWKLGGKALQGRPCASDD

SEQ ID NO: 200003 - protein, 104 aa, Triticum aestivum
  unsure (1)..(104): unsure at all Xaa locations
  Clone ID: PAT_TA_94421.pep
MADEQNGSAXWPVADAALRQEILDIVQQASHYRQLKKGANEATKTLNRGIAELIILAADTAPLAILLHLPXLCXEDKNVPYCYVPSKTASRDELGGCARGPLIW

SEQ ID NO: 200004 - protein, 128 aa, Triticum aestivum
  unsure (1)..(128): unsure at all Xaa locations
  Clone ID: PAT_TA_94422.pep
ARRILLPRRLKMQIFVKTLTGKTITLEVESSDTIDNVKAKIQDKEGIPPDQQRLIFAGKQLEDGRTLADYNIQXKESTLHLVLRLRGGMQIFVKTLTGKTITLEVEXSDTIDXXXGPKXQGQRRGIPP

SEQ ID NO: 200005 - protein, 53 aa, Triticum aestivum
  unsure (1)..(53): unsure at all Xaa locations
  Clone ID: PAT_TA_94423.pep
MGESRQXLVAWLNNLLSLNITKVEQXGTGAAXLCQVFDSIYLDIPMSRVKFNG

SEQ ID NO: 200006 - protein, 125 aa, Triticum aestivum
  unsure (1)..(125): unsure at all Xaa locations
  Clone ID: PAT_TA_94424.pep
MRMHSHALLVVLLCSLLAGAGNAEPSPDPTYKDCHPGDKAALLAFKAALGEPYHLSGWTSDSPCCDWERRHLRPLHRPRRQPRPSSRTPTSRAPSPSALAGLPXLQDLTLXHLPLLSGPIPPGDG

SEQ ID NO: 200007 - protein, 106 aa, Triticum aestivum
  unsure (1)..(106): unsure at all Xaa locations
  Clone ID: PAT_TA_94425.pep
MARMLSARSFFAGGVIDGRVYVAGGYSTDQFELDSAEVLDPVNGVWQPVASMGANMASSDSAVIGGRLYVTEXCAWPFFSSPRXGQVYHSKADRWGDAAPGNPRGW

SEQ ID NO: 200008 - protein, 101 aa, Triticum aestivum
  unsure (1)..(101): unsure at all Xaa locations
  Clone ID: PAT_TA_94426.pep
LVPNSAPESLPLLLETKVPILATGYTQYDMERDYDWVKKNSHGEVDILMEPGENRFRSLRWDINDLDPQDISCGNWGXVWGFXGKRYEAQRKNIESLKANF

SEQ ID NO: 200009 - protein, 148 aa, Triticum aestivum
  unsure (1)..(148): unsure at all Xaa locations
  Clone ID: PAT_TA_94427.pep
AVVDQISSSLASPRPGPCPCPTIQLQRSTSRRSISFSRQGADAVSAPVRSLRTHHAGAPDPSERRHALPVQAAGPGRRRLAGERVPPPHARPRRRLPRLHRLRSXXPTNSASSPXSPAXAPGSPXSLXXPGNATXXGATXRXKGXRXX

SEQ ID NO: 200010 - protein, 72 aa, Triticum aestivum
  Clone ID: PAT_TA_94428.pep
AYDSNWCENTLYCASLASSSPGEVWTNLMIKLSKPIRPYRLNRLCAGFEASMASIRVTKALVYTHNMTVEMN

SEQ ID NO: 200011 - protein, 76 aa, Triticum aestivum
  unsure (1)..(76): unsure at all Xaa locations
  Clone ID: PAT_TA_94429.pep
MVLRIRLARFGRRRNPIYNIVVAQXRSARNXKPLEVLGTYDPLLKTTPYGSDARFKDVKLDSARAQYWLGVXAQPK

SEQ ID NO: 200012 - protein, 134 aa, Triticum aestivum
  unsure (1)..(134): unsure at all Xaa locations
  Clone ID: PAT_TA_94430.pep
MAPTVMASSATSVAPFQGLKSTAGLPVSRRSNGASLGSVSNGGRIRCMQVWPIEGIKKFETLSYLPPLSTEALLXKQVDYXIRSKWVPCLEVSARLGLSSXEHKRNPLGYYDGPVPGTNVGLAYVRVATDHARV

SEQ ID NO: 200013 - protein, 129 aa, Triticum aestivum
  unsure (1)..(129): unsure at all Xaa locations
  Clone ID: PAT_TA_94431.pep
MGKEKTHINIVVIGHVDSGKSTTTGHLIYKLGGIDKRVIERFEKEAAEMNKRSFKYAWVLDKLKADRERGITIDIALWXVXXTPSYYCNVIDAPWVTVDFIXETIDYWVPPQGLDWCLLLHQTPNLGGF

SEQ ID NO: 200014 - protein, 120 aa, Triticum aestivum
  unsure (1)..(120): unsure at all Xaa locations
  Clone ID: PAT_TA_94432.pep
LVPLVPNSARADLDDFFTLRRFPRNFKPKPDQGEFTGVEGEQHIFPVFKDGDVFQNNRLSGSIRVVTTGLDTTNCTVIGLVKEXIKVDADVDFNASATDVDLDSDLDVGKKFTKCEPLXQ

SEQ ID NO: 200015 - protein, 123 aa, Triticum aestivum
  unsure (1)..(123): unsure at all Xaa locations
  Clone ID: PAT_TA_94433.pep
MSSSVTSNQDLPVSQYNLNTYWGRVQHCAAISDPRTLFVSNDELXESAKNLIAAYRQGSIRDLDERVWKAKKIVDSTLHPDTGAPVFLPFRMSCYVMSNLXVVTAGMLTPNLXRRGIIFWQDC

SEQ ID NO: 200016 - protein, 132 aa, Triticum aestivum
  unsure (1)..(132): unsure at all Xaa locations
  Clone ID: PAT_TA_94434.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSXVGFIFREHNASPGVXNDGRYWDNXWACMFRGATERHQGD

SEQ ID NO: 200017 - protein, 50 aa, Triticum aestivum
  unsure (1)..(50): unsure at all Xaa locations
  Clone ID: PAT_TA_94435.pep
NCMSCIIILEAPNANGKRWEFVFIHWEVAFSYLVSPRHTGLRYMLAILSX

SEQ ID NO: 200018 - protein, 90 aa, Triticum aestivum
  unsure (1)..(90): unsure at all Xaa locations
  Clone ID: PAT_TA_94436.pep
MKGTKLAAILILQAVLVMGVLSHVNADFFPKCCNNCRSFSGVDVCDDAHPKCPKGCSAXCRVVSTSPEMWRCADMKSTVDGTCGGPCKKY

SEQ ID NO: 200019 - protein, 106 aa, Triticum aestivum
  unsure (1)..(106): unsure at all Xaa locations
  Clone ID: PAT_TA_94437.pep
ETTDPSARTRQQAPRSIAGAEMGLTFTKLFSRLFAKKEMRILMXVGLDXAGXTTILYXLXLXEXVTTIPTXGFNVXTVXXTRNIXFHPXWGCSGVXDKIRPXVGGH

SEQ ID NO: 200020 - protein, 103 aa, Triticum aestivum
  unsure (1)..(103): unsure at all Xaa locations
  Clone ID: PAT_TA_94438.pep
RAEFGTSGDVLNMWASQHTRSEVLAAATMLSQEELMPDQYRVMTKDVPKPTMDLSAQGELAVGHTIVFHGKDVIALTAGAFNLYLTRVISLFDTNIXFAFGPD

SEQ ID NO: 200021 - protein, 95 aa, Triticum aestivum
  Clone ID: PAT_TA_94439.pep
MRDAGHDAGAGILNWTEIQCVDLTQSLREGVRSSRRCSVAEGTFTTLSFICEMFLFLYVGMDALDIEIWKIVSGTHIQATAGTTNRRRTCYVFGE

SEQ ID NO: 200022 - protein, 146 aa, Triticum aestivum
  unsure (1)..(146): unsure at all Xaa locations
  Clone ID: PAT_TA_94440.pep
ADWQTGALTKPTGQYRNLHQYSSPADPILGSHVWGIVGGRSSFHPPRHGMVTPCPAATCLGEGXPFLQSFQPPQPSVLPCGCEMARQMPPSXGXEGXVXXLGLPRYDWXVVWLVGTASFPPTXXTLASXXPXPWTWRPXCXAPTYX

SEQ ID NO: 200023 - protein, 140 aa, Triticum aestivum
  unsure (1)..(140): unsure at all Xaa locations
  Clone ID: PAT_TA_94441.pep
IASSPRPRPRRRPHPRPRSSPMEDVLDSAVGAHFSGLRRDLRRLSSSSSLPSSPSSATCNDASAAAPSGLASPAPRQPFVIGVCGGTASGKTXVCDMIIHQLHDXRXLLVXQDSFYXGLTXEESEXXWXEXXLXLAXDAF

SEQ ID NO: 200024 - protein, 89 aa, Triticum aestivum
  unsure (1)..(89): unsure at all Xaa locations
  Clone ID: PAT_TA_94442.pep
MKGTKLAAILILQAVLVMGVLSHVNADYFPKCCNNCRSFSGVDVCDDAHPKCPKGCSACRVVSTSPEMWRCADMKSTVDGTCGGPCKXY

SEQ ID NO: 200025 - protein, 55 aa, Triticum aestivum
  unsure (1)..(55): unsure at all Xaa locations
  Clone ID: PAT_TA_94443.pep
XSGTRXLLTDXHRSDXQNTXIVXSSLHXKTPGLPKITXLQFMLRFXXPPXQXVSV

SEQ ID NO: 200026 - protein, 89 aa, Triticum aestivum
  unsure (1)..(89): unsure at all Xaa locations
  Clone ID: PAT_TA_94444.pep
KERVXNKQKSRTQSGETCRTTRKVYSDCTRGFEGAKHYHINFNYIEKFSLVLKVSIIFCSDFSFEKSFRQMYSVLQSIDFTDRYEDFIF

SEQ ID NO: 200027 - protein, 123 aa, Triticum aestivum
  unsure (1)..(123): unsure at all Xaa locations
  Clone ID: PAT_TA_94445.pep
EFMEKVAKTADVGELTVEERNLLSVAYKNVIGARRASWRIISSIEQKEESRGNEAYVASIKEYRTRIETELSKICDGILKLLDSHLVPSATAAKSKVFYLKMKGDYHRYLAEFKGRVLXKESS

SEQ ID NO: 200028 - protein, 95 aa, Triticum aestivum
  unsure (1)..(95): unsure at all Xaa locations
  Clone ID: PAT_TA_94446.pep
MSCCGGNCGCGTACKCGNGCGGCNMYPEAEAAGATLLVSATATHKASSXXGMEMAGRXPXGCGCTPVGGHQALACLQAAIININIAPPVQASDSY

SEQ ID NO: 200029 - protein, 121 aa, Triticum aestivum
  unsure (1)..(121): unsure at all Xaa locations
  Clone ID: PAT_TA_94447.pep
LXNVLXTEFEXHLKIRSTCMDLQCPLYVPQTEYTIYENCTAVPPTKXATYRLDRKHTTETQHAAMAMASRKEFRQREDLSITFSCCCSSEDDALCCAASSLLVVFFSLVTHFASELPTTTL

SEQ ID NO: 200030 - protein, 71 aa, Triticum aestivum
  unsure (1)..(71): unsure at all Xaa locations
  Clone ID: PAT_TA_94448.pep
LFXARIHRRXFKYPCXXLXSLLSNVRAREHLPVWDXFYDKKSDFXSLFRRIISLSLDTXLSXTVRIHVLSX

SEQ ID NO: 200031 - protein, 99 aa, Triticum aestivum
  unsure (1)..(99): unsure at all Xaa locations
  Clone ID: PAT_TA_94449.pep
LVPNSARARAEFGTRLLLLSCLTPFEAAADAFCDNVKVLAATLPXKTSSSPVHFATTTVGQAPDIVYALALCRGDILNXTACSRSVXNXFXHXCGMPLH

SEQ ID NO: 200032 - protein, 85 aa, Triticum aestivum
  unsure (1)..(85): unsure at all Xaa locations
  Clone ID: PAT_TA_94450.pep
XCRIRARRVPQPSASDRADSSRSTFTLYCTSRPGGPSGCCQGGYTPSGHHDGADEGGPGSQPSCLRCQLSSPKQCLGRLITDWFF

SEQ ID NO: 200033 - protein, 63 aa, Triticum aestivum
  Clone ID: PAT_TA_94451.pep
GAEFGTRVALEACVQARNEGRDLAREGNEIIRAACKWSPELAAACEVWKAIKFEFEPVDTIDK

SEQ ID NO: 200034 - protein, 146 aa, Triticum aestivum
  unsure (1)..(146): unsure at all Xaa locations
  Clone ID: PAT_TA_94452.pep
MAAAFSSTVGAPASTPTNFLGKKLKKQVTSAVNYHGKSSKANRFTVMAAENLDEKRNTDKWKGLAYDISDDQAGHHQEGRAXVDSLFXAPTGXGNHEGRPQAPTXYVSQGTQRSXTFDNXNGKAFYIAPGXQWDKPCLSSSKIHPP

SEQ ID NO: 200035 - protein, 159 aa, Triticum aestivum
  Clone ID: PAT_TA_94453.pep
ATAQDIPTALHSSLGASSRRRVSSSLGTAFAGQGLLREINATLKQLKPFDTQDIKILLLENINQAGHDILESQGYQVEALKTSLPEEKLIEKIRDVHVIGIRSKTKLNERILREARHLVVIGCFCIGTNQVDVDFAAKQGIAVFNSPFANSRKCCSLIW

SEQ ID NO: 200036 - protein, 178 aa, Triticum aestivum
  unsure (1)..(178): unsure at all Xaa locations
  Clone ID: PAT_TA_94454.pep
XEGXXRXGGXQPXPFXWSXXXGPXXPTPCXGSNPPXXRGVRFPXLFLLVSEEGTPQQGTAAAWSFATGSRGRRAAAGTWRGRRQGGRRPSGTDSRRWGANPGEARSWRRANLPVSGTRRGRAEGLRGGAANEAWRGAELDGSSRGTPVCWVTGTARKRPATKLGAASMALFSCRIRHE

SEQ ID NO: 200037 - protein, 104 aa, Triticum aestivum
  unsure (1)..(104): unsure at all Xaa locations
  Clone ID: PAT_TA_94455.pep
RRLLAVRRSSSPDQIALRREAMVKAVVADEARVKAFEDGVASSGVLRSQVGLVVGKLSASSDRALVYSLLPTPPTDAGEPACSLRAAXPSAGKAKSKGGKRRRG

SEQ ID NO: 200038 - protein, 86 aa, Triticum aestivum
  unsure (1)..(86): unsure at all Xaa locations
  Clone ID: PAT_TA_94456.pep
LVPNSARVKVSDCSTVLPKRCDSVHVFLIARMANSYVQTSPDRYLALTNLNAWMELCRSGEAALNFSDVFNQTXSYQRLMQLAKQI

SEQ ID NO: 200039 - protein, 114 aa, Triticum aestivum
  unsure (1)..(114): unsure at all Xaa locations
  Clone ID: PAT_TA_94457.pep
NVLLNLTFGNSTTHHTKISMXIGSHGKRRQGHIQHVMLIIGPIVARSSCHAGGFLGVQQDLQRQTKVEGFXGGLHLXHRLKXTTXKFLPTNSGXRRLWQVFSGGTSCKVQLPXP

SEQ ID NO: 200040 - protein, 90 aa, Triticum aestivum
  unsure (1)..(90): unsure at all Xaa locations
  Clone ID: PAT_TA_94458.pep
QVGPCGRNLGRXIRRRAAQEESSRPXADXXXACXERPSQSPPIFPGLRYEATATDEAADSFLLRQELVSCWWWIGGRRLRCRPPSCGVFX

SEQ ID NO: 200041 - protein, 109 aa, Triticum aestivum
  unsure (1)..(109): unsure at all Xaa locations
  Clone ID: PAT_TA_94459.pep
MTFFGFGVGYLQESSTPRGVGTERGLSXMEVLETENFXRMQCFSTLTGTKFLLFTEPQQPNVDLILSNIYELYVDYVMKNPFYQLXEMPVRCEGWERRLVGCLRVMNSK

SEQ ID NO: 200042 - protein, 101 aa, Triticum aestivum
  unsure (1)..(101): unsure at all Xaa locations
  Clone ID: PAT_TA_94460.pep
MAAAGERRLLVGLLLLALMVSAHCLDGAGHHGPRVXRRXKKREIXSPVKXXVVVVMXNXSFHHVLRLAPPPPEHGAPGNCPNRSNVTPSFPGEDGTRKGPW

SEQ ID NO: 200043 - protein, 123 aa, Triticum aestivum
  unsure (1)..(123): unsure at all Xaa locations
  Clone ID: PAT_TA_94461.pep
RAEFGTSFHTLCMALSVSLFFFLFAIPIFWPLLVPYMLYCMYSTSSTSGDLSHRSPFLRSLSVWDLFATYFPARLHRSQNLIATRKYIFGYHPHGIISMGAFASFXTESLGFCNPFFWSKKHT

SEQ ID NO: 200044 - protein, 58 aa, Triticum aestivum
  Clone ID: PAT_TA_94462.pep
KNVINPNESSFTLYHSWEQASSYRLCRPRTAVLRDREFQVTNITKTIMILFHSSSGMA

SEQ ID NO: 200045 - protein, 93 aa, Triticum aestivum
  unsure (1)..(93): unsure at all Xaa locations
  Clone ID: PAT_TA_94463.pep
NSXRNSPXXXRXXRXGAXXXIXXLITXRXXXXPXXXGFSAPLLFXHQXWCXPWRRPWIXPPSWVXGFPGWGGGGXLGREGGRSWFGLGKGERG

SEQ ID NO: 200046 - protein, 109 aa, Triticum aestivum
  unsure (1)..(109): unsure at all Xaa locations
  Clone ID: PAT_TA_94464.pep
MGRVIRAQRKGAGSVFKSHTHHRKGPARFRSLDFGERNGYLKGVVTDVIHDPGRGAPLAKVTFRHPFXYKHXKELFXAAEGMYTGXKFVYCGXXGATLSVGXVIPXXRS

SEQ ID NO: 200047 - protein, 90 aa, Triticum aestivum
  Clone ID: PAT_TA_94465.pep
GICRSETNVNYMRSMSINSSAENPENTIDHPAEPRATTALLPPVVSKLIHKDPLCWLGFTKESILTSCRSGHIRIWERPSNLFETIKVSV

SEQ ID NO: 200048 - protein, 134 aa, Triticum aestivum
  unsure (1)..(134): unsure at all Xaa locations
  Clone ID: PAT_TA_94466.pep
MAPTVMASSATSVAPFQGLKSTAGLPVSRRSNGASLGSVXSNGGRIRCMQVWPIXGIKKFETLSXWPTAQQRRASSKQVDYLIXRLQXWXACLEFKXRLGSTFRXEQQRHLPGYXRMGRYWDNVXKLXXXSGCN

SEQ ID NO: 200049 - protein, 125 aa, Triticum aestivum
  unsure (1)..(125): unsure at all Xaa locations
  Clone ID: PAT_TA_94467.pep
WPLPPENSLTTKKIMRGETFYAKEPKWPAETSSKYRCPQDISREGMPCKASDFSYRMFIPIFLMENQDKMEKLTAKEVASAFXFVCNHILFSHPLGTQENVSHRVWRRNDCRRGESSNXKVSRSS

SEQ ID NO: 200050 - protein, 105 aa, Triticum aestivum
  unsure (1)..(105): unsure at all Xaa locations
  Clone ID: PAT_TA_94468.pep
AIYCNVRELQTSYQSGFGRQVKNSKFIEMSSAKNALELYAILVDETYGELTSRIFTVLLRRGRQQIPLIAKHTRLNPRQVAVTGLVVLIQQEXHIXXVPNXRYGE

SEQ ID NO: 200051 - protein, 66 aa, Triticum aestivum
  unsure (1)..(66): unsure at all Xaa locations
  Clone ID: PAT_TA_94469.pep
SXFAXVRPGXXRHRIQERARXXSYQRLLXLSDXIIKAVGXPSIEKMSTKSKXFKLRYYRALLRPRP

SEQ ID NO: 200052 - protein, 94 aa, Triticum aestivum
  Clone ID: PAT_TA_94470.pep
MLDKLWDDVVAGPRPETGLDKLRRAAATQPLRHQHSCRGRRLTKSPSMPDDPRPRPGDSRRRPTPARAGGSVGGSVFPPRGSPWPPKKPRGAPS

SEQ ID NO: 200053 - protein, 81 aa, Triticum aestivum
  unsure (1)..(81): unsure at all Xaa locations
  Clone ID: PAT_TA_94471.pep
SCRIRHEATSSVEEVASTGPGIRFFQLYVYKDRKVVEQLVRRAXNAXFXAIALXVXXPRLXXRXRATSXRRXXLPLGXTLI

SEQ ID NO: 200054 - protein, 87 aa, Triticum aestivum
  unsure (1)..(87): unsure at all Xaa locations
  Clone ID: PAT_TA_94472.pep
CGXXPSXYPFPGGDDGEGAREXGRRGEXXGAGGGHGPAARRRMXWPXRRGRSGPASCRGGXGGPAGGPGARGRATWPWLXLSRVALV

SEQ ID NO: 200055 - protein, 52 aa, Triticum aestivum
  Clone ID: PAT_TA_94473.pep
TSNPRTTAGARLPVFLLSISGTLKLSSSIFEPRLFGSRGEPCPLSLVPNSAR

SEQ ID NO: 200056 - protein, 108 aa, Triticum aestivum
  unsure (1)..(108): unsure at all Xaa locations
  Clone ID: PAT_TA_94474.pep
LKSYDRDPPDHPLGIIPHQIRGILXTFQNXIISGKSYDCCXSACSPKIINEYKKHGWEFVKRALSDETYVSQISGLAEVQRSAELALENTEWSETEDIYDPGNEGELL

SEQ ID NO: 200057 - protein, 80 aa, Triticum aestivum
  unsure (1)..(80): unsure at all Xaa locations
  Clone ID: PAT_TA_94475.pep
MVKAVAVLTGSEGVKGTIFFTQEGEGPTTXVTGSVTGLKEGLHGFHXHALGDTTNGXCXXTGPHFQTPLGSMCMGGTLER

SEQ ID NO: 200058 - protein, 87 aa, Triticum aestivum
  unsure (1)..(87): unsure at all Xaa locations
  Clone ID: PAT_TA_94476.pep
QVKFWSRFTTPYLHQPAIRISLFVTLHPLQRRTNHHINLLGWGTALALNVGLLLVALKLVLPVVRPVPYXTRLVSCNLXTTCXSTRX

SEQ ID NO: 200059 - protein, 51 aa, Triticum aestivum
  unsure (1)..(51): unsure at all Xaa locations
  Clone ID: PAT_TA_94477.pep
SCRIRHESPSIPIPIPSHSSELETERGXCVERXXCYXXAIGXGXLXSXLCA

SEQ ID NO: 200060 - protein, 94 aa, Triticum aestivum
  Clone ID: PAT_TA_94478.pep
GTPYQLNLNQVSKATESLLAHIQATQKSKLGEEKSTLLDEDPLEDSPIWFQLTTKLHITANKRLKPIKISLPHPLHTHANSSICLITADPQRAS

SEQ ID NO: 200061 - protein, 132 aa, Triticum aestivum
  Clone ID: PAT_TA_94479.pep
RSAALKLDWAQVTSSLGLRGQTATALQAFKKRNEDARRRVQQLKAQPQTVDFAHYRGLLKNQAIVDQIERHCATFRPSTYDLSRQLKSIEAFEAQALKDATATKGRVDLELRDLEKTLKNIEEARPFEDLTS

SEQ ID NO: 200062 - protein, 62 aa, Triticum aestivum
  Clone ID: PAT_TA_94480.pep
EALITRGKGNNFCIMYHPDITKLMQFSGDHLQSFILCLADQVLEMIMSCYVSLDIYVRLLCT

SEQ ID NO: 200063 - protein, 117 aa, Triticum aestivum
  unsure (1)..(117): unsure at all Xaa locations
  Clone ID: PAT_TA_94481.pep
TIAFFSILLVLVLSAISVAASSPNRNGSDTDLATLLAFKAXFSDPLGVLAGNWTTXTSFCHWVXIKCSRRRQXVTALSLXDTPLXGPITPHPRIWIWENHHERVLFLRQYTPLKVFN

SEQ ID NO: 200064 - protein, 92 aa, Triticum aestivum
  unsure (1)..(92): unsure at all Xaa locations
  Clone ID: PAT_TA_94482.pep
GXEITRVXPTWSPKGVXDRTNXASXLLFRFXXQLXGCWHWPGXFWLAAXYXNCKEFXEDPRCCCXSPHRMDXNLLXXEGHIIGRFXVCVKKK

SEQ ID NO: 200065 - protein, 106 aa, Triticum aestivum
  unsure (1)..(106): unsure at all Xaa locations
  Clone ID: PAT_TA_94483.pep
MAPKRGGKAPVPAKKKTEKVTNPLFXKRTXQFGIGGALPPKXKDLHRFVKWPXVVXRSSAXRRILKXRLKVAPGHSPFYXXPXTKNLANKTCSRLLLXXXRARKXX

SEQ ID NO: 200066 - protein, 104 aa, Triticum aestivum
  Clone ID: PAT_TA_94484.pep
MRAYWYDNKPGDARLPHDSGRQVSAKYLAALGVMYLCPSSEEEVAQIARERHYCESDIVTISPENLGTSYESKLDIFFHEHIHEDEEIRYICDGRGYFDVRNEY

SEQ ID NO: 200067 - protein, 107 aa, Triticum aestivum
  unsure (1)..(107): unsure at all Xaa locations
  Clone ID: PAT_TA_94485.pep
MSSHLMDIHLVRTQLNEAQLKHPISSPTKSQVVPLLSSKSTFKNQHILSVDKISRQDLHNLFTVAQEMRLGVQXREGVLSTLKGRVLCTLFYEPSTRASASFDVAKQ

SEQ ID NO: 200068 - protein, 134 aa, Triticum aestivum
  unsure (1)..(134): unsure at all Xaa locations
  Clone ID: PAT_TA_94486.pep
MQTTSLSSAPSSRAPSAPPSTPPPPHVAFPSLRRRDLLLLSASPLPLSLSPXAASARGLFRMPPPGLANRYFLVRAGESVYEGQGLLRTNPVAKTXVDXSGLSPAGLRQAARAALELRRLGACEXDDCWIWPSX

SEQ ID NO: 200069 - protein, 117 aa, Triticum aestivum
  unsure (1)..(117): unsure at all Xaa locations
  Clone ID: PAT_TA_94487.pep
MDTQLPYGSFWLVAVATILMSLILRQVLGXKDTGAKLPPGPWNLPIIXSLHHLVGTKLPPHRAFLRLARRHGPLMLLRXGEVPRVIVSTPEAAMXXLXNEPHLRPGPKRSQRLGHSI

SEQ ID NO: 200070 - protein, 135 aa, Triticum aestivum
  unsure (1)..(135): unsure at all Xaa locations
  Clone ID: PAT_TA_94488.pep
EWWEWVSLVSPFFFWGTAMVAMKGVIPKTGPFFVAALRLLPAGALVVAFAAARGRKQPSGWAAWGAIAAFGLIDAACFQGFLTEGLQKTSAGLGSVIIDSQPLXVAILAALFFGESIGAIXAGGLVLGVVGLFAP

SEQ ID NO: 200071 - protein, 69 aa, Triticum aestivum
  unsure (1)..(69): unsure at all Xaa locations
  Clone ID: PAT_TA_94489.pep
MCHTQVNVRFYVTXALMLRRTKSQVFCSYNGNIAWYTTCVSLVEILEVHSGPTLFNQLMKFGSSLCLTE

SEQ ID NO: 200072 - protein, 133 aa, Triticum aestivum
  Clone ID: PAT_TA_94490.pep
SSHAARVSKNMVVLQYYPERIAASDVELGDKIIDLLYSYSPAGKSVRRMEFERLVRSCVSRRESLHLVLPAFPFKSANRTDKVLGDLPDIGEEMALALLNRICTDINNIYPGSYTTVTIVSRWTGLQRYFRYL

SEQ ID NO: 200073 - protein, 59 aa, Triticum aestivum
  Clone ID: PAT_TA_94491.pep
RDRNLELCRALRKAGKSVEQATYGGVGHAFQVLHNCHLSQPRTQEMLAHIRAFVGARSS

SEQ ID NO: 200074 - protein, 146 aa, Triticum aestivum
  Clone ID: PAT_TA_94492.pep
RAEFGTSTIDAKAFGGHAVNLNLKAEKFPAFAIHNMTDNKKYPYDQELVIDAETIGKHASTFVEGKLDPVIKSEEVPETQDGPVTVVVAKNYEEIVLDDTKDVILEIYAPWCGYCKALAPKYDILGQLYSQAGLNDKVVIAKVDAT

SEQ ID NO: 200075 - protein, 92 aa, Triticum aestivum
  unsure (1)..(92): unsure at all Xaa locations
  Clone ID: PAT_TA_94493.pep
MADDSLRDRLLGHAKSFDGLLSLIPAKFYYGEDNXSNQWKKKKQTKEQAAAARRAKLDPDAAKSAKDVMDEKARKRKLHELEAARRPRRRRR

SEQ ID NO: 200076 - protein, 128 aa, Triticum aestivum
  unsure (1)..(128): unsure at all Xaa locations
  Clone ID: PAT_TA_94494.pep
MPPKSAEKKPSATKAPAKTPVSKEAGKKTASSGDKKKRTKTRKETYSSYIYKVLKQVHPDTGISNRAMSILNSFVNDIFERVATEASKLAAYNKKSXISSXREIQTSVRLXLPGELAXHAVSEGNEGC

SEQ ID NO: 200077 - protein, 113 aa, Triticum aestivum
  unsure (1)..(113): unsure at all Xaa locations
  Clone ID: PAT_TA_94495.pep
MRRDMSTSGSMADDTMQPDSLAVVPPASTLQTSHDDDLDSTLGDDEGSGADYCSVTDSIYDYRVENGRTYHAYMDGKYLLPNDEREKERLERVYKAIDTVFXGKAIFAPLKNP

SEQ ID NO: 200078 - protein, 97 aa, Triticum aestivum
  unsure (1)..(97): unsure at all Xaa locations
  Clone ID: PAT_TA_94496.pep
QRXETGXFRXXRXHXXXXPXXXXPPLLXPASPWXPPXAEAGKRARXSSSARAAPASPAAPGTAWADIEMXFCASLHRDGEVRAAIXRGTWSAHTRLX

SEQ ID NO: 200079 - protein, 137 aa, Triticum aestivum
  unsure (1)..(137): unsure at all Xaa locations
  Clone ID: PAT_TA_94497.pep
FFARNVKFPGLEHLNLNAPNVAYIGYGGSYAGGFVAILRKLYPDVFWGCISSSGVIEAVHDYWAYFEPIRVYADQKCVSNTQKLINVVDNIILGQNDHALTERLKNVFGLPNVTQXDDFAYAISKGIYSWQNRNWDP

SEQ ID NO: 200080 - protein, 69 aa, Triticum aestivum
  Clone ID: PAT_TA_94498.pep
RAEFGTSFSEKLQWQGASWFGGPLATYVAEFVQHSALVECACRPSFVLPFAIQATHLHESSPLRLLSGC

SEQ ID NO: 200081 - protein, 81 aa, Triticum aestivum
  Clone ID: PAT_TA_94499.pep
FYTVIFRLVLPRLNVFTTSPLLLTKGATLIYANSIIGAFGFHQITGLTIIDVKILIPTSHLSFAKFYQPFQTCFFRHLNYF

SEQ ID NO: 200082 - protein, 141 aa, Triticum aestivum
  unsure (1)..(141): unsure at all Xaa locations
  Clone ID: PAT_TA_94500.pep
VTPGXLEVIXTXARQYYTSQXQLDAVPMEEMFPTVAAPNLYSPTPEVEPTAPRWRPPTPAPPGFSRRPTRAARTGCPPFFNDDEAVPPPPSVVPMPSPALIERSRGXQIGLWTDLNSVKVESPNTEGAGASGFLFSDEERE

SEQ ID NO: 200083 - protein, 88 aa, Triticum aestivum
  Clone ID: PAT_TA_94501.pep
MLHPQSPKMPIYQEAILDLKPVGSLVPFANPLADEKVTKKVLKSVKKAAKNKTLKRGVKEVVKALRKSPQGVDATSATGVVVLAADIS

SEQ ID NO: 200084 - protein, 50 aa, Triticum aestivum
  Clone ID: PAT_TA_94502.pep
KQKHSNNSYHLQTHYCHLNSQLVKQQEQVHDLDLHRSDTNSKCKAEWKDP

SEQ ID NO: 200085 - protein, 146 aa, Triticum aestivum
  Clone ID: PAT_TA_94503.pep
DKIVLISNYTQTLDMFDRLCRERGYGSLRLDGTMNVTKRQKLVDKFNDPNGLEFVFLLSSKAGGCGLNLIGANRLVLFDPDWNPAADQQALARVWRDGQKKDCFVYRFIATGTIEEKIFQRQSHKQSLSSSVVDSAEDVERHFTLD

SEQ ID NO: 200086 - protein, 147 aa, Triticum aestivum
  unsure (1)..(147): unsure at all Xaa locations
  Clone ID: PAT_TA_94504.pep
LVPNSARGHFISPAPPMRAADPAQQPPPPPIDPRSAVAXPCPPTRRGAPRSRASSRSTARTARTSASRSAPAPTAPTTPRPRRRRSRSPRSPSTAACPYASSSPSPSSPPSSSSRSGSPRSSSNGGGRRPGPAAAGAANGPWLKREG

SEQ ID NO: 200087 - protein, 103 aa, Triticum aestivum
  Clone ID: PAT_TA_94505.pep
MIFPAETPAPSANPTANPKLEQKTVDASICGWVGGRADAPALCSAGSTCVRDVEHQYVGCCGTSGSCSAGIYTSCLDRNSKGWVKRQGGISKQWASTHVQANK

SEQ ID NO: 200088 - protein, 144 aa, Triticum aestivum
  unsure (1)..(144): unsure at all Xaa locations
  Clone ID: PAT_TA_94506.pep
XDHLGSXXXXQWLSNLXTXXTPTXNYRCTSIICXXXPKXNNVKPLNXXXKAGLXVVRVKFSHXXSYXYHQSVIDNTRXAERVQKGRQVXIALXTKGPEIXTGNTVXXVDIPIAAGTEMNFTADXKYAXIXEXKNKYVVXTNIXI

SEQ ID NO: 200089 - protein, 134 aa, Triticum aestivum
  unsure (1)..(134): unsure at all Xaa locations
  Clone ID: PAT_TA_94507.pep
LSVTTLVYIVSFFYQLISPQFSLPSLLNINKMSQFGAYYLTGFMLVTAAFSQQCRLQFDARVPQGTSVGSFDVKTSLFRTTDVIGKGLKFSEVIELPKSGASLFDEKKFHLKLLFLINQYSMIKVGFPTRRXST

SEQ ID NO: 200090 - protein, 137 aa, Triticum aestivum
  Clone ID: PAT_TA_94508.pep
FLAATKLSIQEKKETAEMFDGEQIPTDQPTHVYCIVGLQAPLNTHFFHDPHPIRERQVSTSWFYYLRFTLPFFTCPCNIVYPIALRSLARLTKTTNKSRQREENPTLYGQSKTLDARSPHDVGGRFLDRAYPGVSPG

SEQ ID NO: 200091 - protein, 149 aa, Triticum aestivum
  unsure (1)..(149): unsure at all Xaa locations
  Clone ID: PAT_TA_94509.pep
SCRIRHETIKAQKLWYSILEAQTETGNPFMLYKDACNKKSNQKNLGTIRSSNLCTEIVEYSSPDEVAVCNLASLALPTYVDSTNGTYNFLKLHEVCQVVVKNLNKIIDVNYYPVPEARTSNFRHRPIAIGVQGLAXDTFLALRLPFRIT

SEQ ID NO: 200092 - protein, 101 aa, Triticum aestivum
  unsure (1)..(101): unsure at all Xaa locations
  Clone ID: PAT_TA_94510.pep
LNNPAKNNLCTNFALALIKHAIHAPSFKLYFSPFLNYLAGGRASLENSSIPTIAMPRVCAMARLLMPLMYAKHKTGPKTEMNRSLKTCRLWSPWRETPLXS

SEQ ID NO: 200093 - protein, 91 aa, Triticum aestivum
  unsure (1)..(91): unsure at all Xaa locations
  Clone ID: PAT_TA_94511.pep
IRSCSRTQAWKLTSDGXCVGQDLSTFYALXSGASLQSALAVSITTESKVASMSVSRDGPFAREVHKYYPQENYRGGKVDDICVLVAIACEE

SEQ ID NO: 200094 - protein, 76 aa, Triticum aestivum
  unsure (1)..(76): unsure at all Xaa locations
  Clone ID: PAT_TA_94512.pep
EACEAEDFERAERISESLAALEKDKDRLLTALRDAELDYDXVDLEXQDVLXSRITXEEEXAAALLEQFAKDATRAS

SEQ ID NO: 200095 - protein, 74 aa, Triticum aestivum
  unsure (1)..(74): unsure at all Xaa locations
  Clone ID: PAT_TA_94513.pep
MGQSGKEQCCSSRTNHEXMLSMLTDDILLSILGRVDTATVTLXSVLSXRWRDLPXWLLPVLNLRVWXFLADXXP

SEQ ID NO: 200096 - protein, 108 aa, Triticum aestivum
  Clone ID: PAT_TA_94514.pep
MSDLDVQIPTAFDPFAEANAGDAGAAAGSKDYVHVRIQQRNGRKSLTTVQGLKKEFSYSKILKDLKKEFCCNGTVVQDTELGQVIQLQGDQRKNVSNFLVQAGIVKKE

SEQ ID NO: 200097 - protein, 110 aa, Triticum aestivum
  Clone ID: PAT_TA_94515.pep
MASQAEVVEATDLTLRFKHTFYTFFLFVDASMSCRRIKNSLLAILSERYPDGLPVDPKDPLPNAPRIPLPASGHDIVFGVPRSPSDPAQGFDELAAAPESKLSQPWHRRQ

SEQ ID NO: 200098 - protein, 100 aa, Triticum aestivum
  unsure (1)..(100): unsure at all Xaa locations
  Clone ID: PAT_TA_94516.pep
FETIAFFSIEGXQTRELSHEQTFIVGNXWPASVMAKFHVDDRLLQSNLLLMIAATXGKALFTLSIKLFKSELALAIKSTNFKKKKKKKKKKKKKKKKKKL

SEQ ID NO: 200099 - protein, 151 aa, Triticum aestivum
  unsure (1)..(151): unsure at all Xaa locations
  Clone ID: PAT_TA_94517.pep
XVVNLSKXSGDWELLNEQILLLSKKHGXLKQAITKMVQAVMGFLDSAPNLTIKLATIETLRTVTEGKIFVEVERARVTKILSDIKKKQGDLKAASEILCELQVETFGSMERKGKNKNSFLAQSRSYCIEXEDWVQGWVSLPERSNVTFSKE

SEQ ID NO: 200100 - protein, 115 aa, Triticum aestivum
  Clone ID: PAT_TA_94518.pep
TKIENDSDQKLYLPDFTADFKNNIEKIEINSNSKPSQAKFSIGVRQTIQTKDEVGDTSQRDIFPKDSNHTERKLRFARKTTKEAPGRNKRTSVGTSERVKGSYRLKSRSLRSFNK

SEQ ID NO: 200101 - protein, 58 aa, Triticum aestivum
  Clone ID: PAT_TA_94519.pep
VRNLRVVGTNQGHQPKKPKMIVLASKRPILFHAQLTAENCLKDDDQVITSDTRIFISG

SEQ ID NO: 200102 - protein, 123 aa, Triticum aestivum
  Clone ID: PAT_TA_94520.pep
FFFSAHIRLPHERLPPRARTRTNTHSPAVHRGAFYTQLHTHASTRTHAIPGHHTATNSKHTVILLTNHTHARLLLDRHTHYLIHLPHACTTAHHGCLTDRLKLLLVASSSQTTQPSSSVVAYS

SEQ ID NO: 200103 - protein, 79 aa, Triticum aestivum
  Clone ID: PAT_TA_94521.pep
LVPNSARGPIPHLILPGTKLDAMFSILHLVANSHYQTLQVFNFGSEQRCPKSGPNLEQIDKPMGTTDEWHYHMTSNTVN

SEQ ID NO: 200104 - protein, 136 aa, Triticum aestivum
  unsure (1)..(136): unsure at all Xaa locations
  Clone ID: PAT_TA_94522.pep
LVPNSARGLYGPALFMQRKTITDMVVGAITIPKDHAVVIGAPFMHRDKKVWGEDXDQFNPMRFANGVARAAKVPHALLAFSIGPRACIGQNFAMLEAKSVMVTVLQKFSFALSPSYVHAPADFLTLQPKFGLPRRY

SEQ ID NO: 200105 - protein, 133 aa, Triticum aestivum
  unsure (1)..(133): unsure at all Xaa locations
  Clone ID: PAT_TA_94523.pep
QSAVGLLQIHRSCCDGRPASTLDDDDXATIRGGVAPSPPELPASASLLRRSTTTMLRQSAAGLLQVHRSCFNARRRXCCDGDVTASGTGPTMLAGAAGSVRGARPHGGGCRVVLKPLXAKATGRLLRLSVVIG

SEQ ID NO: 200106 - protein, 124 aa, Triticum aestivum
  Clone ID: PAT_TA_94524.pep
MSGLQAEDVLPGAAAKMVRWATGLEKRIDVQVEAWDKFLSEIMAEHLEKKRDDGALGAEEDFLDVLLRLRKEGTAGLELTDNRIKSIIKDMIFAGTETSSITLEWVMAELIRKPAGNGQAARTR

SEQ ID NO: 200107 - protein, 138 aa, Triticum aestivum
  unsure (1)..(138): unsure at all Xaa locations
  Clone ID: PAT_TA_94525.pep
MTATRHTGTRPRVSNRVVNSTSNYRNGRRDNPPRNSEEIRDQVCGPRASKVNNTSTPTVKKDILSPLVRRDQFNKSDFSIQYEHAKFFMIKSYSEDDIHKGIKYNVWASTPNGNKXKLDTAFHDAQIFMKEKGTKCPR

SEQ ID NO: 200108 - protein, 136 aa, Triticum aestivum
  unsure (1)..(136): unsure at all Xaa locations
  Clone ID: PAT_TA_94526.pep
HTHIKKANRFVRRLAMPKLWTLVAVLGVFSSLDTASSTSLPHVRRGNSNINSXKYICSVHVTFFGSNIYNSVNSAKSQAGGVQLRAISQSASNVPXIQVNQLISWQDGTFLYPIASTSSSQNRRHIQIFVVLNNNW

SEQ ID NO: 200109 - protein, 152 aa, Triticum aestivum
  unsure (1)..(152): unsure at all Xaa locations
  Clone ID: PAT_TA_94527.pep
RLRRRRGGGGADPLPAARRAAQRAAAAAAAGRGGVPPRVAPLPGDPHGAVPRAAAGAPPAAAPPPAARGRGLPPRLRPRPPLLAPPPLHRLPPAPRPSPPSPPPPRSSTSGXXTPPRPSPPPPPPRRPRRPPQPNRPRXSPFWQTRWRATNA

SEQ ID NO: 200110 - protein, 149 aa, Triticum aestivum
  unsure (1)..(149): unsure at all Xaa locations
  Clone ID: PAT_TA_94528.pep
MIVCYFWLNLIRSTKAQVTFVSEIKSSKVRSIDLVXRFDVANSFVVPSRGASGGLWLMWNDDLKVTIHAASFHYILAIVLHVTTGXQFCLVCIYGDPYHRQTTAIWSEISTFVYDNLGLPMMCMGDLNDILYDTDGCNGNVNYYRMNVF

SEQ ID NO: 200111 - protein, 69 aa, Triticum aestivum
  Clone ID: PAT_TA_94529.pep
NLVKPACLHDATPTSCTLDKSIFKQDPELIQVKTSIGSCESRLTESEDTPVAIMLVSLKYSVIIHIHHH

SEQ ID NO: 200112 - protein, 90 aa, Triticum aestivum
  unsure (1)..(90): unsure at all Xaa locations
  Clone ID: PAT_TA_94530.pep
RRLIKTGRLKIARRAIXLAEASWRGQLPEYYDGKLGRYVGKQARSTQTWSIAGYLVAKMMLEDPSHLGMISLEEDKAMNPVLKRSASWTV

SEQ ID NO: 200113 - protein, 85 aa, Triticum aestivum
  unsure (1)..(85): unsure at all Xaa locations
  Clone ID: PAT_TA_94531.pep
FFFFFFKTRPPWISVSIWHFRAQCHCLIXLSQLTSRKHSHGCQEVTKXERXRKGAHNRQNCLMTKTTGHAASXPSXPPXISTXEX

SEQ ID NO: 200114 - protein, 57 aa, Triticum aestivum
  unsure (1)..(57): unsure at all Xaa locations
  Clone ID: PAT_TA_94532.pep
XXDVXKXXXXHEXIVXLVXXFXGVHXVXWXXVGGGSLARAGSSRVEAEGIERREETR

SEQ ID NO: 200115 - protein, 89 aa, Triticum aestivum
  unsure (1)..(89): unsure at all Xaa locations
  Clone ID: PAT_TA_94533.pep
MKGTKLAAILILXAVLVMGVLSHVNADFFPKCCNNCRSFSGVDVCDDAHPKCPKGCSACHVVSXXPEMWRXAXMKSTVDXTCGXPCKXX

SEQ ID NO: 200116 - protein, 132 aa, Triticum aestivum
  unsure (1)..(132): unsure at all Xaa locations
  Clone ID: PAT_TA_94534.pep
MPQVDLESLVCGGAGAGAGDRKVSCETVIAGGDSGDASPPRRVPPXPDHDFPPESITXPHRRRRGFSELNRYTAGRLHXGSTTQVVGAAAALNPPAKXVNSXLRAAXAARTFGSGRTGRPFKSWDRQQGLLK

SEQ ID NO: 200117 - protein, 89 aa, Triticum aestivum
  unsure (1)..(89): unsure at all Xaa locations
  Clone ID: PAT_TA_94535.pep
QHNACIALPTNPFQRLAAPHFARRYXGDRFCFLFLXWLLRCFSSPGCLLPAHGFSRQFKRLTYLGISGSMLIFNSPKHFVACYALPRLW

SEQ ID NO: 200118 - protein, 153 aa, Triticum aestivum
  unsure (1)..(153): unsure at all Xaa locations
  Clone ID: PAT_TA_94536.pep
XEXICSAXXSAIWSRCGRWRRXSGGDPEEGXVRRRLWXGRGVRRRRXRARRRGXXXAXQXVSEXSAXXETASAXXXLRYTAGSSXSXXFSSIDVRFTSTQRPAPRRRRLRHRXAHXSAAWLXSSIWPAKRKRXLPPLVPCLLLRGGGAEFADR

SEQ ID NO: 200119 - protein, 98 aa, Triticum aestivum
  unsure (1)..(98): unsure at all Xaa locations
  Clone ID: PAT_TA_94537.pep
GIKLLFSSAYHPQTKGQTEVTNHTLSTLLRVLIKKNIKEWEERLPITEYAYNHARHSTTGKSPFXVVYXFXPVVPLDILPLPLHERNNLQRKCPWKYI

SEQ ID NO: 200120 - protein, 88 aa, Triticum aestivum
  unsure (1)..(88): unsure at all Xaa locations
  Clone ID: PAT_TA_94538.pep
XNRCXDAXXLMPWYHQXXXYLPLTIWXSWLISLMPKXXNTXXXPVLGXXVINRFXXNESIICSYFMLXQCXXLHGLNFIKTTLVLELR

SEQ ID NO: 200121 - protein, 185 aa, Triticum aestivum
  unsure (1)..(185): unsure at all Xaa locations
  Clone ID: PAT_TA_94539.pep
VSLVRALLYIIAQCLGAICGVGLVKGFQSAFYVRYGGGANELXSSGFSKGTGSAAGNIXGPSVSVYTVFSATDPNAAPVIPXXSAGPLPSGFXGVQWVHLGTIPXITGTXINPARXLGAAGDSTTTRSLGQXWFSWVGHSIRAAXAAYTTILXKATNNSVAAPLGTLKAAPMAEDEREKRAQSVS

SEQ ID NO: 200122 - protein, 103 aa, Triticum aestivum
  unsure (1)..(103): unsure at all Xaa locations
  Clone ID: PAT_TA_94540.pep
EWRTVATSTPXLSRKCDCGHLXLFFLEYAPSPFQCXWFXEVXXVITFQNATSYFFLXXPVFHNVLXKXXKSXRKHMCLENYLSEYCVLAKKGGPGTIXLKXSY

SEQ ID NO: 200123 - protein, 92 aa, Triticum aestivum
  unsure (1)..(92): unsure at all Xaa locations
  Clone ID: PAT_TA_94541.pep
CRRTXXMPSPADPARXFXSRDPSTPXXGAAXGEEPLNLFLXAVXXIXNNHXRTVLRPKEXLLWCKHQCVNXSSIKLPKCALSMSLRTMFQVH

SEQ ID NO: 200124 - protein, 57 aa, Triticum aestivum
  unsure (1)..(57): unsure at all Xaa locations
  Clone ID: PAT_TA_94542.pep
MAETXYRCFVGXXAWATDDNNLQXVFXQYXEILDDXIIXXREXGKXXGFXFXTXGSE

SEQ ID NO: 200125 - protein, 123 aa, Triticum aestivum
  unsure (1)..(123): unsure at all Xaa locations
  Clone ID: PAT_TA_94543.pep
SMILPWVFLDEAHALLTCLSSCSDDPNGETEHKFVTDHRVGQDXLAXLLRSPLSKRLGSSDLLRHGHLPCPKAHKTKSSGRHLKLXRVGEXQTLARXLTRSVWTCGHSGRQQXWPGXRDATDA

SEQ ID NO: 200126 - protein, 100 aa, Triticum aestivum
  unsure (1)..(100): unsure at all Xaa locations
  Clone ID: PAT_TA_94544.pep
IYLSRHRGEGALSLDSNPHRSRLRKVIHPLYYFIRXPSVRPSTPKARVGLYAARWLNLGKLLCLFFFYHPARRGSDVLGXWRGLXLRXPRRVDLSWGQWT

SEQ ID NO: 200127 - protein, 107 aa, Triticum aestivum
  unsure (1)..(107): unsure at all Xaa locations
  Clone ID: PAT_TA_94545.pep
AAARLHGAARRPPAAGPSPPRRASAARSGVRIRGRIQSSKTRGESVMSRQCLGCRLDCSDAWLQVVRGWWVSPSSINDEAPIRCTLAGQAAARVCIWVXGLVGCIXS

SEQ ID NO: 200128 - protein, 61 aa, Triticum aestivum
  unsure (1)..(61): unsure at all Xaa locations
  Clone ID: PAT_TA_94546.pep
PIPLGFPTLLHPPPPPPLPHXXLXXXGRXAGARGRREALXPXDLRXMFXWXXISAERLPPX

SEQ ID NO: 200129 - protein, 97 aa, Triticum aestivum
  unsure (1)..(97): unsure at all Xaa locations
  Clone ID: PAT_TA_94547.pep
MTAGQPLRADPQQRRHSPPALHPAVVPSYPPPESGNDESXWVWSKIXAXGAPRXADAEPALASFLYATVLSNPSLEALLSFXLGKXVCSSTLXSKLL

SEQ ID NO: 200130 - protein, 142 aa, Triticum aestivum
  unsure (1)..(142): unsure at all Xaa locations
  Clone ID: PAT_TA_94548.pep
LKQSAGRWRNSVGPRKSFVLDLSAMAYIAPGASQKTAASTGEAPHRTSKQCLKNVMLPTEERRRRRCHHADPTGPRLSPRDTTNQARGRCRHTSVAPPRRKMTPSGAIDTGSCCAGLSSVSSHTSAQXLRSSSMSSLAAPCC

SEQ ID NO: 200131 - protein, 152 aa, Triticum aestivum
  unsure (1)..(152): unsure at all Xaa locations
  Clone ID: PAT_TA_94549.pep
MAAATMALSSPVMAGTPVKASRAAPFGEGRITMRKTAGKPKVXASSSPWYGSDRVLYLXPLSGDPPSYLTGEFPGDYGWDTAGLSADPETFGKNRELEVXHCRWACSAXLGCXFPELXARNXFKFXEAVXSRRSISRPRYSTNCACEILGCW

SEQ ID NO: 200132 - protein, 69 aa, Triticum aestivum
  Clone ID: PAT_TA_94550.pep
PPPPKQFHINMTDFIQNRTKRLHFRHIFNEKGKTMRTHGHVELHSHDTDKLVYGRPPRIPLSSPCPAAG

SEQ ID NO: 200133 - protein, 96 aa, Triticum aestivum
  unsure (1)..(96): unsure at all Xaa locations
  Clone ID: PAT_TA_94551.pep
PFIXGKALIIXYTXLLKVXFLGNFLLSLHPPPPLSLGGHLGPLVVIRAVSLXDDEVIPHRLTADLDPCYFWVISSIQSLPRFGTARAARTETVLYP

SEQ ID NO: 200134 - protein, 135 aa, Triticum aestivum
  unsure (1)..(135): unsure at all Xaa locations
  Clone ID: PAT_TA_94552.pep
MPAGHGLRSRTXXLFARTXRKKXYIXLTTYLRTYKVXXHVDVKVXGAVHKXMPHXFYHXXXGXXCXVTKXXIXVEINKHVWQQDHXEEVHVRXXARAPSKCIEXSXXRKXTTTEKSNHTSRSSGVWDTSIRYPSV

SEQ ID NO: 200135 - protein, 67 aa, Triticum aestivum
  unsure (1)..(67): unsure at all Xaa locations
  Clone ID: PAT_TA_94553.pep
YSHSATQKLPTVIPFLVHGDQMGFIDGRNIVEHVMFVAYLIKSCHGRKEQPMVIKLDFQXSKGGGPV

SEQ ID NO: 200136 - protein, 73 aa, Triticum aestivum
  unsure (1)..(73): unsure at all Xaa locations
  Clone ID: PAT_TA_94554.pep
RNVGRMGPXLIATLXFVVCCRGLTCEIPGXRGRGRPEFHSMQPTASXMFVHTVIFFAFCAIFMVAVGVHVYAG

SEQ ID NO: 200137 - protein, 63 aa, Triticum aestivum
  Clone ID: PAT_TA_94555.pep
MHLLLSILADGEEQARRLLRELPPADDEGQLLGRGPAAQCCRSVAEQLLCTFRKAITVAKAIE

SEQ ID NO: 200138 - protein, 179 aa, Triticum aestivum
  unsure (1)..(179): unsure at all Xaa locations
  Clone ID: PAT_TA_94556.pep
MGKEKIHISIVVIGHVDSGKSTTTGHLIYKLXGGIDKRVIERLEKEAXEMNKRLXKYAWVLXQVQXASRERGITIDIAXLWKFRDHQXPCTVIXXPGHRDFIKDMITGLXQADCAVLNXDPTLXXXXAXTPKDGNPXRXSLLQXGVNKCRCCNKWSPSIKALEMQDPQLGVLRFLVTCQ

SEQ ID NO: 200139 - protein, 103 aa, Triticum aestivum
  unsure (1)..(103): unsure at all Xaa locations
  Clone ID: PAT_TA_94557.pep
IDPXXNVVXXCYNDLLXRFRLSXCSHLDQCPKFGXXRDYKKXPSPDETFADWXTVTWQXSXSQVFFNXSIWRVTXSDLGSHMIFIFSDISXGIIVYAMLHRGC

SEQ ID NO: 200140 - protein, 134 aa, Triticum aestivum
  unsure (1)..(134): unsure at all Xaa locations
  Clone ID: PAT_TA_94558.pep
ENFRALCTGEKGVGKSGKPLHYKGSSFHRVIPDFMCQGGDFTKGNGTGGESIYGEXFAXREFVHKAHQAGILSMANXGPTPTVPFFICTVPCNLVRRQXVXFGEVVXXMDXLKDTXKVGPAXGLVQEAHADAAV

SEQ ID NO: 200141 - protein, 142 aa, Triticum aestivum
  unsure (1)..(142): unsure at all Xaa locations
  Clone ID: PAT_TA_94559.pep
QAASDVASXDASIREVLGSSPALPPFFIFVVVVSVXPHAHSPLPHQQVSLLVASSHGHRASISVNVFXSVRXTPXHXHIEHKDSLSKXYLXHLXYSHACTRXXARYQFXYMXXLARNGAVXTSXWETWXYQLNRCKXPLRSG

SEQ ID NO: 200142 - protein, 134 aa, Triticum aestivum
  unsure (1)..(134): unsure at all Xaa locations
  Clone ID: PAT_TA_94560.pep
MFGFGHHHKDQAPPASGPNQIFKIYCRASEDYCLAVRDXEVVLAPVXPKDXTQHWLXDMRFSTTVKDEEGMPGFTLVNKAXGXAVKHPSASPTPXKLVPFNXXVXDXSXLWTXTRNGQGFRCIXWSHRSGTLKT

SEQ ID NO: 200143 - protein, 76 aa, Triticum aestivum
  unsure (1)..(76): unsure at all Xaa locations
  Clone ID: PAT_TA_94561.pep
RVSLYTPLTPIIPSAVSQPVLXFGPLKAPFILGSFXDSVSYSPLPVCSVCGPIQPVDIVGPLTRWTVFIASSNTAY

SEQ ID NO: 200144 - protein, 143 aa, Triticum aestivum
  unsure (1)..(143): unsure at all Xaa locations
  Clone ID: PAT_TA_94562.pep
WLNPNCLXCMIMIVIALRTKGSGLYRRRRGLGLYKVGLQRKEYSYPHAKLAIHAKEIPSRHGGXLYXVXHGHYPTTLHXWTPXDPYPRSSNTPNISMMMCPXCKCLXXERFSXKFQTXNKGCIGXISSRVHKVNXXRATIESS

SEQ ID NO: 200145 - protein, 60 aa, Triticum aestivum
  unsure (1)..(60): unsure at all Xaa locations
  Clone ID: PAT_TA_94563.pep
STLXHXXTSVLTAGXXINXXSXAGYAXNXXEXINLDVDNAHDFFTVNQLEHLSPGFXLXX

SEQ ID NO: 200146 - protein, 92 aa, Triticum aestivum
  unsure (1)..(92): unsure at all Xaa locations
  Clone ID: PAT_TA_94564.pep
HXFPAPGLSQAFRKGGRTPDHLRLCYPSPGQRAILQNDVMIKKRTVCSAMGLPTWAAVRLLLRPTSSVVSGHSIWGPKNDLYISSCVRPRKF

SEQ ID NO: 200147 - protein, 65 aa, Triticum aestivum
  unsure (1)..(65): unsure at all Xaa locations
  Clone ID: PAT_TA_94565.pep
CKCGNGCGGCNMYPEVEAAGATLLVSATATHKASSGGMEMAXENGGCGCTQCKCGTSCGCSCCSC

SEQ ID NO: 200148 - protein, 90 aa, Triticum aestivum
  unsure (1)..(90): unsure at all Xaa locations
  Clone ID: PAT_TA_94566.pep
LPKLGYLKCXIFSXXEYPXGHXDCSKHITQGXTSRLLEDXHRSSSQXAVXSVKVHXXRLNGXXYAWMXXTIGCEELCXNAPXXRDKIFIT

SEQ ID NO: 200149 - protein, 142 aa, Triticum aestivum
  unsure (1)..(142): unsure at all Xaa locations
  Clone ID: PAT_TA_94567.pep
MAPKRGGKAPVPAKKKTEKVTNPLFEKRTKQFXGIGGALPPKXKDLHRFXVKWPRXVRIQAPSAASSKQRLXGAPGLHHXTRTLRQDFATIFQXFLKYRXXKXFQRRVKEPKLNKNFRIFFNFLTNQTNWLQTKSPIDCPCL

SEQ ID NO: 200150 - protein, 140 aa, Triticum aestivum
  unsure (1)..(140): unsure at all Xaa locations
  Clone ID: PAT_TA_94568.pep
MAPTVMASSATSVAPFQGLKSTAGLPVSRRSNGASLGSVSNGGRIRCMQVWPXEGIKEXRALVLLATAQARSLLQAVDYLIPSKWXLSSXFNKVGFTFPXRQRSPGXYYDGRYWAMWXXPMFPGAPXHTXINXVEEXKKP

SEQ ID NO: 200151 - protein, 156 aa, Triticum aestivum
  unsure (1)..(156): unsure at all Xaa locations
  Clone ID: PAT_TA_94569.pep
MDSPVLPTSDRGTHLSLLADEILEEIFLRLPTPEGAPRARPPPAPPSAASSPTALPPAAXASPPLXSFGSSNDRGGRFHPPXAPXPPLSSPAPPSTPPXNYPFXXKPRRVVSPWIPPLPQGASPMQPGKTLIALFRANGCVRTAKKEPNAISPVVT

SEQ ID NO: 200152 - protein, 187 aa, Triticum aestivum
  unsure (1)..(187): unsure at all Xaa locations
  Clone ID: PAT_TA_94570.pep
RFDDSFSLASFKAYIAEFISTLIFVFAGVGSAIAYTKVSGGAPLDPSGLIAVAICHGFRAVPSAVRXSGANISRRHVNPAVTFRLALRRPDLPSSTGSSNWVAHSSGASSGFLLHXGTALGPLTRFSALALFRLLRNYTLVSNVYRPRSPWDPHRTTRALPASGVNNLLGVQQILRPTGGSRVTYLI

SEQ ID NO: 200153 - protein, 79 aa, Triticum aestivum
  unsure (1)..(79): unsure at all Xaa locations
  Clone ID: PAT_TA_94571.pep
XGVXSXTVEVIPHRXIXXLGXCYFGVIFSIQGVSWDLVPAGAPGTGKQSLPLDAQXNAAPPTHFGGDPVALGFGVAFHP

SEQ ID NO: 200154 - protein, 146 aa, Triticum aestivum
  unsure (1)..(146): unsure at all Xaa locations
  Clone ID: PAT_TA_94572.pep
WTGLDILVPGGQNQVVQDIGLSNLNELVIHGFFREEETNDGLHYVMHDLLHDLXALKVASHDCLKLHLSDVGQVXIQPSTHHLYVRTRELGEYNAVSXQNIKSEWESXKXHLKVEHFQTLDVIWKWVKVLPKLFFWGNKPSLSLFP

SEQ ID NO: 200155 - protein, 80 aa, Triticum aestivum
  unsure (1)..(80): unsure at all Xaa locations
  Clone ID: PAT_TA_94573.pep
SXAYTXHYRAELGTRPPPXGXHRPCPLWSVVRVILPAARLRIAPPRPRDAVLFSARSAMSGSLTRVIIPFGPGILSFIYQ

SEQ ID NO: 200156 - protein, 126 aa, Triticum aestivum
  unsure (1)..(126): unsure at all Xaa locations
  Clone ID: PAT_TA_94574.pep
GMDXPKCXXTXSGHLAPXXSDXAXGVASLXKGGSSLTGCILENPXSFGXNRLAPFIFQRXXAQISEYYALFKGWLLLGNLLAVFAPPPPLSLSGHLGALAGDPGCFPLDDEAYPPSSHWPTLTPVI

SEQ ID NO: 200157 - protein, 145 aa, Triticum aestivum
  unsure (1)..(145): unsure at all Xaa locations
  Clone ID: PAT_TA_94575.pep
GMTVSLLVLGLSLRASPTAHAGGSAAWWAAATSVTAAAAFMATFSLGFGPVIWMYGSEILPLPATRAGHWASGTAVNXGLMXPXVGMTFHIAVTSCWDGGTFYIFXGVRSSSWVSXYASLPGTKGKTSQGXESLTFQSAPDTSDP

SEQ ID NO: 200158 - protein, 82 aa, Triticum aestivum
  unsure (1)..(82): unsure at all Xaa locations
  Clone ID: PAT_TA_94576.pep
AAQLNTYWXFSFSFFXXXLFFLFIXHKFFLSLFIFLSFHFPTNYXSFSFSFISFCKXPFFFFFFFFHLHFSFSYLSFALSFL

SEQ ID NO: 200159 - protein, 120 aa, Triticum aestivum
  unsure (1)..(120): unsure at all Xaa locations
  Clone ID: PAT_TA_94577.pep
STRTKTNGPVEGHIPKNNIPKHFVNGTFEQGILKWQQDELDTGFSYGDFSREETNXWGAEXEXGVHVGSNEARXPPKGXXAPYLXANVXPWCSHGKYPKYLQXSSXLRHWGXLFRXFLXR

SEQ ID NO: 200160 - protein, 91 aa, Triticum aestivum
  unsure (1)..(91): unsure at all Xaa locations
  Clone ID: PAT_TA_94578.pep
WDXAXGLXHFXPFPXPXTMSXATXHKHAXVXRXXIGHTGXVREGTPHXRAISCVHFSFXRRLLXTESLYRTXTHHSLTXSLTSHLQXXYAT

SEQ ID NO: 200161 - protein, 85 aa, Triticum aestivum
  unsure (1)..(85): unsure at all Xaa locations
  Clone ID: PAT_TA_94579.pep
RSLAKIQGSRXGWXTGRTXAGGDPRXPRKAXAAPLAYKPVXGDXNIEGVXSXRHPARLTRGRPVRXGXXXGGLGHXXRTXQVXAX

SEQ ID NO: 200162 - protein, 81 aa, Triticum aestivum
  unsure (1)..(81): unsure at all Xaa locations
  Clone ID: PAT_TA_94580.pep
AXCVXHVWXVYRXXRLFLDSXRVXAIVRIRSSXWLHLLHGLVLLPSGISGKMTVTLDXITIIAMPXXVVLSXCCVIYHLLL

SEQ ID NO: 200163 - protein, 113 aa, Triticum aestivum
  unsure (1)..(113): unsure at all Xaa locations
  Clone ID: PAT_TA_94581.pep
LSLIRYNTLRHCKIRLKLRYTVVXSNIKXRXPVLGAEPFKXNRFXGNNGYCVPXPGTIPNTXLNYSKEGQLLTKXNCGXWLQEHNAXXTTVAPSKSRNTRXSPGVGXYSQXAN

SEQ ID NO: 200164 - protein, 159 aa, Triticum aestivum
  unsure (1)..(159): unsure at all Xaa locations
  Clone ID: PAT_TA_94582.pep
LSKEFAATRRSRSLVLSLLKKGTGSAKYTPQQNGLLRGRXXLIEVARRCLMVQGAKHFWAEAVETXCHATNRLYLHKYSGKTAYXEFXTGNNPQVGYFXVLGSKCYILDKHRRSISSXKSHEGFLLGYGSNSHTYCVYNNFTRKVEDTVDVKFDESNGS

SEQ ID NO: 200165 - protein, 152 aa, Triticum aestivum
  unsure (1)..(152): unsure at all Xaa locations
  Clone ID: PAT_TA_94583.pep
XGXSXEXWSAGIERGGIMXKLVYVSXRVXEXRLWRSRCVQCSGSVFXVHRSCFCSGSVSTGRHCGPLHLXLLGGTASPWCVGIQVDVLLPELRIRTDAHPVPERKRSVRGAPRPNGRELSASVLPFWFTRPSRSVFSCCIRQEQGARLHLCQ

SEQ ID NO: 200166 - protein, 92 aa, Triticum aestivum
  unsure (1)..(92): unsure at all Xaa locations
  Clone ID: PAT_TA_94584.pep
MKGTKLAAILILQAVLVMGVLSHVNADFFPKCCNNCRXLRGSDVCDDAHPKCPKGCSXACRVVSXTXPEMWRLRRIMKPPFDGTLRWPCKXY

SEQ ID NO: 200167 - protein, 149 aa, Triticum aestivum
  unsure (1)..(149): unsure at all Xaa locations
  Clone ID: PAT_TA_94585.pep
AIQAHGGGILYDQNTATYYWYGENKDGPTYQIHPEGAQRIDIIGVSCYSXRKDLWSWTPRKEPASLGEPLLISHTTFHIQKVXEEXKVIYNDRTPALFMXDHVXRRNYTKHPSALRHNFPKSLXTTPHFXAHGFYSXTYIFXDXDXWLS

SEQ ID NO: 200168 - protein, 59 aa, Triticum aestivum
  unsure (1)..(59): unsure at all Xaa locations
  Clone ID: PAT_TA_94586.pep
NXWDFGIFKWEXXRDYFLYPYGVPXXGGRXGGGPVGWVNCGVARSXGVMFXWVKKGEVG

SEQ ID NO: 200169 - protein, 147 aa, Triticum aestivum
  unsure (1)..(147): unsure at all Xaa locations
  Clone ID: PAT_TA_94587.pep
LIFAGKQLEDGRTLADYNIQKESTLHLVLRLRGGMQIFVKTLTGKTITLXVDPQDTIDNVEGKIQDKEGPPRXARLIFAGKHSEDGRTLADLHIQEDPPPLCSSPVDAIFGETSTGQTSPGVDPSDTSTTSEIPRQGFPTTRSLVTL

SEQ ID NO: 200170 - protein, 149 aa, Triticum aestivum
  unsure (1)..(149): unsure at all Xaa locations
  Clone ID: PAT_TA_94588.pep
PDPAAPRRHGASRALLPPPRRRRAAPGPGGRRGAGVQRRRGNALYALRMRLSDPNGVLQSWDPTLXVNPCTWFHVTCDTASASVRLGLSNSQXSRSIRPRXXRFVNFNYLECXRTTSNGEISKRXGQVEILXTWVXYANXSTGDPRFST

SEQ ID NO: 200171 - protein, 124 aa, Triticum aestivum
  unsure (1)..(124): unsure at all Xaa locations
  Clone ID: PAT_TA_94589.pep
KNGCPLVGISDITCDIGGSIEFVNRSTSIERPFFRYDTSTNLYHDDMEGDGVICLAVDILPTEFSKXEASQHFGXILSRFVTSLASXKGLLELPSHLXRRLCIAYAGQTHPSCMKYIPXDGERL

SEQ ID NO: 200172 - protein, 96 aa, Triticum aestivum
  unsure (1)..(96): unsure at all Xaa locations
  Clone ID: PAT_TA_94590.pep
FQFEFVANGTDAYYTFLVDDGGGGGNVVSRFVLNQSSLQRYVWLQQQXAWSLYWSLPRDPCDGYXXCGAYGVCDASASPMCCCPAGFTPXSXXEWA

SEQ ID NO: 200173 - protein, 131 aa, Triticum aestivum
  unsure (1)..(131): unsure at all Xaa locations
  Clone ID: PAT_TA_94591.pep
PPPPHSPRAYLPPSRRRGRRPAAGSHRFREGSEAVGSAAAMLSRISHSGARLLRETKSCRKLCQAIAAITTEVKSSRHSTQRXILFSTATIIIMMKRXRTRRISCYIFQTRMVLRRIISCPMSMFRTAPXK

SEQ ID NO: 200174 - protein, 135 aa, Triticum aestivum
  unsure (1)..(135): unsure at all Xaa locations
  Clone ID: PAT_TA_94592.pep
RRRRPRRRAAAACGGAFPPPGXNLGTKDLRRQLFRPPAXNPPPSYDWVLTLLMILYILNGTNHFFIHILLGTFXRVNMANDKTCHFVLXXSFYXDQXRTRQPPXINXXQRLKEGXNNCXSPXCXLGXNLYXLLSR

SEQ ID NO: 200175 - protein, 139 aa, Triticum aestivum
  unsure (1)..(139): unsure at all Xaa locations
  Clone ID: PAT_TA_94593.pep
QIFVKTLTGKTITLEVESSDTIDNVKAKIQDKEGIPPDQQRLIFRRKALEDGXRTLADYNIQKDPPPSLLKSVXGIIXPLQSFPQVNQEKIILPQIYPLHPRLSTAAKRXWPXNQXRPRRNLRLNAAIISMAGLSTLCQ

SEQ ID NO: 200176 - protein, 97 aa, Triticum aestivum
  unsure (1)..(97): unsure at all Xaa locations
  Clone ID: PAT_TA_94594.pep
GFGFWFGSGPRVASLVXGFREEGRRRXKRRRINGXRTXYRCFXGRPRPGPPDDNNLQARPSSQVRRRSSXAKXNQTTXRRGRSRGFRLPSRSAAXIH

SEQ ID NO: 200177 - protein, 139 aa, Triticum aestivum
  unsure (1)..(139): unsure at all Xaa locations
  Clone ID: PAT_TA_94595.pep
GWXGXXSSXQHLSKKEPQGXQXGXEGKRRXGXGREAVGSVTGPQNSAAXNPAXXGALQGRSRRQRRRRRPPGLGFHPRSRWWGVEGQTLTDVSXKKSRPRASLXSRPDGADPGFPRXGSXPRESPASHRQAIQHTQGPS

SEQ ID NO: 200178 - protein, 150 aa, Triticum aestivum
  unsure (1)..(150): unsure at all Xaa locations
  Clone ID: PAT_TA_94596.pep
PPPPIPMAAAHHRPLHALLGGGAVADLLLWRRRNASGGGRRGRHAPSGPLPSAPGTXRVXLXNASPPRLTSSFWANSARCQXLFXHCLIXSXNGXLKNXRPVXXGXXSXAXXXKLHQENGIFXKLKXQGGXFXEAXXFRPIMXXNPXLFR

SEQ ID NO: 200179 - protein, 173 aa, Triticum aestivum
  unsure (1)..(173): unsure at all Xaa locations
  Clone ID: PAT_TA_94597.pep
PPPPQQIILLSSNICWLSVSMEKGYGGGAEEGKAKQSKPPAKARRRHEAHRELLCFCGAPAEVRKSYKVHGAPASMNNYVITAAISVTXHVWLPFSPYFFVXWCFXKIVDXXGXTTTTTTGCMVLTFWXXVVPVTRQHVSPHIGNVYLAPFLTKKXXKKTQGGPVPIPLXESI

SEQ ID NO: 200180 - protein, 155 aa, Triticum aestivum
  unsure (1)..(155): unsure at all Xaa locations
  Clone ID: PAT_TA_94598.pep
GSHDLKGAFGKILVRRTLFXLKWXKYAEFXXFXGXLKPVTVFWVDRYAHXHXSYGILFXKSPGXMYRANWGIGHXXKGILGANKGPIYRKSHKVFMESLTXTSWHVXLSLNLAMLGSTTIVVAHHMYSMPPYPYLATDYGTQLSLFTHHMWIGGF

SEQ ID NO: 200181 - protein, 151 aa, Triticum aestivum
  unsure (1)..(151): unsure at all Xaa locations
  Clone ID: PAT_TA_94599.pep
MQIFVKTLTGKTITLEVEVIGTPSTTSRRKIQGQGGHPPGTKQRLIFAGKAXXDGPTFAXDYNIQEGXTLQLXVSRLSXWDAXLXXKTWXXKTXTLSGXLXAQXTLQGKFQDKEXPPXQEPHLXEFRMGDLNKTSLGPLNNFNLRENTGGV

SEQ ID NO: 200182 - protein, 157 aa, Triticum aestivum
  unsure (1)..(157): unsure at all Xaa locations
  Clone ID: PAT_TA_94600.pep
XGXFXXXNWAPVXXKWXVHPXEXPPXGXXDXSVVPGSXHHLLVXNXGKXXXKSERPCXAXXXNPPCXMPIPXKSAPXXGGNFXWLVGSVRCRSLFXMIKPHAVEILCNQVGKDSDLSSIESTCSAAKPRRGPPVPAGRREKCLRGGKRSGGGGSGGR

SEQ ID NO: 200183 - protein, 132 aa, Triticum aestivum
  unsure (1)..(132): unsure at all Xaa locations
  Clone ID: PAT_TA_94601.pep
XLEDXSGLSRRHMPXPRQSGVSSRXLGGHRVAXAWAGGAVXXGGVXWXVTDNCEXXTPYXACSGTSHXPETRGXCPGAXACPPXSRGQGIHGXVPGECMCRDTDHARCRRRSPPEGGEGDGCGGEEDVRKEE

SEQ ID NO: 200184 - protein, 83 aa, Triticum aestivum
  unsure (1)..(83): unsure at all Xaa locations
  Clone ID: PAT_TA_94602.pep
SXLGIIKICVFYXCGRNCHPPYYLPFKXRTLXEXMALGLFSIILVSXSTIFPSFIFISINPKTPKYFIFCLVLCISIRSHLCK

SEQ ID NO: 200185 - protein, 178 aa, Triticum aestivum
  unsure (1)..(178): unsure at all Xaa locations
  Clone ID: PAT_TA_94603.pep
FDEIQSKTYMEVKGTGTANQCPTIDGGVDSFPFKAGKYEMKKFCLEPTSFTVKAEGIQKNEPPAFQKTKLMTRXTYTLDEMEGXARGRRRRHPXFXEKDGXXLRGVTVHSPGRXRVPFLXNVKXXXPTGNPEXSRAFLVQTTGSSSPTKRPGRAWYRRRREGKTKLSQGTSQRTRSLS

SEQ ID NO: 200186 - protein, 150 aa, Triticum aestivum
  unsure (1)..(150): unsure at all Xaa locations
  Clone ID: PAT_TA_94604.pep
MAAAGERRLLVGLLLLALMVSAHCLDGAXHHGPRVKRRRKEREIHSPVKDGGGWWVMENRTFDHVLGWVXRXRPDIXGSTGTDPTASSVRPSSPEFSSTXKAGTHSGPARESADFWSAEIASPLGSNPGWLDKIGPSSFASQNPFYLTHF

SEQ ID NO: 200187 - protein, 69 aa, Triticum aestivum
  Clone ID: PAT_TA_94605.pep
RYLKRLKYHETCCKKCLNLQNAKKIYGNNLELQKVYKIKNKRKKIKRQKQRKPIKNAEKNLLEKQHECL

SEQ ID NO: 200188 - protein, 136 aa, Triticum aestivum
  unsure (1)..(136): unsure at all Xaa locations
  Clone ID: PAT_TA_94606.pep
ESSDTIDNVKAKIQDKEGIPPDQQRLIFAGKQLEDGRTLADYNIQKESTLHLVLRLXRGGMQIFVKTLTGXKTITLEVESSDTIRQREAKFQDKEGSPPDQXRLIFGXVTLLGXRTFGXYTRRTFTGSLSQGGNYS

SEQ ID NO: 200189 - protein, 70 aa, Triticum aestivum
  unsure (1)..(70): unsure at all Xaa locations
  Clone ID: PAT_TA_94607.pep
RARGLQFDPETLYNLEGIKRXKEYSKKLDGSRNEYIXVTILXAAKGALKFPKIKKPAXSESSXRKTQLYT

SEQ ID NO: 200190 - protein, 121 aa, Triticum aestivum
  unsure (1)..(121): unsure at all Xaa locations
  Clone ID: PAT_TA_94608.pep
MKGTKLAAILILQAVLVMGVLSHVNADFFPKCCNNCRSFSGVDVCDDAHPKCPKGCSGVPXVVSTSPEMWRCAXDMKSTVDGTCRWDPGKXYWQCRIYVPKLNKTPGMTARARVFVTNNIQ

SEQ ID NO: 200191 - protein, 113 aa, Triticum aestivum
  unsure (1)..(113): unsure at all Xaa locations
  Clone ID: PAT_TA_94609.pep
DLXRXXVNXCISQXMXTXFLMXICTLPSITPFNQEIVXNXDESQXPCTSPQSCHKXIDXGSMLQNQXFXVTILEAXRVLSQNIGFYCYHRRKIQHRVSTPXTIQXYQIXDXTA

SEQ ID NO: 200192 - protein, 112 aa, Triticum aestivum
  unsure (1)..(112): unsure at all Xaa locations
  Clone ID: PAT_TA_94610.pep
GVXPXXMVGPWXEGSESWMSLXNHEXSXVSTLKHVCSTXHDPSFGYVSSSISPDXLCCVSRSGMPFSQILCLSILVSSSRGSVFICECLSSILGTIGPLGGQQFMVLPVGKK

SEQ ID NO: 200193 - protein, 79 aa, Triticum aestivum
  unsure (1)..(79): unsure at all Xaa locations
  Clone ID: PAT_TA_94611.pep
QCRSLAXLDPVQPIHGGGSVTVEMGSRLKVLPFGDIESXRRPTEVQESAWNVGGALRKTCRTSGMPSQRQGDEVIGQEA

SEQ ID NO: 200194 - protein, 112 aa, Triticum aestivum
  unsure (1)..(112): unsure at all Xaa locations
  Clone ID: PAT_TA_94612.pep
CSLYVCTAGXMSYHXLVXCYRISLCPYXHPXLXFVTCCRXIVCAFRRGPEYXSXTRSEILILXYXNSTNTSVWHPGSERLFTLHXPAPEMGLLGNTQHHGTESTAFIDTSGK

SEQ ID NO: 200195 - protein, 80 aa, Triticum aestivum
  unsure (1)..(80): unsure at all Xaa locations
  Clone ID: PAT_TA_94613.pep
TGDQFAWFFFNHAMLFILQLYDQKHFVFXHTXXPXVGHXLLQQLAYXKHSIHFLVALXLSXRXSYLLSGCSHIFQXQXXH

SEQ ID NO: 200196 - protein, 131 aa, Triticum aestivum
  unsure (1)..(131): unsure at all Xaa locations
  Clone ID: PAT_TA_94614.pep
MPGLLLTVLLISLLAKETYVATSLDDENFFKSCSPSRCSKHGPEVRFPFRLATQPPPCGAPGMQLSCSXGQDTILYHXILGSCKVTTIFTRXSIINIIHLVDSSXDCPLQETISSXPINGVYKPPKXGVAT

SEQ ID NO: 200197 - protein, 114 aa, Triticum aestivum
  unsure (1)..(114): unsure at all Xaa locations
  Clone ID: PAT_TA_94615.pep
KSQXSVXPQGXXGPDQGRLXKPAXARRXDTRLREAXPNSVXLLRQQCRVPVDPMECAKLLAMASAQXRKDASEVQMPMXPPAIXLAPWSSCRVRAPVVPSLQSIFMVKTRHRYF

SEQ ID NO: 200198 - protein, 144 aa, Triticum aestivum
  unsure (1)..(144): unsure at all Xaa locations
  Clone ID: PAT_TA_94616.pep
LLEAEGFLDSFFLVARALDAEGHVQGPRALEPGRRLGAEVVEALHEPHPPYLAEGKAAKGTAQEXPCGADEIXVMPSXHLRRGLHGAVMQGXNXQEEXXYXPFGGDXRWMTXXXVNHDCVXPPAPTKGEXRPXCPSRQAVALLR

SEQ ID NO: 200199 - protein, 99 aa, Triticum aestivum
  unsure (1)..(99): unsure at all Xaa locations
  Clone ID: PAT_TA_94617.pep
KRTLPPAWXYTCTXPNESPFHPYELQXXIXDTKRLRDXNWIKWAMPQVXXKNXPNTLACQLSGXXXGRXXSGSRXKIEDXPTGXIXQGGXSQXMXXSRX

SEQ ID NO: 200200 - protein, 62 aa, Triticum aestivum
  unsure (1)..(62): unsure at all Xaa locations
  Clone ID: PAT_TA_94618.pep
FFFFFFFFFXFFLIKRHTKFSXTXRXCYVIVHCTXYTTXALWXCEFNCPRXVPSDCKXKKKK

SEQ ID NO: 200201 - protein, 102 aa, Triticum aestivum
  unsure (1)..(102): unsure at all Xaa locations
  Clone ID: PAT_TA_94619.pep
VRIAWESYALLRPLIKESWIWVCPQLKILSDVAGLSLEIQKLEHDVLPQLKLQEAKLEMGALGXVLLMKNSTVASYIXGXLLRKLXRMFCQGSSXLKPNQKA

SEQ ID NO: 200202 - protein, 74 aa, Triticum aestivum
  unsure (1)..(74): unsure at all Xaa locations
  Clone ID: PAT_TA_94620.pep
PRDXETXLXSPGEXXRXFKLYRWRTSXGEEPRLGSDXVXDGRRWVLXRRVMAPWVLNPEKEAWDGGPWXRDALV

SEQ ID NO: 200203 - protein, 78 aa, Triticum aestivum
  unsure (1)..(78): unsure at all Xaa locations
  Clone ID: PAT_TA_94621.pep
SGQENMTCEXRXXVCLVXVWRALRFXQGKXXXCTXIAXNGETRXSRGQXTCXXFTLNMWEISGVWKEKRGEKNVRVNS

SEQ ID NO: 200204 - protein, 87 aa, Triticum aestivum
  Clone ID: PAT_TA_94622.pep
KENIFYTDKIQNLLPHLGLGIYFVLHKIYFSVKHSSQYLSRSIKLRVISSKLFYLFIYYSLILGQREYIPTLNSAQGFIAGASRPYD

SEQ ID NO: 200205 - protein, 88 aa, Triticum aestivum
  Clone ID: PAT_TA_94623.pep
LTKHKYYILNPYSLLMSSNCSTFSKVTLHCVVLKCRACSGWCPWSARRFNGGSSERSHSPDLPSMWSSGFSWRWAGSARGRGEGFLLG

SEQ ID NO: 200206 - protein, 128 aa, Triticum aestivum
  unsure (1)..(128): unsure at all Xaa locations
  Clone ID: PAT_TA_94624.pep
PFFWPKHKLSLTLRPGKTGRAGFVAAAXIAVCPGXISRSRRXSXGQGGVAIFALLLTFYLFVRAVNTGSLAWSLAAAFGYFYMVSAWGGYVFIINLLPLYVLVLLVTGRYSQRLYVAYNCTYVLGMLL

SEQ ID NO: 200207 - protein, 70 aa, Triticum aestivum
  Clone ID: PAT_TA_94625.pep
NKKLHKHTQKYTCTGAKKRPQKRLILQACLREHYATLQLAPHPSSKAQCSLDNQGTPHSWPWIRSTCLCC

SEQ ID NO: 200208 - protein, 89 aa, Triticum aestivum
  unsure (1)..(89): unsure at all Xaa locations
  Clone ID: PAT_TA_94626.pep
VQVSEIFPXINWLFSIEXEKEGXHCPNIPQYFXKASVSRSYPSTFAFGAYIXPPGXGHTNHXALPPLWXXHELIGGTIXXLPGGXQSQM

SEQ ID NO: 200209 - protein, 86 aa, Triticum aestivum
  unsure (1)..(86): unsure at all Xaa locations
  Clone ID: PAT_TA_94627.pep
VWDQQSMRMLELELLRRXFTQGATLRPQIQQAEAQYKDLLERVHFRHSREDAECRRCHWPLVFFPTKRKTEDRKHFRRKLNLNYNG

SEQ ID NO: 200210 - protein, 131 aa, Triticum aestivum
  unsure (1)..(131): unsure at all Xaa locations
  Clone ID: PAT_TA_94628.pep
GDPSALTTGRPGXGVMGYGHTQGTAVMINASQXGRTRRIGDGRRRIQPGEFGGHERGVQLGQGXHMEYIPFGAGRRQCPGALFATTMLELVLANLLYHFDWAIPGGAGPETLDMGEVFGIIVHTRSSLHLQ

SEQ ID NO: 200211 - protein, 62 aa, Triticum aestivum
  unsure (1)..(62): unsure at all Xaa locations
  Clone ID: PAT_TA_94629.pep
RTRRTQDEPYHRFVLARQGRLTGVEEERRSAAAIWVRVKGDAAAGSVKIKGRQRXRRRQNXG

SEQ ID NO: 200212 - protein, 123 aa, Triticum aestivum
  unsure (1)..(123): unsure at all Xaa locations
  Clone ID: PAT_TA_94630.pep
MARLNSKAVAAAVVLAAVVLMMAGREASAALSCGQVDSKLAPCVAYVXRGRASSISKECCSGVQGLNGLARSSPDRKIACRCLKSLATKHQVHQHGQVSGVPGKCGVSVPFPISMSXNCNNVN

SEQ ID NO: 200213 - protein, 80 aa, Triticum aestivum
  unsure (1)..(80): unsure at all Xaa locations
  Clone ID: PAT_TA_94631.pep
EXQXDXRQXFASRRPXHTHXARLXRTGAXXGDPVAGHDEXLRPLHRPXRPRXXHLXPGGPHVRIRSPXXXQDXTXFSARR

SEQ ID NO: 200214 - protein, 142 aa, Triticum aestivum
  unsure (1)..(142): unsure at all Xaa locations
  Clone ID: PAT_TA_94632.pep
MAADDGFSAARLFSQGVSYTYDDVIFLPGFIDFPADAVDLSTRLSRRVPLSIPCVASPMXDTVSEAAMAAAMASSAGPVXHSNTEPRAKAHLRAAKXAAPLSLVPXFPRLRXKLIGQNLLTRDSSLSRGPIPGPPVPIPRLA

SEQ ID NO: 200215 - protein, 90 aa, Triticum aestivum
  unsure (1)..(90): unsure at all Xaa locations
  Clone ID: PAT_TA_94633.pep
GERSTLGERGKAAAKPPPRKRMDKLDTVFSCPFCNXGNXVQCRIDSEKXLMGEXNCQICQESFNTTANXLTEAIDVYSEWVHECERVNTV

SEQ ID NO: 200216 - protein, 104 aa, Triticum aestivum
  unsure (1)..(104): unsure at all Xaa locations
  Clone ID: PAT_TA_94634.pep
MLSAVILSALGYPAFTVGTXLVHQRCVLPGPLVLGKGPLNALTPTPDMDRTVSRRSEPSSRTALMGEQPNPWNHLQSRWAKSRHRGAKPSRRCGLLGERXACYP

SEQ ID NO: 200217 - protein, 75 aa, Triticum aestivum
  unsure (1)..(75): unsure at all Xaa locations
  Clone ID: PAT_TA_94635.pep
LYAGFXSDVXTTXLAAYXTXFGDWXGPPGXEAEHVVGQRYISQSIMYPEEXHKVIDYEXLSDIIPIQGLAXPQGS

SEQ ID NO: 200218 - protein, 101 aa, Triticum aestivum
  Clone ID: PAT_TA_94636.pep
CCRGAPRVERRRSTGWHPARCPACLGASSISLISVFLRPPSWAGAPVGCGGYGCWTPAAVDWGVGKGSVSGIDSDGASSRLLRVPETGGQLGAADKGEVYA

SEQ ID NO: 200219 - protein, 78 aa, Triticum aestivum
  Clone ID: PAT_TA_94637.pep
STSVLAYDIHYPTWVCPRAGLMRLRDLDTICHPSQKTCAMWMDGCGGRDRCGWMDLRHVIDPRLKFSTDEKAVNCVLL

SEQ ID NO: 200220 - protein, 65 aa, Triticum aestivum
  unsure (1)..(65): unsure at all Xaa locations
  Clone ID: PAT_TA_94638.pep
EADTVTXPEVSRALYDRAASADKTIKLYPGMWHGLTAGEPDDNVELGLCRHPSPGLNKRSHHPQT

SEQ ID NO: 200221 - protein, 124 aa, Triticum aestivum
  unsure (1)..(124): unsure at all Xaa locations
  Clone ID: PAT_TA_94639.pep
LPPHPFFRGFLNFFGAQIHHXSPNTISYLAAFVSMCENFLGCHPHWGLFKHIFTCRSRSMKKANPTDERTRVIQMCGGLGIQMRGRSSFPPMTFPEFVRGWQSTWLLGRMSQLRVNRRVFPLSL

SEQ ID NO: 200222 - protein, 98 aa, Triticum aestivum
  unsure (1)..(98): unsure at all Xaa locations
  Clone ID: PAT_TA_94640.pep
LKRTFNFVXNTNMQGMRSVVQVNPALPQSTGQRSSSHTPLEGCFIMRDSKLLISSGMIRVHLAVSVPGFHGPGYSGGGSNSGFQNNQGNQNNQGGHNQ

SEQ ID NO: 200223 - protein, 71 aa, Triticum aestivum
  unsure (1)..(71): unsure at all Xaa locations
  Clone ID: PAT_TA_94641.pep
LFVPGGSASEARKHRLLAMAGGXEXXLXIRXVXAXXTQGLLAHHLQQGVXRDALHXXSTRXAXXSCMACIG

SEQ ID NO: 200224 - protein, 108 aa, Triticum aestivum
  unsure (1)..(108): unsure at all Xaa locations
  Clone ID: PAT_TA_94642.pep
XXIXSVKTRSKCHRQPCLIAHARVCVVVGSSQLGCGATAXAAMAASVXTXPXCTRLIPSSPLSAXAXTAAPSXIRLXGSSTSPXAGPCALXRGXAGRXLXRXPGAGDM

SEQ ID NO: 200225 - protein, 75 aa, Triticum aestivum
  unsure (1)..(75): unsure at all Xaa locations
  Clone ID: PAT_TA_94643.pep
QPPAATTPQSAPTPXQAQXPXAGACWLRRLLGCGGASPPPAPQEEDATRDIXMGLAGGGEEQRVVAARRSRRRPR

SEQ ID NO: 200226 - protein, 94 aa, Triticum aestivum
  Clone ID: PAT_TA_94644.pep
PLQANSLRWLHGLSPFTRTYAVTIPRQLEPTVGLSHDGVEFLKGCSEGLKGYVINRMTKSRRGKHYIDDKGWGPEAGSIEYGYRVPFGGIHVFI

SEQ ID NO: 200227 - protein, 56 aa, Triticum aestivum; identical to SEQ ID NO: 134756
  Clone ID: PAT_TA_94645.pep

SEQ ID NO: 200228 - protein, 164 aa, Triticum aestivum
  unsure (1)..(164): unsure at all Xaa locations
  Clone ID: PAT_TA_94646.pep
TLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQXQRLIFAGKQLEDXRTLADYNIQKESTXLVLRLRGGSIILALCWLILVRCVRFI

SEQ ID NO: 200229 - protein, 97 aa, Triticum aestivum
  unsure (1)..(97): unsure at all Xaa locations
  Clone ID: PAT_TA_94647.pep
MAGSSMSKDERWSLAGATALVTGGSKGIGHAIVEELAGHGARVHTXXRSAADWEXXRRRWEAQGLPVTMSVCDXSLXAHRLQSXETGKQVFYGKAHV

SEQ ID NO: 200230 - protein, 187 aa, Triticum aestivum
  unsure (1)..(187): unsure at all Xaa locations
  Clone ID: PAT_TA_94648.pep
PDQQRLIFAGKQLEDGRTLADYNIQKESTLHLVLRLRGGMQIFVKTLTGKTVTLEVESSDTIDNVKAKIQDKEGIPPDQXQALSLLGKQLEDGRTLADYNIQKESTLHLVLRLRGSMQIFVKDLTGKTXTLSGSSDTXTTQGKIKTRXDSPGQQRLIQANTGGWRTSRLHIRRINLNCPASPGGSIS

SEQ ID NO: 200231 - protein, 122 aa, Triticum aestivum
  unsure (1)..(122): unsure at all Xaa locations
  Clone ID: PAT_TA_94649.pep
XXRXVXAPLRXTXEXTXEGXIRECWXXXGPVXRGXGWXGRGRFFRIPSGSWGGEGSEREGGXVXXRFREGVGLRAXGGXXRWPIGPVGGFXFFSFVFSFIYFFSVLLHSSIYSSYVKYFSST

SEQ ID NO: 200232 - protein, 103 aa, Triticum aestivum
  unsure (1)..(103): unsure at all Xaa locations
  Clone ID: PAT_TA_94650.pep
SFFKIDDFLNSSFLIFCXXSVFCQKATVTKATGNGDNXHAIXQQGERQASMLHRNGWPHVGADWGIXTXEXLLPXXGRKRLXELPLATREXFSXXAXPXQKKX

SEQ ID NO: 200233 - protein, 182 aa, Triticum aestivum
  unsure (1)..(182): unsure at all Xaa locations
  Clone ID: PAT_TA_94651.pep
ISIENYTIIHSCFRSNSFICCLHLYWTMTTEGKRRAVIRNSEHKALQHCKASTVMSGGXRRGEGQCGVRTMAAPAYTSNGTSVSLYXYACVSVILLGLKSAAHSSPPSSSPASPGKASPSRRSADFPRGRTRXXTTPXXGTATVLSDTXQGGXYQSXKDLYPHGSLNSDGNRVPXXLRTLHG

SEQ ID NO: 200234 - protein, 157 aa, Triticum aestivum
  unsure (1)..(157): unsure at all Xaa locations
  Clone ID: PAT_TA_94652.pep
FDESGTVPTLDLGARKETTVRLRVGAVGRALPKLPAAGAVEFAKQKEAGVFDVEVRLGHGDAVQGAQGQVPPGDSSARSGCTPSTRTSPATAFPRRPNAHPQRQDFPVLASPPAFPHLIWLVHFQLXNRPCXVFSTITIMGEHIIPXNXTQXKIPXP

SEQ ID NO: 200235 - protein, 81 aa, Triticum aestivum
  unsure (1)..(81): unsure at all Xaa locations
  Clone ID: PAT_TA_94653.pep
GISCHLLXPYKFLFGLXSLIHFFLLKGIPSINIFPKKIFFNISSIISFVYSLKGNNNPLINPFLETYLTNFHLLYAYSCIL

SEQ ID NO: 200236 - protein, 102 aa, Triticum aestivum
  Clone ID: PAT_TA_94654.pep
VITLSGVETIIRSVLSLRPRTRLITRFSGVGSIFALGGLAATPYTPNFQNYSEWTAILPLGGLAATPYSPKLQNYSEWIAILPLRGLATTLYSPMSQNYSEW

SEQ ID NO: 200237 - protein, 118 aa, Triticum aestivum
  unsure (1)..(118): unsure at all Xaa locations
  Clone ID: PAT_TA_94655.pep
IMSFKSCFNVFHTHSTIITDALCHKHTNTWKWMEHGEGRHQFRYSLLGVVGLXNASSQWPSWXGGFXGGLAXAVPPNATXVTXVPPRYPXILXGSXYCQQHLASPRGXDXTKPVRVXN

SEQ ID NO: 200238 - protein, 89 aa, Triticum aestivum
  Clone ID: PAT_TA_94656.pep
IQKQAMHQIGANNNSSKSNASMREWNGRYRDDQRGACLVALARRGRCRRRSRSPGHQRPRGLPERRGGRNSKYIVNRGNTKHDMTIRSA

SEQ ID NO: 200239 - protein, 84 aa, Triticum aestivum
  unsure (1)..(84): unsure at all Xaa locations
  Clone ID: PAT_TA_94657.pep
VMGVLSHVNADYFPKCCNNCRSFSGVDVCDDAHPKCPKGCSACRVVSTSPEMWRCAXDMKSTVDGTCGGPCKNTIWSPTYIFLK

SEQ ID NO: 200240 - protein, 105 aa, Triticum aestivum
  unsure (1)..(105): unsure at all Xaa locations
  Clone ID: PAT_TA_94658.pep
FFQNXGVTGLFEVVRIAIECSIXDRILFSXRCVLVLMILWFSLKVFAIEKLEYSRYNAKIKYELVCNSTYSSGLLSYTNGSHEGFVEFCVIEVFKFRVILRWMRE

SEQ ID NO: 200241 - protein, 87 aa, Triticum aestivum
  unsure (1)..(87): unsure at all Xaa locations
  Clone ID: PAT_TA_94659.pep
MITSPIVAPTSVPSLSRRGSSFAVVCSGGKKIKVDKPLGLGGGLTVXDIDANGRKVGKKGVYHFVDNYGANVRRYXPIYTQEEWLIR

SEQ ID NO: 200242 - protein, 162 aa, Triticum aestivum
  unsure (1)..(162): unsure at all Xaa locations
  Clone ID: PAT_TA_94660.pep
GNPPLSPSSIDRSISTAAAMDFSGGAGGATLSEMYQSARRLLLSARXGVARVERLASAPASSSYSAXAPLVXAPDXAGXECXAXGGGANPGPLRANGPPLGAPXXAKGQRDSGKRKVXNYLKKSINLRKPRKESLAXTKAXLXXRKGGXFXKLMLIXKSLKF

SEQ ID NO: 200243 - protein, 216 aa, Triticum aestivum
  unsure (1)..(216): unsure at all Xaa locations
  Clone ID: PAT_TA_94661.pep
GVAVADRPVDGLLDRVLDRCSLGPGAVGCLKGNVLEFLRDXRAADXGRRRWTRSWCERPARTXNAAXNEPTAPAVRPGRAMDNNDAAPRCCRSLPPPANNYYNSXSDMEXXIMPRXMLIXHXIIKXXLXISIXNDAXSXXXHKXXAQXGGKSGXXSPXGFLKNPENRLPKTPGSGQSNFQFAXPXWATNLXXSQSEPRYQXSHPIREKXNXXSVXX

SEQ ID NO: 200244 - protein, 124 aa, Triticum aestivum
  unsure (1)..(124): unsure at all Xaa locations
  Clone ID: PAT_TA_94662.pep
NXLGISRIWFXXXSQNLLSXLVXPSXVGYPXGCXGGXEEXKXCAXQXGXXLXXKSLSXXMNSXCHXRXVQPPLXVPXXVEKSKXWXIWFNPLXSLQXFFPLXXPVXVPXKVXRKGXXPGKXXPL

SEQ ID NO: 200245 - protein, 76 aa, Triticum aestivum
  unsure (1)..(76): unsure at all Xaa locations
  Clone ID: PAT_TA_94663.pep
IFATLXTPFSTFNKGSLGKLYGNPXPERARLFXFRPQEFPSPNTDLEPSRRVLLSLFFSYLAAVVTAARRRGWEEF

SEQ ID NO: 200246 - protein, 51 aa, Triticum aestivum
  unsure (1)..(51): unsure at all Xaa locations
  Clone ID: PAT_TA_94664.pep
YYYLTCSLQIILLSNYSITYNFSTCRHYLAEKQLVXFLXAXRWXREXILXK

SEQ ID NO: 200247 - protein, 73 aa, Triticum aestivum
  unsure (1)..(73): unsure at all Xaa locations
  Clone ID: PAT_TA_94665.pep
KXWLARSKVGSGLGGCCESFGLSVPEVTGTALGWFHRAALTVRFQRWKVNRPLHHGPVLVRSPSITDHHLYKK

SEQ ID NO: 200248 - protein, 197 aa, Triticum aestivum
  unsure (1)..(197): unsure at all Xaa locations
  Clone ID: PAT_TA_94666.pep
SAPFPQSLDSLARSRLLPTPGLPRGDQATVRCRQGSPAVLARAGPSSVSRLRRRHGAAGQEGGGSRRRCTCTPRRLXLRQQCGSPGNPAPKTLPKCSWXLLLLAXLLRRSTXPSSSPAALPVFXNRGXAALXAARLMAXXLRRAGAQXXSXXRSXCGXLAXGPSVGILGHVWTXXXTKIGXDHPRNLXXQMRXYNNR

SEQ ID NO: 200249 - protein, 140 aa, Triticum aestivum
  unsure (1)..(140): unsure at all Xaa locations
  Clone ID: PAT_TA_94667.pep
EAFXXXLCFLHLLLLYLFFFXSFFXLFSALFIFXCFXLYXLXLFRAFSFRKIINFLLVPLVFKFEXLFLFFCFLSCFIYFILFLLTKKYLLLFLLLFSALFIFFCFLLYFLIVFAFSFRKIIYFQLVPLFSNLKTLFLFF

SEQ ID NO: 200250 - protein, 186 aa, Triticum aestivum
  unsure (1)..(186): unsure at all Xaa locations
  Clone ID: PAT_TA_94668.pep
IMSGCSLQIHGVYFFVFISNQIIHLHSTHRPRTSTISSHPGSLISLPWKREGNLQAHMLXCRLDAALPGFRYAAPRCIWMPPPGQTXAPAGRDRDIPKYSCCFLQNSNLVGXXTILSAGRAGNXXKEPSLXXLLPTGGSASAXXSCNRPGGCXAPRVXXIXPAXILPEKGFPPXRXLLSPPTXXXN

SEQ ID NO: 200251 - protein, 78 aa, Triticum aestivum
  unsure (1)..(78): unsure at all Xaa locations
  Clone ID: PAT_TA_94669.pep
TSSESRXGKTRXSQRPXPIXPNLGFRRHGIRRLRRLRRSAATAFSSAXTRGRAADXGLGSPASSXXSRMGMIQNEEXV

SEQ ID NO: 200252 - protein, 84 aa, Triticum aestivum
  Clone ID: PAT_TA_94670.pep
LTVKRHARQSQRETFQAGEPAEPSAGREPRCTSRKEGFGPPRVSPLVPVQSRTGTNGGISPGSCAQGPRGPFVPVRLDLLVPGW

SEQ ID NO: 200253 - protein, 88 aa, Triticum aestivum
  unsure (1)..(88): unsure at all Xaa locations
  Clone ID: PAT_TA_94671.pep
KIVLRVLPLFFSSTIAYVSNVIVFTFTVQQGGMTNTSLGXIHVSPATLFIIPITFQAXMLTVYDQFIRVFLRKAHGLXGXITHLQRIP

SEQ ID NO: 200254 - protein, 153 aa, Triticum aestivum
  unsure (1)..(153): unsure at all Xaa locations
  Clone ID: PAT_TA_94672.pep
GYLLYGPPGTGKSSLVAAMANYLRFNLYDLDFSGVYDNSCLQRLLMDMPNKSILXVSKDIDCSFDTMSREKDGKLRQGDRHXDTDTDEDGDDYDDXXARSTSGXSATRLIFXLLNFIXGCWXTTGEDAHLLTXNXKDXXXRALLRPGXMESME

SEQ ID NO: 200255 - protein, 133 aa, Triticum aestivum
  unsure (1)..(133): unsure at all Xaa locations
  Clone ID: PAT_TA_94673.pep
SESLXRSXEGXQXKAALXLVNPVRSLXXVCLFXXGXHPFRDVXWXCHXPGTNYXHHVGRIFPPCPSFVXIPMEXXLXLESNLAXAQEXFPQEVQEEGGLPGETRRVLHXLPNLSCLGRAXLNPGAQKMFEGPP

SEQ ID NO: 200256 - protein, 101 aa, Triticum aestivum
  unsure (1)..(101): unsure at all Xaa locations
  Clone ID: PAT_TA_94674.pep
SPKGHKQQCLIKRFNGSGWSGSFNTTYWAGFILSNRKAVRKFSLQGSPARFRSNFTYPLGFFSPFPHGTTSLSVTQEYLALQGGPCXFTRDSTCPMLLGSE

SEQ ID NO: 200257 - protein, 42 aa, Triticum aestivum
  Clone ID: PAT_TA_94675.pep
LVSATATHKASSGGMEMAAENGGCGCTQCKCGTSCGCSCCSC

SEQ ID NO: 200258 - protein, 86 aa, Triticum aestivum
  unsure (1)..(86): unsure at all Xaa locations
  Clone ID: PAT_TA_94676.pep
MSCCGGSCGCGSACKCGNGCGGCNMYPEVEAAGXATLLVAATATHKASPAGWEMAAXDGGCGXTQXQFGTXCGCPGCSLLDHLIID

SEQ ID NO: 200259 - protein, 48 aa, Triticum aestivum
  unsure (1)..(48): unsure at all Xaa locations
  Clone ID: PAT_TA_94677.pep
LKNYLXRFSKFXAHKXILSCRXXPVYNXATLLITYHGFVXVNNFPIXF

SEQ ID NO: 200260 - protein, 175 aa, Triticum aestivum
  unsure (1)..(175): unsure at all Xaa locations
  Clone ID: PAT_TA_94678.pep
RGFDXSCFXXSFXCRXXHPXIXCYGSLEFLXGXPCKFXLXXRXLKXPXVQGPIXGXXRKGRGTGPSXSPSGGRXRRHPVAPGRVXGEVQERPLVTGXDMPASPGRCSPPPPASSCCPSSRPIRRHATSKPPSRERVQCPCCISSITCIIHLFFHYKLAKQDIVLINRKAKTYEAL

SEQ ID NO: 200261 - protein, 110 aa, Triticum aestivum
  unsure (1)..(110): unsure at all Xaa locations
  Clone ID: PAT_TA_94679.pep
NVRXINXKKXCGLVRGNFXRMNKREXSLLCDAYVLVMPPILAKVLXCCLVWFWRMXHFXXLPQRGTFGXKXLTSDIFIQPAXPXGLKXXAGQXXQKERGYXLILGKNSMG

SEQ ID NO: 200262 - protein, 102 aa, Triticum aestivum
  unsure (1)..(102): unsure at all Xaa locations
  Clone ID: PAT_TA_94680.pep
PKPSSHRXRXRHGRXXPPQPXDLWWVSLXPSAGPPPRNAGARXXXGYLGGGRGXVAEXTGAXXDVKQXAXGEILASXLXXWGWXTXXLXXRXLATWTXCXXS

SEQ ID NO: 200263 - protein, 105 aa, Triticum aestivum
  unsure (1)..(105): unsure at all Xaa locations
  Clone ID: PAT_TA_94681.pep
SVLLVLSLIRNSPXHRRRIELIHRRSGFTLSVAHRATREFFLLVALVLGLSSNFPSLFHMCVCVFCLAGIDLELWTRRTGGKKKTPKALGLQSWNEDEQTNKLPQ

SEQ ID NO: 200264 - protein, 169 aa, Triticum aestivum
  unsure (1)..(169): unsure at all Xaa locations
  Clone ID: PAT_TA_94682.pep
NIHHTRQGRVASMACINTLQSCSMFKGAKAEARRGKATGAGSFGCRASTFMDGSGSGPGRRKPDASSPASGRNFPSLKYEHFRPNFXSQATSKQQQHFPXLPFNNGGVLXPGIXTPSDXXXGKPCEVXRIXSCQAPFXKXPKSSGLXKTXPXVTWQXEXAVDEFTIXLS

SEQ ID NO: 200265 - protein, 91 aa, Triticum aestivum
  unsure (1)..(91): unsure at all Xaa locations
  Clone ID: PAT_TA_94683.pep
YVLARYFEYLAGMXLEGNTSSSSMAGNNFYHPVSXHYASFKIVPDLNNLMFQVVKQQVKMHQDDLHGVLSQVTYKVHLIWSYGLEVMSKTS

SEQ ID NO: 200266 - protein, 67 aa, Triticum aestivum
  Clone ID: PAT_TA_94684.pep
GTEVGRPAQPIQTPRGPGDRDRPAAPTSDGPVSRLHRLPPQAHEGRVADMQNRGDGLSDLSPPHDRG

SEQ ID NO: 200267 - protein, 59 aa, Triticum aestivum
  Clone ID: PAT_TA_94685.pep
NTHLKKRLAKMGIDPVTHKAASGAPVGTADDVRSAKAAASLSHMAQWESARLEAEGRWS

SEQ ID NO: 200268 - protein, 139 aa, Triticum aestivum
  unsure (1)..(139): unsure at all Xaa locations
  Clone ID: PAT_TA_94686.pep
RVGVGCIAASCLDCDHCRRSEENYCDKVALTYNGIFWDGSVTYGGYSSMLRRAXSASSVRIPDALPLDAAAPLLXAGITVLQPNEATTDASSWQESGWLGSAINGRVVKPLLRIPRQPEGRENSRAKIPQEKTNSGKVT

SEQ ID NO: 200269 - protein, 82 aa, Triticum aestivum
  unsure (1)..(82): unsure at all Xaa locations
  Clone ID: PAT_TA_94687.pep
IRRRARRTGSXTXPXGEIARRRRGRAAXGRGLGXGPXLVRXTARXNALPSGARDRGRPVRSGTALERXFSTIVLLRKIRFDA

SEQ ID NO: 200270 - protein, 127 aa, Triticum aestivum
  unsure (1)..(127): unsure at all Xaa locations
  Clone ID: PAT_TA_94688.pep
ERRSRRRQARAGRREPPSSSEXTGKAXPXKHTXXEIAAKIXAXTTNRGGGKAXQXDRLGXEXGXHXKMAXPLCNVTAPVVKXXQIHHXXRHPXLPFYTDKXITXXAPPXXXAXXXPSHAQPERIQGD

SEQ ID NO: 200271 - protein, 75 aa, Triticum aestivum
  unsure (1)..(75): unsure at all Xaa locations
  Clone ID: PAT_TA_94689.pep
TTPVXAVYDXFRXIGTGPPLXLACIMXLYXIYVLELCCXLPVGPCLXCTHLRALISVRSNPGGPQGCCKSPVIGG

SEQ ID NO: 200272 - protein, 99 aa, Triticum aestivum
  unsure (1)..(99): unsure at all Xaa locations
  Clone ID: PAT_TA_94690.pep
MAAMKIALLAVAAMAVLLGTASAVTYNVGDQGGWTLXTDYSSWVSGKXFNVGDEFVFKXTPTPTHDVVXVNKGRYDPGSIDXAINTWLPATTITSTQNY

SEQ ID NO: 200273 - protein, 99 aa, Triticum aestivum
  unsure (1)..(99): unsure at all Xaa locations
  Clone ID: PAT_TA_94691.pep
YVESLQVNVLMTPPVKNRNPRSNSSYRPNSSYGPSPHMDQIPHVDQIPQMDQSSHMIIIVLTLLFRRVELRAMNMHIILQNHYVHXPPKEFSCLFICLP

SEQ ID NO: 200274 - protein, 49 aa, Triticum aestivum
  Clone ID: PAT_TA_94692.pep
GLDCFLFLDPRMCVCNFFSQVSSLQSGSMCQKVIKWAKSPDQCNLQKVY

SEQ ID NO: 200275 - protein, 99 aa, Triticum aestivum
  unsure (1)..(99): unsure at all Xaa locations
  Clone ID: PAT_TA_94693.pep
RWXCYXRVTLXLAPXXSXFCXGCWXSCGTTWWPGLARRRASTSSXRAAXTQXLAINTAAGEAIXXSPSMPXXPDXAGDAVVVHXXARXAXRXXXRFSTP

SEQ ID NO: 200276 - protein, 111 aa, Triticum aestivum
  unsure (1)..(111): unsure at all Xaa locations
  Clone ID: PAT_TA_94694.pep
LSPAIISSWPLPPSILSDCPRARHGGRRVHAAPLRRRAPRRRXPPXSRPFSXRAXXEGRRAQQVXXGVXXRVXRGVEXXAPVXGXGLXGNNXXXYTVXXFMMXKGXSXCRS

SEQ ID NO: 200277 - protein, 62 aa, Triticum aestivum
  unsure (1)..(62): unsure at all Xaa locations
  Clone ID: PAT_TA_94695.pep
TEFXHRIFXHHIPIHVTKGLLHHRXPTVXXLKSXXMLFLPHVLXDLIXPGXXXXSDXXIXXH

SEQ ID NO: 200278 - protein, 110 aa, Triticum aestivum
  unsure (1)..(110): unsure at all Xaa locations
  Clone ID: PAT_TA_94696.pep
MLDKLWDDVVAGPRPETGLDKLRRAAATQPLAINTAAGEAIKQSPSMPTTPTTPGDAVVVNAAAPRNXLXSXFXNPGXNLXTKNXXANSXNARXXTPNVQVLKEQDKNNR

SEQ ID NO: 200279 - protein, 133 aa, Triticum aestivum
  unsure (1)..(133): unsure at all Xaa locations
  Clone ID: PAT_TA_94697.pep
DPVLXTLDPFXDSSPSLLSMGHIVXTPXPECSPXCGPPESRFHVXSXGCXTLLGEIDQGVRIPFDXEAFPPPGAAAXLKXVIKXFKXRYVVGXLFTLLGNRSCTNVVDLSLSGRYKHCPSPSAMPWRTPHRST

SEQ ID NO: 200280 - protein, 169 aa, Triticum aestivum
  unsure (1)..(169): unsure at all Xaa locations
  Clone ID: PAT_TA_94698.pep
MGKEKTHINIVVIGHVDSGKSTTTGHLIYKLGGIDKRVIERFEKEAAEMNKRXFKYAWVXLDKLKAERERGITIXDIALWNSETXKYYCTVIXDAPXHPLTSSKNMIXGTPKADCAVLXIDPTTGGFXAGTPKDGQTRXXRLLASTLGVXQMICCCNKMDPXPKYQKPL

SEQ ID NO: 200281 - protein, 81 aa, Triticum aestivum
  unsure (1)..(81): unsure at all Xaa locations
  Clone ID: PAT_TA_94699.pep
MSCCGGSCGCGSACKCGNGCGGCNMYPEVEAAGATLLVAATATHKASSGGMEMAAEDGGCGCTQXCKCGTXSCGCSXCCSC

SEQ ID NO: 200282 - protein, 72 aa, Triticum aestivum
  unsure (1)..(72): unsure at all Xaa locations
  Clone ID: PAT_TA_94700.pep
KEGVXXSGRAAKGNGVYQFADKYXXNXXXYSPIXTPXQWSPXGDXYXXGXXGLFXWAVXLSGILLXGALLVX

SEQ ID NO: 200283 - protein, 78 aa, Triticum aestivum
  unsure (1)..(78): unsure at all Xaa locations
  Clone ID: PAT_TA_94701.pep
MSCCGGNCGCGTACKCGNGCGGCNMYPEAXAAGXTLLVSATATHKXXSGGMEMXAENGGCGCTXCXCXTSCGCSCCTC

SEQ ID NO: 200284 - protein, 161 aa, Triticum aestivum
  unsure (1)..(161): unsure at all Xaa locations
  Clone ID: PAT_TA_94702.pep
VCSXFXYLGDFPQSAESETLIXCXELVEKVDPSLLNQRQGIXEVXHXGREXCRCXSSWGPIVVGXPVVHLVVPQHLLLVKEGGEVEGEGRFDEDMVSSLVRTKARQVXFPPLXLLPWYLSCVACHNSACIISRDLKFVLFCLGQCICLVPSYVSVLLLPQP

SEQ ID NO: 200285 - protein, 92 aa, Triticum aestivum
  Clone ID: PAT_TA_94703.pep
HLLKDVVLGAKAKLCRPTTLEVVFGLPNKHDTKEQSLGIIPLYSDYYILPRTNRVGPIQRGATPCQTHVTWVTVYGQRPELQPRRVGNLYRR

SEQ ID NO: 200286 - protein, 61 aa, Triticum aestivum
  unsure (1)..(61): unsure at all Xaa locations
  Clone ID: PAT_TA_94704.pep
RPNGGXGXXWXXRGRXRSSGXLSPPLIYXFXSSXNYGNXRXGLXTLGPEXNQNXNRKGRRS

SEQ ID NO: 200287 - protein, 78 aa, Triticum aestivum
  unsure (1)..(78): unsure at all Xaa locations
  Clone ID: PAT_TA_94705.pep
LSLSHTNTCTNTHRHAQTPIYLDPHLSSCPHVYLTHSLSNYVYVSPRYTTQSPMYMSLSILHTHXTXXIYXHCLXXLX

SEQ ID NO: 200288 - protein, 81 aa, Triticum aestivum
  unsure (1)..(81): unsure at all Xaa locations
  Clone ID: PAT_TA_94706.pep
MSCCGGNCGCGSGCKCGNGCGGCKMYPEMDEGVTTTSQXTLIMGVAPSKGTPSFEAAAETGADNGGCKCGSNCTCNPCTCK

SEQ ID NO: 200289 - protein, 143 aa, Triticum aestivum
  unsure (1)..(143): unsure at all Xaa locations
  Clone ID: PAT_TA_94707.pep
XLDLIECVSLVRRKXLSIDTGPSGHXVETVKFPXDCXPNYPRHXSNXDLWFXNGRHLDAPXCGEKFSFCLRRKVXDVSXMDAKRNRRHHLRVFXTEPSGPRVYGPSRFSRRVATIALGWGLPRSPVDRSNRPWRVSSCSIAAT

SEQ ID NO: 200290 - protein, 187 aa, Triticum aestivum
  unsure (1)..(187): unsure at all Xaa locations
  Clone ID: PAT_TA_94708.pep
MAPTVMASSATSVAPFQGLKSTAGLPVSRRSNGASLGSVSNGGRIRCMQVWPIXEGIKNSKTLSYLPPLNTXGLLKQVDYLDPAPXVPCLQFNKVXXLPVEHNASPGVLTMAGYWTMWXLPNVXGCTGRTQVINEVEXVKKXIPDPYVRIIXSTNAQGACVNLPLNQRARSKAKSSQHIKCNFARAL

SEQ ID NO: 200291 - protein, 114 aa, Triticum aestivum
  unsure (1)..(114): unsure at all Xaa locations
  Clone ID: PAT_TA_94709.pep
MVAMXTTAXXXLXXSFSGVRXXAAXXTPSCVATPLAXAICNSISSSTPPYNLNXFKFXXINEXIXSREMTRRXMTXMMTXAXTDXXIIXTGXXXGPAKIFQLPTRITNISISFP

SEQ ID NO: 200292 - protein, 80 aa, Triticum aestivum
  Clone ID: PAT_TA_94710.pep
LFVDFYILSICEDESVRFHTRRTLRRHIPQLGYYSCPACLLACLPAEQFVTSSAARSLRCTASRLVLIRFDLQKFNPLPL

SEQ ID NO: 200293 - protein, 101 aa, Triticum aestivum
  Clone ID: PAT_TA_94711.pep
CVPSSKNIRGFDHAGRRTQLKEFIRVEGIDVVGLQETIKAEFSHRDLLSINPLERFAWHWVPAVGHSGGLLLGSTLLQVVRWKPVNPIRNWRLQGYQPTST

SEQ ID NO: 200294 - protein, 105 aa, Triticum aestivum
  unsure (1)..(105): unsure at all Xaa locations
  Clone ID: PAT_TA_94712.pep
VVFYCGAPCVVPTKGXTDDXPLSIVNGRNGVKLNISSSFVFNIQGLPSVIIVIKADLRHSXVVGKGLXXFPPTQVEGTVLAIWFRCINYTVGGSLTVFLSKKSSL

SEQ ID NO: 200295 - protein, 162 aa, Triticum aestivum
  unsure (1)..(162): unsure at all Xaa locations
  Clone ID: PAT_TA_94713.pep
QPPPCGTVSQLLWPPVAPGRASWWPPQAPSGPPPQSPRPRGQMHQPLANQRSSPGVPVQNDDPGLKSPWKXVQRRLAXSKVPGGRTNTMIRQPXAKEGRPLRXKGRRISXSRKTGXLGRWLPXNHGKPGLRIKLQKNXLXRXLKSLXRITQXCGSRNLXLGX

SEQ ID NO: 200296 - protein, 136 aa, Triticum aestivum
  unsure (1)..(136): unsure at all Xaa locations
  Clone ID: PAT_TA_94714.pep
MAASMITSPIVAPTSLPSLSRRGSSFAVVCSGGKKIKVDKPLGLGGGLTVRXSTPTAGRSXKKGVYXLLDKYGANVDGTANLHXPEEWSESXDRYAXGGTTGLLIWAXTSPGSFXGGLLLXXTTSPPVTTFTGSLA

SEQ ID NO: 200297 - protein, 90 aa, Triticum aestivum
  Clone ID: PAT_TA_94715.pep
PFSPPSLMSRTPLAPEQAAAPAARSVDTAPGSARLPRAATAPRVACRPHGRSCGLGIYIGLGEGREREGWWWSPPVRGEVERQGGLRRCQ

SEQ ID NO: 200298 - protein, 141 aa, Triticum aestivum
  unsure (1)..(141): unsure at all Xaa locations
  Clone ID: PAT_TA_94716.pep
TDHLSLVIVHHRCPAPQLRLHKKQAAEVVSRTRRRRADYHDQCHPPTMLNXVIVAQKPXCSXAVXXRPSNTTPTITGPSGRKDSWNMPKSAPXRIISDLXIRVPDIFYGXQDXHDPQKNGPXSXPAXXXEKLTGDSHNXNT

SEQ ID NO: 200299 - protein, 141 aa, Triticum aestivum
  unsure (1)..(141): unsure at all Xaa locations
  Clone ID: PAT_TA_94717.pep
MXIFVKTLTGKTITLEVESSDTIDNVKAKIQDKEGIPPDQQRLXFXGKQLXDGCXLADYXIQKXSTLQLVLRXRGGMXIFVXXLTGNTXXXEXVXSSDXTIXXVKATIXIRRASPGLXXLIFPVTHLXDXRTCCILSIYLH

SEQ ID NO: 200300 - protein, 90 aa, Triticum aestivum
  unsure (1)..(90): unsure at all Xaa locations
  Clone ID: PAT_TA_94718.pep
NSLLTLKGDVQDHCSFHGEQTSSDNLSPQRSLYYNYTGDXEVLXRWKXDDDPHGLNGWGWQYCTEMVMPMTGSNESMFPPASFSYENTSE

SEQ ID NO: 200301 - protein, 69 aa, Triticum aestivum
  unsure (1)..(69): unsure at all Xaa locations
  Clone ID: PAT_TA_94719.pep
XQXSGLXXSXVXSXXSHDDIRFSXDFGFMPFSLSPVXVXLMGIKCSSWXISLSTHFRYLNAPPFXGDPX

SEQ ID NO: 200302 - protein, 123 aa, Triticum aestivum
  unsure (1)..(123): unsure at all Xaa locations
  Clone ID: PAT_TA_94720.pep
TQHQVDVQLQQATAAMMVERWAGFGSAMATVIFLWSVVQNYVPPTFRLYLTAWGRQGRRLLXTLPAVYHLPNXAPSAFNAATSSSPSKANSTNALGPAGEAXSKAXSXKXQXRLSGQRFXTPX

SEQ ID NO: 200303 - protein, 132 aa, Triticum aestivum
  unsure (1)..(132): unsure at all Xaa locations
  Clone ID: PAT_TA_94721.pep
LVLKSGYLLSQLLPPRGCCCKRHPNIGPTNCHIIYQDLGSXLFKLGCRLSGWANCPKHTFCLSFHXAASNTLGASPLTGXNGXDGGXPXTXTALTTARLRXRCSKDSGGXVPIPXGAIXAXGVLXPXKPGTT

SEQ ID NO: 200304 - protein, 133 aa, Triticum aestivum
  unsure (1)..(133): unsure at all Xaa locations
  Clone ID: PAT_TA_94722.pep
ELSSLYSTWRSHETGANNPQSSGKEVTVYYSCCWARRQRYTVRLISPRRSLGFDLEPGXPPXVKLRXPCRFLXXRPCSRQGXLHAPRLANNRSVCNKXSXSTPQRXTQPLSXNRWQLRTRSKXXXNMHSAXXI

SEQ ID NO: 200305 - protein, 55 aa, Triticum aestivum
  unsure (1)..(55): unsure at all Xaa locations
  Clone ID: PAT_TA_94723.pep
DNTAPFSFDTSSSLQTITGSMSGAKPFXRKVTWXASTAHGRMXXRTXLVALGXFS

SEQ ID NO: 200306 - protein, 105 aa, Triticum aestivum
  unsure (1)..(105): unsure at all Xaa locations
  Clone ID: PAT_TA_94724.pep
PLCACLFXVFXILVPRLEFPTYVSQLDXGPDYGRHKAPPPXEEHXCVVVAHLPRGRSVLSRLAQIAICTRDXNRVSIQAYIMLKLPQIVVIKEQPKQPFCKLPRD

SEQ ID NO: 200307 - protein, 95 aa, Triticum aestivum
  Clone ID: PAT_TA_94725.pep
NGISSLLKHFLITYGSLEGRSPRGLCAARAPSKARPSGGDFFSRLETLVSGSSGVVLFLPWGERMPDSSPWLSSLTEAPVPSVGMGSGGGRFLLL

SEQ ID NO: 200308 - protein, 179 aa, Triticum aestivum
  unsure (1)..(179): unsure at all Xaa locations
  Clone ID: PAT_TA_94726.pep
TCPLQLSSNGLAARRPAAAAPRVGAAAPARRTPRSVPGGPAPARAPRPGPRPSRAPPRXARRRGGRPXAPEAALRPPPPPLHLLPXREAXDGGDAXXXXPAXRRRXLLXXGAXRVXLPAWWCPXXVNSFXSSXTRAVXRXXXLVPNXPPXLXXPQXCVIXLKSRXISXXVAAFXIXLLC

SEQ ID NO: 200309 - protein, 36 aa, Triticum aestivum
  Clone ID: PAT_TA_94727.pep
CRFICPSFSVRHFLAGFVLSAISLCGHHDSREHQIM

SEQ ID NO: 200310 - protein, 36 aa, Triticum aestivum
  unsure (1)..(36): unsure at all Xaa locations
  Clone ID: PAT_TA_94728.pep
EDLVVMTDTXTXYILFKHVEQLILMLKSVQHXEXNR

SEQ ID NO: 200311 - protein, 102 aa, Triticum aestivum
  unsure (1)..(102): unsure at all Xaa locations
  Clone ID: PAT_TA_94729.pep
DGGGAXWRXAAAGSGRGXGGXSRRRRAGRGXRAARHAAAGSRAARRAAXGSRAARHAAAAAGGGGGGGRAARGRGSRRRPGAGSAPTWQPPRRRGKGRGGEG

SEQ ID NO: 200312 - protein, 147 aa, Triticum aestivum
  unsure (1)..(147): unsure at all Xaa locations
  Clone ID: PAT_TA_94730.pep
AAAAGEAATPPAPGPTRPPSTSSPPGPPRSSRPAAARPSPTLTLHTPPCPPTPPXPPSPPPAADRPLPPPRRAPARPLRRRARRRLRPRVPEPRRGQRRASRARDAHRMVGGGAAMGMMLSFPSGVGPAAAAAAAGAGSELFPTSAD

SEQ ID NO: 200313 - protein, 87 aa, Triticum aestivum
  unsure (1)..(87): unsure at all Xaa locations
  Clone ID: PAT_TA_94731.pep
GXNHLFXAYDNCPFHNXIXXGTXHFNTXVTTSNKXDAQTXNITGCXXKCXXPXNQIAXNYPVXIHDHVXXLXGXLXIIERSIXXNFX

SEQ ID NO: 200314 - protein, 108 aa, Triticum aestivum
  unsure (1)..(108): unsure at all Xaa locations
  Clone ID: PAT_TA_94732.pep
MAPKRGGKAPVPAKKKTDKVTNPLFEKRPKQFGIGGALPPKKDLHRFXXSGQVXRIQRQRRILKQRXKVPXGSNNLTEPXXKLSTXXFKIFLNYRXKTNSXKKVLKPS

SEQ ID NO: 200315 - protein, 143 aa, Triticum aestivum
  unsure (1)..(143): unsure at all Xaa locations
  Clone ID: PAT_TA_94733.pep
AAEGSAGGGGGRKTPLPHNPRERGAAKFLTGLPSRGNFSSSSISSNLGGLRVYVCEHDTNPPRGXKLIETDTTNILIKTSATKEERLVEAKDAGSKTPKGKLARVKMFCQNLGVQNPSKKPNLAFFPVASSDEHIFQNNTSFT

SEQ ID NO: 200316 - protein, 97 aa, Triticum aestivum
  unsure (1)..(97): unsure at all Xaa locations
  Clone ID: PAT_TA_94734.pep
HRYNTIPSRPGTPTHVTGSPSVDIDYIMCLPLYMRSXDTSVPFLTRLISYLNTIQPKSNYNYSSVFIYSAYXXYGXKLINLANLXKHXDIXIIXYTM

SEQ ID NO: 200317 - protein, 82 aa, Triticum aestivum
  unsure (1)..(82): unsure at all Xaa locations
  Clone ID: PAT_TA_94735.pep
AXPQEGPPWIGVXILEXSGRRGLEQXAPGSGKKVXGGASRKNGNLAGISSEGGGRDPKPFLXSRNRFYLEMQVKIMKASTXY

SEQ ID NO: 200318 - protein, 70 aa, Triticum aestivum
  unsure (1)..(70): unsure at all Xaa locations
  Clone ID: PAT_TA_94736.pep
MAGMEAFEAYFRRADLNQDGRISGQEAVAFFQGASLPQQASPSVGCTPIXSKTXFLXRPXFFNALAXXNV

SEQ ID NO: 200319 - protein, 134 aa, Triticum aestivum
  unsure (1)..(134): unsure at all Xaa locations
  Clone ID: PAT_TA_94737.pep
GNGPGKVXPCXAPVQFCATTSYPFPRGLVKTSPVFSNLPTERRCSGERSKXPHLFGLPAKAASXWPGRNXARSLNATGXDTLXRRXPCYYPCXYXXKGXTNXKSTAXXNSMYNRIAXXXVVKKXEXRXRGRSIP

SEQ ID NO: 200320 - protein, 77 aa, Triticum aestivum
  unsure (1)..(77): unsure at all Xaa locations
  Clone ID: PAT_TA_94738.pep
GVPGFPKLPGRGPEHPNIFRLCYPTPWXKEGFFRNNIMINERWCVRIEDSLIWSAVRLLLRPTSSVVSGHSIWGPKE

SEQ ID NO: 200321 - protein, 138 aa, Triticum aestivum
  unsure (1)..(138): unsure at all Xaa locations
  Clone ID: PAT_TA_94739.pep
EAGAWLVTREGIPPQARARGALGPRRRVARDCVLAPPRARELRGCVGPGPARLPRSAARSAPPLPRGPSWRRXQGRHWARAHPPHLRVSGFGELGHFLGAKSNDYSDAAPIPQCLHMLMYLLSKFCYPVLMCYAKSXS

SEQ ID NO: 200322 - protein, 62 aa, Triticum aestivum
  unsure (1)..(62): unsure at all Xaa locations
  Clone ID: PAT_TA_94740.pep
NSSFAYMLXTGAQLVHXTXLTHIKMXTTLLNYNQFYIXRKPFXCXPVTQXVPEQKTTWXXRY

SEQ ID NO: 200323 - protein, 63 aa, Triticum aestivum
  unsure (1)..(63): unsure at all Xaa locations
  Clone ID: PAT_TA_94741.pep
HEXIXRVXXRXXCPDPXEVVVPGVVERPQEAAXPRXVAGAARDEVRQXGRRQGLLLLLPPPEP

SEQ ID NO: 200324 - protein, 44 aa, Triticum aestivum
  Clone ID: PAT_TA_94742.pep
VKCLMKMPRHSCHLLILLQFLQLRCQTVLCLSTFSIMASQIETD

SEQ ID NO: 200325 - protein, 112 aa, Triticum aestivum
  unsure (1)..(112): unsure at all Xaa locations
  Clone ID: PAT_TA_94743.pep
XPTXLQGTTRXXGSKDPXKMFXFACPSXSHASNLQVMRGNYFLWLYGLGQRGYPGRGIRCXGIQHWLSMLVLKLGILCLHPISLVQRPRMRGSXAIPWTVTXHCPELREDGS

SEQ ID NO: 200326 - protein, 97 aa, Triticum aestivum
  unsure (1)..(97): unsure at all Xaa locations
  Clone ID: PAT_TA_94744.pep
PRFXVRTXXDGREXGIRLILXELVPGPPLXPCFQXEAGLHTRCQFPNDVGLDTRCKFPDDAGLHTSQVESSAVHVLVALVKAERKHAAALEKVAEFP

SEQ ID NO: 200327 - protein, 147 aa, Triticum aestivum
  unsure (1)..(147): unsure at all Xaa locations
  Clone ID: PAT_TA_94745.pep
MVHVNFYRNYGKTFKKPRRPYEXERLDAXLKLVGXYGLXCKXXLWXVQYALSXIRNXARHLLTLDXKNPXRIFXXXALLHXINXYGLLXXXXXXLXYVXXXTAXNFLARRLKTLVFKAXLXNPSTXXXLIKEPKLRXERXFTIPXLM

SEQ ID NO: 200328 - protein, 108 aa, Triticum aestivum
  unsure (1)..(108): unsure at all Xaa locations
  Clone ID: PAT_TA_94746.pep
MSRGGSAGGGQSSLGYLFGDGEPAKPAAAPAAKPAPAEKPALGSCRCNQADPAGIPGNRANNYYRADGQNTGNSLTDXPSTKXMLLPGGGXSLGYCLAGSYPCLMMLR

SEQ ID NO: 200329 - protein, 202 aa, Triticum aestivum
  unsure (1)..(202): unsure at all Xaa locations
  Clone ID: PAT_TA_94747.pep
PPPSSPGRRNGAVLPCRIYQAGLHRDIRRHRRRIRRLRCFLPPFFLLYTRPRAPLPGPSPPPPPTSLLSPPPPSRRPCYNRPIWETPVGGRRCLRRAAFRLTRELCAPAPAMGSSVVTLXNYXFNGFILNWGAQLXRLRVKHXXVXAMGHKFIPXIYSTACXLHMGTRCHGGLGWGPQLXXMGREKXCHKSLMSQTAWLTLK

SEQ ID NO: 200330 - protein, 51 aa, Triticum aestivum
  unsure (1)..(51): unsure at all Xaa locations
  Clone ID: PAT_TA_94748.pep
QTVLCHKTCRINLQMVIAYIFDKLMXGKKPKLHYREVSLLSSPSSVQRGGA

SEQ ID NO: 200331 - protein, 145 aa, Triticum aestivum
  unsure (1)..(145): unsure at all Xaa locations
  Clone ID: PAT_TA_94749.pep
MAAKCYPTVSDEYLAAVAKARRKLRGLIAEKNCAPLMLRLXWXXAGTFXVATNTXGPFGTXKCPAELPHGANXXLEXXVRLLXPIMXXFXILSXKPTXKISWSPXVEVTXXPXVPSTGXKFXPXPPPKGVFYATKVNLEVFTQGF

SEQ ID NO: 200332 - protein, 156 aa, Triticum aestivum
  unsure (1)..(156): unsure at all Xaa locations
  Clone ID: PAT_TA_94750.pep
MGAAPSRQEASTASSPTGDGRVMPAALSASTTSDIANQAQSKRAPAPHMLREIVAGENVADVAALEDQVSTGIFLDGKTKKYWVDERTRHNCFMLFPRGLHITWSERXKYWTWXPLKEGSXAXXRIETLXLQNXCWLEXHAKLELSLLXPGVTSLS

SEQ ID NO: 200333 - protein, 137 aa, Triticum aestivum
  unsure (1)..(137): unsure at all Xaa locations
  Clone ID: PAT_TA_94751.pep
MAEHXEESVMDKITEKFHGSSSSSSSSDDDXRKSGXSSSVKAKIYRLFXXEKPVXSVLXGGKPAXXFLWRXKKISGGVXAXXIXIRLXFXVPXVHLLNLLXXGFIVXLGIFFXGXXASASVKKXPXXIPXVKILTDC

SEQ ID NO: 200334 - protein, 89 aa, Triticum aestivum
  Clone ID: PAT_TA_94752.pep
IRPSALVLRHPTAYDASRRRLRLGLGEVTNLPQFRPLDIEPVGYTGQSRDINFLRPNISLAWFRVTQRPIWCFVQYLGAEALTFSVLLN

SEQ ID NO: 200335 - protein, 101 aa, Triticum aestivum
  unsure (1)..(101): unsure at all Xaa locations
  Clone ID: PAT_TA_94753.pep
MKGTKLAAILILQAVLVMGLLSHVNADFFPKCCNNCRXFSGVDVCDDAHPKCPQXGCSACRVVSXTTPEMWALRGYETTVRRTCXGPARTDRSMPDDSALK

SEQ ID NO: 200336 - protein, 109 aa, Triticum aestivum
  unsure (1)..(109): unsure at all Xaa locations
  Clone ID: PAT_TA_94754.pep
MAKTYPVVSAEYQEAVEKARQKLRALIAEKNCSPLMLRLAWHSAGDXSDVPSKTGGXSGTMKXPAXQGHXANAGLDIAXRMXPXIKRDXHTPYVISTTFGSPWSRCRLS

SEQ ID NO: 200337 - protein, 95 aa, Triticum aestivum
  unsure (1)..(95): unsure at all Xaa locations
  Clone ID: PAT_TA_94755.pep
MLAYPPMSGKAGFGPEAHRIRITLSSKSVKNLXEXVCSDLVRGAKDKCSGSKGPSRMPTKVVNITTKNXPXGESTKLGSLRDNGDLQSPLFNNLR

SEQ ID NO: 200338 - protein, 117 aa, Triticum aestivum
  unsure (1)..(117): unsure at all Xaa locations
  Clone ID: PAT_TA_94756.pep
MATSPVLFLLLAVFAAGASAATFNIKNNCGFTIWPAGIPVGGGFALGSGQTSSINVPAGTQXGRIWXRTGCSFKWAGSGSAKPGDCRRQLSCPLXGRPPTTLADXTIXGGRPNSTIS

SEQ ID NO: 200339 - protein, 91 aa, Triticum aestivum
  unsure (1)..(91): unsure at all Xaa locations
  Clone ID: PAT_TA_94757.pep
QRGTKILMTRMFPPGVPRMFPLGVPRTFLPRVPRTFPPGVPRNSLRXRXERGSPCTIYSTVDEVITALERSWVGTSNLILGFDSPKXRLVR

SEQ ID NO: 200340 - protein, 144 aa, Triticum aestivum
  unsure (1)..(144): unsure at all Xaa locations
  Clone ID: PAT_TA_94758.pep
HTQHTQTRRSETDETRTKHQNALIHRSPAAAAGDGDDASVPRHCHRHRHLGHARAALGGGARAAGLRLRSRSGSLHSSRQHPRRXFKQGEXLXPAHQDQFTDNCTTXRVMIAATAGSLLLNPTNPTRLRKKISRCEDPVKPEYL

SEQ ID NO: 200341 - protein, 64 aa, Triticum aestivum
  Clone ID: PAT_TA_94759.pep
LYIGLGLLLFILCFGRNIDLTVRGSWRDQFFLHGGGQGVSKGISSRWPFRRSKKSLPGNAPALN

SEQ ID NO: 200342 - protein, 67 aa, Triticum aestivum
  Clone ID: PAT_TA_94760.pep
IDLTIKLEKPLLCKRHSHPMAKVENLLRTCLLVKANMKENQVKYLRVPFFSDEKYLVIRLHTIMWVE

SEQ ID NO: 200343 - protein, 162 aa, Triticum aestivum
  unsure (1)..(162): unsure at all Xaa locations
  Clone ID: PAT_TA_94761.pep
ERTNLEFFFFFFFFQIKSLDVDSSIVFSLNGRQAIILHGLFNNLSNWTCYFSFDAAPPAREFGTFVRSSRRSHESESKYCCSAANTIHYDTGCSKHLQVLNLRLESVGQIQRTLVQLTTEPHVSPEASAGGVTVTAGKLAHGGVQSPTCRCGEXEXRRRDRQ

SEQ ID NO: 200344 - protein, 120 aa, Triticum aestivum
  Clone ID: PAT_TA_94762.pep
MKGTKLAAILILQAVLVMGVLSHVNADFFPKCCNNCRSFSGVDVCDDAHPKCPKGCSACRVVSTSPEMWRCADMKSTVDGTCGGPCKNTDRFKPAYDMFRLKLNKSSDEITASSCLCVCV

SEQ ID NO: 200345 - protein, 50 aa, Triticum aestivum
  Clone ID: PAT_TA_94763.pep
MGLMGLVAAVSSLFTNVISTVGLPLSPIIAVIFLGDRMDGVKVLAMLVVG

SEQ ID NO: 200346 - protein, 91 aa, Triticum aestivum
  Clone ID: PAT_TA_94764.pep
PLFTFQKRLTNLKKNKKGIPLNCIFIDQLELTSRTYNCLKRANIHTLLDLLSKTEEDLLRIDSFRMEDRKHIWDTLEKHLPIDLLKNKLSF

SEQ ID NO: 200347 - protein, 124 aa, Triticum aestivum
  unsure (1)..(124): unsure at all Xaa locations
  Clone ID: PAT_TA_94765.pep
PVGKVALFEACFVRLNLDKYSYCFQLWLLSAPAGSKLRLLSTSAAFTSLSCFFSPVFLQLPRPNQRRRGAASTCQWLGCASVHASPPQRLPKSLTPMSPXXLVHXRGAASRLVTXXQTTGIGRS

SEQ ID NO: 200348 - protein, 158 aa, Triticum aestivum
  unsure (1)..(158): unsure at all Xaa locations
  Clone ID: PAT_TA_94766.pep
MAPTVMASSATSVAPFQGLKSTAGLPVSRRSNGASLGSVSNGGRIRCMQVWPIEGIKKFXETLSYLPPLXTEALLKAGGTTWIRSKWVPCLXXNKVXSSSRGAHASPRGTNDGRYWXTMWELPMFGCTDXTQVINEVEXVKEXXPDAYSASSVRQHRK

SEQ ID NO: 200349 - protein, 156 aa, Triticum aestivum
  unsure (1)..(156): unsure at all Xaa locations
  Clone ID: PAT_TA_94767.pep
RTLXDYNIQKESTLHLVXRLRGGXQIFGXTLXGKTITLXVESSDTIXNXKXXXQDXEGIPPXQQRLIFAGXQLEDGXRTLADYNIXKXSTLHLVLRLRGGMXIFVXTLIGXTITLEVESSXXHXQXSXXDXGHDXXPXDXXRLIFAGXXGWARNIT

SEQ ID NO: 200350 - protein, 108 aa, Triticum aestivum
  unsure (1)..(108): unsure at all Xaa locations
  Clone ID: PAT_TA_94768.pep
MSMAGQGSXPPXFRXHPTDXELILXYLRNRAAAXPCPXXIIADVXIYKFDPXDLPXKXVYSDXEWYFFKPXGTQXPXGIRXPNARXSGYWXSXXTDXPXXSXQARRQE

SEQ ID NO: 200351 - protein, 104 aa, Triticum aestivum
  unsure (1)..(104): unsure at all Xaa locations
  Clone ID: PAT_TA_94769.pep
LCQPSTYYIGXNDFXAXXXKXVPGNGTVFHGHLGXSNREFEPLXFYFGLVLGLVAGLXWSVFCTFLFKKTWRIAYFQLFDELFDRIYVYVVVKWASFTRKTDEE

SEQ ID NO: 200352 - protein, 86 aa, Triticum aestivum
  unsure (1)..(86): unsure at all Xaa locations
  Clone ID: PAT_TA_94770.pep
MADVXYRCFVGGLAWATDDQSLHNAFSKXGDVIDSKIITDRXTGRSRGFGFVIFASXDAMRQXIXXXTXXDXFXRNIXVXXAXSRR

SEQ ID NO: 200353 - protein, 105 aa, Triticum aestivum
  unsure (1)..(105): unsure at all Xaa locations
  Clone ID: PAT_TA_94771.pep
DRETLLNFSLISKLVACIVLMQRPGDNLLFGKNGVCERCSKLSAWPLPPXAPGRSPKPYLVPSAPDTVLCAIGRTPPRCAGPVCLXQGLSPRSHVKXHARTLRQA

SEQ ID NO: 200354 - protein, 52 aa, Triticum aestivum
  unsure (1)..(52): unsure at all Xaa locations
  Clone ID: PAT_TA_94772.pep
MDEEWXNRLWKTCVYVITFGMLVXLLLGLXMSWSAITAALXLIVLDFKDARP

SEQ ID NO: 200355 - protein, 94 aa, Triticum aestivum
  Clone ID: PAT_TA_94773.pep
LEKRACMMEDSSTRSHVFEGNRLGYVRSESMDSAGHPSAARSGSLLSRRSSRPSSRGSSALSRDGRLDPELNEAFPSVSRQLLGDADTRLWSSH

SEQ ID NO: 200356 - protein, 105 aa, Triticum aestivum
  unsure (1)..(105): unsure at all Xaa locations
  Clone ID: PAT_TA_94774.pep
MLGKLFILGLRQSNVSLSSTKLVLFFPKPVFNGLGCSHFARRYXGNRFCFLFLXWLLRCFSSPGCLLPAHGFSRQFKRLTYLGISGSMLIFNSPKHFVACYALPR

SEQ ID NO: 200357 - protein, 59 aa, Triticum aestivum
  Clone ID: PAT_TA_94775.pep
FFFSIGIYGLITSRNMVRALICLELILNSINLNLVTFSDLFDSRQLKGDIFAIFVIALA

SEQ ID NO: 200358 - protein, 39 aa, Triticum aestivum
  unsure (1)..(39): unsure at all Xaa locations
  Clone ID: PAT_TA_94776.pep
MASSAPGGGSGKIERLSSIXAQXRXLFPAKVSEXDKXIE

SEQ ID NO: 200359 - protein, 84 aa, Triticum aestivum
  unsure (1)..(84): unsure at all Xaa locations
  Clone ID: PAT_TA_94777.pep
QAHDHGEQAVLQCSKYCKLTTXSLLXHVXLTKIHVDXGNMLLPPXVXVCKFSIQYXNFPPVXLSLXRRTDTSGKEPLTTHPTXE

SEQ ID NO: 200360 - protein, 174 aa, Triticum aestivum
  unsure (1)..(174): unsure at all Xaa locations
  Clone ID: PAT_TA_94778.pep
WLRRATGIQPHFPYVVDSFEERTAVSVDRVATSSNTSTASKDADCCPIDQQSQTLESNIDSGNHRKHNSRDHGQSHFPFSNLLSNIWPXGHDRMFKRQENDPSSRRYDSSMNNDLGSNPLLPKXTMGGISMSEGGQMSKANLXKKTWDDXTKDLXKASEKTXSXVKKXPGWLQP

SEQ ID NO: 200361 - protein, 69 aa, Triticum aestivum
  unsure (1)..(69): unsure at all Xaa locations
  Clone ID: PAT_TA_94779.pep
MRGDAPPPTAPSASSSSASPSLFGGXGXELFESGPSPLVFLPLLLIQGGGMDLSRVGEXLSSVRSARSS

SEQ ID NO: 200362 - protein, 96 aa, Triticum aestivum
  unsure (1)..(96): unsure at all Xaa locations
  Clone ID: PAT_TA_94780.pep
PLFFHFISSGICQLHHGASXCCGDSPGKKKEVAAVTPTMXVCCCSTSSSLLXGXRFAAPVASARARXWGXAXGXRAVXLAXPPXLXCLGLEARXAR

SEQ ID NO: 200363 - protein, 105 aa, Triticum aestivum
  unsure (1)..(105): unsure at all Xaa locations
  Clone ID: PAT_TA_94781.pep
QGSRSANETMGDKLHPSKRETSRLPTXAPKLRXLXKEVGVQKTAXVFPKTTTFLXVLYPLIXRPFAXNXXVNICPTXGCXKHRRETFPFKGTTXKRGPQNGTKVX

SEQ ID NO: 200364 - protein, 63 aa, Triticum aestivum
  unsure (1)..(63): unsure at all Xaa locations
  Clone ID: PAT_TA_94782.pep
SGXGSFAPLXLFNPSAMTNCVNQRFLSYXVELLSRHCHQXGKTNLSHDGLTPAHVPYWWVNNP

SEQ ID NO: 200365 - protein, 86 aa, Triticum aestivum
  unsure (1)..(86): unsure at all Xaa locations
  Clone ID: PAT_TA_94783.pep
MASKWVRPEVYPLFAATGVAIGICAFSLLRNITGNPESGSTRWGXAAXVLEXHXEGKAYAXXGLKSYXQDKTPKIMPESKXXNNPK

SEQ ID NO: 200366 - protein, 145 aa, Triticum aestivum
  unsure (1)..(145): unsure at all Xaa locations
  Clone ID: PAT_TA_94784.pep
VAAASADPANGAANDLLPKYGLPRGLIPGLGSAPKPSTKATGNFXIQLAGNCXVRFGEQLVYYXKGLRGCLSKGRXNGSPXIQAKXSSSWVSVSGXVAHPKXGPISISKLRSLFNGASGPPGRNPGFPGNKLGPLKVYFRTGFQK

SEQ ID NO: 200367 - protein, 95 aa, Triticum aestivum
  unsure (1)..(95): unsure at all Xaa locations
  Clone ID: PAT_TA_94785.pep
MQIFVKTLTGKTITLEVESSDTIDNVKAKIQDKEGIPPDQXQRLIFAGQAVQDGRTLXDYNIQKXSTSTGSXXPWGXAIFXKTXKXQNINXQVXS

SEQ ID NO: 200368 - protein, 82 aa, Triticum aestivum
  unsure (1)..(82): unsure at all Xaa locations
  Clone ID: PAT_TA_94786.pep
NLSVWSMLNSWEGSQWKXSGLCQNQKLCLNGXNQSXXESKXFXQIWPWPNKKKVSKEXNWPIXVQKXKRXSTXFWTXNXXKL

SEQ ID NO: 200369 - protein, 139 aa, Triticum aestivum
  unsure (1)..(139): unsure at all Xaa locations
  Clone ID: PAT_TA_94787.pep
MVVPVIDFSKLDGAERAETMAQIADGCEEXGGFFQLVNHGIPLEFFDRVKEGVAPEEYRSGKPLPGRPXPVQDLESGWXAEPGGEXVAPVXHMDWERIFYSNDXQWPPDPPAXKGNMRNYAPXQRLPGRSWEAWKLRAH

SEQ ID NO: 200370 - protein, 64 aa, Triticum aestivum
  Clone ID: PAT_TA_94788.pep
ILHFHPTRLPGGGGGGAGGGRRRRVTEEGWRRGGGATSVEGRLGGLVVGAVPEGEARWRRRRAA

SEQ ID NO: 200371 - protein, 110 aa, Triticum aestivum
  Clone ID: PAT_TA_94789.pep
LRPNQGAYPFCLLVFVRVHNRQGAILPHQHTRLLRNRHRHPTVGLHASPQPPPPHQLMPQSPFPHQLIPPPPPTLVSLWPLLAADGVSTRSATQWALAALTIPPNIHGLS

SEQ ID NO: 200372 - protein, 111 aa, Triticum aestivum
  Clone ID: PAT_TA_94790.pep
MGAPEWWWSTWRGLAVAATAACLLLHVAARVADALWWRPRRLEAHFARQGVRGPPYRFLVGCVREMVALMADANAKPMSPPNSTTRCPGARLLHYWRKITGDVLIWFGPTR

SEQ ID NO: 200373 - protein, 101 aa, Triticum aestivum
  unsure (1)..(101): unsure at all Xaa locations
  Clone ID: PAT_TA_94791.pep
PPPLGCLLFFXKDVVCYGKDFKPRSGPMVQRACYPFHRLEEDSERCSCEPSLTRCLPLPRIERPEAFASAPQPTYQLGPGKPAMLQHKPRSRVHTKHPTPP

SEQ ID NO: 200374 - protein, 135 aa, Triticum aestivum
  unsure (1)..(135): unsure at all Xaa locations
  Clone ID: PAT_TA_94792.pep
PDCLVSDNTKCLLSYIVCGNTPTLWFGGGSGRSAMTKFSYNSVGDKFGRKVHGYIKSNAHSLSMPSSKLSNLQSCCENSTLSSLGHIRSLXEFPPVGSPWSTLAYGGSRQYMGSHXQACQTPXGSRSQXSTTXXP

SEQ ID NO: 200375 - protein, 134 aa, Triticum aestivum
  unsure (1)..(134): unsure at all Xaa locations
  Clone ID: PAT_TA_94793.pep
MAASERSLPCLFLHGASAGAHLILALAVAGSRLFPRRGKDTAVAVGGFPCYAVVVCATWALALFQLLLAAYSCYLDAGAGWPLDRWWDQADAATRAVAWLLLAAYCIQFRRQXAVPRAAQXWWALFXLLSVVAV

SEQ ID NO: 200376 - protein, 99 aa, Triticum aestivum
  Clone ID: PAT_TA_94794.pep
YFQGFCGDAASAGRHGRGEHQHHQDAGVAARQDRRSEGDSREADRAPGRLQRADLARDARPSAAARSDAGGPRPHAQDGGRILSIRLGHHTHPPARATA

SEQ ID NO: 200377 - protein, 80 aa, Triticum aestivum
  Clone ID: PAT_TA_94795.pep
HWDQPCNGPPPELVRWNHCEIEEDSTNLAHGGQRWAMLSAVDLLSYEYEDIVLLSNNIFTVTNQGLASYGDKSYGILPIS

SEQ ID NO: 200378 - protein, 99 aa, Triticum aestivum
  unsure (1)..(99): unsure at all Xaa locations
  Clone ID: PAT_TA_94796.pep
KLSQMCDIXGTYKMVKVFFFPGAAWLLGKFSNCPSKVIFCLLLCSATFAIMCISIQNHVPYHGMGLASSSASKSLCFQMLPTFWVEWLSICGMHHFLCT

SEQ ID NO: 200379 - protein, 127 aa, Triticum aestivum
  unsure (1)..(127): unsure at all Xaa locations
  Clone ID: PAT_TA_94797.pep
MRLLSGASASRLPFLARARPRCVSRYSSASACRAASSSAAPVGDGGARKPWLFVGLGNPGKXYQXTRHNVGFXMIDAIARSXGVSPSNINSKQWXAKAYWXFPNMLAKPQTFMNAXVIRWLVISRYT

SEQ ID NO: 200380 - protein, 109 aa, Triticum aestivum
  unsure (1)..(109): unsure at all Xaa locations
  Clone ID: PAT_TA_94798.pep
LFRVNWLLGGNTASLSRKSLCSSQKTXFNGLGCSHFARRYXRDRFCFLFLXGYLRCFSSPGCLLPAHGFSRQFKRLTYLGISGSMLIFNSPKHFVACYALPRLWVPRYP

SEQ ID NO: 200381 - protein, 128 aa, Triticum aestivum
  unsure (1)..(128): unsure at all Xaa locations
  Clone ID: PAT_TA_94799.pep
RSRRRCPTLARSIQSHSRRPTTFFTGVQPSRVPPGSTPPLIPKDHGGCCTSKNGRKGAAPSAGRRRPSPSTFCYNSTRRWWRRSWSRPWWKRGPXAFQSDLEASSNFNVRKKLKTSPSXPQCEDHVNG

SEQ ID NO: 200382 - protein, 42 aa, Triticum aestivum
  Clone ID: PAT_TA_94800.pep
SRAHQVSFHLLKFVFYSSMFQPECFLNRFSLIRFFSHSNHSG

SEQ ID NO: 200383 - protein, 78 aa, Triticum aestivum
  unsure (1)..(78): unsure at all Xaa locations
  Clone ID: PAT_TA_94801.pep
ASPLLRPHPPSSLPACCWPPLHAALCSAAFLELSTRXRERERXRXRXRXRERERERERERERERERERERERERERER

SEQ ID NO: 200384 - protein, 115 aa, Triticum aestivum
  unsure (1)..(115): unsure at all Xaa locations
  Clone ID: PAT_TA_94802.pep
WGXRTRGGWXXLRKTSLAAAQRXRIXGXGEXRGAHRPPAARLQESPDHXVERRRVHGPAXRWWVGESKPWSGXRGKRRAGGAAAAGGWINPSRACLFGSARADGWRGEGGREGAT

SEQ ID NO: 200385 - protein, 108 aa, Triticum aestivum
  unsure (1)..(108): unsure at all Xaa locations
  Clone ID: PAT_TA_94803.pep
DVMCQGGDFTKGNGTGGESIYGEKFADEKFVHKHTKPGILSMANAGPNTNGSQFFICTVPCNWSTXQHVXFGEVVEGMDVVKXXEKVGXRSGTVAIAEWRSKFVRPPV

SEQ ID NO: 200386 - protein, 107 aa, Triticum aestivum
  unsure (1)..(107): unsure at all Xaa locations
  Clone ID: PAT_TA_94804.pep
LNLIALNFFTTRRHPNYPKYKLPLKHXRTRRNKLRXXPTMSCXVGGLQTQXKCXIAPKQDPKSXKITAELQPFXTRTXAFVSWRGKARPHHIWXSRRXXGASAMXPR

SEQ ID NO: 200387 - protein, 81 aa, Triticum aestivum
  unsure (1)..(81): unsure at all Xaa locations
  Clone ID: PAT_TA_94805.pep
AAAAAHSLLAPSPTGEAICRTPKNFRTFSKQASTPLDYSLETLDPQTHAATSSWXIHGASQPAPATTLPRLXGPNSFXGXX

SEQ ID NO: 200388 - protein, 128 aa, Triticum aestivum
  unsure (1)..(128): unsure at all Xaa locations
  Clone ID: PAT_TA_94806.pep
SVRNFFLTEKKLFIVYLEAIETGGRNQGKKXVENKEXRKEHQRRKKKGNHLKTDKETKRKAEKMKKPRRKQRKSTYXRRKLKNKEKQXNRKKGITKKKKKNKRKSVKKKKXNKYHNKKKKEKKKTKKN

SEQ ID NO: 200389 - protein, 114 aa, Triticum aestivum
  unsure (1)..(114): unsure at all Xaa locations
  Clone ID: PAT_TA_94807.pep
PQKTXAXTRSKGNXVRKPXXPXFGXXEIASXRTLCLNEYCSQMRLRNRDFAVVLCLGDKILLRFVHVIVMIQRFCSNCVGLRLCGDMFLSFCHRLSCLQFSFFFGRKKKKKKTR

SEQ ID NO: 200390 - protein, 164 aa, Triticum aestivum
  unsure (1)..(164): unsure at all Xaa locations
  Clone ID: PAT_TA_94808.pep
YGPPPXAXKTTQSXRSXXTPRXVAGRGREESSCCKGWSSQEXSXVPLPGGRXPGLSLKAAALAGIPWTPXNSFGRPPTGVPEESSATRASLSTSAPSHRSDRRRRPCRGGRARSVSPLERRAYEREQPSSQPHRPVCAPRISSCERAGCHRLPWPRASASPSSR

SEQ ID NO: 200391 - protein, 160 aa, Triticum aestivum
  unsure (1)..(160): unsure at all Xaa locations
  Clone ID: PAT_TA_94809.pep
PPNEAVAACPCGSAAATSPCRSAAAWPHRHRVPMAARPHLPHGSTAEGAVVPHPLFGSATRLHRRGSSGAPPAVRLDRSPPPPRERLAPPAFARAXVXRXRXLQTRGKCYERTVRGSXLLSSEFIARCFSPDLGCXAPPELRLXSGNPCXPDSCRWALDX

SEQ ID NO: 200392 - protein, 114 aa, Triticum aestivum
  unsure (1)..(114): unsure at all Xaa locations
  Clone ID: PAT_TA_94810.pep
FFFLISGFSTGXFVLXVYFSFCTRFSSVSFLCYFFLLFFLSPSFCFLFVLLQKILLFCCLVFLFILRFSFFVVIIFSFVSPGALLLVFPAYVYSLLQVPLNVYVVMPVCCVVIS

SEQ ID NO: 200393 - protein, 159 aa, Triticum aestivum
  unsure (1)..(159): unsure at all Xaa locations
  Clone ID: PAT_TA_94811.pep
RNLVKLHGCCIDSKTPLLVYEYLEQGSLDQAIFGKTDLNLDWRTRFEICVGIARGLAYLHEESSMRIVHRDIKASNVLLDADLNPKISDFGLARHYKDSMTHLNTGVAGTXGYLAPEYXMMGHLTEKADVFAFRVLGLEXSLGRPLYDISRGGRYQIAL

SEQ ID NO: 200394 - protein, 78 aa, Triticum aestivum
  unsure (1)..(78): unsure at all Xaa locations
  Clone ID: PAT_TA_94812.pep
DIPKDDVGRTLGIIIXSWQGWPIVASXPPSKNHVNXLTSFPRKXSFSAYGXPGPIPNNXQKTDNTTXGTSQNLNSLAX

SEQ ID NO: 200395 - protein, 84 aa, Triticum aestivum
  unsure (1)..(84): unsure at all Xaa locations
  Clone ID: PAT_TA_94813.pep
AAGPPPPAGARRSGRGPDRCARXRPMPARGGGGGTYQPRLDLGGAAPEPGSGAPRRPSPAPXYWSQSPSRGGAELXGRWGRAXV

SEQ ID NO: 200396 - protein, 81 aa, Triticum aestivum
  Clone ID: PAT_TA_94814.pep
RLKVGPSIDAAQPLYTADALIDAKCLSFSFDSLDNGYVINCRCIYVYMFLCSEIFLMKRADHRNIFNMSICWSTKKKKKKT

SEQ ID NO: 200397 - protein, 71 aa, Triticum aestivum
  unsure (1)..(71): unsure at all Xaa locations
  Clone ID: PAT_TA_94815.pep
XXIXXXMSXXGARMKLEPPAYATFXRXLCRAXRVPYAYEVYDYXIESKSXPPAXXYSELXSSXKWLRKMKV

SEQ ID NO: 200398 - protein, 113 aa, Triticum aestivum
  unsure (1)..(113): unsure at all Xaa locations
  Clone ID: PAT_TA_94816.pep
RRWHNTSNNTSRVRITSHFGLELRTLLLSNNSLSGGFPSLLRQCRNLLFLDLAQNKLSGDLPAWIXDRMAALIMLRLRSNNSQVTFQLEITGLLLLRXLDLTNNSFNGDIPRI

SEQ ID NO: 200399 - protein, 89 aa, Triticum aestivum
  Clone ID: PAT_TA_94817.pep
VFMPADEIAMMPRYSWARYFGSGTSGAGSLYYDGIIVFALIPVGFGFIITGDIETQDTRAQGEALSSRSHGFEDLRADMARICAFLEIR

SEQ ID NO: 200400 - protein, 93 aa, Triticum aestivum
  unsure (1)..(93): unsure at all Xaa locations
  Clone ID: PAT_TA_94818.pep
MLGVFSGEVVEVPAELVAAGSRTPSPKTRASELVKRFLAGADPPCPXELGSLXGNLAYSHANIPPPPKAFPAKDEXFCLFQGSLDXLGRLNXX

SEQ ID NO: 200401 - protein, 120 aa, Triticum aestivum
  unsure (1)..(120): unsure at all Xaa locations
  Clone ID: PAT_TA_94819.pep
LLEGPADALLAKMLTPAPYTVPEKTKKAKGTRKSSRHQASSDSPSDDSMMHSSPEDEEEEEDAPPPTGGDRKRKPPQPGKPEGPRKERSPSGRFNRRRRSEDNGSQGQXQGIXSIXYKLS

SEQ ID NO: 200402 - protein, 47 aa, Triticum aestivum
  Clone ID: PAT_TA_94820.pep
NILPSSGTNGSLPWMTRMKIAVGAAKGLAFLHDADPPVIYRDFKASN

SEQ ID NO: 200403 - protein, 107 aa, Triticum aestivum
  unsure (1)..(107): unsure at all Xaa locations
  Clone ID: PAT_TA_94821.pep
SARPPPAGSPCSGHPRVCCSQIRPRLLPPSRNQVWELCPGDPAPSLPSSPAAPRRPPPTLVHAPASALSPPPAEMSAGPHRASSRXQAPLLLHSIWIWARPALGPSV

SEQ ID NO: 200404 - protein, 54 aa, Triticum aestivum
  Clone ID: PAT_TA_94822.pep
SHSTPLILTSSYELKATGLSKSRLKFTIPGSSNLVIQHEFMIMIHSKHIKHTST

SEQ ID NO: 200405 - protein, 135 aa, Triticum aestivum
  unsure (1)..(135): unsure at all Xaa locations
  Clone ID: PAT_TA_94823.pep
MANPRVFFDMTVGGAPAGRIVMELYKDAVPRTVENFRALCTGEKGVGKSGKPLHYKGSAFHRVIPDFMCQGGDSPRGNGTGGXSIYGEXSPTRIRPQHTKPGSLHGNAGPTQTSHSQLHVPAMGPRWSSSLWTLN

SEQ ID NO: 200406 - protein, 45 aa, Triticum aestivum
  unsure (1)..(45): unsure at all Xaa locations
  Clone ID: PAT_TA_94824.pep
IIHMHKWFIAFCCLVLXVIQEILSNSRTQGESWSFIFFIFEFXQI

SEQ ID NO: 200407 - protein, 104 aa, Triticum aestivum
  unsure (1)..(104): unsure at all Xaa locations
  Clone ID: PAT_TA_94825.pep
MAEQTFIMIKPDGVQRGLIGEVISRFEKKGFYLKGLKLQXNVEKSFAEQHYADXLSSKPFFRWAPLEXILSRPVLPMXWERQDVLSXWTXIIWANKPLAPXPDR

SEQ ID NO: 200408 - protein, 103 aa, Triticum aestivum
  unsure (1)..(103): unsure at all Xaa locations
  Clone ID: PAT_TA_94826.pep
GLXXVKHMCMQSLXFRFGSVYXFRRLVNIIRLLNXSSSLFFFPNRPXQGPYXTSPTCGWINIMYERNYVSAVGWLSLICSHAVARVSEGAFPWLGLWHAGATV

SEQ ID NO: 200409 - protein, 42 aa, Triticum aestivum
  unsure (1)..(42): unsure at all Xaa locations
  Clone ID: PAT_TA_94827.pep
TLFVCIKPWYFSLFVCIKPWXNFQPTKRFELQETTESTLNIS

SEQ ID NO: 200410 - protein, 71 aa, Triticum aestivum
  unsure (1)..(71): unsure at all Xaa locations
  Clone ID: PAT_TA_94828.pep
YSAGDXSLREGEIEAIIITNNXLIVGGLIFINIFTQXYLISXLSSSLVFNLCFKTSDCYLWVASSVDYIFS

SEQ ID NO: 200411 - protein, 67 aa, Triticum aestivum
  unsure (1)..(67): unsure at all Xaa locations
  Clone ID: PAT_TA_94829.pep
YKRVLICQKAGVNLCKKLHKARLNYFKLHNASVIDMLIXSKCHNPSLITXDKTQKLCISWPMGNSYI

SEQ ID NO: 200412 - protein, 151 aa, Triticum aestivum
  unsure (1)..(151): unsure at all Xaa locations
  Clone ID: PAT_TA_94830.pep
DICLRSHDWHIWIERVMPVMLRGFIXEDEWLVLAELGYFFRVLCAKELSPGXLEEMEELAPELICKLEKIFPPGFFNPMQHLILHLPTEARLGGPVQNRWCYPTERMQKKLRQKCKNKRRIEASMAEAFITEEAANFVTAHYEAKNRHLHN

SEQ ID NO: 200413 - protein, 74 aa, Triticum aestivum
  unsure (1)..(74): unsure at all Xaa locations
  Clone ID: PAT_TA_94831.pep
GCPGVXRVVRELGQQRVARAPAPAGGRQLHDRSPTRALRGRGSWTNRGANRSIGGRRGSPPVGAGHVLRRRRRR

SEQ ID NO: 200414 - protein, 129 aa, Triticum aestivum
  unsure (1)..(129): unsure at all Xaa locations
  Clone ID: PAT_TA_94832.pep
MADVDVDTEVAAGAQPKKRTFRKFSYRGVDLDALLDMSTDDLXVQMFPARARRRSKRGSKRKPXGARQEVRKGEKGCSCWXEPEQLRTISGNMIIVPXMIGXLSVLXXXNXKQVXIKPEYWHYLQIFNS

SEQ ID NO: 200415 - protein, 72 aa, Triticum aestivum
  unsure (1)..(72): unsure at all Xaa locations
  Clone ID: PAT_TA_94833.pep
SQQGKXAXAYXNNYVRILXEDVKNLYWVFPXLNAKQEIRGTVYAVIFSYIFKHTSKPVSRLAQVSVSPLLAD

SEQ ID NO: 200416 - protein, 163 aa, Triticum aestivum
  unsure (1)..(163): unsure at all Xaa locations
  Clone ID: PAT_TA_94834.pep
PCGDNCRFSVISKHPRLAFDISSVELXASLSFLSSACTFXAMLFRLCLSRFDMLVVVNLCWLSLTWRMATQELKSDKXIYINTPMCRWRAVDARAPXXRRPPLQLTQRRRQAGGEGGLSGMESTEMIFEGSSRYCLQNPDSNHYHSPKSPSFPYIIKTDHNMA

SEQ ID NO: 200417 - protein, 56 aa, Triticum aestivum
  unsure (1)..(56): unsure at all Xaa locations
  Clone ID: PAT_TA_94835.pep
GKSYASVSKKKALQRAAGPGLWGTLSLGQTMHQQGPLSIIVNMGSIIKIHPXQXGG

SEQ ID NO: 200418 - protein, 57 aa, Triticum aestivum
  unsure (1)..(57): unsure at all Xaa locations
  Clone ID: PAT_TA_94836.pep
XFTPAPPRGDLXACTXAXRPLCQTVTXXETLMVCGCGCXXSVPXXFALRXEXNRXXX

SEQ ID NO: 200419 - protein, 58 aa, Triticum aestivum
  unsure (1)..(58): unsure at all Xaa locations
  Clone ID: PAT_TA_94837.pep
QPQVLLLMNADXXAASXTXVELIVXTYXKQXXLLQCXYTTNXSSXXAQPASXXTCCNH

SEQ ID NO: 200420 - protein, 107 aa, Triticum aestivum
  unsure (1)..(107): unsure at all Xaa locations
  Clone ID: PAT_TA_94838.pep
MKLIAAYLLAYLGGNSSPSAAXVKNILDSVGAEADEEKLXXLSLLKLKRKXINXIDXIWKENFAAFPXXGGAIPLGXSXLXXGGGXKTXAIQXKGGKKVXKKEKSKR

SEQ ID NO: 200421 - protein, 79 aa, Triticum aestivum
  Clone ID: PAT_TA_94839.pep
NVTHPELGVTVQLPIISVKKNPQNQMYTQLGVLTKGTIIEVNVSELGMVTAGGKVVWGRWAQITNNCENDGCVNAVLLI

SEQ ID NO: 200422 - protein, 48 aa, Triticum aestivum
  Clone ID: PAT_TA_94840.pep
IITLLLPLGHISFSTNMHGRSRALDHLRRLEPFSAHVAAAILEGGGPV

SEQ ID NO: 200423 - protein, 138 aa, Triticum aestivum
  unsure (1)..(138): unsure at all Xaa locations
  Clone ID: PAT_TA_94841.pep
EISMANSRXNIRKLVKDGFIIRKPQKIHSRSRARRAHEAXQKGRHSGYGKRRGTXGXARLPTKILWMRRXRVLRRLLRKYRXAKKIRQAHVHDMYLKVKGNNFQRTRRSSWRXIXXFKGXRXKRKXSPINLKRQKQGK

SEQ ID NO: 200424 - protein, 107 aa, Triticum aestivum
  unsure (1)..(107): unsure at all Xaa locations
  Clone ID: PAT_TA_94842.pep
LGQFFRSCSVLLDLWMSDNTPRPLRSGRYVCSSNALIVGLXWELAGFPXXHPRVCFAFHRVLLLLPEXDXXFVFXPSKXLHFXXTFSRFXXGPLVRNXXKVLKEXXX

SEQ ID NO: 200425 - protein, 80 aa, Triticum aestivum
  unsure (1)..(80): unsure at all Xaa locations
  Clone ID: PAT_TA_94843.pep
MSCCGGSCGCGSACKCGNGCGGCNMYPEVEXAAGATLLVAATATHKASXGGMEMAAEDGGCGCTQCKXCAPSCGCSCCSC

SEQ ID NO: 200426 - protein, 69 aa, Triticum aestivum
  unsure (1)..(69): unsure at all Xaa locations
  Clone ID: PAT_TA_94844.pep
VXLRILCIPTXVPSYHSISIQARSRFXLXGEAGTGLNMCPPSPCSPSNPRTHRSGPPYPETAGFDTDTR

SEQ ID NO: 200427 - protein, 78 aa, Triticum aestivum
  unsure (1)..(78): unsure at all Xaa locations
  Clone ID: PAT_TA_94845.pep
ENPSSVMHYVLLCKDEAPKTNTSHNLPLVLSSLLQEFQDVFPDELPQGLPPLXGIERRIDLIPGALLPNKAPYHINPE

SEQ ID NO: 200428 - protein, 101 aa, Triticum aestivum
  unsure (1)..(101): unsure at all Xaa locations
  Clone ID: PAT_TA_94846.pep
GAALKPLRAAQRYCFFPQTXFQRFSCSHFARRYXGNRFCFLFLXWLLRCFSSPGCLLPAHGFSRQFKRLTYLGISGSMLIFNSPKHFVACYALPRLWVPRY

SEQ ID NO: 200429 - protein, 127 aa, Triticum aestivum
  Clone ID: PAT_TA_94847.pep
FTAPIQNFWLPRKYLHPRPLPLTKSHIPPVAAFLSKLKPSLLACSATSSPATLLRTARPRLSRQEIHPDPHPPPSTSHMPRQPTRHLPPKSLTPPPNKRRPKPWCTQYSQGAQGAFGKRRSNCDARR

SEQ ID NO: 200430 - protein, 139 aa, Triticum aestivum
  unsure (1)..(139): unsure at all Xaa locations
  Clone ID: PAT_TA_94848.pep
GLGLGANPKIRYGXKALWKAXPSPLFGDGCRSFPDXCXEXGGRLPFXLKDGPQRSWSLPGALFGXGPCQRSFASWPAPLLTGVVVVPASSTSASSATVASIIALGASAEAPVADGPELLTVVGVLAVYVMEGAERVVGL

SEQ ID NO: 200431 - protein, 108 aa, Triticum aestivum
  Clone ID: PAT_TA_94849.pep
KAHDNLCFPLRRAYLFIFKYLLLGKSNSMHSHFNLNYPLGKHHVDGERSRHILRVKYIDHDLILVGQLSPMINDWGGETLTPTFLLCSDGIHFVLKNSFGVLRIMGNI

SEQ ID NO: 200432 - protein, 108 aa, Triticum aestivum
  unsure (1)..(108): unsure at all Xaa locations
  Clone ID: PAT_TA_94850.pep
MLVYQDKLSGDELLSDSFPYRELENGVLWEVDGHWVVQGAVDVXDIGSQPSAEGGGDDRGFXDQAVKWLTLXXTFRLQXEQPAFDKKHLSLNMKRYIKXLSAKLEGMP

SEQ ID NO: 200433 - protein, 147 aa, Triticum aestivum
  unsure (1)..(147): unsure at all Xaa locations
  Clone ID: PAT_TA_94851.pep
GRLDDQQLPSVLGKFDVSPTYRLRSKRMAVLKTVEKHLDFSADAMDTCDMVGTLKSSCRNTESINASQDISSAHDRRINGHILVXETLTSDFCIHNKXRFNLXSASIQEAVGVXTWKRDXKLYASKLTXPRXCSQNLPREXFWLSTG

SEQ ID NO: 200434 - protein, 56 aa, Triticum aestivum; identical to SEQ ID NO: 134756
  Clone ID: PAT_TA_94852.pep

SEQ ID NO: 200435 - protein, 97 aa, Triticum aestivum
  unsure (1)..(97): unsure at all Xaa locations
  Clone ID: PAT_TA_94853.pep
GFVVTASWVPQVEVLRHSSTGAFVTHCGWNSTXEAVVAGVPMVCWPLVAEQWMNKVYIVXRYEGWVGGEGISAGCPRRCTPRLSRFMHGTRRPKGGG

SEQ ID NO: 200436 - protein, 100 aa, Triticum aestivum
  unsure (1)..(100): unsure at all Xaa locations
  Clone ID: PAT_TA_94854.pep
DXETATXTXVLAPGRAXXRAXIQAAPRHPXTVSLXCHRARTLTXVAAXGXSPSSAVFHGEXFVXGDNIXTDHIIPDXXLTLMPSKPXXXRKXXSFXFEGL

SEQ ID NO: 200437 - protein, 137 aa, Triticum aestivum
  unsure (1)..(137): unsure at all Xaa locations
  Clone ID: PAT_TA_94855.pep
ATXVXVDXXGVXIIXIXNPPXXSLSIXVLLXLXESYXEXLXRKDVKPIVXTXEXXKXSGQFXILSFGNLHXGXKIEQPXDVYISXDILTELLEXPXTTSXXAIDXLYLXXXIXXFNGIHXLXSNPTXQXXXPXXNLR

SEQ ID NO: 200438 - protein, 65 aa, Triticum aestivum
  unsure (1)..(65): unsure at all Xaa locations
  Clone ID: PAT_TA_94856.pep
WGSGXXTICPAVGRRWLILLARYPAPRSFLISFSRTVEAIHLPPAPNPDIFGRPFVGRKDKRLGV

SEQ ID NO: 200439 - protein, 90 aa, Triticum aestivum
  unsure (1)..(90): unsure at all Xaa locations
  Clone ID: PAT_TA_94857.pep
MSCCGGNCGCXTACKCXNGCGGCNMYPXVXAAGXTLLVSXTAXHKGXSGXMXMAAXNGGCXCXQCKCXTSCXCSCCSCILIMHAPRASYL

SEQ ID NO: 200440 - protein, 157 aa, Triticum aestivum
  unsure (1)..(157): unsure at all Xaa locations
  Clone ID: PAT_TA_94858.pep
PGRMXPPWLPETAXATCTATMPSGSSSSLGCEGPIAGDGGLQGMVAMQEFRTDGEAGAAVSMTQWRQVLVLRDIGQPWRGCHGHDLLGARELVARRHDTGAGCRGRAHGHLFLVAVQTPSCFDRPCLFLRTPVSWSPILCFRLISRWFYKGINKRQR

SEQ ID NO: 200441 - protein, 90 aa, Triticum aestivum
  unsure (1)..(90): unsure at all Xaa locations
  Clone ID: PAT_TA_94859.pep
MKGTKLAAILILQAVLVMGVLSHVNADYFPKCCNNCRSFSGVDVCDDAHPKCPKGCSACRVVSXTSPEMWRCADMKSTVDGTCGGPCKKY

SEQ ID NO: 200442 - protein, 100 aa, Triticum aestivum
  unsure (1)..(100): unsure at all Xaa locations
  Clone ID: PAT_TA_94860.pep
SVWXGCIXGLAQXGPCVGENKHSNLISFLPLTRKGNLAELASGTRPISEQSRXEYGVMRFFCKKKIFRRSKDGKANERGTKNQKYNMVRWTDKKRTKLRW

SEQ ID NO: 200443 - protein, 135 aa, Triticum aestivum
  unsure (1)..(135): unsure at all Xaa locations
  Clone ID: PAT_TA_94861.pep
MANPRVFFDMTVGGAPAGRIVMELYKDAVPRTVENFRALCTGEKGVGKSGKPLHYKGSSFHRVIPDFMCQGGDFNKGNGTGGESIYGEXFADEXFVHKHTKPGFSPMGNAGPTQSNSLHVPAIGPNTCPRQVADG

SEQ ID NO: 200444 - protein, 78 aa, Triticum aestivum
  unsure (1)..(78): unsure at all Xaa locations
  Clone ID: PAT_TA_94862.pep
EITFSKRCSHSISHIAPYRAHKGDFGGSSDRSRARHPSKRIANEEXRXSSXRYDXPTCPDIXSTVPSNFHXQEEXTGL

SEQ ID NO: 200445 - protein, 135 aa, Triticum aestivum
  unsure (1)..(135): unsure at all Xaa locations
  Clone ID: PAT_TA_94863.pep
LARPSGLPRLRLLARPHGLPRLRLTRPSAPAYNAAAGSSVCSHGRLGREWVLVSPRRSSTLQRIISGLTYQVNLSKFIFDTYYFIKGTLLWLCIFKYXTSSLLYNGHGARADISARGYXYIYPMNGXQSATXWPV

SEQ ID NO: 200446 - protein, 82 aa, Triticum aestivum
  unsure (1)..(82): unsure at all Xaa locations
  Clone ID: PAT_TA_94864.pep
MSCCGGSCXCGSXCKCGNGCGGCNMYPXVXAXAGAXLLVSXXAXHXXSSXXMDMAAXENGGCXCTQXKCGTNCXCSWLQLLN

SEQ ID NO: 200447 - protein, 87 aa, Triticum aestivum
  unsure (1)..(87): unsure at all Xaa locations
  Clone ID: PAT_TA_94865.pep
VQILQSVIPSILCRSRVKYLTKLNCXQFQLTPSXXLEEANQKKCQSKXNCSXARFGXPXRIXPQXNRIRLRHPXXKFIIXLFXGXKK

SEQ ID NO: 200448 - protein, 136 aa, Triticum aestivum
  unsure (1)..(136): unsure at all Xaa locations
  Clone ID: PAT_TA_94866.pep
VXGXVPXQMVRRFSILSDVVDPLHIWLLRXGTFLERAEVALGQAISCDGRGANSLLCRLLCQSLSLTSRAIKMWISMAASSLVLRDSRPVLGPVRRPKCCRTSRVWPPRGSVSGVADHARATDVEWGTCFTLKKKK

SEQ ID NO: 200449 - protein, 88 aa, Triticum aestivum
  unsure (1)..(88): unsure at all Xaa locations
  Clone ID: PAT_TA_94867.pep
ACPPHHPCRPGFLSASASFFRGFLNFFGAQIHHFPPNTITYLADFISMCEXLLGCQPHWGLFKHILTCRHSVKAIPTDEKMQFKCVGG

SEQ ID NO: 200450 - protein, 65 aa, Triticum aestivum
  unsure (1)..(65): unsure at all Xaa locations
  Clone ID: PAT_TA_94868.pep
IFGFFTVFXLMGWPQLESRLCVHSEIRRNERRIGGPSSRVRSRDLCPERTIVVGLCCRPIESRKK

SEQ ID NO: 200451 - protein, 130 aa, Triticum aestivum
  unsure (1)..(130): unsure at all Xaa locations
  Clone ID: PAT_TA_94869.pep
MARSWLVGXRSRFGGGXRHDGLXILAFEXAXAMSRLVSLHLSLXDAXVTMLRXDXLRAXGXXXLXSTDQXXLLXLXXAXLXXASXGRIDAAXLGAXCSCWTLPAHATLKGARTDARSHAEVRWPKCRTLR

SEQ ID NO: 200452 - protein, 165 aa, Triticum aestivum
  unsure (1)..(165): unsure at all Xaa locations
  Clone ID: PAT_TA_94870.pep
MLVYQDKLSGDELLSDSFPYRELENGVLWEVDGHWVXVKGAVDVDIGSQPSAEGGGXDMRCPNDQAVEXVVDIVDTFXLQXQPAXFDKEAFISQXMKRYIKNSPANXKGMTNFQRRFDLPQIPNNSRTFLLKHHDMAAGVPTQGGTADQSVFQWKKAVTHALFRQ

SEQ ID NO: 200453 - protein, 75 aa, Triticum aestivum
  Clone ID: PAT_TA_94871.pep
ASLILFLFLFFFLPATCEVEFLQLVLSRNTNYLLVFSRKEGIYPRPLHLFMHTSILLKIQVQNKVLSRSMKLKNK

SEQ ID NO: 200454 - protein, 66 aa, Triticum aestivum
  unsure (1)..(66): unsure at all Xaa locations
  Clone ID: PAT_TA_94872.pep
QYRXFFSLTTCIWSSCNASETVAPRCLLSYSLLLPCHSLACCILPCHHVHCIMSSCTFFNSIKLNA

SEQ ID NO: 200455 - protein, 91 aa, Triticum aestivum
  unsure (1)..(91): unsure at all Xaa locations
  Clone ID: PAT_TA_94873.pep
QHNACIALPQPRFHGLGCSHFARRYYGNRFCFLFLXWLLRCFSSPGCLLPAHGFSRQFKRLTYLGISGSMLIFNSPKHFVACYALPRLWVP

SEQ ID NO: 200456 - protein, 106 aa, Triticum aestivum
  unsure (1)..(106): unsure at all Xaa locations
  Clone ID: PAT_TA_94874.pep
EMFVCRRAVEPLSVAVLAFAGVFNXLXXSRAIFHXVVGSXKVSGXYVNXRGAGTXSPXXSIXPXAXFNXDXKPGYQLTLXXPSNXXTRPXSSKXHXGRTPXXNGVG

SEQ ID NO: 200457 - protein, 54 aa, Triticum aestivum
  unsure (1)..(54): unsure at all Xaa locations
  Clone ID: PAT_TA_94875.pep
WSXVXHXSPPTKQXYXVXAXDLSLSXXSEXRKPXTRLXTLGPEPNQNPNRKXRR

SEQ ID NO: 200458 - protein, 150 aa, Triticum aestivum
  unsure (1)..(150): unsure at all Xaa locations
  Clone ID: PAT_TA_94876.pep
MAEQTFIMIKPDGVQRGLIGEVISRFEKKGFYLKGLKLQNVEKSFAEQHYSDLSSKPSSAGLXVEYIVSXPVVXMAGKGKSVVATGTQVHLGATNPWALTRHIRGDFAVRHRQDSSMGTNQFRCQEGXAWWVPEGFKWXTTTQRFMRLVQ

SEQ ID NO: 200459 - protein, 109 aa, Triticum aestivum
  unsure (1)..(109): unsure at all Xaa locations
  Clone ID: PAT_TA_94877.pep
ELSFLVKKSHARIVPLLGHSVKDDEELLVYKYMSKGDLTTALHRKPADAEVGLSSLDWITRLKIAIGXAEALCFLHDECSPPLXVHRDIQASSVLLXDDXFEVCLGKFE

SEQ ID NO: 200460 - protein, 151 aa, Triticum aestivum
  unsure (1)..(151): unsure at all Xaa locations
  Clone ID: PAT_TA_94878.pep
HIXGTXSKQXAIRXCTKXXXKXRPXXLDXVSTSXSASSXVGTLGVQVXISVCXGSWNRHXEAXLKRKKAXQRRSXSQRQHRSPXXXRRGTXAMRLDEAARGGDEVAXRRCRGSGEGDSKRLWHRDGVPXPDRGRRADGRRGRLGGEVRRRR

SEQ ID NO: 200461 - protein, 73 aa, Triticum aestivum
  unsure (1)..(73): unsure at all Xaa locations
  Clone ID: PAT_TA_94879.pep
GTHLRSXRGTGTXRXGQXAXSAXGTGRPXXXVAGVDSRPAAXAAGHFGGLLGRVDLGTATPAAGAAKVEVGVG

SEQ ID NO: 200462 - protein, 119 aa, Triticum aestivum
  unsure (1)..(119): unsure at all Xaa locations
  Clone ID: PAT_TA_94880.pep
MAPTVMASSVTSVAPFXGXKSTAXLPVXRRSNGASLGXVSNXGRIRCMXVWXIXGINKFKXLSYLXLLXXEXLLXSMVXLXXXLQXGXPCLXXIXXGXIFXXXNHLXGXNXXXXWSXWS

SEQ ID NO: 200463 - protein, 88 aa, Triticum aestivum
  unsure (1)..(88): unsure at all Xaa locations
  Clone ID: PAT_TA_94881.pep
XRLPPGLTTGSLVHLQPXSSFXHLKHTCXCPSFADTWAGHGIRSPFTLTAQQINERITDRIDGELSYLDGEPLFLXPLSTSRLPLAIE

SEQ ID NO: 200464 - protein, 88 aa, Triticum aestivum
  unsure (1)..(88): unsure at all Xaa locations
  Clone ID: PAT_TA_94882.pep
LSSHVSIAACRCLXPSPPTPWSPPPPRRLPPTNLPRTRRSXWWSXVGPGXGXPXLDCSTXRXPSRLXXXVCXNRRDGTEDGXXSGDPA

SEQ ID NO: 200465 - protein, 82 aa, Triticum aestivum
  Clone ID: PAT_TA_94883.pep
VWKYFSSAGSTESRESYSVTTRSMVCLELENNATITGVELGRVAEMNLVESRTGGGDESGGNWTGGGYMLQVNSDWRDGSEY

SEQ ID NO: 200466 - protein, 57 aa, Triticum aestivum
  unsure (1)..(57): unsure at all Xaa locations
  Clone ID: PAT_TA_94884.pep
AXXXXPLPXPSPXXRAAERTEGXAGGRASPXYPRXVKPPPXSPGRRAPELDTRREDQ

SEQ ID NO: 200467 - protein, 119 aa, Triticum aestivum
  unsure (1)..(119): unsure at all Xaa locations
  Clone ID: PAT_TA_94885.pep
MATSVTGSPVPSPREVLYAVAAAAIAWCAVRALEWAWWRPRRLDRALRSQGLRGTAYRPVAGDVQLSQRLNKEARSRTMPQGCHDSCRRAMPLLHQGRQGHGKMSFTWXGPVPKVTSQT

SEQ ID NO: 200468 - protein, 111 aa, Triticum aestivum
  unsure (1)..(111): unsure at all Xaa locations
  Clone ID: PAT_TA_94886.pep
AAVVLMMAGREASAALSCGQVDSKLAPCVAYVTGRASSISKECCSGVQGLNGMARSSSDRKIACRCLKXLATSIXSINMGKAPAARQFASVSLPXHISTNCDTVNYSIYNL

SEQ ID NO: 200469 - protein, 73 aa, Triticum aestivum
  unsure (1)..(73): unsure at all Xaa locations
  Clone ID: PAT_TA_94887.pep
KAHPXFQGDVPFLDYPPHTQVGGLIPEXPISHPNLPSQTIHLGICXIWXLLRCMGTAIXHQSLQXEKMSALXC

SEQ ID NO: 200470 - protein, 177 aa, Triticum aestivum
  unsure (1)..(177): unsure at all Xaa locations
  Clone ID: PAT_TA_94888.pep
AFDSISWPFLFEVLRKYGFGDRFREWMAILLSSASTRVMINGVPGPPIWHRRGLRQGDSTSPQLFVLAVDTLGRLMRHALQTGILQQLHPRRAIPAISLYADDVMMFCHATTEEXAAVKGSWDVFRYGSGLPREYPRLGTILQARRYWGAGQSACGFRYYWDPSIAPATEPWRPLNL

SEQ ID NO: 200471 - protein, 62 aa, Triticum aestivum
  Clone ID: PAT_TA_94889.pep
CDNDGAIDQAEHLVLLNVQKWRWPNLSHRANLEILSWSESLEIHVIWFDVSITWMLIVNICA

SEQ ID NO: 200472 - protein, 81 aa, Triticum aestivum
  unsure (1)..(81): unsure at all Xaa locations
  Clone ID: PAT_TA_94890.pep
TVGAARAVRVPPPRGAPVRRLXSPPAXPRSPPPARRTSSPSPAPPPRPTPSPAPAAGTSRHQRTPWAWRTTCSSLQRMVAN

SEQ ID NO: 200473 - protein, 96 aa, Triticum aestivum
  unsure (1)..(96): unsure at all Xaa locations
  Clone ID: PAT_TA_94891.pep
LLVSNKETGLEKLTLERCPPLELKHXLRLTNLMTLIVKHSDGLVGSQGGGXGDVEWKLPVEYIKINDLHGNTGEELTXSSXTSQTLXIGKYLSVKT

SEQ ID NO: 200474 - protein, 66 aa, Triticum aestivum
  Clone ID: PAT_TA_94892.pep
PSSFRFRRRLGGKAVLAAEGGPSPRHGGVAPSSQGMGEMWSGGGGGKGSHCMEAAILRRRRSRGVI

SEQ ID NO: 200475 - protein, 126 aa, Triticum aestivum
  Clone ID: PAT_TA_94893.pep
MERRHPQIAPSPPVSRRKAAAAASQEWLVVPAAGERRAGEFGRHRIMEMTGLPARDSACSTVLAYLNISAATHIVINSTLKALSPPPKVVRDPTALRPSQESSPLASRGTSGTGTELHSDSESRLH

SEQ ID NO: 200476 - protein, 78 aa, Triticum aestivum
  unsure (1)..(78): unsure at all Xaa locations
  Clone ID: PAT_TA_94894.pep
LSXXAQPLLVVWWLPSSAMAPAAAPPRPFCLLLFIGVLSRVAVGVSLSRRREVVDWVEAGAGVGVGVGVGMDLIEEGG

SEQ ID NO: 200477 - protein, 114 aa, Triticum aestivum
  Clone ID: PAT_TA_94895.pep
VVVVTPLATCNASLASVTGTLTAPVQLLGIDTGSGNGSGSGSGGLGGLGGLIGPHRPVRGRLLGGILNIIPLPFSVRLDASNYRRVRLKKHDGPKINKYVPILSTYQTATVPAL

SEQ ID NO: 200478 - protein, 89 aa, Triticum aestivum
  unsure (1)..(89): unsure at all Xaa locations
  Clone ID: PAT_TA_94896.pep
PDVVVNXHVTPVHXTCAAAEXTGQGKESECWTYPLKRPRRRERCTCLKTARYHSXRSQHRRGLSFTGTRHRGAATTGLWSSNANIDPIL

SEQ ID NO: 200479 - protein, 131 aa, Triticum aestivum
  unsure (1)..(131): unsure at all Xaa locations
  Clone ID: PAT_TA_94897.pep
MAGEKGLVLLDFWVSPFGQRVRIALAEKGLPYEYAEEDLMAGKSDRLLRANPVHKKIPVLLHDGRPVNXSLIILQYWRTLPGPPELLPPTLXARAQGRFWAXTXTXRSXDCGPPLELXGNXRAXPPQILES

SEQ ID NO: 200480 - protein, 146 aa, Triticum aestivum
  unsure (1)..(146): unsure at all Xaa locations
  Clone ID: PAT_TA_94898.pep
SPVQXXPQKSSSVPRCLLRPLGRHRGPITSPWTEREMVRXVVVVSGGAEELRKILPRHRPKANKQRAERIPDTNTDPQRRGSTIGTMAQGGGGREERRWTGXLGATRGHRGGGRDAGDGDTAEGGGRATAHGGFGGARDGGRSQRR

SEQ ID NO: 200481 - protein, 102 aa, Triticum aestivum
  unsure (1)..(102): unsure at all Xaa locations
  Clone ID: PAT_TA_94899.pep
MAEEKHHHHLFHHKEGEDFQPAADGGVDTYGYSTETVVTATGNEGEYERLXKEEKHHKHKXTPRIGAAAAGPSPSXXXHKAKEGPGXXHKFRRVPPKLGPGV

SEQ ID NO: 200482 - protein, 70 aa, Triticum aestivum
  unsure (1)..(70): unsure at all Xaa locations
  Clone ID: PAT_TA_94900.pep
GGVNGWXQXWQFLKKMXFLGKXPICMAXIQXXGFNXFXLXXEXXFSPGIXVGQKKTPDFSGVKLARSCLV

SEQ ID NO: 200483 - protein, 83 aa, Triticum aestivum
  unsure (1)..(83): unsure at all Xaa locations
  Clone ID: PAT_TA_94901.pep
IFRGIKFLIGNCXNHNHGFDNTPQKDYSIXSRRWETLWIKXRXXXDIIXXRPWNXXXQAGKLSLXCXLGPRPXVXEKXGKFXG

SEQ ID NO: 200484 - protein, 146 aa, Triticum aestivum
  unsure (1)..(146): unsure at all Xaa locations
  Clone ID: PAT_TA_94902.pep
MANPRVFFDMTVGGAPAGRIVMELYKDAVPRTVENFRALCTGEKGVGKSGKPLHYKGSAFHRVXPDFMCQGGDFTRGNGTGRRSIYGENSRQXFVHXTQPDLSWQPGPTQRPFSSDLPCNWSTHLSSQSRMTLKNQKLTDCQVYPN

SEQ ID NO: 200485 - protein, 135 aa, Triticum aestivum
  unsure (1)..(135): unsure at all Xaa locations
  Clone ID: PAT_TA_94903.pep
DCVIKLGMVVTFGPTCLTXVKSVEMHHGLSLEALPXGDNVGFNVKNVAVKDLKRGFVASNSXKDDPAXKEAANFTSQVIIMNHPGQIGNGYAPVLDCHTSHIAVKFAELVTKIDRRSGKELEALPKFLKNGDAGI

SEQ ID NO: 200486 - protein, 135 aa, Triticum aestivum
  unsure (1)..(135): unsure at all Xaa locations
  Clone ID: PAT_TA_94904.pep
MANPRVFFDMTVGGAPAGRIVMELYKDAVPRTVENFRALCTGEKGVGKSGKPLHYKGNAFHRVXPDFMXQGGDXTRGNGTGGXSIYXEXFXDENSSNKHTXPGSLNGNXGPTQRPILNLTLHPTEHLLREVSRML

SEQ ID NO: 200487 - protein, 80 aa, Triticum aestivum
  Clone ID: PAT_TA_94905.pep
RSVFFFQRLCCSLGLISSWQELELAEGFDAQACLVHSNLVSCSVVSCIFVVLFFVFCSFDCTLDVCLVVALYIKRGESLF

SEQ ID NO: 200488 - protein, 95 aa, Triticum aestivum
  unsure (1)..(95): unsure at all Xaa locations
  Clone ID: PAT_TA_94906.pep
AXSXGLLLYGAASVKXSXLLELTXGTLRXKGHAIYPTPLRLRXRXXSSSFVFGILSAYXXVSXXXVTLXXAPXAXLXGXMAAHYLXSPQPTTPRT

SEQ ID NO: 200489 - protein, 68 aa, Triticum aestivum
  unsure (1)..(68): unsure at all Xaa locations
  Clone ID: PAT_TA_94907.pep
LGQPXWITXXVXXSKXXLXGXFGAXDALVXGLTXEEVRRAVXFHPSXLGXHLHLLKVGVXAIDRLGHS

SEQ ID NO: 200490 - protein, 75 aa, Triticum aestivum
  unsure (1)..(75): unsure at all Xaa locations
  Clone ID: PAT_TA_94908.pep
MADRANHPSVMQKFGGQFHLASSFSEGVXVLRNICPSVPSYERRFTTSCYMTQELGIKCPHDVIFSIGLPKRGKK

SEQ ID NO: 200491 - protein, 90 aa, Triticum aestivum
  unsure (1)..(90): unsure at all Xaa locations
  Clone ID: PAT_TA_94909.pep
NKTIXVKCHIPVHXRXXQFHSTNXRSXQTSGQXXINCVSLRHLLSCLWLHVFCKWPVPQLPSIKEKNITKCYXSYXXNSNKKFIPTRNAI

SEQ ID NO: 200492 - protein, 122 aa, Triticum aestivum
  unsure (1)..(122): unsure at all Xaa locations
  Clone ID: PAT_TA_94910.pep
MPAGHGLRSRTRDLFARPFRKKGYIPLTTYLRTYKVGEHVDVKVNGAVHXGMPHKFYHGRTGRVCNVTKRAIXVXXNKHVGNRXIKXRXHVRXXHXQPXSXXRSSPKETXNDNXXRSKLKSL

SEQ ID NO: 200493 - protein, 133 aa, Triticum aestivum
  unsure (1)..(133): unsure at all Xaa locations
  Clone ID: PAT_TA_94911.pep
RXVLTAAAQNRDLGFNPRCRGRRRREVNXNVPSRKGXXPEAPPXECRRRRPKGLPRIQTFPTXNPTQPTAGSGRIPPDPDEEDADASDRVPSSDLAQQVAGVLPPDAQVHRRLATHAAEGRRTHLQRTPPTAG

SEQ ID NO: 200494 - protein, 141 aa, Triticum aestivum
  unsure (1)..(141): unsure at all Xaa locations
  Clone ID: PAT_TA_94912.pep
PPPPPPPGEATHQLGFSAGLAGGWGAMSTPADGAAYWLRWQVFVCGALIAVPTALAAALLPRLRRSVAPLRATDLWLPCWPRLHPGCLLGYRAFALAAAAALLVRDIXPNGXKVFFFLNQWTFLXHIYFAVETAIXXHGCW

SEQ ID NO: 200495 - protein, 160 aa, Triticum aestivum
  unsure (1)..(160): unsure at all Xaa locations
  Clone ID: PAT_TA_94913.pep
EVSTSKTGKHGHAKCHFVAIDIFNGKKLEDIVPSSHNCDVPHVDRQDYQLIDITDDGYVSFXLESGNTKDDLNFPLDDFCLGRXKTGFADGKDXILSVMSAMGEKQFCAVXXIWWEINNLRLPTCHTWYQMLPGVYTIKYRWGENLKVFTNAKGGRYQIL

SEQ ID NO: 200496 - protein, 153 aa, Triticum aestivum
  unsure (1)..(153): unsure at all Xaa locations
  Clone ID: PAT_TA_94914.pep
MATETETFAFQAEINQLLSLIINTFYSNKEIFLRELISNSSDALXDKIRFEXSLTDKSKSMRSRVFIHIIPRQGDQHVTXVHSGXGMTNPGSVKTXDIARSGDKXSWRXPAGADVXMIGIRVGSIRLLXPKGXLTTXXTTQHXFGSQAXGLNV

SEQ ID NO: 200497 - protein, 89 aa, Triticum aestivum
  unsure (1)..(89): unsure at all Xaa locations
  Clone ID: PAT_TA_94915.pep
GDFRGVNDXXXLXSEVXQAMXLLSSTPIDEXEXSFHXPXXRSAXXPRKGQMKXLCLCGQXLELPKEMXYSVLIFGPKMQAIEVGRXLLK

SEQ ID NO: 200498 - protein, 175 aa, Triticum aestivum
  unsure (1)..(175): unsure at all Xaa locations
  Clone ID: PAT_TA_94916.pep
SRVSFFPFSNSSSGKGEAAKMPDSSSRRRAVEHQARLFEVSSWLQLKRHRSYMALFPRCIAASAVIAAHCIRRPSVCCIGVHPKLQGSTIWGIEXPPRCNGLHALRXTPPWRNGLQRNYNGPSGXSAXVQWTSHNYNGPXRAVRRPPGAMNSPGXSXRVLLLGWAAYMXXDXXFX

SEQ ID NO: 200499 - protein, 147 aa, Triticum aestivum
  Clone ID: PAT_TA_94917.pep
FIDRTLVRARDPPTPSYPHIEYQPAPAMLSSVPQALSGKPTPPPTAVDIFKLTRSELGCLRSQLPTGEGAPRFSTYAVLAAHVWRCVSIARNLAPEQPTKLYCATDGRQRLQPPLPEGYFGNVIFTATRSPRQQGDRLAEGQRSSER

SEQ ID NO: 200500 - protein, 64 aa, Triticum aestivum
  unsure (1)..(64): unsure at all Xaa locations
  Clone ID: PAT_TA_94918.pep
AAAAPPTPPSPHPPSPPPLHLWPPPSPPPPQIXLRHCLXLTRPPQXPPXLNXLPXAPPFGRRPN

SEQ ID NO: 200501 - protein, 38 aa, Triticum aestivum
  Clone ID: PAT_TA_94919.pep
HIRTKDMLADPLTKGLPSNVFKEHLAGMGLRKSLMISG

SEQ ID NO: 200502 - protein, 99 aa, Triticum aestivum
  unsure (1)..(99): unsure at all Xaa locations
  Clone ID: PAT_TA_94920.pep
GLSCYPAVSFXTMSLSPMSHWRTLTLVIFGSYLVFRVCXDLVPLAQPAPKQCFTLRCPVNCCASTHFGENQLALGSSGISPLTTTHPLILQHQSVRTSA

SEQ ID NO: 200503 - protein, 133 aa, Triticum aestivum
  unsure (1)..(133): unsure at all Xaa locations
  Clone ID: PAT_TA_94921.pep
PSLLRPSVPTRGSTGILTCCPSTTPFGLILGPDSPSVDEPCGGNLGFSGHWILTNVFVTQADILASASSTPLSRLLPLRRNAPLPMHFDIHSFXDCLAPLXSPKGAXLVSYTIXKGAAQETPGVLHPLLTRRH

SEQ ID NO: 200504 - protein, 141 aa, Triticum aestivum
  Clone ID: PAT_TA_94922.pep
WTVKQSVVGHIPCEIGHMKHLVALKLSSNNLSSKIPNSIGGLTKLTSLYLYGNQLYGQIPRELGYLLNLEDLQLGTNTLSGSIPRNLRNLTKLAVLSLWGNELSGLIPQELDYLGSLQYLDLSENILSSSIPNSLGNLTKL

SEQ ID NO: 200505 - protein, 180 aa, Triticum aestivum
  Clone ID: PAT_TA_94923.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINKWRSQEGVPDRTSAYRITTSPSECVSSCKHRLKIRKAKHSHGTYNALNL

SEQ ID NO: 200506 - protein, 192 aa, Triticum aestivum
  unsure (1)..(192): unsure at all Xaa locations
  Clone ID: PAT_TA_94924.pep
XQIPFLXWRTXSAEXYIXFENXIMAEYRHLXSXPXRRFXHHLSPWECNSLLXFEQKCSHSKXVPXLPSGRDXRREXIKVVTNNAASKSIYGYFLTAAKSRPSSRGHSIWVPVGGHVLLLCLDGRSHIVRRERVRRALTRKAATGWRGRRPSAQHGGYEPPRPDPARPSTPSLVDQDGLRIGSGWRLGLLVDF

SEQ ID NO: 200507 - protein, 34 aa, Triticum aestivum
  Clone ID: PAT_TA_94925.pep
RNLVSLLGYCDEEDEQMLVYEYMPNGTLRDHLSG

SEQ ID NO: 200508 - protein, 54 aa, Triticum aestivum
  unsure (1)..(54): unsure at all Xaa locations
  Clone ID: PAT_TA_94926.pep
ENXSXLFFFFFFFFFFSKQXIVKGPXLXXKGMVHHYINQYPXXELHIKTXCRIR

SEQ ID NO: 200509 - protein, 100 aa, Triticum aestivum
  unsure (1)..(100): unsure at all Xaa locations
  Clone ID: PAT_TA_94927.pep
FFESPNNCLRVCSEFXCCPHRSVQPTMXDPRAAXWCSKXTXIYXYDNSHASXWKCDNKIFPSVQVDXTLRKTPCMRSCHRLPFWNEPLQRVLYRHAADIP

SEQ ID NO: 200510 - protein, 39 aa, Triticum aestivum
  Clone ID: PAT_TA_94928.pep
LQPTVQHHKIGDTSVTVRHLKTLILHNSTLISPLSRGRT

SEQ ID NO: 200511 - protein, 148 aa, Triticum aestivum
  unsure (1)..(148): unsure at all Xaa locations
  Clone ID: PAT_TA_94929.pep
CAVLDLPATGVGRIQDGSTKGVYRISNAKNXLFVLXCKTTGYFASQPDQGSGESTSYAQFTGCLCYCNNSQSAVNGACSGVGCCHVDIPPDLTDNWVAFMSYDHTDKVNFSPCDYAFVAEKKHYTFNTTDLKRALRQNTWGWEMPVVL

SEQ ID NO: 200512 - protein, 120 aa, Triticum aestivum
  unsure (1)..(120): unsure at all Xaa locations
  Clone ID: PAT_TA_94930.pep
MSASPSMSGGAGERTRTRTVVWFXRDLRVEDNPALAAAARTAGEVVPAYVWAPEEDGPYYXGRVSRGGQPEPQALDASLRRSAQPAQPAVNDTSAVELVARNHSNTQRLAGQRNNLGGYS

SEQ ID NO: 200513 - protein, 94 aa, Triticum aestivum
  Clone ID: PAT_TA_94931.pep
HQRTIITYSRRIFRISEQQATPNFSRERKHSDEDTAYWYTYLLATHTRIGTMTLLISSELLFHFRRNISCWHEPISTSCSTWGNSRRSRVRGLP

SEQ ID NO: 200514 - protein, 141 aa, Triticum aestivum
  unsure (1)..(141): unsure at all Xaa locations
  Clone ID: PAT_TA_94932.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTXQADCAVLINDSTXGGFXAGTPRMADRDKLSLHPG

SEQ ID NO: 200515 - protein, 78 aa, Triticum aestivum
  Clone ID: PAT_TA_94933.pep
LQLFTVARTTKRNGAPSREGERERERERERELGWAVYPSKKPCTVVSKVSVVYIYPAPAEAICRHEQNSPELKQFSRH

SEQ ID NO: 200516 - protein, 139 aa, Triticum aestivum
  unsure (1)..(139): unsure at all Xaa locations
  Clone ID: PAT_TA_94934.pep
ALRXQILFLHRFSTLYRNHVLFIIHPVRRLFFRSPSXYSPQIPHLFLNAATVSFPSAEXANSTFLYPTGFKILVGXFPFSFSLAVRLQKMVVISGLQLAFDIFSKVGDGAGLVQSGRKRWSRGKGGLQCGAAEAPAWCS

SEQ ID NO: 200517 - protein, 89 aa, Triticum aestivum
  unsure (1)..(89): unsure at all Xaa locations
  Clone ID: PAT_TA_94935.pep
MCGCPESPQHRDLFRSGQQFALRSTHASVCFGDAEFMEQWNESGNSAATQAPANETRXFWQXHRFLNFLLACMVFAFVISWLFHFNVPG

SEQ ID NO: 200518 - protein, 199 aa, Triticum aestivum
  unsure (1)..(199): unsure at all Xaa locations
  Clone ID: PAT_TA_94936.pep
RREECEIRESRTLYAGCRVGNTSEFTTELVRFSSNCRFIDSESGRRTGPSRDPNTSPDHSIVRSDGRCVQRAGTXSTRADDSRLLGIPRXRPTIAMIYPHHDEISQDYPGLSAKAIYSLNTSVXARVRPRTSKGXHRPVIASNFRRLNGDSPSKKLAAEGWLRIASXQAEVSFVNGINQTNRSTNXERPCTTTHRIKKE

SEQ ID NO: 200519 - protein, 157 aa, Triticum aestivum
  unsure (1)..(157): unsure at all Xaa locations
  Clone ID: PAT_TA_94937.pep
MQIFVKTLTGKTITLEVESSDTINNVKAKIQDKEGIPPDQQRLIFAGKQLEDGRTLADYNIQKESTLHLVLRLRGGMQIFVKTLTGKTITLEVESSDTIDNVKAKIQDKEGIPPXDQQRLIFAGKQLEDXRTLADYNIKKESTSTGAKLRGXSLVKT

SEQ ID NO: 200520 - protein, 130 aa, Triticum aestivum
  Clone ID: PAT_TA_94938.pep
MAPAEEVKRIVGPILFTLRSSPDATYVMLGNILVFAKTAPLLFASYYEDFFICASDPYQTRALKLEILTTIATESSIPAILEELQDYIKDPNRRFVADTVAAIALCALKLPSITSSCPEGLWHLYCTNCH

SEQ ID NO: 200521 - protein, 78 aa, Triticum aestivum; identical to SEQ ID NO: 106977
  Clone ID: PAT_TA_94939.pep

SEQ ID NO: 200522 - protein, 137 aa, Triticum aestivum
  unsure (1)..(137): unsure at all Xaa locations
  Clone ID: PAT_TA_94940.pep
MAPKAEKKPAAAEKTPAAEKTTAGKKPKAEKRPPKSKEGGADKKKKKAKKSVETYKIYIFKVLKQVHPDIXGISSKAMSIMNSFINDIFXKSPGESAKXGRYNKKPTSLQGXQTPSARLXGESPRSLSXGTRRHNIP

SEQ ID NO: 200523 - protein, 109 aa, Triticum aestivum
  unsure (1)..(109): unsure at all Xaa locations
  Clone ID: PAT_TA_94941.pep
PPPPXGRGQITACPGMRLLLLGVEINGPAGAVDLVPNFFLDLLVVYPGGRGSIPRLAITVPVPAPRNSDSRFTNSSSLTARRPAPSPLPPSGTRRSMSESTYGRRPPPS

SEQ ID NO: 200524 - protein, 146 aa, Triticum aestivum
  Clone ID: PAT_TA_94942.pep
ATKKPSTDFTPSKGSQGSVSNSSNATRVGSACETEGKWNCIDEKSYQQCASGTWSVVMPLAAGTMCEKGVSDAIKVNAIKRATLDFPHLTYGVILGGSEKLWITLAGHDVIKFMRILGELQRNGFSYVTFPGHIKIMACNIDWLGV

SEQ ID NO: 200525 - protein, 68 aa, Triticum aestivum
  Clone ID: PAT_TA_94943.pep
GNYNVVFEHFYLHLILGNLRGQNRVFISPCLAAGSGIGNEDSPAAAFLASSRITLQAACMWLFNVMME

SEQ ID NO: 200526 - protein, 61 aa, Triticum aestivum
  unsure (1)..(61): unsure at all Xaa locations
  Clone ID: PAT_TA_94944.pep
MLCFVXGLKVLLTKLCGIALYILGSSXGSPKISETQXWHMAIRYGGSVLGLVPPSSRCFQP

SEQ ID NO: 200527 - protein, 87 aa, Triticum aestivum
  unsure (1)..(87): unsure at all Xaa locations
  Clone ID: PAT_TA_94945.pep
MSCNCGSGCSCGSDCKCGKMYPDLTEQGSAAAQVAAVXSVLGVAPENKAGQFEVAAGXSGEGCSCGDNCKCNPATVKLHAPYYVCWC

SEQ ID NO: 200528 - protein, 84 aa, Triticum aestivum
  unsure (1)..(84): unsure at all Xaa locations
  Clone ID: PAT_TA_94946.pep
SDLSFGLLTAHALHGPIPAQFLFRPAKGPQHSWGHLQYDLTFGLLSSPCSSWSSTTRCLFRPAKGLQYSWAYXPNLSNXLLXAX

SEQ ID NO: 200529 - protein, 80 aa, Triticum aestivum
  unsure (1)..(80): unsure at all Xaa locations
  Clone ID: PAT_TA_94947.pep
IPSCGSVAFQSCFEQSVKESNLGCRKLTWTGIDXYQLMXLEVEPGLHLTXVSNIGVLFLLGHLFWIPRIIPLPTXSAVVF

SEQ ID NO: 200530 - protein, 175 aa, Triticum aestivum
  unsure (1)..(175): unsure at all Xaa locations
  Clone ID: PAT_TA_94948.pep
IHRHVHIYTSRIRVEEADPTSGERRGIRRLNRPSGSPPQQTLGTKRSAATRAARSPRAPARQTGCSWESAMRHMTRRSRRAPLPPPXGGGRGRXGPMIPNLGQXRTPKHGPPAAAAGRSRHCRVEXASPSSPPRRNXLXRRCXPAATVAKPSXXRADGXVRXSAXAXKPLAAGKP

SEQ ID NO: 200531 - protein, 107 aa, Triticum aestivum
  unsure (1)..(107): unsure at all Xaa locations
  Clone ID: PAT_TA_94949.pep
MGATSSGXLILXXPASXGSKVXVVTINXPXALNTLTXXMMISLXSAFRRLDADDGLTXWVLAGRGRSICAWVDLXAXEDVFKGELQGTTAXPLXKLSLPEAILYGLT

SEQ ID NO: 200532 - protein, 143 aa, Triticum aestivum
  unsure (1)..(143): unsure at all Xaa locations
  Clone ID: PAT_TA_94950.pep
CYPSISSRSYPELIRSSTRIGTLTXKAXLQRRPXELHHXRPLAIKTSLPNLXDFNPERXXDPDKTRTEMAKLKKEHKREKKGAIRELRKDAKILAHESLREKKEKDAAYEKKYKRLIAEIQGEEGKEANAYEREKQWRRKGKK

SEQ ID NO: 200533 - protein, 121 aa, Triticum aestivum
  unsure (1)..(121): unsure at all Xaa locations
  Clone ID: PAT_TA_94951.pep
WVLLXMWVLSHLVGRXEGXGIPRTETLVLAFTGWLQEHYRIGVAMSLEGLDFVTSSMPTLFLLYVFVKGFKSSMVRVLVMGVPVLVVTWYFLTLYKPCGPDTLNITTTLMSMLPRPSIFTE

SEQ ID NO: 200534 - protein, 63 aa, Triticum aestivum
  Clone ID: PAT_TA_94952.pep
TYHGSGGQFSSTIRIIVTTDGRTTASVHRLGCTCVHTFIKISAHACGERLAGTLPFLKKYKSI

SEQ ID NO: 200535 - protein, 104 aa, Triticum aestivum
  Clone ID: PAT_TA_94953.pep
MDRWRGSALRKPPPAIDARRAEAERGGGETGEGREEPVSPTGRLFREPHFSCYIVSVFGLGARVDLAAVRVGLEATLARHPRFCSVQVMDELEEDATPSGSGPR

SEQ ID NO: 200536 - protein, 95 aa, Triticum aestivum
  unsure (1)..(95): unsure at all Xaa locations
  Clone ID: PAT_TA_94954.pep
HHHGTLLFKNNAPYQPVLGVTLQRLKEIPLNPXPNVLXIQKXRLXRRKHTHEQPWXPPSLGXTYQTLDRAPGVSXPXTXQAXNPYHFVVAXFIVH

SEQ ID NO: 200537 - protein, 66 aa, Triticum aestivum
  unsure (1)..(66): unsure at all Xaa locations
  Clone ID: PAT_TA_94955.pep
LPXXAPRMRDLERQLPGRWDWDGLAFRRCAAARLLRASVSSKRGRGGEGKVSRAGGRQRPRDKNHQ

SEQ ID NO: 200538 - protein, 99 aa, Triticum aestivum
  Clone ID: PAT_TA_94956.pep
NKFILVITEEALSLHVALLSSMKIPVYARMEVVENWFALLLAQRPSSLRTMLSIEGLLFRSMRTQSRQFQCIPLLPGRHLHQLEYLDACVLCPILRTLQ

SEQ ID NO: 200539 - protein, 90 aa, Triticum aestivum
  unsure (1)..(90): unsure at all Xaa locations
  Clone ID: PAT_TA_94957.pep
FDLGLGCCQEEEDXXPSHINXRRXSPGGPAPXRRPPAAGELTERNXSEXASTPCSFXNRHHXTXXDTXQSRTERXXXETNTAHWRPPXIV

SEQ ID NO: 200540 - protein, 81 aa, Triticum aestivum
  unsure (1)..(81): unsure at all Xaa locations
  Clone ID: PAT_TA_94958.pep
AVWDXVXNXDSFXVDEAAMENLFPQNSATXXAGNSGQAAARGGQHSRLLDPKRLQNVAIMLKALNVTADEVIGAXVHGNLE

SEQ ID NO: 200541 - protein, 169 aa, Triticum aestivum
  unsure (1)..(169): unsure at all Xaa locations
  Clone ID: PAT_TA_94959.pep
DGIWPSGRNRRLFEYDGQQHRLRPRLPRFVGRRGSLVFDLHGYYSSASGDLCMVGSGSGRAADGRPVALLAAVLRLRFPRXANLSSPFVTGRLESTGPGPGVAFEPVSLLAYAEEGYAYAESASCLARPPTVATPLEEQPLRARGKAYGTGSALGIQTCRKRLSPAKLH

SEQ ID NO: 200542 - protein, 151 aa, Triticum aestivum
  unsure (1)..(151): unsure at all Xaa locations
  Clone ID: PAT_TA_94960.pep
CPPPPLLLAAPLHSCPRRRTSSIQRLASHVGKLLLAAPRRGRRRGPGRDDGAGGQGGFRVGRAGRRRLHGAAVVSAADASSGXLLLRQRELIXSSSXXFPTAXIXKPKNNKXXKXPGNVLSTTNCRRGLCXTDKXSGAXTRXIXPARFSRA

SEQ ID NO: 200543 - protein, 106 aa, Triticum aestivum
  Clone ID: PAT_TA_94961.pep
GRPWRGRTAAGWATLLLPAERRAAREELMSSRCPRLTLRSMLRLRVLPHRPLLSCLPLFLAPAVALFLGLVAVHGRRRDVLLGLAVSLFLRSDGVGLSRRWRWRRR

SEQ ID NO: 200544 - protein, 77 aa, Triticum aestivum
  unsure (1)..(77): unsure at all Xaa locations
  Clone ID: PAT_TA_94962.pep
LEFFFFFFSEFGQIAAADDQCDRIFLHSFNSIIIKKAYTIHGLQSRGAKNPTAQWRSCEPFPWGNGMDSXPRGGPGT

SEQ ID NO: 200545 - protein, 138 aa, Triticum aestivum
  unsure (1)..(138): unsure at all Xaa locations
  Clone ID: PAT_TA_94963.pep
MAASMITSPIVAPTSVPSLSRRGSSFAVVCSGGKKIKVDKPLGLGGGLTVDIXDANGRKVGKEGRVPFXVDKYGANVXDGYSPIYTPXEWSESGDRYARRDDRLLIWXLXPVPRGGSSSKKTKFSPGKKLLKKGGPAS

SEQ ID NO: 200546 - protein, 170 aa, Triticum aestivum
  unsure (1)..(170): unsure at all Xaa locations
  Clone ID: PAT_TA_94964.pep
RIXRXALSGIEKAFVXVVXQXRRRSCRAFPESIMXPRWXWFXELLEANGALEEALEERPAGVXGRCTQSPLPSRGRRGTPRRLNSATAASXQPPPRRPHRHPEPGALPRALSRRRRQRRPAPFPADGPPVETMKNVWASGGGRRGRRADMRAGQRRQDVHAGDGVRGRHR

SEQ ID NO: 200547 - protein, 80 aa, Triticum aestivum
  Clone ID: PAT_TA_94965.pep
PLEPRASWFSPKCVEAQQLTGHLGVKHCFGAGCASGTKSRQTLNTRYDPKITGVKVGQLRRWGISFIRPRGKQPDHQLRP

SEQ ID NO: 200548 - protein, 55 aa, Triticum aestivum
  unsure (1)..(55): unsure at all Xaa locations
  Clone ID: PAT_TA_94966.pep
AWXEAAXXVPXRHRRVHPQXVXLVMVLVXHGXXYPHRDAQERRGGSSETRRVVPP

SEQ ID NO: 200549 - protein, 61 aa, Triticum aestivum
  Clone ID: PAT_TA_94967.pep
KEERSKMPPKKAAASKADVAKKQKVVEDKTFGLKNKNKSKNVQKYVQSAAPVRPAQARPRP

SEQ ID NO: 200550 - protein, 80 aa, Triticum aestivum
  unsure (1)..(80): unsure at all Xaa locations
  Clone ID: PAT_TA_94968.pep
QNKSSXLSSHSFXARFICGVXDGRPDSGVAGGGGDGXPXQGGLRPXCPPCXASRGSGXRXSSRRHYXRLRRAERAGXPVL

SEQ ID NO: 200551 - protein, 87 aa, Triticum aestivum
  unsure (1)..(87): unsure at all Xaa locations
  Clone ID: PAT_TA_94969.pep
MADVXYRCFVGGLAWATDDQSLQNAFSKYGDVIDSXIITDREXGRSRGFGFXTFAXDXXMRXXIXXMNXQXLXDGRNITVNDXXSRR

SEQ ID NO: 200552 - protein, 107 aa, Triticum aestivum
  Clone ID: PAT_TA_94970.pep
STVTRGLPISKVVYSFLNDTLSASFHYPKWNKGRVICLKSQLKKLQAAIDSSNGAAVPGFVHMTDSRLPSPGSKVYTREPQVENGSAHAHSTAESLGRRRRKGGLLL

SEQ ID NO: 200553 - protein, 197 aa, Triticum aestivum
  unsure (1)..(197): unsure at all Xaa locations
  Clone ID: PAT_TA_94971.pep
MLVYQDKLSGDELLSDSFPYRELENGVLWEVDGHWVVQGAVDVDIGANPSAEGGGDDEGVDDQAVKVVDIVDTFRLQXEQPAFDKKQFISHMKRYIKNXTAKLEGDDLDVFKXKNVESATKYLLXKLKDLXFXVGESXHDDGGXCSLLXEELLINFPLPWLQCGMNLGHNLPAQVCIWAYTSNQRNGILEGNWWLGY

SEQ ID NO: 200554 - protein, 112 aa, Triticum aestivum
  unsure (1)..(112): unsure at all Xaa locations
  Clone ID: PAT_TA_94972.pep
NDLGFARLPAGHGLPAGAGDGDGRELGRAGFERACRLPNTVHSEIAAALPLXPTLPATLGTDLHDHDEPLAEPDRPDMIMQAAAIARILASTDISHLGFTEADHVAVDPSEC

SEQ ID NO: 200555 - protein, 106 aa, Triticum aestivum
  unsure (1)..(106): unsure at all Xaa locations
  Clone ID: PAT_TA_94973.pep
MAAMKITLLAVAAMAVLLGSASAVTYNVGDQGGWALSTDYSNWVSGKKYSTPTHDVVEVSKAGYDSCSTDGAINTLTXGNDVISSTPPAPLLICGVLTLQPAAAAT

SEQ ID NO: 200556 - protein, 123 aa, Triticum aestivum
  unsure (1)..(123): unsure at all Xaa locations
  Clone ID: PAT_TA_94974.pep
SGLRTRSAVRRLTYSPSPRLISAASGTACRPPALASRAPGVLHPRLPPQPKKLQDGVSIQGEGDSVEVLHTQRRREHTSLRXPGTASKKDMGVXKFVRXVTFMSVGXTGQXILSRRYNNXPXG

SEQ ID NO: 200557 - protein, 64 aa, Triticum aestivum
  unsure (1)..(64): unsure at all Xaa locations
  Clone ID: PAT_TA_94975.pep
FVGWXENYCECLKXFXKXXNLMLPIFLRNXRLCNCGCAFRCHSCSKPSGSPDPVPRMFPVILLC

SEQ ID NO: 200558 - protein, 151 aa, Triticum aestivum
  unsure (1)..(151): unsure at all Xaa locations
  Clone ID: PAT_TA_94976.pep
HQALLSVTTFPVFAFFPAVTKRLFGRRWAACLAVRRRQDEVFVPLIHAKRGDGDPPCYADSLLAVRVADEGGRQLTDAEMVALCSXFMNGGTXDTTVTLLEWFVGRLRAKPDVQTKVYEEVKSNPRXNNCKQCLLKAFGAGTNPIYRVGFV

SEQ ID NO: 200559 - protein, 144 aa, Triticum aestivum
  unsure (1)..(144): unsure at all Xaa locations
  Clone ID: PAT_TA_94977.pep
RGITIDIALWKFETTKYYCTVIDAPGHRDFIKNMITGTSQADCAVLIIDSTTXGGFEAGYXKDGQTRXEHXLLAFXLGVEQXICCCNKLVATSLIPQXPLXXIFXGSLXTLKRVXNPXKXLXXHSXFXGGXXXXAXTFGKRPTF

SEQ ID NO: 200560 - protein, 73 aa, Triticum aestivum
  unsure (1)..(73): unsure at all Xaa locations
  Clone ID: PAT_TA_94978.pep
MAQXSVILXTASYDHTIXFWEAXSGRCYRTIQYPDSXVNRLXIIXXKXFLXAAGNSHXXLXDXNSNGNSILVM

SEQ ID NO: 200561 - protein, 90 aa, Triticum aestivum
  unsure (1)..(90): unsure at all Xaa locations
  Clone ID: PAT_TA_94979.pep
SRLLRHHSTCSDLTPXPPXHRPQXAXSPPIPPAKSAAARAVXPQPCXARPRCSPPRPPQPPXAPRSAASSPRXTSPRPASSSASPGSSPP

SEQ ID NO: 200562 - protein, 193 aa, Triticum aestivum
  unsure (1)..(193): unsure at all Xaa locations
  Clone ID: PAT_TA_94980.pep
PDQSLQVPPRRIPFLPRTGLGPPRVHARSSLPRRGDARGPVATPWXAFXPVLTCRDNPDGPVPXLXDHIXAXSASARQAXKXQGGIFIMTGDVLPCFDASNLLLPDDAACIVTAPTTLDVASNHGVVVASKDGTEGQNCSLCLVDNLLQKPTVSELVEGQAILDDGRALLDTGIIAVRGKAWQELVALAYSSS

SEQ ID NO: 200563 - protein, 114 aa, Triticum aestivum
  unsure (1)..(114): unsure at all Xaa locations
  Clone ID: PAT_TA_94981.pep
DHVXXPLLSWKXXXPGKGCLSRPAWGIXSPTXCIKXQXVRHPFEGKNFTDXPKKXXKEYKVDLKERISSRRCISLQVYKVIGRRIYIYKEGCTPEIVTTRKEQDIPKGSHRYTQ

SEQ ID NO: 200564 - protein, 105 aa, Triticum aestivum
  unsure (1)..(105): unsure at all Xaa locations
  Clone ID: PAT_TA_94982.pep
MSCCGGNCGCGTACKCGNGCGGCNMYPEXEAAGATLLVSATATHKGESGGMEMAAENGGCGCTQCKCGTXCGCSCCSASSSSIMHAPRVHHRLYRSTTTIHVTAT

SEQ ID NO: 200565 - protein, 101 aa, Triticum aestivum
  unsure (1)..(101): unsure at all Xaa locations
  Clone ID: PAT_TA_94983.pep
MDASATGAGXKGKKGAAGRKAGGPRKKSVTRSVKAGLQFPVGRIGRYLKNGRYAKAXVGTGAPVYLAAVLRYLARSCWXVAGNAAKGQQESRIVPKXCCWR

SEQ ID NO: 200566 - protein, 165 aa, Triticum aestivum
  unsure (1)..(165): unsure at all Xaa locations
  Clone ID: PAT_TA_94984.pep
STPLKNNRASQPHSPDQPAGRLTPRSCALSGEQRSLRAARVMALLLLRGCLAPVNAAGPAFRPAETTSRLSYRRXSRFGAVVASAAAASPSGGDGATAAVDAVLRXSEGSKAXARXYXGTNGXAFXXPAGQXPSRHRREDIFDFRFLXXSXXRXAXXLLLCFSMA

SEQ ID NO: 200567 - protein, 159 aa, Triticum aestivum
  unsure (1)..(159): unsure at all Xaa locations
  Clone ID: PAT_TA_94985.pep
MASTSPEPAATETGDSVKIRRLQIADRERGFLPLLSQLSSCPDLTESEFAACFADLAALGDDHVILVAEDPAAAPERRILSTGCLXVGAQXLRGGGKVGTWRLVVDAAARGRXVGVRVVRRSWRSXXGAGCYKSWNAPGTARYYAKCAGKGVKMACIIG

SEQ ID NO: 200568 - protein, 72 aa, Triticum aestivum
  unsure (1)..(72): unsure at all Xaa locations
  Clone ID: PAT_TA_94986.pep
QIQXNLNTKYDPKITRVKVRQLDMGITHLEKEXPVYNXGLKTXMIKEXGQXQQEXPKTAPLRXVYHYQRLPK

SEQ ID NO: 200569 - protein, 93 aa, Triticum aestivum
  Clone ID: PAT_TA_94987.pep
VAAYPHGPPRRLLRPRRRRPRARVIWAGPCGSSTMVGACGSAVAAYPHGPPRRLLRPRRRRPRGLGAKTVPPPRLLAAAQRAPRKAMPMPTAT

SEQ ID NO: 200570 - protein, 97 aa, Triticum aestivum
  unsure (1)..(97): unsure at all Xaa locations
  Clone ID: PAT_TA_94988.pep
IPRFTNPGGSIICGELIPENTTVSVALVPASTSPDFWTDADEFVPERWCKEERCPEKYRNDNRKVMQPFSIGXRNCIGKNLGQXEIRPILTVMLWNF

SEQ ID NO: 200571 - protein, 173 aa, Triticum aestivum
  unsure (1)..(173): unsure at all Xaa locations
  Clone ID: PAT_TA_94989.pep
MAQTMASMTGLSQGVRLPGPAGRRASRFIVRASSAEAEAAGRRAVLGLMASGVVGSAFAXVVHARHRRGIXFWPPPPLSGWTPPERTTPNEARDFXDLPLKNRFXLQPLQRREAAVPAKDSAKNPQLQALIXKNNGVLKNTPPEGSYCATTQDILKTQGGKRPKDYGNSSVTP

SEQ ID NO: 200572 - protein, 88 aa, Triticum aestivum
  unsure (1)..(88): unsure at all Xaa locations
  Clone ID: PAT_TA_94990.pep
VLSVCRILNCEWVGXSTLSSPXYGPFIAWRPVSPRYHVMSFFKEMDVKSWRRYYNMVVPSGEGICGEFICPPGASCTHTLLEAMQPLA

SEQ ID NO: 200573 - protein, 137 aa, Triticum aestivum
  unsure (1)..(137): unsure at all Xaa locations
  Clone ID: PAT_TA_94991.pep
LFDPLQGVKVFPRINAIRYHQLXVREKVYLKTLXPTRYGLYGILLCHLVLTNAXTYSMNMMNKVFMEFLDKFIIVFIDDILVYSKNEEEHKEHLCFLLKKLREHQLYAKFSKCEFWVKEVGFLGHVISREGIAADPT

SEQ ID NO: 200574 - protein, 48 aa, Triticum aestivum
  Clone ID: PAT_TA_94992.pep
PAVRELKSEYALCCFHQASKLCTVRMHFLFSLYITWDIYYITPSDPYY

SEQ ID NO: 200575 - protein, 152 aa, Triticum aestivum
  unsure (1)..(152): unsure at all Xaa locations
  Clone ID: PAT_TA_94993.pep
MXPIXLYGMMLXPNVTRVATLLNELGLDFDFXDXHLRIGAHKQPDFLXINPFGQIPXALXDXEEXVFXVRXPSTGYIATXYXAALLPXPSXXXKRYWXVESHHSTXPEXTLXFQLLIXPXWAPXXAXHVDXNPATSQVNFNPLPGKYSGSTR

SEQ ID NO: 200576 - protein, 144 aa, Triticum aestivum
  unsure (1)..(144): unsure at all Xaa locations
  Clone ID: PAT_TA_94994.pep
ARRILLPRRLKMQIFVKTLTGKTITLEVESSDTIDNVKAKIQDKEGIPPDQQRLIFRWASSLRMAGPFADYNIQKXPPSPCPPPSVGGMQFSVKTFDWARHHLXVESVLDTIDNSKARFKTRXDPPDNNASXXPGKQLEDGAPF

SEQ ID NO: 200577 - protein, 137 aa, Triticum aestivum
  unsure (1)..(137): unsure at all Xaa locations
  Clone ID: PAT_TA_94995.pep
PXXXPRESRXFPPLCQXRLTVXXXSXCWRSRTRSXXIAXCXSGEKSTAVVRKKVVKVVSLRCFACRARXNCRRGAFVPSFLLVISVSLLFVCTYIFFARKFQSIHLLSRQYNEHLEIIKITSRSVDHLATTTITEMS

SEQ ID NO: 200578 - protein, 84 aa, Triticum aestivum
  unsure (1)..(84): unsure at all Xaa locations
  Clone ID: PAT_TA_94996.pep
PLQPRNVLKTLWMHKAKKQRRRRRRRRRRRRXKEEEEEDPATAINSLYLQHEPPPRQHPKFKFSKSGVKKENSAQPPSASDHRS

SEQ ID NO: 200579 - protein, 170 aa, Triticum aestivum
  unsure (1)..(170): unsure at all Xaa locations
  Clone ID: PAT_TA_94997.pep
MANPRVFFDMTVGGAPAGRIVMELYKDAVPRTVENFRALCTGEKGVGKSGKPLHYXGNAFHRVXIPDFMXQGGDFTPGQRHRRRSIYGENFPNEXFVHKHTXPGILSMANAGPNTNVPFXIXTXPXNWXXGTLXFXKXPXMDSSRTSKXGSRNGLSTSVINNGSSGPFPS

SEQ ID NO: 200580 - protein, 52 aa, Triticum aestivum
  unsure (1)..(52): unsure at all Xaa locations
  Clone ID: PAT_TA_94998.pep
AXHXXSXSPPPPDSPPPAPQQPPPWSPPSYDNRTLRGLKLTRGGFLVPNSAR

SEQ ID NO: 200581 - protein, 179 aa, Triticum aestivum
  unsure (1)..(179): unsure at all Xaa locations
  Clone ID: PAT_TA_94999.pep
GFALRANSLGHLEQIKSYAPGRQVRFGSLNYTGDIRGDLIFDGFEPLPSAPHCHDEHDLALPPNSVLEAAPASASTLNSEPTALVEDGWLDAASGLRSQWRSSRTPTPHSARLVTPKEPDSSPGLRTSAPLPIESDCTPXMEFXTWTSSALAFRRXFEDTKXPLIREPGRTTSARWTRX

SEQ ID NO: 200582 - protein, 153 aa, Triticum aestivum
  unsure (1)..(153): unsure at all Xaa locations
  Clone ID: PAT_TA_95000.pep
MSDTDEHHFESKADSGASKTYPQQAGAIRKGGHIVIKARPCKVVEVSTSKTGKHGHAKCHFVAIDIFNGKKLEDIVPSSHNCDLPHVDRQDYQLIDITDDGYVSLLTESGNXKDDLKLPXDDVLXGXIKTGXLMGRTDLRIPHGEKPLRRGGK

SEQ ID NO: 200583 - protein, 128 aa, Triticum aestivum
  unsure (1)..(128): unsure at all Xaa locations
  Clone ID: PAT_TA_95001.pep
RMLDLSGNNLSGSVPPYLLKGCGQLIMLNLRGNHLGGTWPDETSESCQLQLIDLHGNHIQGRLPRSLARCQYLIALDIGGNHFEDSFPIWMGQLPQLRLLIXRNNNFHGPVSILLWRRTLPDYFPVYQ

SEQ ID NO: 200584 - protein, 143 aa, Triticum aestivum
  unsure (1)..(143): unsure at all Xaa locations
  Clone ID: PAT_TA_95002.pep
HSRPSSPTHHEDEDAELRRRRWSGPPRDQTVLRRPLLPLPQDLGRLVQGDRSSALVGLPNPPLAPRAALPXPPPPPQVPPRCSRSRPSPTPPPTPTPTPDATFFDATSSTPSPTSMAGTRHGVRVWPLNTRARSSAPLGTISP

SEQ ID NO: 200585 - protein, 107 aa, Triticum aestivum
  unsure (1)..(107): unsure at all Xaa locations
  Clone ID: PAT_TA_95003.pep
EVXDFAVHPEPAXPLPSPLRTPRMPSELRERERERERERERERCSGGEAACWSGLELSRRWMEMAGPAVAKSPRWSSIYSYPHSAPTWIGGGGEKQVVGGDLKRRLE

SEQ ID NO: 200586 - protein, 190 aa, Triticum aestivum
  Clone ID: PAT_TA_95004.pep
MAMAGLTSSTNQPRMAPPPGRNPSMHTYHLCLCFLLLASTATLSAAVTASSYSIACPSLPPANDRHTDADDALSLTRSFQISAGQFSGGAAGLFPPEDDDLYNDRSFAFFPHGISRTEEPGSPPTQRHIHLNGGRRDNYSFLRPSPPPRRDSSASLSDGRDGRPRTVPKHTRASARVRISSSFDGSVGWI

SEQ ID NO: 200587 - protein, 50 aa, Triticum aestivum
  unsure (1)..(50): unsure at all Xaa locations
  Clone ID: PAT_TA_95005.pep
PXSXQGRPEXDXFDMXXXNXXXXTRSLDGDMTVDYFNECLLRFDVDXXCR

SEQ ID NO: 200588 - protein, 148 aa, Triticum aestivum
  unsure (1)..(148): unsure at all Xaa locations
  Clone ID: PAT_TA_95006.pep
QATLSSTSRPAASSASTAANGYHQRRRGDHRRRPCRHRQAAGPXSAPAEDXEREGEVXLLQGRQGGDPGGRRPRGRRVPARRGXXVTASAXPXLALVXERVSXXAXGSXXGXXTXCWGXFSLGVXGLNWSLXTSXLXTPXDKSPAALV

SEQ ID NO: 200589 - protein, 83 aa, Triticum aestivum
  unsure (1)..(83): unsure at all Xaa locations
  Clone ID: PAT_TA_95007.pep
EKEHAIAHHCKYVRKINLHHVVVNTLIMISSLSTSCSSTSAMKXXSFLCTXQHSSNENLRYTTQPMARYTWXRQKVGEGYGTP

SEQ ID NO: 200590 - protein, 144 aa, Triticum aestivum
  unsure (1)..(144): unsure at all Xaa locations
  Clone ID: PAT_TA_95008.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGXHRDFIKNMITGTSQADCAVLINDSXTGGFXAGISKDGRPLACLAPWSEQ

SEQ ID NO: 200591 - protein, 72 aa, Triticum aestivum
  Clone ID: PAT_TA_95009.pep
MGGGNDGHGYPPGGQGGYPPAGYPPQQGGYPPQQGGYPPQQGYPPAPGAYPPAPGAYPPAPGAYPPAPGAGG

SEQ ID NO: 200592 - protein, 80 aa, Triticum aestivum
  unsure (1)..(80): unsure at all Xaa locations
  Clone ID: PAT_TA_95010.pep
MRAVAIAXPGGXEALQVRXVEDLPXPXEGXVLVXVXXAGXNRAXXVQRXXXVPAXLGRLHLPXXSRCSVTILXLGDXXPR

SEQ ID NO: 200593 - protein, 180 aa, Triticum aestivum
  unsure (1)..(180): unsure at all Xaa locations
  Clone ID: PAT_TA_95011.pep
MTSSSTLTVTKSPPALIPPAGPTPRGTLSLSSIDKTVAGSGFVCLIQVFSPPSLSAARRDLGAAAAVAAMRDGFARALVPYYPVAGRIAPSGLAVDCTGXGIWXFVEAAASCVLADVDGSSAARFHPTAAPPPRLPGELKAIFMSKRQVTAWFPSDSRVFNGRAISTSQPGVRTCRMDQH

SEQ ID NO: 200594 - protein, 61 aa, Triticum aestivum
  Clone ID: PAT_TA_95012.pep
RYSLYAFNIFQMLGLHFLNVLRRVILLIYLFRFFGIINITKKRKKNKNKKCEKNQNKKRGT

SEQ ID NO: 200595 - protein, 73 aa, Triticum aestivum
  Clone ID: PAT_TA_95013.pep
MAFLGSSRAAGRLMVLLQMALFVIVSALIMNSSLCLAAAGQDDIAGSGSRCIGQKCSGGTHCCRGVPLVGDRP

SEQ ID NO: 200596 - protein, 190 aa, Triticum aestivum
  unsure (1)..(190): unsure at all Xaa locations
  Clone ID: PAT_TA_95014.pep
EGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLNGKTITLEVXSDTNDNVKAKSRQGGYPPDNXVXLXVTTXDGRTWRLQRRISTGLLQGGSLENT

SEQ ID NO: 200597 - protein, 63 aa, Triticum aestivum
  unsure (1)..(63): unsure at all Xaa locations
  Clone ID: PAT_TA_95015.pep
YRDHDEEXSDDIPTGXXIXRDXXDEQXWSGXRRRFLRWRQRKATRRXGTEXPTKAATVTTXXS

SEQ ID NO: 200598 - protein, 136 aa, Triticum aestivum
  unsure (1)..(136): unsure at all Xaa locations
  Clone ID: PAT_TA_95016.pep
IXGNPGXXPPGPGPCTGXAXCPTWCNPPQLSQHGHALPLXFAAAAAEDDCFPLSXRPSALDTGVMAMAVVVVVAAAGFGDGRKSREHDGEDAKDQQQRRQASSSSHLCVCHSLYLSLFDFFPLSQELATASLVAWS

SEQ ID NO: 200599 - protein, 170 aa, Triticum aestivum
  unsure (1)..(170): unsure at all Xaa locations
  Clone ID: PAT_TA_95017.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATKXTKVEEVKEGVPDAXVRIIGFDNMLKIRQLIASQRAAKIRG

SEQ ID NO: 200600 - protein, 60 aa, Triticum aestivum
  Clone ID: PAT_TA_95018.pep
RAEFGTRQHIIPIEIRECLEHDYMKNSAVDFNQLLDPNPQLRFGIFAFCLNFSTAVELNL

SEQ ID NO: 200601 - protein, 114 aa, Triticum aestivum
  unsure (1)..(114): unsure at all Xaa locations
  Clone ID: PAT_TA_95019.pep
GRFSPYSPWIEPTGAQKKKPSFIRNAALFTWDXDELNGKICTLYNPGTSVPIIXSXIAXGLRRTXXMCMCNWXFRXKPAGAPLTMLRTSPPRRGXRKGPEPGRXCXTAKLRGRA

SEQ ID NO: 200602 - protein, 82 aa, Triticum aestivum
  Clone ID: PAT_TA_95020.pep
RKFSLLCNEWQEMINFSKSKQKHIDASIHYHRIILRPNGAKLLTTTIAIYCLLIETKKGNDHIYLNDFNILLEHSIGKYFLF

SEQ ID NO: 200603 - protein, 142 aa, Triticum aestivum
  unsure (1)..(142): unsure at all Xaa locations
  Clone ID: PAT_TA_95021.pep
MHHVAVXCVPRSXXTAWXXFLAXXAXVARXAARKLVGSXGCCVXDEEXLLLVXGXCPNXSXDRLLFAPASAAPGAPALGWDRRRRIVAGLAAALLYLHEQLDTQIIHRDVKTSNVMLDSEYNARLGDFGLARWLEHAVEDAP

SEQ ID NO: 200604 - protein, 100 aa, Triticum aestivum
  unsure (1)..(100): unsure at all Xaa locations
  Clone ID: PAT_TA_95022.pep
KRSTGNRTARILAITLPIVAAILAAVVICLYHGGGRANRARKASLSYPTNPEDIQSIDSPFSIYQLLRAATDNLVKRINXGEGGFGWVYKGILPDNGRIQ

SEQ ID NO: 200605 - protein, 79 aa, Triticum aestivum
  unsure (1)..(79): unsure at all Xaa locations
  Clone ID: PAT_TA_95023.pep
MSCCGGNCGCGTACKCGNGCGGCNMYPEAEAAGATLLVSATATHKASSGGMEMAAENGGCGCTQCKXCGTKLRCSCCSC

SEQ ID NO: 200606 - protein, 66 aa, Triticum aestivum
  unsure (1)..(66): unsure at all Xaa locations
  Clone ID: PAT_TA_95024.pep
XTTVXRXSTLLLXQXLXXTXRAIDGYVRXVVXGGDGVGSPRXEDXGSVXAWWRMRPXXWEHRXXVA

SEQ ID NO: 200607 - protein, 112 aa, Triticum aestivum
  Clone ID: PAT_TA_95025.pep
NLDPTTTSSPPRRSKPACPCCSVRSSPEPVAAPRPLLVPVILAGVHRPRLIGAPPPTGVPRHGASASSASPVAPPLPVVDPTTLNSCAEAPPRASPSLRRSSTCCRGPRPPT

SEQ ID NO: 200608 - protein, 193 aa, Triticum aestivum
  unsure (1)..(193): unsure at all Xaa locations
  Clone ID: PAT_TA_95026.pep
LYLGPLSGDPPSYLTGEFPGDYGWDTAGLSADPETFAKNRELEVIHCRWAMLGALGCVFPELLARNGVKFGEAVWFKAGSQIFXSEGGLDYLGNPSLVHAQSILAIWACXVVLMGAVEGXRVAGGPLGEXVDPLXPGGSFNPRGSRRPEASXXQVKEXKNGGSHVSSLLQAQRGPQNSNRDRKTWAQISRPSN

SEQ ID NO: 200609 - protein, 103 aa, Triticum aestivum
  Clone ID: PAT_TA_95027.pep
MKGTKLAAILILQAVLVMGLLSHVNADFFPKCCNNCRSFSGVDVCDDAHPKCPQGCSACRVVSTSPEMWRCADMKSTVDGTCGGPCKNTDRFMPGMIFPPKIK

SEQ ID NO: 200610 - protein, 121 aa, Triticum aestivum
  unsure (1)..(121): unsure at all Xaa locations
  Clone ID: PAT_TA_95028.pep
MGTVKAWVAGKYAEPMGPMHDSLRVAYVVFSFCAAFLLGGIKAMVVEPVAAALIXTGELGVILRVFPGQVWWDIYSLIKTXRINAGLNWRGILRCCGLVGWDRAWPGNVRGFNFRVRKKAF

SEQ ID NO: 200611 - protein, 122 aa, Triticum aestivum
  unsure (1)..(122): unsure at all Xaa locations
  Clone ID: PAT_TA_95029.pep
RAEFGTRLVRQWLEEQNVGNITVENDWFVVESTVRGVERLLHTNFEVYENTLTGKSVLRTLSYSLPRSLKSSYRHHCTYNQISTPRGLQXHAGGTGLXXEIHENTAPLMVGAAAXLNSTNXP

SEQ ID NO: 200612 - protein, 150 aa, Triticum aestivum
  Clone ID: PAT_TA_95030.pep
SGGAAGAALVLWDCGSALYDSYELTAFKRQLDAAVLAGRSLSMPHLPAASPAVQPAGRRKRARRLPALLRRLFSKVLRLAARGARHDRYRAYEGTARRYSGTGSRCPGADFIPEEDGGTGSGSPPSSPANPRKILIGRRTRWDSVSCIVP

SEQ ID NO: 200613 - protein, 131 aa, Triticum aestivum
  Clone ID: PAT_TA_95031.pep
MPLPAHTSRPQSNAMAAASFLFLTILAAATTTPTAKATGISKSNGSCIPAERAALLSFKADITGDPDNRLVSWQQGRHDCCQWSGVTCSAGQAHPQVDSAIFPFPTSEPWVSMVLRHPYDISPARLSHQVR

SEQ ID NO: 200614 - protein, 147 aa, Triticum aestivum
  unsure (1)..(147): unsure at all Xaa locations
  Clone ID: PAT_TA_95032.pep
MANPRVFFDMTVGGAPAGRIVMELYKDAVPRTVENFRALCTGEKGVGKSGKXLHYKGSPFHRVXPDFMCQGGDFTKGQRHRRRXIYGEXSPNEXFVHKHTXPGFSPMAKRAQHKRPILHLPAMVDLSRSRMDSQDKGPNGLSYAMGN

SEQ ID NO: 200615 - protein, 117 aa, Triticum aestivum
  unsure (1)..(117): unsure at all Xaa locations
  Clone ID: PAT_TA_95033.pep
SESLKLPPFAHSPSTTAGKKSRGARGDLEPSSLPPMATRVLDTLAVAAEGGGGGAALPLTFFDVPWIFTGPVGARLLLPYPHRPKNFGRLLRAPCSFSPRWXFNXLXAXACPDXGXN

SEQ ID NO: 200616 - protein, 151 aa, Triticum aestivum
  unsure (1)..(151): unsure at all Xaa locations
  Clone ID: PAT_TA_95034.pep
AAESXXEITLSRVXIXLHPAXRVTSRXPDLGLXRXVXRHXYVXRWGTVXXAFXXCXTWSQGEFREGQXXLCLXSGXKCNSACGSEGRLXTRARGRMRRGYPPANTPNPTWTIRVAQRRRRRHRHVLNSFLAATRPAIDHNEIGEGGGVVYT

SEQ ID NO: 200617 - protein, 93 aa, Triticum aestivum
  unsure (1)..(93): unsure at all Xaa locations
  Clone ID: PAT_TA_95035.pep
VFCPGAVXXSSQTFISXDLSPETVPDRTLSCGSELPDQGIRYLRTVIVTAAVHRGFGRRLPCHQFTNFLDLPALGRRQPPYMVLRLCGDLCFW

SEQ ID NO: 200618 - protein, 95 aa, Triticum aestivum
  unsure (1)..(95): unsure at all Xaa locations
  Clone ID: PAT_TA_95036.pep
LSSDYVTGRAFTCTDRPAGWXXXSVGSPLRRPARRLGXFRGCQFLIPFKNGKGXGIXIPMCXLGPAMDKFVEEMGKLLRPPVDVDMFPAMIKSAL

SEQ ID NO: 200619 - protein, 115 aa, Triticum aestivum
  unsure (1)..(115): unsure at all Xaa locations
  Clone ID: PAT_TA_95037.pep
MRECISIHIGQAGIQVGNACWELYCLXHGIQPDGQMPGDKTVXGGDDAFNTFFKRDXGAGKHVPRAVFVDXEPTVIDXVRTGCLPPVFXPEQLSXGKDDAAQQFARXHYTNGXEC

SEQ ID NO: 200620 - protein, 95 aa, Triticum aestivum
  unsure (1)..(95): unsure at all Xaa locations
  Clone ID: PAT_TA_95038.pep
HLYXVFXDXDXCPXLXTTXIXLGNXXNGVGXPSXQDEQAQGXTSTXEXXGXQLVTSRXHVENSNDXPNXXXXAHGVPXXXSSQIPSKATNGREEK

SEQ ID NO: 200621 - protein, 141 aa, Triticum aestivum
  unsure (1)..(141): unsure at all Xaa locations
  Clone ID: PAT_TA_95039.pep
SSCSSPVDLLRAPLPPRPGRSSPPWRLACPPPSSSSAPRCSWGLAAGAARASTKEGXALYALRMRLSDPNGVLXSGIPTSVNPCXWVHVTCXTASRFVRLDLRNSXVSGSIGPELKRLVXLQXLXXFKXNFNGXFPKXFXN

SEQ ID NO: 200622 - protein, 118 aa, Triticum aestivum
  unsure (1)..(118): unsure at all Xaa locations
  Clone ID: PAT_TA_95040.pep
GPXXVFXISGNRKRGTXPQXLKXXAXPPAKXXRQKRPQPPQGXPPPPGSAARTTRTAAPTLAPCAAAERQRTPPPPFISGRAGSPATASGDGEEGRAEKGGGGGRGREPSSSPREGDA

SEQ ID NO: 200623 - protein, 146 aa, Triticum aestivum
  unsure (1)..(146): unsure at all Xaa locations
  Clone ID: PAT_TA_95041.pep
RXXXIXSLPMLGLXRLKFIXXPWGXLXFXKXKIGXGXPGXLXLKVXXVVKRGSTSXWYWGXRGKVIDXXGKLXFNXLRVGNXTASLGSTNACIVXPXKPVLNGLGCSPFRSPLLTGSLLAXFPLGYLRCFSSPRLSLACSWIQQAV

SEQ ID NO: 200624 - protein, 58 aa, Triticum aestivum
  Clone ID: PAT_TA_95042.pep
LNFLVSMAPKFAKGKGVAKVVGTVKPPESALSGDRTKSAFFFPSTLDVQRVRAPSTPM

SEQ ID NO: 200625 - protein, 103 aa, Triticum aestivum
  unsure (1)..(103): unsure at all Xaa locations
  Clone ID: PAT_TA_95043.pep
PSPLRLAAPPRSKTQARARPRNPNPSSAACDEGPPGGRRRRRRILLLRRPPPQRVALRLGAVSFFGKAPLEGVGASAGAWRITGGLERGXLPXGFRLAXLXVS

SEQ ID NO: 200626 - protein, 70 aa, Triticum aestivum
  unsure (1)..(70): unsure at all Xaa locations
  Clone ID: PAT_TA_95044.pep
KIQKFLSQPFHVAEVFTGAPGKYVDLKEGVQSFQGVLDGKYDDISEHAFYMVGGIDEIIAKAEKIXSENA

SEQ ID NO: 200627 - protein, 97 aa, Triticum aestivum
  unsure (1)..(97): unsure at all Xaa locations
  Clone ID: PAT_TA_95045.pep
DSGGGRRLNHEEASAAAXAWESTAATKNMGSGLSXRPGFHXMQKPGXXTTGEGPRAAKPSNNGQRKXIATPXSRRNGXIKXXPGGFPAPQXXRNXGR

SEQ ID NO: 200628 - protein, 108 aa, Triticum aestivum
  unsure (1)..(108): unsure at all Xaa locations
  Clone ID: PAT_TA_95046.pep
SNNSFTGIIPTSFRNLSSLTILNLEYNQLETRDNRDWEFLNALTNCRSLKKLSLSYNQLQGPIPQSVGNLSPSLGXLRLTGKQLSGTXTPKSIXKLNALTNXALSENY

SEQ ID NO: 200629 - protein, 126 aa, Triticum aestivum
  unsure (1)..(126): unsure at all Xaa locations
  Clone ID: PAT_TA_95047.pep
RAASLXVPLKRESGXELQTVFPRRTAGCQTSASPSCSSLGAGSRSWIHGESLESPPSTLSAPCAXTPRTHSXETVMVSIFFSRFKVFQRRKEGSRGVSSLGVSSGVCLLLRRCGVCVGWAGGGGGV

SEQ ID NO: 200630 - protein, 63 aa, Triticum aestivum
  unsure (1)..(63): unsure at all Xaa locations
  Clone ID: PAT_TA_95048.pep
HKVHMHVGTWSKXHKKYKCVTPXMYXRYLRAHGIHIHEASSIQXYLSSSGNRLARTRTPVTNT

SEQ ID NO: 200631 - protein, 90 aa, Triticum aestivum
  unsure (1)..(90): unsure at all Xaa locations
  Clone ID: PAT_TA_95049.pep
MLDKLWDDVVAGPRPETGLDKLRRAAATQPLAINTAAGEAIKQSPSMPTTPTTPGDAVVRPTPPRGGXFXRSVFNPGXSNLATKSFGQLL

SEQ ID NO: 200632 - protein, 52 aa, Triticum aestivum
  Clone ID: PAT_TA_95050.pep
NEVCVSAVAPNCFLLCFSLLFLMINWNFHICIQCKYPVWKCQGNLGFQKKGG

SEQ ID NO: 200633 - protein, 117 aa, Triticum aestivum
  unsure (1)..(117): unsure at all Xaa locations
  Clone ID: PAT_TA_95051.pep
QQQLRRSPPPSSPRARPLLAAMAPRVPSSLLLVGAALLLGLAAGAARAXRRRGKRAVRAADAAVRTPTACSKSWDSTSVNPAPGSTHLATAPXRLRWIKXSNSPVHRPXSTAFVNLQ

SEQ ID NO: 200634 - protein, 64 aa, Triticum aestivum
  unsure (1)..(64): unsure at all Xaa locations
  Clone ID: PAT_TA_95052.pep
SRVSVERKRRGRXXSMXXTEYRXFXGGLAWATXDIXLQQXXXLLRRDPRRXDXXTXAKQLXSPL

SEQ ID NO: 200635 - protein, 133 aa, Triticum aestivum
  unsure (1)..(133): unsure at all Xaa locations
  Clone ID: PAT_TA_95053.pep
TFRXPRLSXKXPGESTQQLLXSPRXXPVXXSLKXVVRXAQRRPXRTRNXAXXRRVGTRQXRGRRRQGSPPWRPWSSCTSPSSLXRPHWGRPRACGLAMAARATTVVAAAALMVAIWLLCLRCLPPACWCWRVW

SEQ ID NO: 200636 - protein, 111 aa, Triticum aestivum
  unsure (1)..(111): unsure at all Xaa locations
  Clone ID: PAT_TA_95054.pep
MTLPDIRHCSNTLIFVAALTIAQMXPVTHIPHXFEVGFTDFXGDNYFVPCVXCPTCKRXTAAIGCKDGINSMPWKNSXXXDXKXEXSNMPIPXXXXQTQNICKVSSSXGNK

SEQ ID NO: 200637 - protein, 102 aa, Triticum aestivum
  Clone ID: PAT_TA_95055.pep
GPTSYSNVEKGYNVSHQNQLLSNIHQQGSSLQSSFTAVKDSADETIVKPKTSDSVFSVNHSSEEQEDDEGDQNEEYLLPQIATQLKMDITGRKYGQKQLKSN

SEQ ID NO: 200638 - protein, 108 aa, Triticum aestivum
  unsure (1)..(108): unsure at all Xaa locations
  Clone ID: PAT_TA_95056.pep
XINSGQLLLXKNCVSXFSAQTFCYENHIVSKSMSRKIXSXXFCANNXFXKFKXSAKICLQKPPLSKXKVVXAKLKFSGQKNXFGKKXFLCSKIKGXFQQKXKXFPAKN

SEQ ID NO: 200639 - protein, 158 aa, Triticum aestivum
  unsure (1)..(158): unsure at all Xaa locations
  Clone ID: PAT_TA_95057.pep
MAMAPATSPRHLLLLLFLWLCAAASTAWAHGGGGDADSGDADGGGEAKPDLRARGLVATKLWCLALVFAGTLAGGVSPYFMRWERGVPGRWAPFXGGVFLNTAMXIXSTTQRTSGDSSPTAXPFAXISPAPVLLNMLANAQLSXVXAANXAAARTKEL

SEQ ID NO: 200640 - protein, 111 aa, Triticum aestivum
  unsure (1)..(111): unsure at all Xaa locations
  Clone ID: PAT_TA_95058.pep
SEIRTTFTLTSFSRHDFTQDGVDSQFRQCITAVHTEGVACLSVFPWVKPYLAASESAGXGRRASGTGRRGAXKRGKGGGVQKEPGXTGPPXEQQLRLALESPDSXGERRLR

SEQ ID NO: 200641 - protein, 127 aa, Triticum aestivum
  unsure (1)..(127): unsure at all Xaa locations
  Clone ID: PAT_TA_95059.pep
IVDRCHGLPLAIVTIGGMLSSRQRLDIWNQKYNQLRSELSNNDHVRAILNLSYHDLPDDLKNCFLYCSLFPEDYHMSRETLVRLWVAEGLVXRKEKNTPEMGXLEGNSMDLIXRNSLKLLENDDXVK

SEQ ID NO: 200642 - protein, 159 aa, Triticum aestivum
  unsure (1)..(159): unsure at all Xaa locations
  Clone ID: PAT_TA_95060.pep
TVQPGAICHGGHDGESGGFGDGGPAGFVRPRAGHEDHRGGGDCPAEQAGVQESREPRIRDRRPAAAAAGPAGGATAGRAGHXSRKRHXSSLQSWTPPXSLPDTTEKLRNPTQVYPTXLTLCXHTPLXPLXXXSPXPTXSSTIXPXGFCLLRXTEGGXWE

SEQ ID NO: 200643 - protein, 167 aa, Triticum aestivum
  unsure (1)..(167): unsure at all Xaa locations
  Clone ID: PAT_TA_95061.pep
ALRXRSXPRVGGASSARXLDXXQQSRXRVFXSRCAASSRFVPRHEGAPEAPARSGPAPTPRGQARXPRRPRAAGARISGLLPWRDCELCVARSAFRRGSQIAHQTAPPAPIWGGFTRGWGLRAAAEVGFEGGVAAAVVAVTGEERRAGEGGVEEEGGERFRRLRARH

SEQ ID NO: 200644 - protein, 172 aa, Triticum aestivum
  unsure (1)..(172): unsure at all Xaa locations
  Clone ID: PAT_TA_95062.pep
MAMFATSTAAVLGSARPGRAAEPRWCVVARASSTMAAPAAVAIGRTHYEVLGVGVGASRGEIKAAYRRLAREVHPDAAGGGGDEGSSRLHAAYATLVDPNERARYDRDLLGAPRGXYGGPRLGLLPGDLEDNSVRLLEGCLGPNRAPGDQARLKKLRCLHKIAANWYQETEV

SEQ ID NO: 200645 - protein, 74 aa, Triticum aestivum
  Clone ID: PAT_TA_95063.pep
GGSCGCGSACKCGNGCGGCNMYPEVEAAGATLLVAATATHKASSGGMEMAAEDGGCGCTQCKCGTSCGCSCCSC

SEQ ID NO: 200646 - protein, 168 aa, Triticum aestivum
  unsure (1)..(168): unsure at all Xaa locations
  Clone ID: PAT_TA_95064.pep
RQLAMTFGGIFGLPGYILFGDKEQERKLRKRKKKLQRERKLRLRQERKLRQREQELQWLLLRQQPSKLRGTQGFSSESLAVARSSNSVAVPRGYERQGAHGFSSDSLGARSLEQLTGQSSWSWVRATWGARARGSLVTHWQSLALAIIGILVVRPQDHLVSLXXASWY

SEQ ID NO: 200647 - protein, 98 aa, Triticum aestivum
  Clone ID: PAT_TA_95065.pep
MQEMDRSSEENVKIVEMDSGEQPARRGGAKGGDRQFSSVEYHHGGRCSPAPSAMTELSPRASNWHVEDHLSFGTAHSSPHSHSHNATTAMAEPAASDL

SEQ ID NO: 200648 - protein, 148 aa, Triticum aestivum
  unsure (1)..(148): unsure at all Xaa locations
  Clone ID: PAT_TA_95066.pep
KHGPEIRFPFRLSIDPPSCGAPGMQLSCSGHDTILDHHVLGSCRVTAIYYRHRVINVIPLVESSMECPLQKLISTNLETDVYKQPQSSEVTTXVRCSTDFIXADPYRIAGPASCXSNNATQFWYLASISASITDLPWNCVALVNXPIP

SEQ ID NO: 200649 - protein, 84 aa, Triticum aestivum
  Clone ID: PAT_TA_95067.pep
HRHQCVHMLIRSFPWKESNTNQVSKWKHSPKRETRKKRLYTLEPKARRPNSICRLKDAINKYVQTMRLNSVKSHFCLILKKKGS

SEQ ID NO: 200650 - protein, 88 aa, Triticum aestivum
  Clone ID: PAT_TA_95068.pep
VSVLNACAEIGALALGRRVHVFASKVGLVGNRHVGNALIDLYAKCGGVEDARKVFEEMGVGRTVVSWTSLIVGLAGNGFGKDALELFG

SEQ ID NO: 200651 - protein, 78 aa, Triticum aestivum
  unsure (1)..(78): unsure at all Xaa locations
  Clone ID: PAT_TA_95069.pep
XXIGNRXXLFIVXGNVCYAXWYQVXGWXXKFLPKIWSATLLMGXTVLPWTQLTXGCKFSSPSIRVHVVVLDFAFFEKC

SEQ ID NO: 200652 - protein, 103 aa, Triticum aestivum
  unsure (1)..(103): unsure at all Xaa locations
  Clone ID: PAT_TA_95070.pep
SRRXGXAEXRRSXPGRGSRDEVYFFDRGGRRDXGERQQLRVFERVHPSGGGQTCRRGVLGVGRHRXAHLVSVRRQGRSTNLQLQLLQIDPIILECVCIHECSN

SEQ ID NO: 200653 - protein, 138 aa, Triticum aestivum
  unsure (1)..(138): unsure at all Xaa locations
  Clone ID: PAT_TA_95071.pep
MCRQYTLLVVXLFLETKSLVGALESSWVFXFLCATRCNWLRHAAXLCSGRWHWLRQRLGSLRRSWPGKAIITRNSRRWSGTMGQHNMLQFRTGEMDSTGHQLGSLFKMVGLSESFERRYYSWTVEVPEKVKERAQQVD

SEQ ID NO: 200654 - protein, 119 aa, Triticum aestivum
  unsure (1)..(119): unsure at all Xaa locations
  Clone ID: PAT_TA_95072.pep
YKSVXXHLXYFRLFPSXRGXXXFPGGCWFPPKYFLAXQGLRLCLRGACLXCRVVFAYYREGLLNQFXVLCTWAERGQVLIALYAKIYAVVSIFALLYGCQSTLQCCVGNYQMLSVLKTF

SEQ ID NO: 200655 - protein, 159 aa, Triticum aestivum
  unsure (1)..(159): unsure at all Xaa locations
  Clone ID: PAT_TA_95073.pep
INIVVIGHVDSGKSTTTGHLIYKLGGIDKRVIERFEKEAAEMNKRSFKYAWVXLDKLKAERERGITIXDIALWNSETTKXXNCTVIDXPGQPLLQSKNMIXGTPQADCAVXXIXPTLXFFRXXPPRMAXPLTSPLASTLGVNQXICRRYKMDPHPNFQR

SEQ ID NO: 200656 - protein, 112 aa, Triticum aestivum
  unsure (1)..(112): unsure at all Xaa locations
  Clone ID: PAT_TA_95074.pep
MAKPGVYHCSISLQALTVFSVLSVLVVDVQGGDRCQGFSCGHLRDSGILSDXRYPSGCGVXEYNWLWXXKAAIXINTGXYXVTGIDNQLTFWVVDPTLSQXKCPSSEQFLIK

SEQ ID NO: 200657 - protein, 123 aa, Triticum aestivum
  unsure (1)..(123): unsure at all Xaa locations
  Clone ID: PAT_TA_95075.pep
MGKEKTHINIVVIGHVDSGKSTTTGHLIYKLGGIDKRVIERFEKEAAEMNKRSFKYAWVLDKLKAERERGITIDIALWNSRPPKYXCTVIDXPGHRDFXKNMIXGTPKADCAVLINXPNTGGF

SEQ ID NO: 200658 - protein, 73 aa, Triticum aestivum
  Clone ID: PAT_TA_95076.pep
VCNSWLLMFQNVIIWLLLANYFTMIHGMVARCTILLYYKLLHMVLAHARMQLQSSFHGNADLSFKSSVLLTFS

SEQ ID NO: 200659 - protein, 103 aa, Triticum aestivum
  unsure (1)..(103): unsure at all Xaa locations
  Clone ID: PAT_TA_95077.pep
SIDIALMRFSDISVPATVFLILNQAYAQTSTDCNPLQKTCPPNPGLGTSVFTDFTKGKSDYWQPLQGTTXXYDGPNXAQSLSKNPVMRLQCHSXXXHVWXILT

SEQ ID NO: 200660 - protein, 103 aa, Triticum aestivum
  unsure (1)..(103): unsure at all Xaa locations
  Clone ID: PAT_TA_95078.pep
ANCPQTVGSGDGSLANLDTTTPNAFDNAYYTNLMSQRGLLHSDQVLFNNDTTDNTVRNFASXNPAAFSNAFTTAIIXMGTIAXXNGNXGNFRLNXPGKIYQFG

SEQ ID NO: 200661 - protein, 53 aa, Triticum aestivum
  unsure (1)..(53): unsure at all Xaa locations
  Clone ID: PAT_TA_95079.pep
VQNPSPSXYHXKAKANQXXSSXTQLRPCGXGSVQXRQGRHRSVERASRPILGV

SEQ ID NO: 200662 - protein, 108 aa, Triticum aestivum
  unsure (1)..(108): unsure at all Xaa locations
  Clone ID: PAT_TA_95080.pep
LARSIAILALICSALACSVAAQVAQGGSREPGRPPSPQFPSPRRPGQAPLTPPPPSTLRKTRAFTPHRKTVQVAGGYSELKMMSTCYSSVYQCVPXMLSNKPGLFFYS

SEQ ID NO: 200663 - protein, 55 aa, Triticum aestivum
  unsure (1)..(55): unsure at all Xaa locations
  Clone ID: PAT_TA_95081.pep
MAMATQASXATRHLITAAWSPSAKPRPATLAMPSSAXGXAXLCAAXXGXPAPXAP

SEQ ID NO: 200664 - protein, 108 aa, Triticum aestivum
  unsure (1)..(108): unsure at all Xaa locations
  Clone ID: PAT_TA_95082.pep
AILVVGSGAPPDITPARSPLSSTCRDRLWSRRCPASAPARSAARRVALRPRYRSLSGGRGSSRCWSAAAESGACRYRPTSCAPISLDMMRDPXRAHGINYNRKPXRVA

SEQ ID NO: 200665 - protein, 185 aa, Triticum aestivum
  unsure (1)..(185): unsure at all Xaa locations
  Clone ID: PAT_TA_95083.pep
VGCSVGAKCARSXRXXXFGXPATXXSVRVSRXSXDLEXRQKVXGXXXXXVPNXXGRLXAPXNHSXRGVXXGXRXAGRAXRKENLGPXXLFRKGRIXXSLRXHGRXXRQKGHGAALAGRLERRSADCLGLAGQNWPILGVWTRELYTGQESFFKDLLCVRLAKCKYVNELVTYCKLKANEHTSFFY

SEQ ID NO: 200666 - protein, 175 aa, Triticum aestivum
  unsure (1)..(175): unsure at all Xaa locations
  Clone ID: PAT_TA_95084.pep
MSDTDEHHFESKADSGASKTYPQQAGAIRKXGHIVIKARPCKVVXRLHLQRLGKHGHAKLSLLLPLDIFKWEKNXEDIXLHPHNCELPHVXRPRLSTGLDIXDDGXVXLSXLESXXTXDDLDFPTDEFRLXXFKRVXXKXRPILXVXPAXVKNXCXFKDRGNYTWCLMQSSGLKS

SEQ ID NO: 200667 - protein, 78 aa, Triticum aestivum
  unsure (1)..(78): unsure at all Xaa locations
  Clone ID: PAT_TA_95085.pep
XVXFGXLXXAFRXGINGSLSSTKLVCFSXKPFXTGLGCSPFRLAVITGSLLLSFPLGYLRCFSSPRLSLACSWIQQAV

SEQ ID NO: 200668 - protein, 145 aa, Triticum aestivum
  unsure (1)..(145): unsure at all Xaa locations
  Clone ID: PAT_TA_95086.pep
MTRSFAKKLGQGGFGAVYRGDLSDGRQIAVKMLKDFKTDGEXFINELASIKXNSHVNVVTPLXGFAWEGTKRALIYDYMPNGHXERYAFXKDGPXGGKYFKVWEXFIXKXQXELXPXLXYLHXGCXTXIXHFGYKPQKSGQSKFF

SEQ ID NO: 200669 - protein, 94 aa, Triticum aestivum
  unsure (1)..(94): unsure at all Xaa locations
  Clone ID: PAT_TA_95087.pep
MAAKCYPTVSDEYLAAVAKAKRKLRGFIAEKNCAPLMLRLAWHSAGTSTWQQNRXPXXNMKCXXXLAXGANAGFKIPXKVPTQGNSQLPSQFLI

SEQ ID NO: 200670 - protein, 206 aa, Triticum aestivum
  unsure (1)..(206): unsure at all Xaa locations
  Clone ID: PAT_TA_95088.pep
XXTSXRTXARXXKRXXRALPXTSXNPXTDSGLSGQXPQXTPAHTDPAXAPNHASQXXXDNXREECXTNHQXWAXAPAXHRRXARRSRRREAKSGRIVPQKXAAAGAARPPPAQAGKAAAHRSPRRAANRRPPPTXAPPAALXRAVQRSPLVRRRPSRRKLAPPPPWLTRALPPGGAGDGEGVDGVGRPEALAAWSPPVSPLGRERR

SEQ ID NO: 200671 - protein, 92 aa, Triticum aestivum
  unsure (1)..(92): unsure at all Xaa locations
  Clone ID: PAT_TA_95089.pep
MSCCGGNCGCGSGCKCGNGCGGCKMYPEMDEGVNTASQXLIMGVAPSKGTPSXSEAAAENGGLQVRPNCTCNPLQLQVIPMKASNQVRWGWA

SEQ ID NO: 200672 - protein, 40 aa, Triticum aestivum
  unsure (1)..(40): unsure at all Xaa locations
  Clone ID: PAT_TA_95090.pep
ASXATXSGSPXATSSTGTSTTXPXNTANILAQTNKPHLAR

SEQ ID NO: 200673 - protein, 188 aa, Triticum aestivum
  unsure (1)..(188): unsure at all Xaa locations
  Clone ID: PAT_TA_95091.pep
GXXSXIXLXWGPISXEIXQTQFXXGKPXKIXXDFPQKPGXFFWXXRKGRPXVXILTXKFLESTQIXRXXYWFXLKPSIKWXXLGAGXPRKGLRMLXRVHKVAAVEKCFVLSWNVFQGIRVYIGEGIGQGTTGGPTEGGGRALLPHGFLVASPPYSTSLLVCFQSKKDHREGFILFGLCLVFLFCKTLK

SEQ ID NO: 200674 - protein, 82 aa, Triticum aestivum
  unsure (1)..(82): unsure at all Xaa locations
  Clone ID: PAT_TA_95092.pep
GIALSLSRSISLHHTTVVAWWRRTGDRKGGRKLGRGRRRQRPPLRSIXREGRWRWSDGLGFAXXTLPXAXXXRKEGGGAAIR

SEQ ID NO: 200675 - protein, 98 aa, Triticum aestivum
  unsure (1)..(98): unsure at all Xaa locations
  Clone ID: PAT_TA_95093.pep
RLKLNNAGGTGXGKNLALPSEKXFSESSGRRKRLXXFVSFSPXLFAFXVXXXAKXFPAPAPXKXFPXLGAISPPXLGLRRRXKTPQPPXRTGXRXSRG

SEQ ID NO: 200676 - protein, 150 aa, Triticum aestivum
  unsure (1)..(150): unsure at all Xaa locations
  Clone ID: PAT_TA_95094.pep
HIEIQGEPLDVHKAVELIASHLRKFLVDRSVLPLFEMQMKVHNAHREQPMPPPQTWGPPPPWGHPSNVPPGXGPGYGGXPQFMPPPAXKDHYYPPPXMYSLSKXTTLWIPSYGRXAPPTGLLPASREPHQQMVLPKYTQMNSSSIWGTQH

SEQ ID NO: 200677 - protein, 132 aa, Triticum aestivum
  unsure (1)..(132): unsure at all Xaa locations
  Clone ID: PAT_TA_95095.pep
MPIRNIAVGSHQEVYHPGALKAALAEFISTLIFXVFAGQGSXGMAFXKLTGRRTTTPAGLXXGGGGHXFALFLAVPSXQISXGXXNPAXLRAFXRGNTFPRLLNGFLLVLGLPPRFSKRGSPTDLRPFWKPL

SEQ ID NO: 200678 - protein, 166 aa, Triticum aestivum
  unsure (1)..(166): unsure at all Xaa locations
  Clone ID: PAT_TA_95096.pep
XQEGCXYCIGLSLLXVTXCIFSXCSXNPGMKXTXXVKXKQRCMXSSQKSSFGMCILKXEXNQSSIXLVYXTISWRRERISCAXCXIFGDHXVLLXCAAWSSSLALSQQAXNVRSSATAAAARXNFXLRXXDDDIPGADFPHGSVKESEGGSNRSTTLQLGDGGTVC

SEQ ID NO: 200679 - protein, 175 aa, Triticum aestivum
  unsure (1)..(175): unsure at all Xaa locations
  Clone ID: PAT_TA_95097.pep
LGWGRVTLXGXGSETADHVGERXDPGGPAARXSDRVXRAXXEGSTRERRARGTXDGAPGGGRLGXAGVXSRGAALVRRSXSAXREASSDRSVRELLVQARAGRKQLLLPLQLREAIPHRRARRRIQPPPPNHRGPAAGAAIAQAPPTQTLAAAPLDPRNPRARGGGVWDGRGEES

SEQ ID NO: 200680 - protein, 116 aa, Triticum aestivum
  unsure (1)..(116): unsure at all Xaa locations
  Clone ID: PAT_TA_95098.pep
AXXGGEGPVXILGPVINIXVQTVIFNXRRGDQFTAVGGRWDDSQCXTSRSVLRVATIIGARKGRVAKTFLAATLPTGNTRAQGSVLPHGEVYQDIYSFPETAFWLSGATAHTNVGF

SEQ ID NO: 200681 - protein, 81 aa, Triticum aestivum
  unsure (1)..(81): unsure at all Xaa locations
  Clone ID: PAT_TA_95099.pep
LNFRENKTKSXLDILEFLXXLPWNKKIHLXISRKTKNHXHXGKKXSHVKGNEVKTTILDXMXSTIILGXQIXLKAVVXSXT

SEQ ID NO: 200682 - protein, 183 aa, Triticum aestivum
  unsure (1)..(183): unsure at all Xaa locations
  Clone ID: PAT_TA_95100.pep
MAAATMALSSPVMARAAPSTSSALFGEARITMRKTAAKPKPAASSGSPWYGADRVLYLGPLSGEPPXYLTGDSRATTGWDTRGLPPTPEXFAKNRDWSDHPXXGDAGPSGAXXRXSSPRNAXQFGEXFXQRXXPIFNEXGSILGNXXXXAKXSQRASSVQWALQGXXRGXRKPRTGPRFRRKK

SEQ ID NO: 200683 - protein, 105 aa, Triticum aestivum
  unsure (1)..(105): unsure at all Xaa locations
  Clone ID: PAT_TA_95101.pep
MATDVAATEPEVAAEEAAAAAPETTATAGDSKPAKEXKAKKAAAPRKXAPPPPTXPYAXEMFXEAIXKLKEXTGSNXYAIWNFXQGQQKGNCIXXRKXVXQIXTL

SEQ ID NO: 200684 - protein, 172 aa, Triticum aestivum
  unsure (1)..(172): unsure at all Xaa locations
  Clone ID: PAT_TA_95102.pep
MASSAMELSLLNPAAMRGLSAAKPRVVSSRRIVRFRVASSAAAPPAAKPGTPKKRGKTEIQETLLTPRFYTTDFXDEMERLFXNAEINKQLXNQGGFDALLQDXKXDYNQXHXVRQPGFXAAARQMEGSQAIFDSSTSTRISPKRLGAGQETTMGVSKRIGNWKGSMRGLTR

SEQ ID NO: 200685 - protein, 138 aa, Triticum aestivum
  unsure (1)..(138): unsure at all Xaa locations
  Clone ID: PAT_TA_95103.pep
MAAATMALSSPVMARAAPSTSSALFGEARITMRKTAAKPKPAASSGTRXTAPDRVLYLRPVSXGEPPTTHRQFPGNNGXENGGXSXRTPXTXXKNPXLEVFXPRVGQSWPLXCXFPXSXPRKXHFREAFXLKXVFFKQ

SEQ ID NO: 200686 - protein, 101 aa, Triticum aestivum
  unsure (1)..(101): unsure at all Xaa locations
  Clone ID: PAT_TA_95104.pep
MKGTKLAAILILQAVLVMGVLSHVNADYFPKCCNNCRSFSGVDVCDDAHPKCPKGCSACRVVSTSPEMWRCADMKSTVXXTCXGPAXSTDSVPNMIFPAQT

SEQ ID NO: 200687 - protein, 80 aa, Triticum aestivum
  unsure (1)..(80): unsure at all Xaa locations
  Clone ID: PAT_TA_95105.pep
MVICWPAAPRVHTSPNLCWLPSSAPTPPRRPTTLSRRAPPRPLRATRRRLMPGXXPNGCGSQPKFKTGGAAPGNFASFPI

SEQ ID NO: 200688 - protein, 69 aa, Triticum aestivum
  unsure (1)..(69): unsure at all Xaa locations
  Clone ID: PAT_TA_95106.pep
AXLTRVXHQXTSSSSITHTIRAGDRXASEXSKQKSSRSSDRRMGSXYXSGRXRCRXXGTSRXXXWAQAG

SEQ ID NO: 200689 - protein, 132 aa, Triticum aestivum
  Clone ID: PAT_TA_95107.pep
MASQGVASMFALALLLGAFASIPQKAEAIGVCYGMSANNLPPASSVVGMYRSNGITSMRLYAPDQAALHRWAGTGIKRLVGAPNDCSPTRRHPAGRASWVRTTSSLPSCRSTPLGNKAGTLRAWRRWFRGVG

SEQ ID NO: 200690 - protein, 126 aa, Triticum aestivum
  unsure (1)..(126): unsure at all Xaa locations
  Clone ID: PAT_TA_95108.pep
HTPSHDKQTQPKPNTSRTRRSAPSLSVARDAAKPRAPPPPPPPPPEMDGSGSWDAIDWNQIKEPRPPRSSSRGMEDFLLEDDEVYAQXHGVVLLNTDEAGILSXTNFRLLLVSQATKRRYXVGTSH

SEQ ID NO: 200691 - protein, 56 aa, Triticum aestivum
  unsure (1)..(56): unsure at all Xaa locations
  Clone ID: PAT_TA_95109.pep
MAPATXAAMALAPPPSHHHHHHHVKQLQLPPSVSVSVPLRSGFLXRALPXAXHSRC

SEQ ID NO: 200692 - protein, 129 aa, Triticum aestivum
  unsure (1)..(129): unsure at all Xaa locations
  Clone ID: PAT_TA_95110.pep
GILEPTSFTVKAEGVAKNAPPEFQKTKLMTRLTYTLDEIEGPLEVSSDGTIKFEEKDGIDYAAVTVQLPGGERVPFLFTIKNLVATGKPEXFGGPSSVPSYRGSPPRPKGPXGLPLRQPVSPPEQNEKT

SEQ ID NO: 200693 - protein, 69 aa, Triticum aestivum
  unsure (1)..(69): unsure at all Xaa locations
  Clone ID: PAT_TA_95111.pep
RITLXEXRXKKKXLXXWWKGGGFXRXEWFLXEGESGEELELLGGLGIVVXGDREVGWGVVRFFFXXYMP

SEQ ID NO: 200694 - protein, 103 aa, Triticum aestivum
  unsure (1)..(103): unsure at all Xaa locations
  Clone ID: PAT_TA_95112.pep
MSAYCGKYKDELIKNAAYIGTPGKGILAADESTGHHWATLWXSINVENVXENRRSLXRAAPSXPLVPSXTNGVILFXGTLXQXDKDGTLRFPKEGGPRASGTF

SEQ ID NO: 200695 - protein, 145 aa, Triticum aestivum
  unsure (1)..(145): unsure at all Xaa locations
  Clone ID: PAT_TA_95113.pep
LAPVSRSCVTVQLNSLDSLVTSSELLQLKEGGRSNGAHDVLHFERRLRRRAAAGGAFRSGGGGLISTSSRAGTQGXAEXSSTSRLASTGEGRRXDYTRKGXXPLLDTSIPIHMKTSLKXSXXXRHXVRXTXXFQNGEXGQPRVFT

SEQ ID NO: 200696 - protein, 93 aa, Triticum aestivum
  unsure (1)..(93): unsure at all Xaa locations
  Clone ID: PAT_TA_95114.pep
MSRPAGNPSYAAELGAAKKAVALAARLCQTVQQEIVQSDIQSQRRDKILVTVAXYGXQVLVILVFKYGXTSGXFPRVAEGDPRDXRKDXAENS

SEQ ID NO: 200697 - protein, 121 aa, Triticum aestivum
  unsure (1)..(121): unsure at all Xaa locations
  Clone ID: PAT_TA_95115.pep
XKFXIALLSXXTMXXHLSXECWYCQXPIVLXKXVXTKCSLXTPTSIYVKIVPINXARHKFXTCMMISQHHSTSIQFGGSLEFHICEARKEAEMATQNKSIQIHKLSKYKRCSMRSNSYNAI

SEQ ID NO: 200698 - protein, 105 aa, Triticum aestivum
  unsure (1)..(105): unsure at all Xaa locations
  Clone ID: PAT_TA_95116.pep
AYSFAVNCGSNRFISGSDNLRYETDDVNLQAASYNVTGAPTWGVSNVGKFMDAPNGNYIIYSSRQFQNTLDSELFQTSRMSPSSLRYHGXLGLENXNYQXXFNXA

SEQ ID NO: 200699 - protein, 185 aa, Triticum aestivum
  unsure (1)..(185): unsure at all Xaa locations
  Clone ID: PAT_TA_95117.pep
FSVILLMLCFATLGSAQYVKYKDPKQPVSVRVKDLLGRMTLAEKIGQMTQIERENATAEQIAKYFIGSVLMGGGSVPAPXGITQAWVXMVNEMQKGALXXPRLXFPMILRIDAXAWGTITSTSYXFPHNVXLRATKTPDLIKEDRLSDLYSLLFLAFSNPTYKLYTQVPSLTNHVQGHNLKHGNK

SEQ ID NO: 200700 - protein, 140 aa, Triticum aestivum
  unsure (1)..(140): unsure at all Xaa locations
  Clone ID: PAT_TA_95118.pep
MAVGKNKRISREGKGSKKKAVDPFTKKQWYDIKAPLLFTSRNVGKTLVSRTQGTNIASXEGLKHRVFEVSLADLQNDEDQAYXKXRLXXEDXQGMNVLTNFWGMDFTTDXQXLLRKXXTLXEXHVDXKTTTTSMLVKPDK

SEQ ID NO: 200701 - protein, 77 aa, Triticum aestivum
  unsure (1)..(77): unsure at all Xaa locations
  Clone ID: PAT_TA_95119.pep
MGNGLSPCMHLPATAAAGVKLVYWGGQTRMLDDDGGVCAVAGDVTAELPGDHVVCXADSFXVGSRFXVVSARRRLMR

SEQ ID NO: 200702 - protein, 104 aa, Triticum aestivum
  unsure (1)..(104): unsure at all Xaa locations
  Clone ID: PAT_TA_95120.pep
SMAGLVGFGWGSSQIGPGGAAPAADAGVGQRAQSERGRAARVRXGDGVVXEXTNEGRXTATSSSPTPEAPLCMLMDPXXPALTPLTGRWAFPXKRXNGTFTVLX

SEQ ID NO: 200703 - protein, 85 aa, Triticum aestivum
  unsure (1)..(85): unsure at all Xaa locations
  Clone ID: PAT_TA_95121.pep
XLCESQGLRLTLLXNYFFPIFVLXFALFIFIHSLLXFLXXXFXFXSXKIVKFPSRAIXFTXIXNFXXGHXFSGVGIXXTXIXXNW

SEQ ID NO: 200704 - protein, 62 aa, Triticum aestivum
  unsure (1)..(62): unsure at all Xaa locations
  Clone ID: PAT_TA_95122.pep
MCGGAILAELIPSAPAAXRVTAGHVWPGDANKAKKKGARADDFEAAFRDFDNDSDDEEMVEG

SEQ ID NO: 200705 - protein, 97 aa, Triticum aestivum
  unsure (1)..(97): unsure at all Xaa locations
  Clone ID: PAT_TA_95123.pep
QRKPLTXXHRXQQGLRGPAPQXWTSWLGPSAFPPNPSHPSQLRVSTVTPVNGGSGGDHQTVVDALLSHIAGWRIRQRRSGLGFGGLGNAGAGTMWGR

SEQ ID NO: 200706 - protein, 133 aa, Triticum aestivum
  unsure (1)..(133): unsure at all Xaa locations
  Clone ID: PAT_TA_95124.pep
MAPTVMAXSATSVAPFQXLKSTAGLXVXRRSTXSGFGNFSNXXRIXXXQVWPIEGIKXFXTLSYLXPLTVEDLLKXXEYLLRFKWVPCLEXNKXGFVNXXNHRLPDTIWKYXXCGSXNFXCTVXQGLKDXRQE

SEQ ID NO: 200707 - protein, 58 aa, Triticum aestivum
  unsure (1)..(58): unsure at all Xaa locations
  Clone ID: PAT_TA_95125.pep
FVDISSLAISIDQHGVFSCDCDLVHLPRGLNNITFTMLGMVPNDDTNHVRXXEYXPSM

SEQ ID NO: 200708 - protein, 141 aa, Triticum aestivum
  unsure (1)..(141): unsure at all Xaa locations
  Clone ID: PAT_TA_95126.pep
AYSDFGLSKLLGEDGRXQITTQVXGTMGYLDPEYYMTQXLTDRSDVYSFXVLLLXEVITARKPLEXXRYVXREVKDAVDPXXDMYXSTELLDPALXAXSGLAGSSRNSTWXLXCXKDXAPDRPXXGXAXPRLTDQWGCGPG

SEQ ID NO: 200709 - protein, 125 aa, Triticum aestivum
  unsure (1)..(125): unsure at all Xaa locations
  Clone ID: PAT_TA_95127.pep
MGGGKDKHDESDKGLFSNMMHGVAGGHGYPPHQGYPPQXGYPPPPGAYPPPPGAYPPPPGAYPPPPGGIPPQHGYLSLVVPPLVVPPNGVPPAVPGYLAQGAWIPWRNDNLVRRSQWKNSAWEMV

SEQ ID NO: 200710 - protein, 126 aa, Triticum aestivum
  unsure (1)..(126): unsure at all Xaa locations
  Clone ID: PAT_TA_95128.pep
AFXHXLGXKQIXVFTPQIXGRLVXLXCMAPCPXRERDAXXXSCRRRAAQRPSXAXPHRRXETGGXRGXHXVLPPHPATTRSRWRLAGMCEVLRRCPSPCSSLGTFMEEATARRRGEVGVPGWGGGD

SEQ ID NO: 200711 - protein, 72 aa, Triticum aestivum
  unsure (1)..(72): unsure at all Xaa locations
  Clone ID: PAT_TA_95129.pep
AXXGDGXEAYVVEXVXXXTWEAAGHEXGXSXXGRXXTVERRGEWSWWFDCYRREGRXGERRDRGRRASVVVP

SEQ ID NO: 200712 - protein, 98 aa, Triticum aestivum
  unsure (1)..(98): unsure at all Xaa locations
  Clone ID: PAT_TA_95130.pep
FFLQFPLFNSVINLIVRSDLKILRPIEHGVPFGSDXNAPRHGRRLRRRGLGDGAEFXCREMRXVGXTGVQLHXLGEXQXXRXKXHACIXIRQGRXXGD

SEQ ID NO: 200713 - protein, 90 aa, Triticum aestivum
  Clone ID: PAT_TA_95131.pep
WSRLLPELLTEIMRRVDAGAERWPPRRDVVACACVCRRWRDAAVSVVRPPLECGRITFPSSLKQPGPRDAPMHCFIRRNKKNRPSTFNST

SEQ ID NO: 200714 - protein, 133 aa, Triticum aestivum
  unsure (1)..(133): unsure at all Xaa locations
  Clone ID: PAT_TA_95132.pep
XXIXTXLXQILNLLXFQXIFPXLVLRXKAXNWQPSSXXFPRXXIKVGXICXXGLXIQVIHCKXSFPGSXIPKYTXDQRTNLNQQXXAINRSSACVNPMVQQTLVXAXAXSAATAXXWFSXLPXXXXRGAPGHX

SEQ ID NO: 200715 - protein, 72 aa, Triticum aestivum
  unsure (1)..(72): unsure at all Xaa locations
  Clone ID: PAT_TA_95133.pep
GIPLLFSPVPEXEQVRRVVVGXDGHVVSEXRWWGALGPWADXAVRGAGXXACVVXRGXXXXSMGXSXXRXFA

SEQ ID NO: 200716 - protein, 161 aa, Triticum aestivum
  unsure (1)..(161): unsure at all Xaa locations
  Clone ID: PAT_TA_95134.pep
VYHTPPLLVASYQKPSAPTPSCHCLAQRPPAPPGQCSAPWPQSRCPPPLGTGISFLTTTVLAVPWDRHLLKCKLYGRRCMVHIRLGPQSASTSLGALSQRCGPSPXLCDPPDSINTLIHAPKCXXKXKDHXEIHNTXLKHNIXQXPYTPRAPXGAGPFPXR

SEQ ID NO: 200717 - protein, 140 aa, Triticum aestivum
  unsure (1)..(140): unsure at all Xaa locations
  Clone ID: PAT_TA_95135.pep
MAMALHGHGRRGRLXAALWLVVVATASVAXARFVVXKNSIKVLSPHSLRGRHXAAIANXGVPDYXGXLXXRXLYPXGRRXKPNGCKPFXGRXRSXXXPGXGXXCSXLGPSXGCXFXLXXWKPXKXGXAXXLXAXNLQGPL

SEQ ID NO: 200718 - protein, 142 aa, Triticum aestivum
  unsure (1)..(142): unsure at all Xaa locations
  Clone ID: PAT_TA_95136.pep
GSTGEEQDLNRGNGEGGAAGSCYHXXGGRKXXTPPSXCXERXDRTTVNTMXGEGGQLLPTTPGGKQPPPLPPRSHTGERQQEPPSAPRRGGEGAAGEGGRCRCHXQDGEGRHRHHAXGRKSSSRRXGGSSSRRGLGFEETVC

SEQ ID NO: 200719 - protein, 83 aa, Triticum aestivum
  unsure (1)..(83): unsure at all Xaa locations
  Clone ID: PAT_TA_95137.pep
RVXLNFFGXXIPVWTXPQTPGNXKRDWRGKLKXWFXLXXAKKQGXXYLLSXTPVESREGRKVGAATAGGRDSAAANESDRRVG

SEQ ID NO: 200720 - protein, 124 aa, Triticum aestivum
  unsure (1)..(124): unsure at all Xaa locations
  Clone ID: PAT_TA_95138.pep
IEIXSGEEDGLLXXXHRXTXGLYGWVXLIXDPPSGGXRXPPXSNXGXRRDXXWGGATGGGXRRRRXRGGGPXRXXAPGFAPSXSSSXSXGXFSLFTMSXXGCGRGXDELSPQXSASISISXSVC

SEQ ID NO: 200721 - protein, 167 aa, Triticum aestivum
  unsure (1)..(167): unsure at all Xaa locations
  Clone ID: PAT_TA_95139.pep
MAAATMALSSPALAGKAAAKVFGEGRITMRKSAAKPKPAASGXPWYGADRVLYLRPSPGDXADYLTGDSPGDYGWTPRVSADPXTSXKTGXEVFXPKXAISAPXXLFPXSSXPXGVNXGRVCKGVQFLNGAQYEPDLFTTLPSGGKCMQGPRGPKFTLPGELRNAPR

SEQ ID NO: 200722 - protein, 95 aa, Triticum aestivum
  unsure (1)..(95): unsure at all Xaa locations
  Clone ID: PAT_TA_95140.pep
VLRESXXCGLMVLKVXXWKKGLXFXELSXXVRIFXLIKXFXLXFXXKXRMNKFCXKWFLRXVFARXXXKXFGXRPAHLVLKEYVFRTELEVDGFH

SEQ ID NO: 200723 - protein, 86 aa, Triticum aestivum
  unsure (1)..(86): unsure at all Xaa locations
  Clone ID: PAT_TA_95141.pep
GRDXFLISLVVIPCSWKIFLPFFXVLFXLLLXSXSLLYGISPTTWPNLPLHHDEKLQIIPCSNQLHWLVAATSPPSIIIIYWMMIS

SEQ ID NO: 200724 - protein, 85 aa, Triticum aestivum
  unsure (1)..(85): unsure at all Xaa locations
  Clone ID: PAT_TA_95142.pep
XESSXRNSTTTXPLXSXGXVMCIXPILXXCXXVKXHVLECXPKDXXEIXXCVGYNXKYILVMXXXIAQKXXWSHFXIMGXKNAAF

SEQ ID NO: 200725 - protein, 149 aa, Triticum aestivum
  unsure (1)..(149): unsure at all Xaa locations
  Clone ID: PAT_TA_95143.pep
RFISRLGEKAIPLYQMLKKTDNFVXXDXXXAXFEDLKKQLAEPPVLAAXXXKDPXLXKVAANTRAIXIXFXVXAREAGKEYPVQXAXFIIXSDVXNXSKXKXPPIXXXRXLGGFKXXIKNLKXFXRGXPXXRVXXPLWGXIPGSTGFGF

SEQ ID NO: 200726 - protein, 96 aa, Triticum aestivum
  Clone ID: PAT_TA_95144.pep
FDPQSRCARVWRPVLSPRRRRAPSSPPAPAKPLFFSYKQQALAGNSKQRDARIRSPTCLGVSCFKKFSVLSGSMPNRPTSAQGGDVSAIHDALRPF

SEQ ID NO: 200727 - protein, 159 aa, Triticum aestivum
  unsure (1)..(159): unsure at all Xaa locations
  Clone ID: PAT_TA_95145.pep
MAAAKRRVRDAEADLNLPPGFRFHPTDEELVAHYLCPRAAGRAAPVPIIAELDLYRHDPWDLPHRALFGRRXWYFFTPPRPQYPXSRPNRAAAFGYWEXTGADXPXLHNXKTAGFKKXXVLQXXPXAXXKRXFITIRSPRRPRPARLKWIWPVSKENGK

SEQ ID NO: 200728 - protein, 140 aa, Triticum aestivum
  unsure (1)..(140): unsure at all Xaa locations
  Clone ID: PAT_TA_95146.pep
MGGKLLPAAAFAGSAPPLSQVATSAAHGEDSAVXFAGWKAYDEDPYHAVDNPDGXIQMGSPENQSPXTPPSLLRDHPEAPGHRRPRPYFKDTSKITRLQTSSMGLHGKNPRKVDPTLRRASLNLPTRPVTYLPVAGLGEV

SEQ ID NO: 200729 - protein, 62 aa, Triticum aestivum
  unsure (1)..(62): unsure at all Xaa locations
  Clone ID: PAT_TA_95147.pep
MALVEGNNGLSGGAVSFSEXQEALVXNSWXIMXKDSXKIXLGFFLKXFKVPXSXTHMSSRLQ

SEQ ID NO: 200730 - protein, 93 aa, Triticum aestivum
  unsure (1)..(93): unsure at all Xaa locations
  Clone ID: PAT_TA_95148.pep
XIXXXESFXXSDKFXQXXGDNCGXLVPNVXSXXRFXGGXXKGXKEGVLFRLSGXQPSTLSXGIHPWCIGXPPLVQESPLRFNTSRVTLKFPKL

SEQ ID NO: 200731 - protein, 120 aa, Triticum aestivum
  unsure (1)..(120): unsure at all Xaa locations
  Clone ID: PAT_TA_95149.pep
KSXLKEGGNYPRXKGKRKDXTXPXGXKRKXSPYRRRPAXAXARGVXPPPXVLXADAGEKRGGGAAPPACRAPLHSRSTAAHSLSGECARRQRGVRRRRRAVPPCRRAVPPWLGFRPASYA

SEQ ID NO: 200732 - protein, 105 aa, Triticum aestivum
  unsure (1)..(105): unsure at all Xaa locations
  Clone ID: PAT_TA_95150.pep
RHMCPCLPSPSSSPFFPSXXPSHKEKXXAXKSPQXXGXTHKRGGNXKGGRXNXXXQILXXXKNKXGRGKTPPQRGXKXGKXARXRTPKKPQXGXPPXXFXFLRGX

SEQ ID NO: 200733 - protein, 90 aa, Triticum aestivum
  unsure (1)..(90): unsure at all Xaa locations
  Clone ID: PAT_TA_95151.pep
PYLSHYQQHTDLASRYIQSYHICHITNNIQISHRRDRHFCFVLFNLSSLCSIPALICVYXASWVGFCCTPLRVGLFSXYMISSCKVACVM

SEQ ID NO: 200734 - protein, 114 aa, Triticum aestivum
  unsure (1)..(114): unsure at all Xaa locations
  Clone ID: PAT_TA_95152.pep
SARWTRGGRTSCTRCWCRRRSSATPTAATASPLLSAALSLSPRXRCFLCPARGGAMKHTTNARWAHIVCALLVPDVFFRDPDDHDGVDCSYLALFAALWVSPASPPRHLHRCHS

SEQ ID NO: 200735 - protein, 70 aa, Triticum aestivum
  unsure (1)..(70): unsure at all Xaa locations
  Clone ID: PAT_TA_95153.pep
SRVFFFFFFFFFLKRTYFMPCSLICTQGYQKYKESYFNANILKNEKYSLSDTNLNIXFPSFGFXNPXQXW

SEQ ID NO: 200736 - protein, 134 aa, Triticum aestivum
  unsure (1)..(134): unsure at all Xaa locations
  Clone ID: PAT_TA_95154.pep
XRGGVKMTLRKQGRDRLSGPALAEEVMKRQXXITSXIGAXRSAVECSXSGGSAARAPRRRWRXECTALAAAAAWVVPGPLXDIAAVEATVAGXGLGLHAHPPHPPPTKTSAAAAAAAPNPVGLGFMPAKCSTMP

SEQ ID NO: 200737 - protein, 86 aa, Triticum aestivum
  unsure (1)..(86): unsure at all Xaa locations
  Clone ID: PAT_TA_95155.pep
QNFRKDXGYLMLTTGTTNXXNIDDITXSKGMXLQEGXTFTHMPTYHXYAYPTLXLXRKNXXXPADALLSXTWLKAXTHTKRTPDKX

SEQ ID NO: 200738 - protein, 97 aa, Triticum aestivum
  unsure (1)..(97): unsure at all Xaa locations
  Clone ID: PAT_TA_95156.pep
GIVQVTEALLREVFQSTGLVEGCKLIRKXKXSXXGFVELTMDRRLSCIIIXXTLNGNQIFGQLTKXNWANPIXXKGXXTXXXQNFGXEXLPQXVXDS

SEQ ID NO: 200739 - protein, 111 aa, Triticum aestivum
  unsure (1)..(111): unsure at all Xaa locations
  Clone ID: PAT_TA_95157.pep
LFFFRPITIQFHHTLISRTKGGRQDFLRKLNVSQLACYLFTGSXGWQSPAEQASTTERGRSRPPEPARGAGWSRRGAPRPWRXGRGPGAAGERRSRGXGDSXCRGRSPAAG

SEQ ID NO: 200740 - protein, 56 aa, Triticum aestivum
  unsure (1)..(56): unsure at all Xaa locations
  Clone ID: PAT_TA_95158.pep
XYXHXAVXQEVAFXXLFPQSXLXRXXFXXRXTSRRASLSLLGGSXQPRRLWRWRMP

SEQ ID NO: 200741 - protein, 109 aa, Triticum aestivum
  unsure (1)..(109): unsure at all Xaa locations
  Clone ID: PAT_TA_95159.pep
YGRLCRGVPGCESGRNNPVSAEQXETLQGFRDDFXGGLGGESSXXPRGLFVNSCFAHCQSEVQDIWFAPASPALGDRRIADAVGDWFYGRSGFQKTDCPYPCDSTCYTN

SEQ ID NO: 200742 - protein, 105 aa, Triticum aestivum
  unsure (1)..(105): unsure at all Xaa locations
  Clone ID: PAT_TA_95160.pep
MVKAVAVLTGSEGVKGTIFFTQEGDGPTTVTGSVTGLKEGLHGFHVHALGDTTNGXCMSTGPHFNPAGNFNGDKKXNPPXWGFLGNXXTGADXVXXTXLXDXKSP

SEQ ID NO: 200743 - protein, 197 aa, Triticum aestivum
  unsure (1)..(197): unsure at all Xaa locations
  Clone ID: PAT_TA_95161.pep
KKRGLFLLFFLRLGRRLLAAVVTASSLSLSLSRTRKLLEASRSPAQRGAAHDVRDLRVLNYNVSRERRYILEVLFNGSAASNYRXYXPPGSPLTPTSLPAFFFFFXRAVPAYARGFPAGVPAKEGKXRPXTFXXPXFMKRXXPDPPLSXCWIAXQSGTMVXCPRKXPNFGAXIFWXQKXXKIQXEXIXEGYLXERXN

SEQ ID NO: 200744 - protein, 81 aa, Triticum aestivum
  unsure (1)..(81): unsure at all Xaa locations
  Clone ID: PAT_TA_95162.pep
MASKLGMVVLLISGLFAARCAAVVTTGEPVVAGLSCGFYDTSCPSVXGIVXWHVTXALARDIGIAAGSSXSXSXMLPQGCE

SEQ ID NO: 200745 - protein, 105 aa, Triticum aestivum
  unsure (1)..(105): unsure at all Xaa locations
  Clone ID: PAT_TA_95163.pep
MGEITNVTEYQAIAKQKLPKMIYDYYASGAEDEWDSPGEXGGFAXXLFRPRILIDVSKIDMAXXXGVXISMPIXIAPRAMXKXHXNGKXXTAPAAXTTXQKSTFL

SEQ ID NO: 200746 - protein, 107 aa, Triticum aestivum
  unsure (1)..(107): unsure at all Xaa locations
  Clone ID: PAT_TA_95164.pep
MLVYQDKLSGDELLSDSFPYRELENGVLWEVDGHWVVQGAVDVXDIGANPSAEGGGDDEGVXDQGRXRWVDIVDTFRLQGATCFXTRTFTSXMNRYIKNSLPTKGMT

SEQ ID NO: 200747 - protein, 95 aa, Triticum aestivum
  unsure (1)..(95): unsure at all Xaa locations
  Clone ID: PAT_TA_95165.pep
SPIQNESPISSAPPLAVASPVRRPPLRIPVRRKERRGNGDTVIREAKSMCSMEKVLSSEHPLLGLLQRSSNRLKDLPTKSLDEIYNXVDHXIAMG

SEQ ID NO: 200748 - protein, 123 aa, Triticum aestivum
  unsure (1)..(123): unsure at all Xaa locations
  Clone ID: PAT_TA_95166.pep
RRRNPLAGGGLAGVGRCLRRGRCCICLPVARGKSERPCGLALLEGRVRVVSLLVWVARLSRWPFCYHNLSISGLQWNECASLVAGKHCLTNKWVLMILXRRPKATKDQEPDISNHYIWHYSPI

SEQ ID NO: 200749 - protein, 177 aa, Triticum aestivum
  unsure (1)..(177): unsure at all Xaa locations
  Clone ID: PAT_TA_95167.pep
AYDGGGGGRSPASTRHGLLLPGHHGDGHGHGVHAQERRQHRRHRPHRPRRPLRPRRARRPHAARPPRRPSSCPSRPPSATTCTSWRRRPSPDGARCXXXAPYASXDIPPIRLPTSWKLGDNYFLEPCRRRRXGSPFLXAYPPVXXPXADIXVPVGRDGRXTPSXTTXQRTILXTAXP

SEQ ID NO: 200750 - protein, 59 aa, Triticum aestivum
  unsure (1)..(59): unsure at all Xaa locations
  Clone ID: PAT_TA_95168.pep
FWAXFFXVGPNGDXXTGXPGXGGRASSRRGAXPRKLVVWCSXDAXIVLTRXMRRRLGMP

SEQ ID NO: 200751 - protein, 165 aa, Triticum aestivum
  unsure (1)..(165): unsure at all Xaa locations
  Clone ID: PAT_TA_95169.pep
IXDXASKVFXHYHYQGRIPKFGXFSHVFFQNPSXQLGKYTSIXNRRRILLVFSLGKEGSXTGVMQCFMTSGTISWHGAGRPAWTREPTQRPFATAGSATLKLPIRARPFAAVERAPAAVGAAEPRRPRLQRQPHARLHCYAASSAAEVERELKRRERERGENRMP

SEQ ID NO: 200752 - protein, 89 aa, Triticum aestivum
  unsure (1)..(89): unsure at all Xaa locations
  Clone ID: PAT_TA_95170.pep
MGAVSRSGRAVAVLQLVSTVVLLLSPPPAAASRRDMSVDFHAASCPQLETIVRSAVHAALQREIALXAAGLLRIFVHXLLPTTGARRYI

SEQ ID NO: 200753 - protein, 112 aa, Triticum aestivum
  unsure (1)..(112): unsure at all Xaa locations
  Clone ID: PAT_TA_95171.pep
MKLSIQSFARKLSLPSPKRTWSSGGGSXXRDGGMSKNGSGVKRAISRXXASSFASASSEXESSSDDALMARXTPXSVLPAEISRRELEAVLRRLWHGEPDDDELXRRLAITA

SEQ ID NO: 200754 - protein, 38 aa, Triticum aestivum
  Clone ID: PAT_TA_95172.pep
SRVFFFFFFDELTVSLRTNEGSQVSNTAKIKNEFYMMA

SEQ ID NO: 200755 - protein, 87 aa, Triticum aestivum
  unsure (1)..(87): unsure at all Xaa locations
  Clone ID: PAT_TA_95173.pep
MMGAAVTMVDRRMAFAAEADVDSKAAFGFLGXECFXGEGDLVNPXPPPPQQQQVHEGGXPXEDEXDGDDDDDDDDTNGLDPFHGASK

SEQ ID NO: 200756 - protein, 118 aa, Triticum aestivum
  unsure (1)..(118): unsure at all Xaa locations
  Clone ID: PAT_TA_95174.pep
HSRVYKVQSGDCVLVHAAAGGVGSLLCQWANALGATVIGTVSNEEKAAQAAEDGCHHVIIYTKEDVVTRVKEFTAGKGVNVVYDSVGKDTYKGXVECLAXRWYLVSFGAXSSKPDSIR

SEQ ID NO: 200757 - protein, 170 aa, Triticum aestivum
  unsure (1)..(170): unsure at all Xaa locations
  Clone ID: PAT_TA_95175.pep
MASTSCFLHQSTARVAARVASPSPATRTHLLVCRAQKQDDADVSRRAALALLAGATAAVGVKVAPAAAAYGEAANVFXGXPKTNTDSXPNSGXGFKLLIPPKXDPXKGXXFPGQPPAYEDNFDPTXLSXIXTQQPXDXTIWSPILIQCWETAIRKSQGIDPGGSETGREI

SEQ ID NO: 200758 - protein, 163 aa, Triticum aestivum
  unsure (1)..(163): unsure at all Xaa locations
  Clone ID: PAT_TA_95176.pep
AIDISSSRRRVWPRRTSLRCTARRSHGAPFGVGHPRAVAAASPGGRKGLAAPRASERRACRRRHFDGIACFDSCRARRGVLQGGRRRSRXPKWWTXWTSHPAXAAKWPSIRXRAQKRLGQAANRPACAERRRXKPELAXPLLRAPXTTERPRXGHRPFXXXTF

SEQ ID NO: 200759 - protein, 138 aa, Triticum aestivum
  unsure (1)..(138): unsure at all Xaa locations
  Clone ID: PAT_TA_95177.pep
IICQIIQAMLLPSSVVPLFRVASSRLIMGAHRVSLHLEILTFLAFLLMLFSNIIFMAEMLFGXDSGWLNTLKGNTGNPVVFPSTVLITVGFVSLLHFHSYMAVTPTETRKHELNCNKKACAFSKSWNTTRQRKTCNVT

SEQ ID NO: 200760 - protein, 156 aa, Triticum aestivum
  unsure (1)..(156): unsure at all Xaa locations
  Clone ID: PAT_TA_95178.pep
LRFVRLPWLRGVAGIAACWPSSSSRPPPAPPTGSSCRRRSTRRAARRCRWWCAPPCSARSSARAADXRVPRQVLLPRRFXPXCDPPPPXTTXRRRLRXRETLPNSIRXAVHSSQIXQXXPLPXLSARXPSPPAKTPVXXNWXPWAGXTXTXXEXTR

SEQ ID NO: 200761 - protein, 111 aa, Triticum aestivum
  unsure (1)..(111): unsure at all Xaa locations
  Clone ID: PAT_TA_95179.pep
MATAMMAATATSCSPRRAPVVASSSVQPPRRQQQQQPRRGLKQLPGLRGDGGRXPLAAAPLPALAEQXMEKAALFDFXPDXPADXDRFLLLMVGPGQXYFKPAGIPMDNAT

SEQ ID NO: 200762 - protein, 134 aa, Triticum aestivum
  unsure (1)..(134): unsure at all Xaa locations
  Clone ID: PAT_TA_95180.pep
MEPSTKQLLPMPQQDPNSPSSSTSSSSSSSTSPSHPHHRAPLPPXPRPVPRTIXTTPFPXTFVQADTXSFNQVVQMLTGAXQPSXNXXTASTAXAGNINALMDWWXYXANWRXVPNXXXFKLYERXSNSXTQDV

SEQ ID NO: 200763 - protein, 137 aa, Triticum aestivum
  unsure (1)..(137): unsure at all Xaa locations
  Clone ID: PAT_TA_95181.pep
MNGGDAAAAAATPSHRRLPDFLQSVNLKYVKLGYHYLITHLLTLLLLPLMAVIVXEAGRTDPDDLRQLWLHLQVQXLVSVLVLSAVLVLXRTVYSSPPXPVYXVDSPCYSAPTQFDSPHRCGLLSKSLAQGELSPRN

SEQ ID NO: 200764 - protein, 136 aa, Triticum aestivum
  unsure (1)..(136): unsure at all Xaa locations
  Clone ID: PAT_TA_95182.pep
ASSTAPNLPSVAAAYPRLLIYLSPSAAAGAQRNRTLSSPAAATPRLIPFPGQGREGINLXFPPPPVPRTSLHDDGRWXLSFTSHPXXKPXLEPKIXNLXTLXQKLXDPSTVIXSKVSXQKNXKYKHIXRKIPRRIN

SEQ ID NO: 200765 - protein, 135 aa, Triticum aestivum
  unsure (1)..(135): unsure at all Xaa locations
  Clone ID: PAT_TA_95183.pep
LXYAKXSYNNRSQASLKMXPFEVLYGRKCRTPLMWDEXGERQFFGPDLIKDAEEKVKLIRDRLKIAQSREKSYADAKRKEVTYEVGDRAYLRVSPLCGIKRFGIKGKLAPRFVGPYKILERRGEIAYQLELPGSL

SEQ ID NO: 200766 - protein, 129 aa, Triticum aestivum
  unsure (1)..(129): unsure at all Xaa locations
  Clone ID: PAT_TA_95184.pep
GIRSPRPPPPPPPRPTRGRPTPRRVATPRAPLSAGGGASPSSGASRPASTTSPSPSGACSTTPATCSTTCSTGGSSGAMPXPGADSPASFSLYDWSLHGLSNPLFPQFFCHSILQTLGNVSVYKDSCEF

SEQ ID NO: 200767 - protein, 151 aa, Triticum aestivum
  unsure (1)..(151): unsure at all Xaa locations
  Clone ID: PAT_TA_95185.pep
MASLEAQAAERVIEACVRTESVRKCVFTSSLLACVWWQNHPNERRGPTIXDENCWSDESFCRNNXLWFALGEDSGREGGWRAAXGKRPQXLTVCPXWHXAGFXRRNSYASXATSKWCPAPMLPDKLRCATPGFYKMGTHGGTSHRPDPDGP

SEQ ID NO: 200768 - protein, 80 aa, Triticum aestivum
  unsure (1)..(80): unsure at all Xaa locations
  Clone ID: PAT_TA_95186.pep
MDPWISTQPSLSLDLRVGLPATAAVAMVKPKVLXXEGLLSPGSLSKKDPXGXGLEAGADGGKGKTRTWRRPIKGKPAPHR

SEQ ID NO: 200769 - protein, 88 aa, Triticum aestivum
  unsure (1)..(88): unsure at all Xaa locations
  Clone ID: PAT_TA_95187.pep
DSLPDSEPPAPLPIESDWAPIMEFTAADIFQHSPFGDILNLLKHLSLSGEPWPDYGQDGWDXDDXEIQSPPTAHFVATIGRXNRHARL

SEQ ID NO: 200770 - protein, 92 aa, Triticum aestivum
  unsure (1)..(92): unsure at all Xaa locations
  Clone ID: PAT_TA_95188.pep
MAMGEEAAATVTAAATLSAPHLLIICNPSXGNINPMLRLGKRLAAKGLLVTFSSTADVGAKITASSRGGRWRRRRAARPLGASGSIPKTHRG

SEQ ID NO: 200771 - protein, 79 aa, Triticum aestivum
  unsure (1)..(79): unsure at all Xaa locations
  Clone ID: PAT_TA_95189.pep
MSSLVDIWTVERERIRVSGAQAFRTTVASKRGCTAXRSDDGQXNKPDGAAXGNXXAKNQXAAARLGXPXASVIPRRPWT

SEQ ID NO: 200772 - protein, 131 aa, Triticum aestivum
  unsure (1)..(131): unsure at all Xaa locations
  Clone ID: PAT_TA_95190.pep
MAALAPSKMLGTRLNFAGSSRYATAAPTTGAHXIVSLFSKKPAPKPKPAAVTSSSPDIGDXLAKWYGPDRRIFLPEGLLDRSKXXDYLNGEXPXXYXYXXFXLSXKAXDXQXXAYELXRQXXMLXXAGNIP

SEQ ID NO: 200773 - protein, 154 aa, Triticum aestivum
  unsure (1)..(154): unsure at all Xaa locations
  Clone ID: PAT_TA_95191.pep
MAAMAAAAKLTAAASSLLLRRSPLLRPHGLRLSRRFAPQRFVRHIASSTNEEAAAKAAAATADTGGPTIFDKIIAKEXPSNVVYXDEKVLAFRDINPQXPVHFQSSQKIRDGXTXTRQXEPSILNGLPIRRKIWEGSKVRFSTTKEHHLNSVGR

SEQ ID NO: 200774 - protein, 112 aa, Triticum aestivum
  Clone ID: PAT_TA_95192.pep
HTSPRPPPSTPVSSPAAGADLHPASRGGAGVLLLLPPHSLTGEHPNPSHPASASASNFVSSPAACADPHPASRGGARRPPSTSTASSLAATAIRPHSVGPPVGLRYKWLEVC

SEQ ID NO: 200775 - protein, 51 aa, Triticum aestivum
  unsure (1)..(51): unsure at all Xaa locations
  Clone ID: PAT_TA_95193.pep
XXSHXXXXCGLDKESSLXLIWKLLLLLXEDPTVXKAXSQTIXLLAXXTXVI

SEQ ID NO: 200776 - protein, 43 aa, Triticum aestivum
  unsure (1)..(43): unsure at all Xaa locations
  Clone ID: PAT_TA_95194.pep
MRAPSSPWPPPSSCLAPPSPPPPXTSPSSTRPSHPPAGPTRPG

SEQ ID NO: 200777 - protein, 81 aa, Triticum aestivum
  unsure (1)..(81): unsure at all Xaa locations
  Clone ID: PAT_TA_95195.pep
LLHFSDLDLGCLEAWLXIAVAPGIEELTLMFPCVRYKFPCSLLFERGXNXVRYLHLMGCTFXPTIGLXCLTKLTXXHLSFV

SEQ ID NO: 200778 - protein, 125 aa, Triticum aestivum
  unsure (1)..(125): unsure at all Xaa locations
  Clone ID: PAT_TA_95196.pep
GAVVAANIVAGXXWXXPEXXVGIFXPXXAETPSXXAAPNPRCPREISSAGAGRRPTSPGXSKTXTPPLSXSSXFXREEAQFGYGSGGRRRKKECNRRGKSFLGFFKNVFILTRKLFFISYNIFLC

SEQ ID NO: 200779 - protein, 134 aa, Triticum aestivum
  unsure (1)..(134): unsure at all Xaa locations
  Clone ID: PAT_TA_95197.pep
MGNRTSRHHRAAPEQPPPQPKPKPQPQQQQQQWPXPQQPTPPPAAAPGRGDXEGAGGXPMEDXXXTXPSGRELGRGXFGVTYLVTHKARGTLXLQSIATPELAHRDDIEDXRREVHXAQLTGXANLNSGGPGPH

SEQ ID NO: 200780 - protein, 84 aa, Triticum aestivum
  unsure (1)..(84): unsure at all Xaa locations
  Clone ID: PAT_TA_95198.pep
AYVRGGEGDPHQRLRGGLRRAGDGGAGHRQAGAXGXGXGKGGTCCAXRXTCCIXXRWPFXAXXPLLAXYXLHXXLAVHLQSTLX

SEQ ID NO: 200781 - protein, 132 aa, Triticum aestivum
  unsure (1)..(132): unsure at all Xaa locations
  Clone ID: PAT_TA_95199.pep
GIARGNKKLQERVPIRRTAWRLADLAILFLLLALLLHRVLHDSGAPWRRAALACEAWFTFMWLLNVNXKWSPVRFDTFPXENLXERIDXLXAVXDMFXTXAGPXXEPPXVXVXTGAVALALYYXAASWLSFP

SEQ ID NO: 200782 - protein, 72 aa, Triticum aestivum
  unsure (1)..(72): unsure at all Xaa locations
  Clone ID: PAT_TA_95200.pep
MCGGAIISGFIPPSAAAAAAAAAAKKQQGRRVTADVLWPGMCXRGKAAVXREXDFXADFRXFERGIHTQGLG

SEQ ID NO: 200783 - protein, 173 aa, Triticum aestivum
  unsure (1)..(173): unsure at all Xaa locations
  Clone ID: PAT_TA_95201.pep
MAASTTCPARSMASVSRALRPRPHAAIASAAVRTAARLGGGLGIVCSMPSYGRKEKEEWGLTIASRXPATTAAXGSENCQLLXKAEANISSNLPXEAFXSEPNQYXENIELLTSFPCXXHIXTLWXYXNPGTXLERXLTVANASMGQMTPIESDQGCGDSHIVTSIAILAPEW

SEQ ID NO: 200784 - protein, 90 aa, Triticum aestivum
  Clone ID: PAT_TA_95202.pep
LAPPPRHLPFSNGTGGGCPAAAAAAPSPPPTTSTSSPTAPCPSPTSPRPPARPAPRARPLGSCASGSWIDRLARKLLLRDLSPLLCFGMP

SEQ ID NO: 200785 - protein, 188 aa, Triticum aestivum
  unsure (1)..(188): unsure at all Xaa locations
  Clone ID: PAT_TA_95203.pep
TFXXXVEDSSAEIXGYXXAPTXXLXNLRIXPFXWXWGXXSXSYPXKRXSXXXKHLVXXSPRVIXXXAVIKXEGLLAXXXAPGPPRLPPADXNISCFSPSAXLLSPLXSPXXFKCXXPFSNFXXFISAXSFPPASVLPLLVTGISFALSAAAPPSCSTAXSFASMPSGFAESFTESTVSAASSMPSSLC

SEQ ID NO: 200786 - protein, 59 aa, Triticum aestivum
  unsure (1)..(59): unsure at all Xaa locations
  Clone ID: PAT_TA_95204.pep
XTMXXTXXXAXSARDXPPVXPPRGARGPVHVPPXXXPAHXPRXAAARTRSAAASRAPAV

SEQ ID NO: 200787 - protein, 67 aa, Triticum aestivum
  unsure (1)..(67): unsure at all Xaa locations
  Clone ID: PAT_TA_95205.pep
MGIDLVAGGRNKRTKRVAPKSDDVYLKLLXVKLYRFLGEEDQEQFNAVILKRXFMSKTNRRRLHAPL

SEQ ID NO: 200788 - protein, 167 aa, Triticum aestivum
  unsure (1)..(167): unsure at all Xaa locations
  Clone ID: PAT_TA_95206.pep
RCRCVSSPPPHLPPDSGGSSEMSDTDEHHFESKADSGASKTYPQQAGAIRKGGHIVIKARPCKLLRSPLQDWGSMAXKXTLLQLXXLMERXFRXXSFNXXXVNSPMFNRQXFXXLXKLNNGXQPFPLKRXNTKMTELPTKXFCLANKTVSYXRLIXCXSXXVKKXSL

SEQ ID NO: 200789 - protein, 83 aa, Triticum aestivum
  unsure (1)..(83): unsure at all Xaa locations
  Clone ID: PAT_TA_95207.pep
SNIVSSLRQVFQLLXQHQLKIKLSKCTFARMSLLYLGHEISGDGVHTDNRNIAAVAKWPTPATVKEVRGFLGLAGNYRKFVRN

SEQ ID NO: 200790 - protein, 158 aa, Triticum aestivum
  Clone ID: PAT_TA_95208.pep
MEPYQCREISWINYESDVLQIHWIDAWRYNLSLIPPIRLIMHLCNAKLSWDIPDYEVGTRHDPWFEDSKGFSKTITFGARSSSSASCLMAKVSEVTERSSSEFSDCESDDDESDDDIEPSYTKLVCIPTKQQHALEKVQNMLDKRDDMLGEEMDRTKA

SEQ ID NO: 200791 - protein, 80 aa, Triticum aestivum
  unsure (1)..(80): unsure at all Xaa locations
  Clone ID: PAT_TA_95209.pep
APCVGTPLVSISLMADHTDGTPLLTIFFTKLEAPPGDSASLLVLTSNGAPHTLCATINKFFFTFFFKTSNGTPWIXXRHY

SEQ ID NO: 200792 - protein, 55 aa, Triticum aestivum
  Clone ID: PAT_TA_95210.pep
SHMATGLSLSRRDHPCLLVPTRQMPCQYLIMLLMQRSKLCFFTCVRAFCFHCKTV

SEQ ID NO: 200793 - protein, 95 aa, Triticum aestivum
  unsure (1)..(95): unsure at all Xaa locations
  Clone ID: PAT_TA_95211.pep
AASKVCHSLGGGTGSKIREQYPGRMMLTFSVFPSPKVSDTVVEPYNVTLSVHXCVENADECMVLDNKALYDICFRTLKLTTPSWEVTTFFPLLKK

SEQ ID NO: 200794 - protein, 114 aa, Triticum aestivum
  unsure (1)..(114): unsure at all Xaa locations
  Clone ID: PAT_TA_95212.pep
GPSLRNFVESPRGLSRSXARXTXCSPSRLHSXXXXSPSPAANTRIGCNXGXRLFSFKGXGXHSIGATLTPFIPVSIXRPDTXVNARGHQIWPXRRPPQGGXLQXXILFRHHNGL

SEQ ID NO: 200795 - protein, 131 aa, Triticum aestivum
  unsure (1)..(131): unsure at all Xaa locations
  Clone ID: PAT_TA_95213.pep
HRESILPSDLRPGCMMRMAAKECDSLGWVINPRLPQNGFRPHKNGSDVRMIRWEPKLGLSGRSTRCFLVRRNTNIFGVHADAPTTDITCLSSLXSPGFKKAFGSLPSPSYNTXVRXXSQAXAVATXWQPTP

SEQ ID NO: 200796 - protein, 77 aa, Triticum aestivum
  Clone ID: PAT_TA_95214.pep
ISVGVRHTHAIKQSPGAISGDLGREVDGRWRSKGSPSRDYTHRGLIARLSYSNSYPARRLLANKKGDAWRHVNGTSK

SEQ ID NO: 200797 - protein, 171 aa, Triticum aestivum
  unsure (1)..(171): unsure at all Xaa locations
  Clone ID: PAT_TA_95215.pep
XXCWGCXRRFPXFXPIXISPTXXPHILGATEXWKXYFXXVTGXXPXDXFVXVHSLXVPVGVRSXXXDSXWRAEQAYSHPCLXSRPLQXNKDLLGCSVASLXVWVWVWVXLSLSCLSQLAHGRVLIGWTGGRSXTAGAGGVYVYVTSPSPSRPPPRYLAPATGQAGRRGQPN

SEQ ID NO: 200798 - protein, 104 aa, Triticum aestivum
  unsure (1)..(104): unsure at all Xaa locations
  Clone ID: PAT_TA_95216.pep
HLRPFFFNTNPFGLKKRQTCLGKADRQXVEAYVDDVVIKTRHLDSLIDDLRLMLTNLXTYDIKLNPEKCVFGVPAGKLLGFILSSRGNEANPAKIRALSQLATP

SEQ ID NO: 200799 - protein, 98 aa, Triticum aestivum
  unsure (1)..(98): unsure at all Xaa locations
  Clone ID: PAT_TA_95217.pep
PGXSGDSWXXFLXGGFGKGFXGAVPFXNFGXXFRXTXHFXEHRGXQFXSXXXKRXXFKLXRKVFXGXXPXLTXPXCVXXFSXKXCACHLGQPCHFSVD

SEQ ID NO: 200800 - protein, 104 aa, Triticum aestivum
  unsure (1)..(104): unsure at all Xaa locations
  Clone ID: PAT_TA_95218.pep
LLXGMLTETECVXNSTRLXDSSINSTRYXYAYSMYFXILKXEANXSFSXXLXHXXRVYILHAWENTGXNIXVLSTKNDXEFLXXXTXTTYNXXKXSXXTXRADX

SEQ ID NO: 200801 - protein, 73 aa, Triticum aestivum
  unsure (1)..(73): unsure at all Xaa locations
  Clone ID: PAT_TA_95219.pep
LNCVLTXAXCXYIXHLEIYXXTVGLXXMXSILWVKRWGXSIPGXXNHXIQIPXFKNFLRGPFGQQGLXXXLPG

SEQ ID NO: 200802 - protein, 149 aa, Triticum aestivum
  unsure (1)..(149): unsure at all Xaa locations
  Clone ID: PAT_TA_95220.pep
VLLPTRTTAAGARLTSAHGSRAAHAVTTSGAAAARQPLXMGMARALLPQRAPLLRRLLMAGALAAPAPVPPRPPSAAPXXAXXRVXXGXXGXAAGKTPSXSXLPSPSAPXARPWXPSXRXXTVXPXLXXXLXLXYKLLKKPAXHXYTNX

SEQ ID NO: 200803 - protein, 65 aa, Triticum aestivum
  Clone ID: PAT_TA_95221.pep
SFILAKRISYHFNKIGVNINHLKISLEVAPLFLHLLLFTGVSSVTLVVVKVMLRLLKISSNLSIQ

SEQ ID NO: 200804 - protein, 78 aa, Triticum aestivum
  unsure (1)..(78): unsure at all Xaa locations
  Clone ID: PAT_TA_95222.pep
ANQRSKSILGTQMYFVHEHDTFSSLKNKLIYPQHISPMHKXVXIFCXAXGAXIFXPSGXISXTLXXAXYFXKATXKFP

SEQ ID NO: 200805 - protein, 112 aa, Triticum aestivum
  unsure (1)..(112): unsure at all Xaa locations
  Clone ID: PAT_TA_95223.pep
MATETETFAFQAEINQLLSLIINTFYSNKEIFLRESSXQSSDALDKIRFXELTDKSKXDAQPXXFIHIIPDKATNSXHIVRQXIGMTKXDFVNNSGTSQVGTRFMELPAGRS

SEQ ID NO: 200806 - protein, 49 aa, Triticum aestivum
  unsure (1)..(49): unsure at all Xaa locations
  Clone ID: PAT_TA_95224.pep
EFFFFFFFFFFFFFFFFFCXLLXXVPLKYNNXFXXHWFXQFKITXTXTD

SEQ ID NO: 200807 - protein, 66 aa, Triticum aestivum
  unsure (1)..(66): unsure at all Xaa locations
  Clone ID: PAT_TA_95225.pep
LGXTPXEXQGGAXHXQXDGXDEREPVIAPWALXTDGFCXQHDKXXLVKCWXCLFGHQETXVCCXLA

SEQ ID NO: 200808 - protein, 78 aa, Triticum aestivum
  unsure (1)..(78): unsure at all Xaa locations
  Clone ID: PAT_TA_95226.pep
TGGIHVFLIRHFPFFLFQFCISSSEEALNLDVAPKSLLPPLVNLCPAEGILSFQAGKKQAARARTRPRXLRLPNNLSC

SEQ ID NO: 200809 - protein, 79 aa, Triticum aestivum
  unsure (1)..(79): unsure at all Xaa locations
  Clone ID: PAT_TA_95227.pep
TKIWCWTIGFPXSSAQYXRGVYPNFIKPLXXAKIXXQTRQSGXYGFLNAERYVILLFNIRNAFPKKIVPLSVPFFGLSC

SEQ ID NO: 200810 - protein, 115 aa, Triticum aestivum
  unsure (1)..(115): unsure at all Xaa locations
  Clone ID: PAT_TA_95228.pep
RTKSYSFLCXIPLHQNSWKSSPLGXFPIPDVFHSLFLXKHLAILSRQALSKEILTLKKCFCATSITLDPGHXPYLAQLPGPSTNAQLKRAEINNDGVQESPSRIAKLSGTSLLVI

SEQ ID NO: 200811 - protein, 99 aa, Triticum aestivum
  unsure (1)..(99): unsure at all Xaa locations
  Clone ID: PAT_TA_95229.pep
AVXALPDSSAAGGFXGNESWTHCTWAHVVPIPMDADLRVKGTPSLTPPTXLITCVASXAPRTXAVPXCPNNGRPXXPGXHXAPXXXPHLVDXGKDQLDR

SEQ ID NO: 200812 - protein, 112 aa, Triticum aestivum
  unsure (1)..(112): unsure at all Xaa locations
  Clone ID: PAT_TA_95230.pep
MLDKLWDDVVAGPRPETGLDKLRXAAATQPLAINTAAGEAIKQSPSMPTTXTTPVTPSSSXAPXRRQLWRSVFHPXSNLGHQKLGXXLFDRXXQLXTVXDXFXSDETRTNNA

SEQ ID NO: 200813 - protein, 60 aa, Triticum aestivum
  Clone ID: PAT_TA_95231.pep
MGRISKKSEKNATIFRNLFSPEDFFAWDLANQLSVHCRSAHINQHGSDFPSPTKITTNML

SEQ ID NO: 200814 - protein, 136 aa, Triticum aestivum
  unsure (1)..(136): unsure at all Xaa locations
  Clone ID: PAT_TA_95232.pep
TLQHQQAGGKQRKHNNQMATISAAAATTVVARAAIARPQALGLPQLRTRSERVRCSYSKDAKEATPAAAVRGAGASLLAAXGRGDRVRXAGAGAGXTSGCXRXDRAXPGAXQQLLGGSPGRPXAQLVLXTSTLRLX

SEQ ID NO: 200815 - protein, 58 aa, Triticum aestivum
  unsure (1)..(58): unsure at all Xaa locations
  Clone ID: PAT_TA_95233.pep
ACRXXETVLFXSXTXPXFVSCXXLXXASXQRTRRVTGCXXXLXRXVGHYSICVYGXSR

SEQ ID NO: 200816 - protein, 131 aa, Triticum aestivum
  unsure (1)..(131): unsure at all Xaa locations
  Clone ID: PAT_TA_95234.pep
TFKGIIPGVEASCTGSVTLEVVFGSPDNFQSEELIFDIVPFPXGYHALLGQTAFAKFNAVPHYAYLKLKMPGLRGSHHGQMGNMETPPERRNIQRSPKNSEQLLKFPSPAFNDRTRQTAWSKSTKTTGSFR

SEQ ID NO: 200817 - protein, 123 aa, Triticum aestivum
  unsure (1)..(123): unsure at all Xaa locations
  Clone ID: PAT_TA_95235.pep
MASIAGSAVSFAKPVKAINTNSLSFSGPRRGNAFLRLQPVPMRFAVCCSXAKQDTVEKVCEMLKKQLXVPESTEXCGTTXLXTXGADXLGHVQIVXGLQEEFKLXVEETIRKFSDLHIFLSTG

SEQ ID NO: 200818 - protein, 104 aa, Triticum aestivum
  unsure (1)..(104): unsure at all Xaa locations
  Clone ID: PAT_TA_95236.pep
MXSIAGSAVSFAKPVKAINTNSLSFSGPRRGNAFLRLQPVPMRFAVCCSAXQDTVEKVCEIVNKHLAVPEGTEVCAYTKFSDLGAESLDXVEIXMGLQEDSCKR

SEQ ID NO: 200819 - protein, 115 aa, Triticum aestivum
  unsure (1)..(115): unsure at all Xaa locations
  Clone ID: PAT_TA_95237.pep
MCQAWSAGPGWRRRILPEEARGFARIRVIPFGAGRRNXPGMAFGXAQHGXAXXXLLYHFDWELPDGAEPGELDMAELLGLTTRRRFDLLLVPAVRVPLPKQNLNAPSENSFDIKP

SEQ ID NO: 200820 - protein, 67 aa, Triticum aestivum
  Clone ID: PAT_TA_95238.pep
NPGGGMESGGEEAVSVEDLEDPEVEALVGDEYGVAASRIHAHYPPVTSSRAEASAAGGRKAKTAGED

SEQ ID NO: 200821 - protein, 149 aa, Triticum aestivum
  unsure (1)..(149): unsure at all Xaa locations
  Clone ID: PAT_TA_95239.pep
PPWGPKXGGXPPHLXXXSXVNSCPWKLVPKXXLXVHPFDSFXIIXLGNXNRQENAXXWLRIIGLSQKYLKVFIKXLIIQNRXYNSMNASLIIDTLQTYHYASLCEGPIFYFYLLPLYKSHGDHHLSFLHFFLWQALCVGAIRIYISTWM

SEQ ID NO: 200822 - protein, 77 aa, Triticum aestivum
  unsure (1)..(77): unsure at all Xaa locations
  Clone ID: PAT_TA_95240.pep
SXAKXXIPTXRASQKCCAXQVLDRKPSALWXLFXFPKSPDQCLFRCLEMVVPLVWQRQKVDSASFAKHQFWTKRKRV

SEQ ID NO: 200823 - protein, 61 aa, Triticum aestivum
  unsure (1)..(61): unsure at all Xaa locations
  Clone ID: PAT_TA_95241.pep
VVTILXVNXESCEYGIKXYALRVCLXAXXXGXVIAYVAGSCRNSKQSXYLSIXAXAELESE

SEQ ID NO: 200824 - protein, 59 aa, Triticum aestivum
  Clone ID: PAT_TA_95242.pep
FFFFFKGEKCFNFCLHQSGEQNTGGFVTRVYVPKVHRASTRRLNSYVRRVSETDISKCY

SEQ ID NO: 200825 - protein, 187 aa, Triticum aestivum
  unsure (1)..(187): unsure at all Xaa locations
  Clone ID: PAT_TA_95243.pep
AGYRSALRHPRYLSQEYESHASQALPLGRSARPAPREPPFAAVSWPPAAAVAAMMVGSSALNGFAGANLDARRRRARSCRTAVKLTTVPPKXDRACFHRPCCCSVPGXTXRPXPXFSTLGLNIXGNGNKPTLRXXAGFLXLXPGXVSMFFXQPWAQXXEQXATLXWIYNLXANSQSQQLSIDGXTGS

SEQ ID NO: 200826 - protein, 96 aa, Triticum aestivum
  unsure (1)..(96): unsure at all Xaa locations
  Clone ID: PAT_TA_95244.pep
STXTWTTVWPDXLTSLDXYKGXCYHIXPVAGEXXXWXCYVTYPLXLXXEGSVTIMFTSIXXNXFGFKXLRALRLXDLRLXPTYXKTFXXXPHXIQV

SEQ ID NO: 200827 - protein, 102 aa, Triticum aestivum
  unsure (1)..(102): unsure at all Xaa locations
  Clone ID: PAT_TA_95245.pep
XHYPRGXXXKATINPXCTIXXXKNLGFXPXPXAILIQXSRAQFXSKXXLDWXKXXNHXTSGEXPGGRTIPQXXLPAKASFNSXGNLVPLTLXXPSTGKQGXV

SEQ ID NO: 200828 - protein, 110 aa, Triticum aestivum
  unsure (1)..(110): unsure at all Xaa locations
  Clone ID: PAT_TA_95246.pep
PPSQLRLGSIMQGELLRRILRWFLAFGIWGGQIGEEKKLFIMMSLIKNGHLWAEMVGRWVHTPVIARSYARVAREGKFLFQSGYWALFMKGNNPRFNTXNPSFFETQRHN

SEQ ID NO: 200829 - protein, 55 aa, Triticum aestivum
  Clone ID: PAT_TA_95247.pep
LHHHRQADCLTILPMPFIPGTQSRQCSKLTSNFPHHIVCLERQLCIMRWHLIYGL

SEQ ID NO: 200830 - protein, 139 aa, Triticum aestivum
  unsure (1)..(139): unsure at all Xaa locations
  Clone ID: PAT_TA_95248.pep
TVVPRSPPTSAYDHRNIEFKGGLSRSHSYGVLPMDRIKNLAVHFPDEFVADLKARVGXRCSTFQCLLSHAWKKITAARDLAPDXFTQVRVAVNCRGRAXPPVPMASFXKWXPGFPRMQVXDSCQSNYQRALHPGAPPEQ

SEQ ID NO: 200831 - protein, 127 aa, Triticum aestivum
  unsure (1)..(127): unsure at all Xaa locations
  Clone ID: PAT_TA_95249.pep
LINFPNKMFCEISGSFPRTFVSCTLNNTIAILAEKHRQSRVKXPXKXMQAKSPKTKGKMFWESNXFGEXSQGGTAXVXXLSSXPHLWPSSLXXXHNXXKGPRLXIXLGXTXFWGTLFGLXGFPWXQX

SEQ ID NO: 200832 - protein, 82 aa, Triticum aestivum
  unsure (1)..(82): unsure at all Xaa locations
  Clone ID: PAT_TA_95250.pep
ARRLEAYIKVVRELLDDGELVQETDEDLVEQGDEAVVQAALPLGGSSKYWXXPPCPGASRRHGHLXSRLISCSSPPMGXLNS

SEQ ID NO: 200833 - protein, 74 aa, Triticum aestivum
  unsure (1)..(74): unsure at all Xaa locations
  Clone ID: PAT_TA_95251.pep
LLSEAYQIPTARNHHYVLMNVIITPHKIXNASCQGDVXFAPNDSQQILVGGQXCLPSRVCXRGAFLKLPSXPKX

SEQ ID NO: 200834 - protein, 184 aa, Triticum aestivum
  unsure (1)..(184): unsure at all Xaa locations
  Clone ID: PAT_TA_95252.pep
LAPPTPLERPTAHQAVPDYFVCSLRQPDTRDFWGLRDYLLASSDLERPSAATLRGRPLLEWRSLGEGVSLSIISGKKIPRRRIIXEGLEAELQDNCGCFLKRKKIHTLTNKNFGITYXXLRFXSLAAXAQXTPRGKTSVGILSRLEAXFRXLRXILSPRCLLXXNAPGXXSKMGACYRISPXTS

SEQ ID NO: 200835 - protein, 196 aa, Triticum aestivum
  unsure (1)..(196): unsure at all Xaa locations
  Clone ID: PAT_TA_95253.pep
QHRPRDPTRTNPRAASHLPRSSSFSPSTQSTQPLIHPFVAAGWRSNGHQSARASHSARFRSDRGLHERSPEFRFESPPLPRPRQSLPDRRTTASAVSLQQETTTMASPXMGXRRDKRLHGPDADRFSRQLLLSERSKSPTPCXSSPHQTXTLHARXCSLQXNCXAQXASRLENDPGXWXRISCVAXXXPXXSARVV

SEQ ID NO: 200836 - protein, 168 aa, Triticum aestivum
  unsure (1)..(168): unsure at all Xaa locations
  Clone ID: PAT_TA_95254.pep
MANPRVFFDMTVGGAPAGRIVMELYKDAVPRTVENFRALCTGEKGVGKSGKPLHYKGSAFHRVIPDFMCQGGDFTXGQRNRRRXIYGEXSPXEXFSTXHQPGIXSMXNAGPTQXSHSXSELPCNWVXGXTXLREVXEAXLVKKSKSATDCQTVVSTMRLIAAAVPFPL

SEQ ID NO: 200837 - protein, 60 aa, Triticum aestivum
  unsure (1)..(60): unsure at all Xaa locations
  Clone ID: PAT_TA_95255.pep
QXRXPWLEXQRSXPAXRGXRQGGCTSPLLXAPSYXSSXCTCAXPILNLSTEIKWMGCRCG

SEQ ID NO: 200838 - protein, 78 aa, Triticum aestivum
  unsure (1)..(78): unsure at all Xaa locations
  Clone ID: PAT_TA_95256.pep
MGGGNAQKSKMARERNLEKLKGGKGSQLEANKKAMNIQXCKICMQTFICTTSEAKCKEHAEAKHPKSDLRXCFPXLKQ

SEQ ID NO: 200839 - protein, 57 aa, Triticum aestivum
  Clone ID: PAT_TA_95257.pep
RRAGNGRKTCGMPTYAYLPGPLDGSFKHHLLTVHQSVHASSSTIVYQHHAVYTDLLS

SEQ ID NO: 200840 - protein, 94 aa, Triticum aestivum
  unsure (1)..(94): unsure at all Xaa locations
  Clone ID: PAT_TA_95258.pep
ANRNTGCSPXPPSXVVPXLLLTQMQSIHXLGIESSTKASLSCSNLREDVARRTVKKQQVRLKKKQVDIFVLRRGCRPPPRQARASLACRATSTP

SEQ ID NO: 200841 - protein, 97 aa, Triticum aestivum
  unsure (1)..(97): unsure at all Xaa locations
  Clone ID: PAT_TA_95259.pep
MNCNRRNFTCTMRLFVILSEQISFHLHMQAVCHTQTTSCPNKIPLFLQTMVVGLLVAMVKEKVSSYMLDXYMVMKGMETQHKILNLNLLPVILSHHQ

SEQ ID NO: 200842 - protein, 174 aa, Triticum aestivum
  unsure (1)..(174): unsure at all Xaa locations
  Clone ID: PAT_TA_95260.pep
MSGRKKTREPKEENVTLGPAVREGEHVFGVAHIFASFNDTFIHVTDLSGRETLVRITGGMKVKADRDESSPYAAMLASQDVAVRCKELGITALHIKLRATGXGNKTKTPGPGCSSXRLRALARSGMKIGRXEDVXPVPLTPPEGVEEGVIQARWKIQAIISALELVVHLDVNSI

SEQ ID NO: 200843 - protein, 73 aa, Triticum aestivum
  Clone ID: PAT_TA_95261.pep
SNSRPQGKYMHHTHVHGDFLLMYILFARKTHEHVGTFPIFTSFALMHIAKIHVTHLLTLSCLCIHMLLHSIFT

SEQ ID NO: 200844 - protein, 65 aa, Triticum aestivum
  unsure (1)..(65): unsure at all Xaa locations
  Clone ID: PAT_TA_95262.pep
GEXXXGXEMXVPRTAXCXCXQCKCGXXLGMPLPAAGRSLXIDHXMHRACXXDXXDLLXLYXVTAT

SEQ ID NO: 200845 - protein, 158 aa, Triticum aestivum
  Clone ID: PAT_TA_95263.pep
MPTHSLRACWILRQVAKSGEDLLINNTAEHRPVENKNIVLTVFETFASNNRRKRALRSLAEVCHVAAINPWNDTAITFNANDEPQFRTARAPAALVLSPIVDGFRPTKMLMDGGSGLNLIYKETLSKMEIDKSRIEQSNTTFRGIIPSREARFAGKSH

SEQ ID NO: 200846 - protein, 143 aa, Triticum aestivum
  unsure (1)..(143): unsure at all Xaa locations
  Clone ID: PAT_TA_95264.pep
QSKEILKYVTTCLKGKVVGWKAKXXSKAAREVLIKSGLQAVXTHTMSCFQLTKKMCRNLTSISSKFWWAATNGERKVHWISWRKMCTSKRDGGMGFRDPEAFNQALLAKQAWRILQVPSSLCARVLKARYFSSDSILMATATS

SEQ ID NO: 200847 - protein, 62 aa, Triticum aestivum
  unsure (1)..(62): unsure at all Xaa locations
  Clone ID: PAT_TA_95265.pep
IKMEGAXXTXYKHGLFSDXRIQLXMTALIQLIYQVMIIITTGXGVDGKWIRWKLXAAISFXL

SEQ ID NO: 200848 - protein, 123 aa, Triticum aestivum
  unsure (1)..(123): unsure at all Xaa locations
  Clone ID: PAT_TA_95266.pep
LSVNLLVGQIPPKLDLLSKLFYLDLSGNSLXGQIPPXLXFLKNLXYLYLGSXQLXGSIPDELGQLLQLXQLLLRNXKLTXXILTHAILNSLXSLKYLXLGSNMLRXALPXNIGDRCLISLNPL

SEQ ID NO: 200849 - protein, 68 aa, Triticum aestivum
  unsure (1)..(68): unsure at all Xaa locations
  Clone ID: PAT_TA_95267.pep
FAXECKCTWQVMLCGGHHQSVKTMHYAYKQITKIMICIMKNGRLQNDFMRDLSLHYRIADKVANDHQV

SEQ ID NO: 200850 - protein, 58 aa, Triticum aestivum
  unsure (1)..(58): unsure at all Xaa locations
  Clone ID: PAT_TA_95268.pep
NEVPXXEDMFHXXATIMGPSDXPYSGGXFLFTIHFPPDYPFKPPKVAFRTIVFHXNIN

SEQ ID NO: 200851 - protein, 110 aa, Triticum aestivum
  unsure (1)..(110): unsure at all Xaa locations
  Clone ID: PAT_TA_95269.pep
SDIVKSXXPDWXLVLXLGRGKGLIXHGRKKXNLVPLLKRVNIKHPLRSRLGLTYNLGVLDTVGLPTNRINKNPVIRGTRSPLWQDVSRNRLAICVELVKRNGLNNHRAMT

SEQ ID NO: 200852 - protein, 91 aa, Triticum aestivum
  unsure (1)..(91): unsure at all Xaa locations
  Clone ID: PAT_TA_95270.pep
IERNLGERALRALPEXACDAXRVXTLRPXVLAXVGTFWXXRGRDREEMGSSTVLYWRRXEERKRRRGSREMWVEARVRTGGGRLGLWAGLX

SEQ ID NO: 200853 - protein, 135 aa, Triticum aestivum
  unsure (1)..(135): unsure at all Xaa locations
  Clone ID: PAT_TA_95271.pep
AGXPXEXXDALGXYRXLWGIVRAPLGXMVATRGENRGASXDSXCLXPHGGSGRRLXXPPGRPVAALTAGDGNDEDAADGRXLGEARSDGGPAXGAGXTCVGHGCDGRRRAGWWTTNSGAPLPSAPNVGFRVPADP

SEQ ID NO: 200854 - protein, 161 aa, Triticum aestivum
  unsure (1)..(161): unsure at all Xaa locations
  Clone ID: PAT_TA_95272.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAXAYLVGLFEDXNLCAIHAKRVTSCPRTSTRPPHRGRPNCLSVNTYGSDNYPVLSLRQNFVKKYV

SEQ ID NO: 200855 - protein, 162 aa, Triticum aestivum
  unsure (1)..(162): unsure at all Xaa locations
  Clone ID: PAT_TA_95273.pep
MASRDLAESLLPGGGASASASSSHDEYEERAYDSDDKVSISISDSEPDDDGDPGAPRARPAFSWRKLWRFTGPGFLMCIGFLDPGNLEGDLQAGAAAGYXVLWLLLWATXMGALVQLLSARLGVVTGXLAELXREEYRLGXRALWVYGLRSSGYIKSIGTDA

SEQ ID NO: 200856 - protein, 89 aa, Triticum aestivum
  Clone ID: PAT_TA_95274.pep
VGAGRGRRRWRRSRGGGRGRRWSALRRRPAGGRRRGHGAAEPQVKKQRHKEDHGDTGDEAAAALAPSHAAGRRGGEEGSRGRGCGRKMG

SEQ ID NO: 200857 - protein, 78 aa, Triticum aestivum; identical to SEQ ID NO: 106962
  Clone ID: PAT_TA_95275.pep

SEQ ID NO: 200858 - protein, 95 aa, Triticum aestivum
  Clone ID: PAT_TA_95276.pep
MYLSTRPLSQAIQSRCREFLRPQNRRFDRKLGRTDIYSHDSSSARTPFTTLISPWLSVYHQQHLHHRVCTAVLVGESCCRCSTQRSSSTTLYYLQ

SEQ ID NO: 200859 - protein, 79 aa, Triticum aestivum
  unsure (1)..(79): unsure at all Xaa locations
  Clone ID: PAT_TA_95277.pep
ARPHPPATATCRPPPASARLSAAXAPPRRASGXLPRLPRRSSXRRGWRXVAGGGXSPGSGWRPPPPRXSTMLYARGRPM

SEQ ID NO: 200860 - protein, 102 aa, Triticum aestivum
  Clone ID: PAT_TA_95278.pep
RGNCKFSQCRTQLQDFKLNAQQQVCNLDDMTACNLNTMTYIIPLAPHNVSMHETYMPSSHHVCVPPRCDEKSEKGIEALVHVTHAAWCTGTNKLESNSTTFQ

SEQ ID NO: 200861 - protein, 165 aa, Triticum aestivum
  unsure (1)..(165): unsure at all Xaa locations
  Clone ID: PAT_TA_95279.pep
GQXCCYFDPDFKXYXGSXVHPYPTGLGGXNCXWFXKVXPVARLKXCCDGPNGVEGSFGVTSFAXASFSTNWLSPAAGPHESKVLRFLPENCARCSDFLMGESSASLASGGGCLLYECSNKEGFVRQMPLFDELGLRPAGLEGPCENPIFVGPLLVDPAVRALDVG

SEQ ID NO: 200862 - protein, 91 aa, Triticum aestivum
  unsure (1)..(91): unsure at all Xaa locations
  Clone ID: PAT_TA_95280.pep
QHKRLYCSQKTRFNGLGCSXHFARRYXRDRFCFLFLXGYLRCFSSPGCLLPAHGFSRQFKRLTYLGISGSMLIFNSPKHFVACYALPRLWV

SEQ ID NO: 200863 - protein, 116 aa, Triticum aestivum
  unsure (1)..(116): unsure at all Xaa locations
  Clone ID: PAT_TA_95281.pep
MAPVXVFGXEAFTNVERVLECLEEVSXXYEIVDVDFQSKEHKGPDHLARNPFGXXPXFQXXDLTXFHSXRAISRNXLXESQDPXKSTCXXERXXKELTFVGWTLHLLSTINIRLQD

SEQ ID NO: 200864 - protein, 89 aa, Triticum aestivum
  unsure (1)..(89): unsure at all Xaa locations
  Clone ID: PAT_TA_95282.pep
EIVAGCWQGLIXDDVGXXAXRCKVVVNIEQQSPXDXXQGVDGHFTKRPEEVGXGXQGIMXGYAXXETPELXPLSHVXXTKXGARXTEVR

SEQ ID NO: 200865 - protein, 107 aa, Triticum aestivum
  Clone ID: PAT_TA_95283.pep
IYPYDALHVSFPRMSSFLMVNPCALTGSPLPSFSTLFPCPSHARPRSIPCRRQWMWKWIPRMSEKHDHEAGSSSGSSGLRSAVVFSITPPATAARQMLYVKVEVCQR

SEQ ID NO: 200866 - protein, 133 aa, Triticum aestivum
  unsure (1)..(133): unsure at all Xaa locations
  Clone ID: PAT_TA_95284.pep
LASTTPTCAVLLWQAAASTSHRVAPASSRIHLPPRCYGERLASTCPHFAPVSDAPPPALERRLHRGLADEMLGNGLGGSCSRRHFLLHPVLFCWESRNFFCYDSHFKSVFGWEPLPNFCYHGFLATTVAXLXF

SEQ ID NO: 200867 - protein, 97 aa, Triticum aestivum
  unsure (1)..(97): unsure at all Xaa locations
  Clone ID: PAT_TA_95285.pep
MKGTKLAAILILQAVLVMGLLSHVNADFFPKCCNNCRSFSGVXDVCDDAHPKCPQGCSGVPXVVSDXPEMWRCADMKXTVDGTCGGPCKXTDSVMPA

SEQ ID NO: 200868 - protein, 105 aa, Triticum aestivum
  unsure (1)..(105): unsure at all Xaa locations
  Clone ID: PAT_TA_95286.pep
SWDMXQLYLYTKHGLSCHXAGVESSCPPFPXAXRQVERRCDESNXSPPLXPSXFTPPTLXNSPXASILQMRDGRCXXLPXKHHDGHNRPCXARRHGRHHKHHLPV

SEQ ID NO: 200869 - protein, 87 aa, Triticum aestivum
  unsure (1)..(87): unsure at all Xaa locations
  Clone ID: PAT_TA_95287.pep
IPQSVVESKRQEFRNLKQGSLSVYDYNKLFQKLARFAKQDVPDEKSMIYQFRGGLREEIQLALVLFEPXEIHEFXNMALXQEAAHLC

SEQ ID NO: 200870 - protein, 150 aa, Triticum aestivum
  unsure (1)..(150): unsure at all Xaa locations
  Clone ID: PAT_TA_95288.pep
MSPXTXTKXXVGFKAGVKDYKLTYYTPEYETKDTDILVXFRXVSPQSXVPPXEEAGAAVXAEXSSTXTWXTVXTDXLTSLDRXKXRXYHIXPVAGXDRQWICYVAYPLXLFAXGSRSSMXTXNGGNXFXFKALRVXRLXDYXFPSKTSRP

SEQ ID NO: 200871 - protein, 128 aa, Triticum aestivum
  unsure (1)..(128): unsure at all Xaa locations
  Clone ID: PAT_TA_95289.pep
AQHIYVKLTVFNXDCIVSXSGLPYVVLVXDSRDPALPLRPSEAQAAVPRRRAGVAVARRSPTPVRSSLPNQGPAPRPGPASGVAPTDRTPRRSCPSRDSAAAAGSRPATRLPRHGRRTDHDGPAAAPA

SEQ ID NO: 200872 - protein, 102 aa, Triticum aestivum
  unsure (1)..(102): unsure at all Xaa locations
  Clone ID: PAT_TA_95290.pep
EPYAPKPAAEGRGYWRWHXDDFFXEPSFASWGAYRSAXAXTPXXXRXRFXGRSIXXIILXRCXXHXENXILRSXXGVDLTXFGFLSHHXXGIFXLIXHDXHE

SEQ ID NO: 200873 - protein, 91 aa, Triticum aestivum
  unsure (1)..(91): unsure at all Xaa locations
  Clone ID: PAT_TA_95291.pep
MGPVKEXAXMEEGTLEIGIEYRTVSXGVAGPLVILDKVKGPKYHXIVNIRLGDGTTRRGQVLXVDGEKXVVXVFEXXSGIDXKYTLLIQES

SEQ ID NO: 200874 - protein, 78 aa, Triticum aestivum
  unsure (1)..(78): unsure at all Xaa locations
  Clone ID: PAT_TA_95292.pep
IXRXFXHGGLRLYESVYGXGXIHPDAKXPPRQGSPIRTRVKPSILIFTAHQSGPXYTDRTPEDPIIQDSLSSPRTCLQ

SEQ ID NO: 200875 - protein, 128 aa, Triticum aestivum
  unsure (1)..(128): unsure at all Xaa locations
  Clone ID: PAT_TA_95293.pep
QQQQQILQQILQQQQLIPCRDVVLQQHNIAHASSQVLQQSSYQLLQQLCCQRLWQIPEQSRCQAIHNVVHAIILQQQQQQQQQQQQQQQQQQQQQQQQQQQQQQQXXQQQQQQQQQQQQQQQPSSQVS

SEQ ID NO: 200876 - protein, 122 aa, Triticum aestivum
  unsure (1)..(122): unsure at all Xaa locations
  Clone ID: PAT_TA_95294.pep
QALSAPAFLSNQAVAEAAWGSGDAHVQSTTTRRPRPQAFGGPRHSVLDLWLRLEAKPERALGPGATVGVLGTGGPQTCLPAAHGVAVLASLLRXIFINKDSRPPRXXPXXQIXXIXSLXTAL

SEQ ID NO: 200877 - protein, 87 aa, Triticum aestivum
  unsure (1)..(87): unsure at all Xaa locations
  Clone ID: PAT_TA_95295.pep
RPRXVELSPLXCCDAPIXLXRDXFARVRRAGMPPVRDMRSVDPIAAXXKVNAIXCTPGIXSPVRCTTYGLRRRLRMTHHRVEVCYKQ

SEQ ID NO: 200878 - protein, 120 aa, Triticum aestivum
  Clone ID: PAT_TA_95296.pep
GQLVTYSKLLVGLSCLVKKGSEYGGDNRERPHVRAQLTYNLIIGRFCRLGAGGEGTDIFGFMRKNECEPNAFNYATLINGHCKKGEVEDAKLVFEEMRTAGVEPDAVSYTALIGCLCRHG

SEQ ID NO: 200879 - protein, 88 aa, Triticum aestivum
  unsure (1)..(88): unsure at all Xaa locations
  Clone ID: PAT_TA_95297.pep
MKSTKLAAILILQAVLVMGILSHVNADYFPKCCNNCRSFSGVDVCDDAHPXCPKGCSACRXGDADPHKXGAPDMKTPFXGTAAXQCXT

SEQ ID NO: 200880 - protein, 166 aa, Triticum aestivum
  unsure (1)..(166): unsure at all Xaa locations
  Clone ID: PAT_TA_95298.pep
LFSPPPLRPRTTTIGEKPAGSGEGNQSPCPRPSSPDQIPGGPARSRRRGPARPXIGPGKAPEPRRLKXARSAWDGSGVPEEALHLXVLGNFDXRATAKRLAGFRRWHTSTPLNAXXXTXPFCYPCXPARLVARFPRLXSXXKGXPRAIXAIPTWGAYXPWVPXAAP

SEQ ID NO: 200881 - protein, 130 aa, Triticum aestivum
  unsure (1)..(130): unsure at all Xaa locations
  Clone ID: PAT_TA_95299.pep
LXNSREEEXVHGKSPEXRRFMEARSSLDFCAXDGRSASLQRRRQQAXWLMAALPIFACCVAGQRXPASLQRRQQQGTLHGSVAVVALSRRRQRRPASLQHRRQQGTLNGSVAVLALSRRRQQRPRFIATS

SEQ ID NO: 200882 - protein, 54 aa, Triticum aestivum
  Clone ID: PAT_TA_95300.pep
FPLHIKVKIVLPNIRSLIRMPFQRLHPQKLEILQGSNSRVIWLKFEDYKVQTDI

SEQ ID NO: 200883 - protein, 93 aa, Triticum aestivum
  unsure (1)..(93): unsure at all Xaa locations
  Clone ID: PAT_TA_95301.pep
TIXQTNPDQIXLXNLTXFNFXNIXPNFNPFPRXNKRNPRXXHLPSLESSKXXLGKPPCSXXXNVPDGAXXTXPLRRXAXPXXFQSSKFPEESR

SEQ ID NO: 200884 - protein, 118 aa, Triticum aestivum
  unsure (1)..(118): unsure at all Xaa locations
  Clone ID: PAT_TA_95302.pep
GGNFWPIKRXHXQLQSLXGAIEGFGXXYLXLGKCXMTGILHSQNLLHPGFXTVWLEFXRPMGHAAXSXFTPLSHISHXVAIIGFFCLMWICRLRPSILSLPRNLSVFRMQSIKVSLKT

SEQ ID NO: 200885 - protein, 110 aa, Triticum aestivum
  unsure (1)..(110): unsure at all Xaa locations
  Clone ID: PAT_TA_95303.pep
DGFEPQPSTPHCHNGHDLALPPDSAQSAAQVSAPTLSSEPTTPAEDGWLDAASGGYNIYSDSSPNTXLSFCEVXDPKVPGSFSRTPKSFXTLSDFEPFXPDXRIQRXRIF

SEQ ID NO: 200886 - protein, 154 aa, Triticum aestivum
  unsure (1)..(154): unsure at all Xaa locations
  Clone ID: PAT_TA_95304.pep
AARLVRRCLGPSKDFKSPRTPELDASRLHLRPPMQQAGVXKXGPHPXAASNSXDPVLGKLPXQRPHPQXGFPVXRPVPXPTPPSNSRFRCQAVPXTPXLXQRFXWQQLTXTPPLXXRFXXXTATKXPPLQSRPGEQXXTKPFPKPTQWFNHGPK

SEQ ID NO: 200887 - protein, 126 aa, Triticum aestivum
  unsure (1)..(126): unsure at all Xaa locations
  Clone ID: PAT_TA_95305.pep
VPANLLHNHPPHTKKYILPQLTITYSNVXLCSTTDTTKVPWEFIXSDDMQQLITYDYGCXQPKVXVXQXLIRANTXTTXTGIHGTAFPCXIIXIHTQXQTLCLSGXMXLRXXQYLQXAARPPXWXT

SEQ ID NO: 200888 - protein, 56 aa, Triticum aestivum
  unsure (1)..(56): unsure at all Xaa locations
  Clone ID: PAT_TA_95306.pep
TGSXCLXXGXTKHRXKXPPFSPGXXPSKRDXXKRXLWSPFVVPTGTKGGISPGWSH

SEQ ID NO: 200889 - protein, 88 aa, Triticum aestivum
  unsure (1)..(88): unsure at all Xaa locations
  Clone ID: PAT_TA_95307.pep
MSTEKKQLNPMRDIKVQKLVLNISVGEXSGDRLTRASKVLEQLSGXSPVFSKARYTVKAFGIKXVNEKIALLLXIXGXRKAMXCWXSG

SEQ ID NO: 200890 - protein, 114 aa, Triticum aestivum
  unsure (1)..(114): unsure at all Xaa locations
  Clone ID: PAT_TA_95308.pep
AIPQFSTISNLVXYFAHAWLXPFXRTXNDXLEGFNQVTXSFXWTNNTHSFCASISVXTXXXQPAVLLXLXGXSXTLRXWXKIPFLQXTWKVKEXRSGFPIPKLGSVXNQRXXXF

SEQ ID NO: 200891 - protein, 70 aa, Triticum aestivum
  unsure (1)..(70): unsure at all Xaa locations
  Clone ID: PAT_TA_95309.pep
HQGNTNARXFCPPFGLPLATFTXRFLGKLYGNPESRARPACSDSDFKNSPFSRGPSRALPTSSXXSFFLI

SEQ ID NO: 200892 - protein, 93 aa, Triticum aestivum
  unsure (1)..(93): unsure at all Xaa locations
  Clone ID: PAT_TA_95310.pep
AAPRALRCPASCRRVSGGDRRCPFILNWWFPQLHQRANLEKEGQDMTHLSNFLTRGWWWXEXLMGAAEPNQFKRADXRTVKNYIPQTSPRYIP

SEQ ID NO: 200893 - protein, 93 aa, Triticum aestivum
  unsure (1)..(93): unsure at all Xaa locations
  Clone ID: PAT_TA_95311.pep
MKGTKLAAILILQAVLXVMGVLSHVNADYFPKCCNNCRSFSGVHVCDDAHPKVPQRAAPACRXGVQRAPEMWXACADMKPTXDGTCXGPAKXY

SEQ ID NO: 200894 - protein, 151 aa, Triticum aestivum
  unsure (1)..(151): unsure at all Xaa locations
  Clone ID: PAT_TA_95312.pep
MAPTVMASSATSVAPFXGLKSTAGLPVQPPLXTALASAASATVEGXRCMQCWPSEGXXKNXXTLSYXXTAQHGGLPLSKSDYLXIPSKLXPXLRXXKFXSSSRXXNHPXGYNNXXYWKCXNCLFSDEPTQQVINKVEEXXKDYLTPIHNRF

SEQ ID NO: 200895 - protein, 163 aa, Triticum aestivum
  unsure (1)..(163): unsure at all Xaa locations
  Clone ID: PAT_TA_95313.pep
STCGDVYSFGIVILEMLTGKRPTDDSFENGLNIVSFVQVSFPXDQILKVTDAALQEEXRALYTIQYSNRERXIRVLVHLLGGGLPCTRQHQXXRINMKQATAAFNQGICQRTASFSSPERHPKGHCINFPFYITSMEKYTSLLYNIFIMSIISKNPCKRFCIS

SEQ ID NO: 200896 - protein, 162 aa, Triticum aestivum
  unsure (1)..(162): unsure at all Xaa locations
  Clone ID: PAT_TA_95314.pep
ELSNSXLFXSVICHPGFXEXAIILNSGTFPFTNQLGFPLENMHISLNSRFFLPNSRTNFGFNDQFLKSQVNYFIKMWNIFSPLIFFNSRNCFLKFDIFPLKFRNIFLLTNIFLKFVNIFSEIDKNLLFNEYIFSDELFCNWKSFVYFQNIYFKRSSLSKKCS

SEQ ID NO: 200897 - protein, 100 aa, Triticum aestivum
  unsure (1)..(100): unsure at all Xaa locations
  Clone ID: PAT_TA_95315.pep
XPCAALVQCLFALHSCLETLGIQFCSLLCXNCKLSRAPIIVDMLLWIFGLGRRWSQSGNSLAVQPTPCSSPFQQHSHFLADSDAVNSHSIEIQICFVLSV

SEQ ID NO: 200898 - protein, 66 aa, Triticum aestivum
  unsure (1)..(66): unsure at all Xaa locations
  Clone ID: PAT_TA_95316.pep
FXGYFYALXKHHLGYLSMKDSPFFSFTFYFLPFTIVYFFIKXWLFTSVLIGVLPPIQNKCRVLNQS

SEQ ID NO: 200899 - protein, 43 aa, Triticum aestivum
  unsure (1)..(43): unsure at all Xaa locations
  Clone ID: PAT_TA_95317.pep
SAYWXLCXSVXXVXXAXEAAXPXYXXWIFPFVSXPNYGNPRLG

SEQ ID NO: 200900 - protein, 39 aa, Triticum aestivum
  unsure (1)..(39): unsure at all Xaa locations
  Clone ID: PAT_TA_95318.pep
MEEXXYRCXEGGXAWATDDXNLQKAXSXYXXIXXAKIIX

SEQ ID NO: 200901 - protein, 136 aa, Triticum aestivum
  unsure (1)..(136): unsure at all Xaa locations
  Clone ID: PAT_TA_95319.pep
KLKAQQDIVDTSQRIYWQLGDLEHVFETXQVIMFWPPDADDLSHIVPATRRSNPQIWIDSLIKKNQIVECPDTEALAAFKHSVRDEWLTRHLGQEKPKTMAALTALMTRFCTSEDSWLARRSNSTSDPGTSEARDG

SEQ ID NO: 200902 - protein, 97 aa, Triticum aestivum
  unsure (1)..(97): unsure at all Xaa locations
  Clone ID: PAT_TA_95320.pep
ALKPHXKIXRPNPGESDXRDGGSACLNTEAGSTTFESFTEPISLKLMRRLWNTASXXGXSLXRRCXETWCGXRQHXGSGPXSXRXAPQESTRRPDNR

SEQ ID NO: 200903 - protein, 84 aa, Triticum aestivum
  Clone ID: PAT_TA_95321.pep
HGKKTDPFVAHHLLAKIEKVNMKEEKETIVTWSRASSILPTMVGHTIAIHNGKEHIPIYITNPMVGRKLGEFVPTRHFTSYENA

SEQ ID NO: 200904 - protein, 82 aa, Triticum aestivum
  unsure (1)..(82): unsure at all Xaa locations
  Clone ID: PAT_TA_95322.pep
MGAYKFVSELWRRKQXDVMRFVQRVRCWEYRQXPAIXRXPRPTRPDRARRLGFKGQARVCGSTRIRVKRXGKKXAMPKGIVW

SEQ ID NO: 200905 - protein, 68 aa, Triticum aestivum
  unsure (1)..(68): unsure at all Xaa locations
  Clone ID: PAT_TA_95323.pep
MSRTGPIAQDXEPVVVRKKLXNAAAKXDEXAXNAXRRAGVDIDIAXKHXAGTNXAAHSTTXLNXKSFH

SEQ ID NO: 200906 - protein, 99 aa, Triticum aestivum
  unsure (1)..(99): unsure at all Xaa locations
  Clone ID: PAT_TA_95324.pep
YNIQKESTLHLVLRLRGGMQIFVKTLTGKTITLEVESSDTIDNVKAKIQDKEGIPPDQQRLXIFAGKQLXRMGRTLXADYNIXEGXTFHFXVXLRLVGN

SEQ ID NO: 200907 - protein, 79 aa, Triticum aestivum
  unsure (1)..(79): unsure at all Xaa locations
  Clone ID: PAT_TA_95325.pep
IVFXKCLTMGFQSISWLIKQNHPLHCLSNQGNPTSSIPSPEYAHXNAALPKRLLVNCLQAGMKGYNELCIKSNSFCHLR

SEQ ID NO: 200908 - protein, 82 aa, Triticum aestivum
  Clone ID: PAT_TA_95326.pep
VPNPSDHLAFILVPPLILGLSCFSGGAALPVGSFGDRGPQCGGSCNTACRSLLAYRRPPRPGKRHTRQPPCRGHLPWVSWWR

SEQ ID NO: 200909 - protein, 85 aa, Triticum aestivum
  Clone ID: PAT_TA_95327.pep
RCLISEDYSQLSLIIEDDIREELRRFCIEVARFGDLCEDPQWHNLDRCGSALTVTSKNNSSEEHLPFAYLIKLGTKYMGSAPKKC

SEQ ID NO: 200910 - protein, 101 aa, Triticum aestivum
  unsure (1)..(101): unsure at all Xaa locations
  Clone ID: PAT_TA_95328.pep
KINGAXHSARTXGFQNHXVGNXSAFKXETTAKTGSXKPEXNVRXITKLXXXNAXKPRFSQXRXGGEXGLNRRKXXMXQSYPVTLXEXXESSXSGXVXQSSF

SEQ ID NO: 200911 - protein, 133 aa, Triticum aestivum
  unsure (1)..(133): unsure at all Xaa locations
  Clone ID: PAT_TA_95329.pep
ERTSLEFFFFFFFFFFFFFWALAPGASGSGAWTPHSSTPRPNCSAARSGGXSSPRAXGGAAAAVPERFRNMQSRKILTHMIXDXQLIWEAXFXQKKFQNYGNRPNKXIKFPLAQPGLWAPLXPSKKNGNLLEI

SEQ ID NO: 200912 - protein, 97 aa, Triticum aestivum
  unsure (1)..(97): unsure at all Xaa locations
  Clone ID: PAT_TA_95330.pep
MQIFVKTLTGKTITLEVESSDTIDNVKAKIQDKEGIPPDQQRLIFAGKQXEDGRTLADYNIQKDPPSTWVLRLRGGAKKRKKKTTPSPKKQKHKHKK

SEQ ID NO: 200913 - protein, 130 aa, Triticum aestivum
  unsure (1)..(130): unsure at all Xaa locations
  Clone ID: PAT_TA_95331.pep
LGFWDEMNPIHVATVDQPIYLMERPADEIXSIRXILPKYNXNXXIKXLGNKRXXRAXTLAXNXLFNPGXPKDLEPQPGXPXTLTLXQPXXRGHXPTARPKANTPXVSPXNTHGSSQGPXLTXXNPXPRGK

SEQ ID NO: 200914 - protein, 79 aa, Triticum aestivum
  unsure (1)..(79): unsure at all Xaa locations
  Clone ID: PAT_TA_95332.pep
GVGQSYKSGRRRGAGLHQDIGXRXGXMXTSCTTXCXPXWCYYMXQPRXLGGXXGEPXPVAXPXPLPXSPCRAXAXGNCR

SEQ ID NO: 200915 - protein, 105 aa, Triticum aestivum
  unsure (1)..(105): unsure at all Xaa locations
  Clone ID: PAT_TA_95333.pep
PASRTVACSELRLREVKCRANKPQVACRARPARVWARAGRVGCAGSAATSACVWVARACSVRVHAVCVCDRWRWANRAGLARXSVWSHPVGRSPETRXWAXTLRI

SEQ ID NO: 200916 - protein, 96 aa, Triticum aestivum
  unsure (1)..(96): unsure at all Xaa locations
  Clone ID: PAT_TA_95334.pep
MSDTDEHHFESKADSGASKTYPQQAGAIRKGGHIXVIKARPXKVVXGSTPRLGKHGHANVTFVAIDIFXGKELXGIVPXSHNCDXPKFYRQISDLT

SEQ ID NO: 200917 - protein, 63 aa, Triticum aestivum
  unsure (1)..(63): unsure at all Xaa locations
  Clone ID: PAT_TA_95335.pep
CGACSIDYKTCDLHXQQTVLVQNSVQGKXXMGVQHXDXRVTXSXVGRMQYQSKXRIGKXTXVT

SEQ ID NO: 200918 - protein, 96 aa, Triticum aestivum
  unsure (1)..(96): unsure at all Xaa locations
  Clone ID: PAT_TA_95336.pep
GQAATPSTPPNKSPWFNKXQGTCLLRFTQGFNSAMXPSNLGNKXAGXKXVNRCNSQISRXFSNRLGFXLDYXKLSXECNVGKNLEDIGEXKCKXGX

SEQ ID NO: 200919 - protein, 165 aa, Triticum aestivum
  unsure (1)..(165): unsure at all Xaa locations
  Clone ID: PAT_TA_95337.pep
PMSPILFNIVVDMLAVLIGRAKENGQVGGLVPHLIDGGVSILQYADDTIIFMEHDLAKARNMKLVLXLFEQLTGLKINFHKSXLFCFXRAXDEXDAYRQFVCDVSXDSYHSQYLXDPNHHRXLTYREWKXIQTDTNELLGRLIHMAIILIIAHNIPSSSSLGQLV

SEQ ID NO: 200920 - protein, 44 aa, Triticum aestivum
  unsure (1)..(44): unsure at all Xaa locations
  Clone ID: PAT_TA_95338.pep
HCXEEKXGXMRERERERERERERERERERERERRMRRRRERWLV

SEQ ID NO: 200921 - protein, 70 aa, Triticum aestivum
  unsure (1)..(70): unsure at all Xaa locations
  Clone ID: PAT_TA_95339.pep
RIQKREFNVGDYVLLYNSPLRFFTGKLFSKWEGPXVIEEVYRSGAIKIYKFEGTNPRVVNGQRIRTIYLR

SEQ ID NO: 200922 - protein, 130 aa, Triticum aestivum
  unsure (1)..(130): unsure at all Xaa locations
  Clone ID: PAT_TA_95340.pep
VGLLSELLVTSVKLKTILSHNNKLEMVFWIKPRDRHATWKKLPCPFLNPCRIYYFQQTKLPHIHIWGFLLRNYIPWVNCPXHDSSPRQRDSQAMHTFPTFTPGRLLHKREVPTVGTIVAWNXVXGGAGRL

SEQ ID NO: 200923 - protein, 167 aa, Triticum aestivum
  unsure (1)..(167): unsure at all Xaa locations
  Clone ID: PAT_TA_95341.pep
MSTLLRRILCSTPAGASLSQHLPFATSSRRTPHRFRRSHRAPSQSPSPDAVSAAIAXLPSRPHPGRPPHPRSASTSDSAPLPVLTHPSAGHFRADPGLPRRHQALGTPVYTSRTGLFSPLSCVPGPLKAPLFGARESLVNGLATAGRANYKLRARPGESKIMKGCSK

SEQ ID NO: 200924 - protein, 49 aa, Triticum aestivum
  Clone ID: PAT_TA_95342.pep
VLLRPNRPQPSFDASPLGPGRRRFPRQIKVPTVSQEGGDKWGLRPLLFD

SEQ ID NO: 200925 - protein, 88 aa, Triticum aestivum
  unsure (1)..(88): unsure at all Xaa locations
  Clone ID: PAT_TA_95343.pep
PLNXFAFAXHQAKXLKXKLCPRXXLGVGPTSAXSKFRPSFPVPFHKSRPPXGLAXXITYXDTHCPTTCILHGMPGVHGTSAFXXGKYV

SEQ ID NO: 200926 - protein, 150 aa, Triticum aestivum
  unsure (1)..(150): unsure at all Xaa locations
  Clone ID: PAT_TA_95344.pep
HLGYSPALELGHSPALELGYSPTLELGHSPMLELGYIPALDLGSGPALVLGCKRYLECSPALDLGRKRTLPPGNNFKPEVWHENNKALIKARNLKGISDTRRVNSSDALRRFSRSKMRRFLNQFQDRRPKMKNXXKIQEVPTXDGQGXRR

SEQ ID NO: 200927 - protein, 56 aa, Triticum aestivum
  unsure (1)..(56): unsure at all Xaa locations
  Clone ID: PAT_TA_95345.pep
SPLLCCCRGSYRVRXSSVIPVVAAAADGGHASAXTPAXXRXXXPLXDXRRGRRHVT

SEQ ID NO: 200928 - protein, 51 aa, Triticum aestivum
  unsure (1)..(51): unsure at all Xaa locations
  Clone ID: PAT_TA_95346.pep
HRLPRCSSLXRQTKIYLCTXNRSAAAAVAEIARRRQGGIGRPVQRRSAGAG

SEQ ID NO: 200929 - protein, 155 aa, Triticum aestivum
  unsure (1)..(155): unsure at all Xaa locations
  Clone ID: PAT_TA_95347.pep
SLXQGVVXLXLDLTCRASXPACIGFLSPLFPFRRRARRTGQRRPLVDLSFLSPLFPFRLRARRRRQRWPLRRLWASCHRCSPFAAVPGDGGSSACLSSTLGFLSPLFPFAAVPGDGGSAGHSSILGFLSPLFRFAAVPGDGGSGGLSSTLGFLTG

SEQ ID NO: 200930 - protein, 112 aa, Triticum aestivum
  unsure (1)..(112): unsure at all Xaa locations
  Clone ID: PAT_TA_95348.pep
PMCVQRAACXYTXCFVVKCHXMXEARLQIICEYAIGAGAIKVYIDERSGPNHKRTSEPAYPMRMASVLLLHRCGSSAMKKDGITNVMDTRWQHKLCNFVICDPEDLCHAEVQ

SEQ ID NO: 200931 - protein, 66 aa, Triticum aestivum
  Clone ID: PAT_TA_95349.pep
FFFWHSFPFISAHNVFDRKNKRQLHDSWLCSFLKMFDFVRLPPISSFFGMTHAMSPQPKLSSLTRR

SEQ ID NO: 200932 - protein, 54 aa, Triticum aestivum
  unsure (1)..(54): unsure at all Xaa locations
  Clone ID: PAT_TA_95350.pep
MXRSHYNYMLYLXQXIVAXIKEEIKEEEXKKKXDWSWRALDIIPFLKRVTXYSX

SEQ ID NO: 200933 - protein, 105 aa, Triticum aestivum
  unsure (1)..(105): unsure at all Xaa locations
  Clone ID: PAT_TA_95351.pep
STYSRPYNLNPFQRAPLHDALLNTRPPPPPPPHPPPQPAPLLPPTAPXVVRRPFSVPSPVXPAQPEHGFPRFAAAAXKTKTRPTTARGEFCRGPRRNLQPNXANT

SEQ ID NO: 200934 - protein, 80 aa, Triticum aestivum
  Clone ID: PAT_TA_95352.pep
PTYPGSGGTNPVRTHPCVVRRHLSTGPSFRSYLRHLTLSGHSAIDVTHDARQLPPPALHPAHRTPSLHSAMPPITAAINV

SEQ ID NO: 200935 - protein, 91 aa, Triticum aestivum
  Clone ID: PAT_TA_95353.pep
VSSSPLPSTPTPRWPPPSLSASPPQSLPPPPLLPPPPRPRLLCAASSSPLLSATAWPPPLRLFLHATPVGRTIPILHQALLCAWVLDRPQV

SEQ ID NO: 200936 - protein, 115 aa, Triticum aestivum
  unsure (1)..(115): unsure at all Xaa locations
  Clone ID: PAT_TA_95354.pep
XSSITCXPXPTGTLXXLLSLGCRNLKGGCKIXPRGRSSYIHVLDPIVYFMSVFXIPKGFKTLGSVRRVSFWPRRKVYPVLQCLVALEKCVQPKNCGGLRPKXLHKQNNCLLMNSR

SEQ ID NO: 200937 - protein, 77 aa, Triticum aestivum
  Clone ID: PAT_TA_95355.pep
IKVQNNNNTALSWQCQNSSTRAGSTSKIFGKRSDQKGTYLMMGTISAVKAIIEGMTPVTNMDDSIHGDLLVHSPKMN

SEQ ID NO: 200938 - protein, 135 aa, Triticum aestivum
  unsure (1)..(135): unsure at all Xaa locations
  Clone ID: PAT_TA_95356.pep
CGFEWCILNTHKVWSSNKLKKNKSLCNKRVPYKTGILPKEIVRFYMXCIHFLPVTSQLLTHPMWGEMMIPCHPFNLFQXHLVXLFISSGHIVQKMNSLYTRFPXESKYFXKNXPFGTRXHHVXRYLPIFNHIIXG

SEQ ID NO: 200939 - protein, 68 aa, Triticum aestivum
  Clone ID: PAT_TA_95357.pep
EGVRKPTYLRMNYYPLTTQATELLAVLISHITIHLSVFRLHQHEGRGMNSDGKKYHYVKNSQKVVQFS

SEQ ID NO: 200940 - protein, 76 aa, Triticum aestivum
  Clone ID: PAT_TA_95358.pep
FIILILTDLTEGFVEFCVIEVSQVLGYLTMDVSGETTPTGSRRIPFAMVGGHGAVERAGLEDQHGGIIQVRAASDA

SEQ ID NO: 200941 - protein, 118 aa, Triticum aestivum
  unsure (1)..(118): unsure at all Xaa locations
  Clone ID: PAT_TA_95359.pep
RWXNLFPFLPSKXHQGFAHQXDXRTIKKGKQWEFENPQDDGRSRRSSSFFSCVDLFDAGRKPHCHPAPLTLRLMWAPPPSPAGFLSSSAVTPDISADSSLPCRAARGGVGVRSRVGDP

SEQ ID NO: 200942 - protein, 76 aa, Triticum aestivum
  unsure (1)..(76): unsure at all Xaa locations
  Clone ID: PAT_TA_95360.pep
PPPENTCIXGTLPKNPFMLRPFENLSLGTSXHFGYKRILLLWSRFIFPYTCFSLAQLVERVGKVKLELQLELLVIP

SEQ ID NO: 200943 - protein, 134 aa, Triticum aestivum
  unsure (1)..(134): unsure at all Xaa locations
  Clone ID: PAT_TA_95361.pep
FLHRSDPTSAQDAGQAVGRRGXPGLARRRASTKLRRAAATQPLRHQTQLQGKAIKQSPSDAERPPTTPGDAVRPPTPAAPAAAXXRSVFHPRGXPGQPKTSRANSFRPPAANPPXXLTTGFTTNQXKDKXNHAX

SEQ ID NO: 200944 - protein, 127 aa, Triticum aestivum
  unsure (1)..(127): unsure at all Xaa locations
  Clone ID: PAT_TA_95362.pep
GNTXPGFVITPXEXXLXPCXTIMLLXSXIPVGTSESLXLSSVGXLLXTPKVXRSARRICFHLFILHHGTCFWEAFKXICFGTMCFVIIRLCSFSFSCLLYCSCLGRARPRVYLSRRWVARSPGRAKR

SEQ ID NO: 200945 - protein, 111 aa, Triticum aestivum
  unsure (1)..(111): unsure at all Xaa locations
  Clone ID: PAT_TA_95363.pep
LFNKWNTYRPFPGWAVRSGEXQXSFLKPALXDQRVXGKKGRXPVPWFSCKWFPGTTRSLGMGFPXSTFCFXEIFEKIALWRAQYGWKVVSCVPGGSYCLSLASMVEPVGEA

SEQ ID NO: 200946 - protein, 85 aa, Triticum aestivum
  unsure (1)..(85): unsure at all Xaa locations
  Clone ID: PAT_TA_95364.pep
XPXLIWPDHLVETLGXPWFSGLXLTIFRXSAEFWSRXVXPFXVFPXKGKXPTGDFDIXHXXXATRXSXRERXXISGIRXFKRWCS

SEQ ID NO: 200947 - protein, 107 aa, Triticum aestivum
  unsure (1)..(107): unsure at all Xaa locations
  Clone ID: PAT_TA_95365.pep
MLVYQDKLSGDELLSDSFPYRELENGVLWEVXGHWVVQGAVDVDIGXANPSAEGGGDDEGVXDQXVKWFDMVXDTFRLQXEQLLFDKKHXTLNMKRYIKELNWQLRG

SEQ ID NO: 200948 - protein, 67 aa, Triticum aestivum
  unsure (1)..(67): unsure at all Xaa locations
  Clone ID: PAT_TA_95366.pep
FFYFWPKGXQKVIXGXXKXPNFGRSNXLSMXSGKKXXXGKQXKXWEKPXXRXKRXXKKIKEGNPKTE

SEQ ID NO: 200949 - protein, 163 aa, Triticum aestivum
  unsure (1)..(163): unsure at all Xaa locations
  Clone ID: PAT_TA_95367.pep
RRNXXTRRLAVWKPFFCVRSSQNPSMSAGPLCCPENPYLDLAAESGGCGLCTSQSPEGSRNGRLYWSXIPIVRERPTSVDXIAGLSGLELNRLSGLAMTDVVAHLWPERPKPKSYLGLLQQFLGAVPHIKAIKRSTCIEGARMALARVKTYWADMDATAVASR

SEQ ID NO: 200950 - protein, 119 aa, Triticum aestivum
  unsure (1)..(119): unsure at all Xaa locations
  Clone ID: PAT_TA_95368.pep
HIGYPKSIRSRSKTLXRXSQGTFXDMFLKGSKMDPVQRGFLXLSXGVKLRLKAGPTAEERERTKVVPYALAIGSIXYVVMRTAPYMCLAMCLERGYKSDPGVDHWTTVKIVLRGIRKCF

SEQ ID NO: 200951 - protein, 86 aa, Triticum aestivum
  unsure (1)..(86): unsure at all Xaa locations
  Clone ID: PAT_TA_95369.pep
MASIAGSAVSFAKPVKAINTNSLSFSGSKEGQXAFFRLQPVPMRFAVCCSTKQDTVEKVCELLKNTLLFPERTEXCGTTNSPDLWS

SEQ ID NO: 200952 - protein, 100 aa, Triticum aestivum
  unsure (1)..(100): unsure at all Xaa locations
  Clone ID: PAT_TA_95370.pep
QMLQFSQSYIYQGKYIVTWTQTLPPLHRPKXGSNLQPVGEYLAALLLGSYTKLTGFLPHXTYGPDXGKLLDSLXIHVFTMAKLSRPLXRPNFHSRXTPPF

SEQ ID NO: 200953 - protein, 84 aa, Triticum aestivum
  Clone ID: PAT_TA_95371.pep
EEIKQKRKHYKKLGRCPVGLLGHGRAITGLKGPADTQGSAQNLGPQACYIEKFKEVAAAGFINQCGCPSPGDVGLNFGVAARGL

SEQ ID NO: 200954 - protein, 97 aa, Triticum aestivum
  unsure (1)..(97): unsure at all Xaa locations
  Clone ID: PAT_TA_95372.pep
VLKFLGMQENTEAFXIPTNHLTSVFQIYRRKGRDEIPAAFYYCISQESHESSSXXTILPPIGSCAYGHCALIREDRMSISAALSLXEVARGQVKHEL

SEQ ID NO: 200955 - protein, 101 aa, Triticum aestivum
  unsure (1)..(101): unsure at all Xaa locations
  Clone ID: PAT_TA_95373.pep
VSSPKRRRSTAAAAMGKGARIAGPSRERCGAKTPKGGRKQGQRKKQPAXARAQQSASNXNRRFRHRRXSXXXKEAPAQLLPRINLVGLAAXSFFLFPXQLL

SEQ ID NO: 200956 - protein, 118 aa, Triticum aestivum
  unsure (1)..(118): unsure at all Xaa locations
  Clone ID: PAT_TA_95374.pep
RWECSPQQLCIGGPLSSSAFTGRTASYNNPRPVLLMVSHKFKEKPHVKGAGCTAHPLAKTLPLFVPRVLFKHDFRQLINCXQPKXVXAIWTXCRPDPSXXLSXXXCDTXXGKXWTARG

SEQ ID NO: 200957 - protein, 118 aa, Triticum aestivum
  unsure (1)..(118): unsure at all Xaa locations
  Clone ID: PAT_TA_95375.pep
CFLTRSNVCLGSCFTTASNIWEPTRPQEQYRQPRSNHDDTRRXETAAAPGAPARRILLLPPRYXLRNNAPSXVXSTLQLXGXEYRSGPLGRSRELHXKDRRRCEIPRRWEXLRGKKKT

SEQ ID NO: 200958 - protein, 64 aa, Triticum aestivum
  Clone ID: PAT_TA_95376.pep
RPNKLDVNDTQYDRTCKGSSSEDLQKDDESSSPHKVLALTWPVIWVQHAYNVLECIYSIAMSCA

SEQ ID NO: 200959 - protein, 83 aa, Triticum aestivum
  unsure (1)..(83): unsure at all Xaa locations
  Clone ID: PAT_TA_95377.pep
TSSXTNPHFGLWSKLQRGXKMIEGVRQMRRAVITRRRSPWXXGSSEELXCXTYGSYTLQGTRKXPSLRRASNSNSGKRTYGAQ

SEQ ID NO: 200960 - protein, 161 aa, Triticum aestivum
  unsure (1)..(161): unsure at all Xaa locations
  Clone ID: PAT_TA_95378.pep
RNPSRSVEPSAAAPPSALSFLLRSKMKFIAAYLLAYLSGNASPSAEDLTSILESVGCEIDNEKMELMLSQVKGKDITELLAAGREKFAAVPSGGGGVAVXAAAPAAGGAAAPAAESKKEEKXXEKEESDDDMGFSRSTNCGEVSEYQPWQETRSMMFNLNN

SEQ ID NO: 200961 - protein, 78 aa, Triticum aestivum; identical to SEQ ID NO: 106980
  Clone ID: PAT_TA_95379.pep

SEQ ID NO: 200962 - protein, 99 aa, Triticum aestivum
  unsure (1)..(99): unsure at all Xaa locations
  Clone ID: PAT_TA_95380.pep
MVAAAAAAVAVPHKVKKXINLFYCXXCXELALKVAAASDAIXLQSINWXNFPDGFXNLFIKXAHXIXGQHVXFLASFSSPAIIFQQDPRLQITQSVTLA

SEQ ID NO: 200963 - protein, 62 aa, Triticum aestivum
  unsure (1)..(62): unsure at all Xaa locations
  Clone ID: PAT_TA_95381.pep
MVXRAVVLEEEXAVSPRSSEXVGGAXXVGGEXRXRRVXXEMRXRSIPXRRNXKTXARXCXYY

SEQ ID NO: 200964 - protein, 88 aa, Triticum aestivum
  Clone ID: PAT_TA_95382.pep
MKGTKLAAILILQAVLVMGVLSHVNADFFPKCCNNCRSFSGVDVCDDAHPKCPKGCSACRVVSTSPEMWRCADMKSTSTALRWTCKKY

SEQ ID NO: 200965 - protein, 119 aa, Triticum aestivum
  unsure (1)..(119): unsure at all Xaa locations
  Clone ID: PAT_TA_95383.pep
CAMESILRAQQIQLGARPSMQCXDRVKRIYPVGHPTTGPWAIRTSLRGNKSFLTNYGQACLSYIRTYPTHISGQLVPNNXKVXAPTXQKXHGRHXXKSXXLKRXRYXTPIXFXXXXTET

SEQ ID NO: 200966 - protein, 195 aa, Triticum aestivum
  unsure (1)..(195): unsure at all Xaa locations
  Clone ID: PAT_TA_95384.pep
PPLRALLAGSHRLAWRGSSRRGRCHAGHRPLSAAAAGARRLAASSKRCRPRLVGAHAPXLRPGRRWHDQRGGRSAXPXAAPTRGISGFLXGDXVRVLHPCSKXGQPXKGLKANPKPFXQNPXGGXLGRGRAXGTAGKKXHXXXSQAXSTTKKXXTFCXXNXRMISTFRSEKASGNTXVNGLCIIRXCLQTGLVQI

SEQ ID NO: 200967 - protein, 162 aa, Triticum aestivum
  unsure (1)..(162): unsure at all Xaa locations
  Clone ID: PAT_TA_95385.pep
DIFHVPSFISLMCLVVLFFQGKQNQFNQIKLTSCCGLPSHILASCFMLQDTSRRLLXISLXTFNRVPLNQFXIXXLLPGAIKXSLXHXXPXLPMKXCQRCLVLDXMFQHQXLTXEMQXQIXXQXEVPTSIXXQKLXXSXXXIKEMRXFSXMVYXQMGIQVNH

SEQ ID NO: 200968 - protein, 147 aa, Triticum aestivum
  unsure (1)..(147): unsure at all Xaa locations
  Clone ID: PAT_TA_95386.pep
SAGVGFTLLRRXELGKMCPFCLLSPXIFRRTIXDPLXXIGCFDTDSRRLGRQSSSKNDRGLRSSQTPNGCDGRMRLQSQPSXGDGLLLRLGPKPREADPVTEGREVVSSFRLRVIVATVGRLASAALLPSFFLFRRRRPXGHQDEDV

SEQ ID NO: 200969 - protein, 183 aa, Triticum aestivum
  unsure (1)..(183): unsure at all Xaa locations
  Clone ID: PAT_TA_95387.pep
NTSPGRDPEARKFPKPNHIPSPSLLPRAHRPNPSSRLLACGAVWSSCLFALGLGHRSWDPGGTPDLGPAGFIPVHCFRRRQAARSRPREXNCWVXRXGLXSEKCIPRSHPRGPGGAGSGRIDGCRILXXLIXNSXRTSPXGAXLRVXALXTGPLXKXPXKINGWXVDATDXLXSAQAAIFHSK

SEQ ID NO: 200970 - protein, 78 aa, Triticum aestivum
  Clone ID: PAT_TA_95388.pep
MSCCGGNCGCGTACKCGNGCGGCNMYPEVEAAGATLLVSATATHKASSGGNGDGGRNGGCGCTQCKCGTSCGCSCCNC

SEQ ID NO: 200971 - protein, 182 aa, Triticum aestivum
  unsure (1)..(182): unsure at all Xaa locations
  Clone ID: PAT_TA_95389.pep
PCIEKMINIFRKSIRIIQLIYHGHKPRATVNKCPWPSTASRQVATTLSFHVISTPYISFPTSQFGPARQRSSNGTVALRRCCELEGSARRRGLQSRARSDTGALLVTQHASKGATXFLSAPGDAVRAPRQPRCCKXXPSXTAVATNTRLSTCCVQXSVRXEPXSHGXIRXGIXGHHQPPPSX

SEQ ID NO: 200972 - protein, 140 aa, Triticum aestivum
  unsure (1)..(140): unsure at all Xaa locations
  Clone ID: PAT_TA_95390.pep
MYLIRAPLNSSLGLGTKCLXCDLDGDLTLLVAXRSLXVRLSPVSXDSHLVASALGHASLRLGADLLSFSKSTPHSCHACSLGKHVRLPFSSSTSTSMFPFHVLHLDVWTSPVASISGYQFYLVVLDDYTHYVWTFPLKHK

SEQ ID NO: 200973 - protein, 91 aa, Triticum aestivum
  Clone ID: PAT_TA_95391.pep
TFAPVARLESIRLLIAYAYHHNFKLQQMDVKSAFLNGPLNELVYVKQPPGFEDPYFPDHVYQLDKALYGLKQAPRAWYDHLTELLQDRGFE

SEQ ID NO: 200974 - protein, 67 aa, Triticum aestivum
  unsure (1)..(67): unsure at all Xaa locations
  Clone ID: PAT_TA_95392.pep
XAPXTXGCXRXRRAWCAWXCAGELPXGXPPRLHRHHHVVXRXRGSPAGPSXPIXALSSLXXVDRATS

SEQ ID NO: 200975 - protein, 41 aa, Triticum aestivum
  Clone ID: PAT_TA_95393.pep
VPSDVMTLKSVGPTSSRLGGYWHMIIEYVQKILTRISFESW

SEQ ID NO: 200976 - protein, 113 aa, Triticum aestivum
  unsure (1)..(113): unsure at all Xaa locations
  Clone ID: PAT_TA_95394.pep
MAXHNEESVMDXITEKFHGSSSSSSSSDDDERKXGSXXSVKAKIYRLFGRXKPVHSVXCGGKPADLFLWRNKXISXGVLAGXIAIWLLFEVLXYISPPLARLHPHLGSSQRPS

SEQ ID NO: 200977 - protein, 89 aa, Triticum aestivum
  unsure (1)..(89): unsure at all Xaa locations
  Clone ID: PAT_TA_95395.pep
MKGTKLAAILILQAVLVMGVLSHVNADFFPKCCNNCRSFSGVDVCDDAHPKCPKGCSACRVVSTSPEMWRCADMKSTVDGTCXGPCKKY

SEQ ID NO: 200978 - protein, 122 aa, Triticum aestivum
  Clone ID: PAT_TA_95396.pep
HSSKRRRAPLNRLVKPSILSGGVSDGHKALAILLMAFRARSCTTDSSLSMSPRNLDTSSSGRPVNRPTTTKLWYYELCNNMSLSDGSKKSYQICRLSTSQSLFVRPITDPLTLYLQQQIMLF

SEQ ID NO: 200979 - protein, 100 aa, Triticum aestivum
  unsure (1)..(100): unsure at all Xaa locations
  Clone ID: PAT_TA_95397.pep
MKGTKLAAILILQAVLVMGVLSHVNADFFPKCCNNCRSFSGVDVCDDAHPKCPKGCSACRVVXSTSPEMWRCADMXSTVDGXCGGPCKNYDRSSPMICSA

SEQ ID NO: 200980 - protein, 69 aa, Triticum aestivum
  Clone ID: PAT_TA_95398.pep
VDVIFIVVNMANVLFLLFSCIIPMPVYCSSSGSNGPAENETWERMSHGDGTDLFGSQRPETPPWDASEY

SEQ ID NO: 200981 - protein, 32 aa, Triticum aestivum
  Clone ID: PAT_TA_95399.pep
TLIFTVFTTTHNNFLLLFLILFCVILSFSSKQ

SEQ ID NO: 200982 - protein, 170 aa, Triticum aestivum
  unsure (1)..(170): unsure at all Xaa locations
  Clone ID: PAT_TA_95400.pep
MVSLKLQKRLAXSVLKCGKGKVWLDPNEVNEISMANSRQNIRKLVKDGFIIXKPQKIHSRSRARRAHEAKXNGRHSGYGKRXGTKEATLPTKIXWMRRMRVLKRLLRXXRXAKKFDKHXFHDMXLKXKGNISKNKRSSWLPQIKARNKTRSFEAPTKQERTQRLGQTHIG

SEQ ID NO: 200983 - protein, 78 aa, Triticum aestivum
  unsure (1)..(78): unsure at all Xaa locations
  Clone ID: PAT_TA_95401.pep
SXTLWNXLRPCIPLTXVCYVVSFIXLVXCISWFFXLFCWFFYINKXFSGSAVVXFXLNXESMPVYFSCYPHXVTRGXC

SEQ ID NO: 200984 - protein, 152 aa, Triticum aestivum
  unsure (1)..(152): unsure at all Xaa locations
  Clone ID: PAT_TA_95402.pep
YLXEPGALQEHXQICPAVCLIRTILPAEDGSLTEKLFWSQYALAEHPVPMSDQLKQMVELHKTADQAMKGFIVRLWPGDVLPNSFFGLVRRLVDACPRLEVVKRSICIEGARRAFAHVKMQWVNLDAMKLIKEGPPKGKEHRHPEMYYEGVL

SEQ ID NO: 200985 - protein, 74 aa, Triticum aestivum
  unsure (1)..(74): unsure at all Xaa locations
  Clone ID: PAT_TA_95403.pep
XXLDGLRAKGXPXTLSIWCSPMXXFAEXSPXDALIKKSSTEVVSSLKCKFAFVSSSXELFVPVESKTNGYLRLT

SEQ ID NO: 200986 - protein, 43 aa, Triticum aestivum
  Clone ID: PAT_TA_95404.pep
DNPCSVLGSTDVLRPGPAAMKLAKFLAQRLSYPAFYSRQCVWD

SEQ ID NO: 200987 - protein, 67 aa, Triticum aestivum
  unsure (1)..(67): unsure at all Xaa locations
  Clone ID: PAT_TA_95405.pep
MDGLQRRPAAAAAASARGEGQPPGGQRVIHCDVEPAPRAWPGMXMLALAAVLVLXGLQFLPVYTLHA

SEQ ID NO: 200988 - protein, 44 aa, Triticum aestivum
  Clone ID: PAT_TA_95406.pep
GRSCSLDEGSAMMIPSPFTTYLLLLPMLLLQQSRAGSNSGRLIE

SEQ ID NO: 200989 - protein, 158 aa, Triticum aestivum
  unsure (1)..(158): unsure at all Xaa locations
  Clone ID: PAT_TA_95407.pep
CSNAANVTILSTISAITNXSSEDVASITDDAGLKELYMTGMYKSLKGHQTLCDVLKKQILNRNPRKEVLPLRGNSMLMEHIGSLSSTPKPHGLLQRDLQLIHPIYMALHVNLLILLMSHLTQTINCSKIRMVKYLLDKLALTAGRFPYEENLGSQKVS

SEQ ID NO: 200990 - protein, 76 aa, Triticum aestivum
  unsure (1)..(76): unsure at all Xaa locations
  Clone ID: PAT_TA_95408.pep
MFLTXLSVIVILAAXXVEXRNHRPDCXXFSCXPLDYVXPPFRXAXDXPXCGYQXLXLVXXDTNXXIRIDNPSYXCV

SEQ ID NO: 200991 - protein, 161 aa, Triticum aestivum
  unsure (1)..(161): unsure at all Xaa locations
  Clone ID: PAT_TA_95409.pep
SKHLDFTLTSGEDAVQLRHERGEAREETSEQEFQGSQTCRLVNVSTLVSPTGGGAVXVFTTNTRPLXPGLLRPXXHGMHVYMGHCGWEAXQDAARNYHLLDXHALFPEIQXILAAVEVTPAEVSEMLLRSEDVDVALRVLMEFIKARRSKTNDKHNDGITN

SEQ ID NO: 200992 - protein, 64 aa, Triticum aestivum
  Clone ID: PAT_TA_95410.pep
RKPKTDCHDKARAGRCSRGLKSLKTFSASGEESALPDLGVYSAPNSAFRILGASPKFKIVDFYG

SEQ ID NO: 200993 - protein, 70 aa, Triticum aestivum
  Clone ID: PAT_TA_95411.pep
FETEPAVDLDNPQPKNKRNDKRDFVARKHGKERETWVQKPMSFPRKSTKKKDDEEFERFAEMIRPVRILA

SEQ ID NO: 200994 - protein, 196 aa, Triticum aestivum
  unsure (1)..(196): unsure at all Xaa locations
  Clone ID: PAT_TA_95412.pep
NQIVDCPDAEALAAFKHNIRDEWLARHLGQEKPRSMAALTTLMTRFCTGEDSWLARSNNTSRNPSTSDTKDANSRPRHNRHKRHNNGDNVDXTSGQCRIQRSRFRSAEKAFKRXIPGXHLGXILXPPCQIQRTPDXHPXHQQRSWCSKXAGXLMPKTRTRXAYNDQXDPGRRNGRHKXSPQVKMXTCXQPHSXGWT

SEQ ID NO: 200995 - protein, 117 aa, Triticum aestivum
  unsure (1)..(117): unsure at all Xaa locations
  Clone ID: PAT_TA_95413.pep
RDXXXFRHXFXFLEEXXVMSIAIIFVSMGGXDQYFVSDCPLPFXXHXNGVLLXPGSAPRSRRRCARPSISRPTFSCRERQLGSRLPQLNLLRRATSRRRSGLPPGGSPPAAPPEALV

SEQ ID NO: 200996 - protein, 150 aa, Triticum aestivum
  unsure (1)..(150): unsure at all Xaa locations
  Clone ID: PAT_TA_95414.pep
VERSGVRSRQXPAPRQGDRCXAWSGSREFVRTCGCRPMRSRRPAASTPRXTTACSPSPSPKDDGRKAYGRIIPITQLMIQPTRMHHRLQSNTVPPYVVYYQVSPLLNYTSLKRTVRCRRYPGGVCMCRMEFWKISVNYTIDAVNPSFCID

SEQ ID NO: 200997 - protein, 161 aa, Triticum aestivum
  unsure (1)..(161): unsure at all Xaa locations
  Clone ID: PAT_TA_95415.pep
MQIFVKTLTGKTITLEVESSDTIDNVKAKIQDKEGIPPDQQRLIFAGKQLEDGRTLADYNIQKESTLHLXVLRLXRGGMQIFXVKTLTGKTITLXEVGSSXDTIDNVKAKFKTRRASSGQHASSRWQQXRMAHLADYNIQKXPPQLVSASGSILQNVTGRH

SEQ ID NO: 200998 - protein, 137 aa, Triticum aestivum
  unsure (1)..(137): unsure at all Xaa locations
  Clone ID: PAT_TA_95416.pep
NQIGKTIEAYIDDMVIKTKNVTGLVDVLRLTFENLQTYDIQLNPDKCVFGVPAEKVLGFIMSHQGIXANPAIIQACHNWRXPTKLKHVQKLGRCCGGLNRFISKVGEEKALPPTGAPNTPPTFQWDRCGNAWEEIKC

SEQ ID NO: 200999 - protein, 130 aa, Triticum aestivum
  unsure (1)..(130): unsure at all Xaa locations
  Clone ID: PAT_TA_95417.pep
HHPILWTLPLTTMICSFLRFQLYSFMLFVCPGCVFVCQRSTHPPPQPTPNGPCGQKPCFLFLFFCPLFFLVVGHVIPPLCFSSSFLSLFLCVHDLXNNPCLLNPGLALQVMNDAXEGEVVVCAYTRDKXI

SEQ ID NO: 201000 - protein, 105 aa, Triticum aestivum
  Clone ID: PAT_TA_95418.pep
GLNSSFFRCRSHSVPWMKCFPCSFASHQFILSECSSHLRRFVCVPINSRLSRHSNISIVPVHLISVHQSFSTVFSLQWALTHRSFPRILPDSSNFPRVILNPFQV

SEQ ID NO: 201001 - protein, 52 aa, Triticum aestivum
  Clone ID: PAT_TA_95419.pep
SSFFFFFLADPLLIVRLSYDSNPPKKEHRKTPPSIIFEGLLTVLCLVMKYLK

SEQ ID NO: 201002 - protein, 73 aa, Triticum aestivum
  unsure (1)..(73): unsure at all Xaa locations
  Clone ID: PAT_TA_95420.pep
AVTTXLLKNXCPXSTKKXQVNWAINXPKXPWQNCTXYRIVEWDXXLPDSICTXKTIILNXAKGLKXQXTXKKK

SEQ ID NO: 201003 - protein, 96 aa, Triticum aestivum
  unsure (1)..(96): unsure at all Xaa locations
  Clone ID: PAT_TA_95421.pep
AYPPCLXXDLDPCYFGSYLVFRVCXDLVPXAQPAPKQCFTLRCPSQLLRLNAFRGEPASSGFEWHFTPNHNSSADSSTSVGSDLCLVSSKLHPGHG

SEQ ID NO: 201004 - protein, 99 aa, Triticum aestivum
  Clone ID: PAT_TA_95422.pep
FFFSQTDFVMKIYRVMCIFFRFFLKLQIYDFRIFFSEKNEFHGVRARKIHSLLHVLCTIYCYSSIYALSLVVLSGRHGRSAFALPPATISVSVSIAPLS

SEQ ID NO: 201005 - protein, 74 aa, Triticum aestivum
  unsure (1)..(74): unsure at all Xaa locations
  Clone ID: PAT_TA_95423.pep
FVILRRISILNSANRVHIKARELLGLPCLLFINMKGVHRSPDLVLPPRPVSPGLLHCLVQCKKSKCLRVGLTXL

SEQ ID NO: 201006 - protein, 75 aa, Triticum aestivum
  unsure (1)..(75): unsure at all Xaa locations
  Clone ID: PAT_TA_95424.pep
MFLQLKCTSAPRAQMSLVNSKIVIIFFRIKDLYYQETLGVTINKGLTLQLLKXLNQTKSYSTFNPRIRTNYRYXF

SEQ ID NO: 201007 - protein, 74 aa, Triticum aestivum
  unsure (1)..(74): unsure at all Xaa locations
  Clone ID: PAT_TA_95425.pep
SGPWXILPPXSATLTAXPCMLWSFILTTPFEINNWSXRGLXNRTVSNTXTHXDPNTITQLATYQXNQWSKHCME

SEQ ID NO: 201008 - protein, 93 aa, Triticum aestivum
  Clone ID: PAT_TA_95426.pep
KLSFSFLREAFRSYRFVKLGDTEATLESKHVESARPGHSSVTPSLLGFHKVLVSVTPICNFWSDRKSLVHWPKPNRWDRFLQFGRSEMSTTKT

SEQ ID NO: 201009 - protein, 100 aa, Triticum aestivum
  unsure (1)..(100): unsure at all Xaa locations
  Clone ID: PAT_TA_95427.pep
GXLQWMRRKVEEXAGWXLGMLGRRLLLPNLAARKPMFPNPRNFCAVTQPKETYYLMNYMCFMRNIGGWIDAHLEKQDLLITPKLRGRELETMDIDLGAGI

SEQ ID NO: 201010 - protein, 69 aa, Triticum aestivum
  unsure (1)..(69): unsure at all Xaa locations
  Clone ID: PAT_TA_95428.pep
RCVDHRQTLMVVPEARWCPVFLVEXCCLKRLXRVRCQLWKPAYXLYTLPSPXLVMFQDSXSYNDLWLLV

SEQ ID NO: 201011 - protein, 144 aa, Triticum aestivum
  unsure (1)..(144): unsure at all Xaa locations
  Clone ID: PAT_TA_95429.pep
RSLRLLEXEPXFVDKEAXXXLDPHTLEEYDSCSAGRGRVGSAITLDQLIEXALLPPQPIAWYVRGITTRTTEMLVNDLIAETARLRGLASNGDANEHTEENRDVNGDVLTEDCNDVKERWRQRRKAGRHGSSLRLTQDNRGRIS

SEQ ID NO: 201012 - protein, 56 aa, Triticum aestivum
  Clone ID: PAT_TA_95430.pep
REPCTHRSYYSTTLIKHTLDFEWIEEQPEATHQRNNEKYGHEARDLNSLTSQCTTV

SEQ ID NO: 201013 - protein, 90 aa, Triticum aestivum
  unsure (1)..(90): unsure at all Xaa locations
  Clone ID: PAT_TA_95431.pep
MKGTKLAAILILQAVLVMGVLSHVNADFFPKCCNNCRSFSGVDVCDDAHPKCPKGCSACRVXVSTXPEMWRCADMKSTVDGTCGGTCKXY

SEQ ID NO: 201014 - protein, 97 aa, Triticum aestivum
  unsure (1)..(97): unsure at all Xaa locations
  Clone ID: PAT_TA_95432.pep
VDAYIXWMWILDXXXGNFVVLFXRSTSVKYVSLGLPMSLSCSAXSSXFXWCDICETKHXCLXNXNALSMFIPSXSQVFVGLLXFLPLCYCYPIKKTL

SEQ ID NO: 201015 - protein, 116 aa, Triticum aestivum
  unsure (1)..(116): unsure at all Xaa locations
  Clone ID: PAT_TA_95433.pep
XQTLLNVAXXSGXRXLMCXRXXGXAGNXRYXRIGDVXXXXIKXALPQMPLERSEXIRAVIVXTCKXFTCXDXXIIXYXDNAAVKNDQXXNPKXIXXFWPIAXEXKRLNFTNIVHLK

SEQ ID NO: 201016 - protein, 103 aa, Triticum aestivum
  Clone ID: PAT_TA_95434.pep
PFLSHWALLVALHETRGGGWGNRPDERRAVDLRAEGTGTGAAAISWRGRRKCSVERLGKARARRRSQTRPLERAGGRAGGRRSEEGRRVAPSHPHPSLAAAPR

SEQ ID NO: 201017 - protein, 114 aa, Triticum aestivum
  Clone ID: PAT_TA_95435.pep
SLGLNTVCLPPSIYLWICAWHSTILLRNTQLMEEHFLYWPSKLFAHFGNRCQWGRSFRECCGEVFRVSSCFGLVPKHLHLILMHHWLLHCMVMHNSLYKLPLKVIVINYQNGGD

SEQ ID NO: 201018 - protein, 128 aa, Triticum aestivum
  unsure (1)..(128): unsure at all Xaa locations
  Clone ID: PAT_TA_95436.pep
YSEYHSFTVLAVAWVVRLNTSSEDHLDLAKVPLMWALPPALAPSRWRTEERAGGEEEATIRGRWKAVGRCRQWQKWPNVRALDEFWVGPXPXXFVXGGRLDARKPRVWFRFVGFQTFSLGPDNFGERR

SEQ ID NO: 201019 - protein, 115 aa, Triticum aestivum
  unsure (1)..(115): unsure at all Xaa locations
  Clone ID: PAT_TA_95437.pep
MDHPAPRGSGGLPYEVGCPAFTCGLXSSQWPSHRTFKPDVGKKYNDKTHPSKFLSIYTIAIQAIGARDDKVLANYXPLALKPNVMSWLMHFPADSISSWSDLCHEFVGAFTGGQQ

SEQ ID NO: 201020 - protein, 188 aa, Triticum aestivum
  Clone ID: PAT_TA_95438.pep
PARARAGAVSRFVSAALEAHPGPFPFASFTCSFLDGADRRVLARWFQLLATKGVKQLIFANRPAPLPGLRLPSSLFSCAYLRRLWICAWVFPETSTLPRGAGFPNLREARPRPQRHGGQKTSSSARRPVLEISWPGTRPIDACLASPTGARNKLVRLDKSCGTPKERPSNNGQNQILALTGLWLNRRI

SEQ ID NO: 201021 - protein, 135 aa, Triticum aestivum
  unsure (1)..(135): unsure at all Xaa locations
  Clone ID: PAT_TA_95439.pep
KIPAASPPPLGGVTAALSYKTGDTLQRIYNLVCSMLLYYHSWDVLHHFXVILNHFWVXTIDIMPNCNLXFRTFFKSXGIXTXGSKXXKLLGIFWQKKQWSENPKGPRGXPKGLXASXLWLPPGXXTXXQKTIQNQ

SEQ ID NO: 201022 - protein, 104 aa, Triticum aestivum
  Clone ID: PAT_TA_95440.pep
LPSRTFPHPLPSEIPPCRRRRRYRSLRGPPPPDAKPTPSTAPPPPPPPHPASTRRSRGGRCPEAPSPPPPPPPPDAASPAARPPAPPPPTTWAMWRSRHGTRSS

SEQ ID NO: 201023 - protein, 91 aa, Triticum aestivum
  unsure (1)..(91): unsure at all Xaa locations
  Clone ID: PAT_TA_95441.pep
SMEXXXXNWVKGYLAXFFCXKXWVQNLIXAPXXPSXKFVCXKXISTLGYFGXXKXWXSKREFXASXXFGRVXTWXFGKGVIFRLWLCLGXA

SEQ ID NO: 201024 - protein, 100 aa, Triticum aestivum
  unsure (1)..(100): unsure at all Xaa locations
  Clone ID: PAT_TA_95442.pep
IWXTVIXDPXFCWPFNYVXGCFNNVGXDIFIVSPWDFPTSXSFXILSGPFKISSRAXEGIKPCKITEYKHNYITINTDCTQKNSGTNSKENIVLNPKGLV

SEQ ID NO: 201025 - protein, 53 aa, Triticum aestivum
  unsure (1)..(53): unsure at all Xaa locations
  Clone ID: PAT_TA_95443.pep
MAAPVTVXGPEXSXXVARVAACLLEKDXAFXLXAVDXSXGDHXSPSFLXLXPF

SEQ ID NO: 201026 - protein, 133 aa, Triticum aestivum
  unsure (1)..(133): unsure at all Xaa locations
  Clone ID: PAT_TA_95444.pep
RPCWRPRQSTCSSAAPVTMMTTGAARSQGSSWSSSTCWRRRCSTRPRAPRTARWSASTSAWRSGAQVGPGQAAXLWRQRLPXARRRSSRLSAAVQFLARSFRLRCXTAAQKRFPFNVXXFMXNXDICNCNXLY

SEQ ID NO: 201027 - protein, 93 aa, Triticum aestivum
  unsure (1)..(93): unsure at all Xaa locations
  Clone ID: PAT_TA_95445.pep
KXKXFTELVPGNPSMEPIXVPKLYAGXLHLEFIPDXCIRALCRICFYPISAIYSLMRYIAQEPLRCVLAQKFNMRLRIVIPSKTVLHFLNYLR

SEQ ID NO: 201028 - protein, 162 aa, Triticum aestivum
  unsure (1)..(162): unsure at all Xaa locations
  Clone ID: PAT_TA_95446.pep
XSCRVSGXSLVGPPCIGCRXRGFALGXGNLVXLAKKGCQQVXNRAAAASVHSRGVIRRXRDAGEPGVGNRCGDARRTVAGKKRRWRAMRCPSLTGPRDGRKERVAVLLGCPPGGAGSFRCARTTTARRRWRRVWMGKRAAARVGRKGEARVRRGRGRVLIHL

SEQ ID NO: 201029 - protein, 62 aa, Triticum aestivum
  Clone ID: PAT_TA_95447.pep
SCSDVKFLLTFFLVFQAYGTFKLFVCFQHKSCSATPNTFRDSAKSFSDIAIYASVLNSVFSQ

SEQ ID NO: 201030 - protein, 67 aa, Triticum aestivum
  unsure (1)..(67): unsure at all Xaa locations
  Clone ID: PAT_TA_95448.pep
PPAEQATRLSVPMRTLLNRTVLRYLMITSXFFNNPMLVSSVFAFFCYCCFCLQGGSTDGCILRGTGK

SEQ ID NO: 201031 - protein, 102 aa, Triticum aestivum
  unsure (1)..(102): unsure at all Xaa locations
  Clone ID: PAT_TA_95449.pep
LLLLDXHMXXGIPSWXCNGNQXTLTQGTIKMKXARYNGNXRFNVHTRSKEKTIQGGXRRISNLDXILNRSCQIHGTPIKPANHTNKVVGFLNKSTSLMPNTR

SEQ ID NO: 201032 - protein, 101 aa, Triticum aestivum
  unsure (1)..(101): unsure at all Xaa locations
  Clone ID: PAT_TA_95450.pep
TXTRSQAAIAQPNRXASPISSAXLDGRHFAGLRRPHPGXXXEAGVQGLRGDHQPPRCXXRADALXDDXPGLXXPXAGXRXXRXXXGARRSXXPFCXGVXLT

SEQ ID NO: 201033 - protein, 89 aa, Triticum aestivum
  unsure (1)..(89): unsure at all Xaa locations
  Clone ID: PAT_TA_95451.pep
LPVLASSLQLAISRRLGIEEPQLMKIVRTTLHTHTEWFKLQMCKDRFDHFLKIDSLKEIDPPVSRTMSKVLTDECGNXSSQXTHAQRAD

SEQ ID NO: 201034 - protein, 88 aa, Triticum aestivum
  unsure (1)..(88): unsure at all Xaa locations
  Clone ID: PAT_TA_95452.pep
MGRVIRAQRKGAGSVFKSHTHHRKGPARFRSLDFXERNGXYLKGVLTDVIHDPGVGAPLGKVTFRXPFKYKHKKXLPSRPRYVNRQFM

SEQ ID NO: 201035 - protein, 36 aa, Triticum aestivum
  Clone ID: PAT_TA_95453.pep
YIGIAPELAKEIAEEVDVIVNSAANTTFDERFVKLY

SEQ ID NO: 201036 - protein, 59 aa, Triticum aestivum
  unsure (1)..(59): unsure at all Xaa locations
  Clone ID: PAT_TA_95454.pep
PPLXXSSRMXRFVLLKIKQDPRVLMRWLRDIVHPFLSCNVYKWCTTSRSSSTWTEGVII

SEQ ID NO: 201037 - protein, 122 aa, Triticum aestivum
  unsure (1)..(122): unsure at all Xaa locations
  Clone ID: PAT_TA_95455.pep
HSTISHPSVLYDIVYLLWCNCNLQVPWRALVADLPSWVHACDAGAVHFSHSSAAAAGREADPGLRDVVXDAERLLXVFPMIAXLXVAAXXEARXGLSRPXAHCPAQLHLXPPAXHSTPXPQP

SEQ ID NO: 201038 - protein, 61 aa, Triticum aestivum
  unsure (1)..(61): unsure at all Xaa locations
  Clone ID: PAT_TA_95456.pep
LWXMLSLGXTHFXXVFVTXGKHLMLIAIRGSLDIYSCGIGSIWCPRLRMLIIXRKGSGSCL

SEQ ID NO: 201039 - protein, 77 aa, Triticum aestivum
  unsure (1)..(77): unsure at all Xaa locations
  Clone ID: PAT_TA_95457.pep
YSEFAWIWYRSAQPAXKQCFTPRCPSQCCASTHFGGDQLALGSEWHFTPNHNSSADSSTSVGSDLCLVSSKLHPGHG

SEQ ID NO: 201040 - protein, 98 aa, Triticum aestivum
  unsure (1)..(98): unsure at all Xaa locations
  Clone ID: PAT_TA_95458.pep
LGFIEVXLLXHNIHHVCEHSPXISLPGICLLLRLFXFDLDGSRSRLFSLMWRVHHREDNYLAWSMTALVANLRVRSIQXGYYLEGLGFGTCNLLGNGR

SEQ ID NO: 201041 - protein, 78 aa, Triticum aestivum
  Clone ID: PAT_TA_95459.pep
GGPSGADDLAKLKPLHWDKVNVAATDHSMVWDKLTGGSFNLDEGTIEALFGTAAVNRKTKSADADAFQRLARPEKQIF

SEQ ID NO: 201042 - protein, 78 aa, Triticum aestivum
  unsure (1)..(78): unsure at all Xaa locations
  Clone ID: PAT_TA_95460.pep
MIIIIEHCPMKKRKKRKKKKKKERPKKXNKKGGQRSPPKKRKKKKKKKKKRKGAMLSNFQNLCFKITSSKWFAPKPFK

SEQ ID NO: 201043 - protein, 197 aa, Triticum aestivum
  unsure (1)..(197): unsure at all Xaa locations
  Clone ID: PAT_TA_95461.pep
GRKELAAAKPKPKPKQIVQRKRAAEAHALLVLPWRGWGEVGKLREGSEAGEGCWWGQRAPEEFWGGNELLRRSLRDAGGGRRGDRVWQTASXRKGAGHVHLPDPWPSPXXCSRTGILSTAXLQXVNPIPPPAAXRRRRRRTQHTFGIKRINQGYXLXTFTXWTYNGGLLLITESQDSPRXSISKIQIYIHHKXLLLX

SEQ ID NO: 201044 - protein, 77 aa, Triticum aestivum
  unsure (1)..(77): unsure at all Xaa locations
  Clone ID: PAT_TA_95462.pep
RETPXAIXVVXPMXTTKIPREDTPSVAYETTGDQIHAAPSWAPWPCLAAASGSGEERERERNWEEGGGGRQGSREEG

SEQ ID NO: 201045 - protein, 140 aa, Triticum aestivum
  unsure (1)..(140): unsure at all Xaa locations
  Clone ID: PAT_TA_95463.pep
MVVPVIDFSKLDGAERAETMAQIADGCENWGFFQLXVNHGIPLELLDRVKKVCSREYRXRRGGXRSSEPVQTWRXGGDGAARRXXXPXGHIDWEXIFYSNDXQQWAFRPPASKETSGLRASKTPRTGMEAWKTRTKAHEA

SEQ ID NO: 201046 - protein, 123 aa, Triticum aestivum
  unsure (1)..(123): unsure at all Xaa locations
  Clone ID: PAT_TA_95464.pep
SQDTAFNELKNFLTHAHVLALPNFDKPFEIHCDASGNGIGGVLTQEKRPIAYFSEETSGSXLNHLIYDXRLYALMQXCRXWGTYFNLHEFTSIPXNEHPXXLKGQTKFNKRHAKWSEFIGXFP

SEQ ID NO: 201047 - protein, 179 aa, Triticum aestivum
  unsure (1)..(179): unsure at all Xaa locations
  Clone ID: PAT_TA_95465.pep
MATSPVLFLLLAVFAAGASAATFNIKNNCGFTIWPAGXPVGWGGFXAXAQGQTSSINVPRRAPKPGRIWXRTGAPFNGGXGSCQTGDCXGTIXAPSSGRQPTTLADYTSXGGPDFTHLVIRTFHDSPAHRDPPKDPLPRRSYKPTSNGIIILLRHLYSPRNHKGYYALIKGRLKTILNP

SEQ ID NO: 201048 - protein, 112 aa, Triticum aestivum
  unsure (1)..(112): unsure at all Xaa locations
  Clone ID: PAT_TA_95466.pep
CLDXKXFYIGIXGKICQGFXALVNXKTTXVGIWVXCLXNTLXLTKXCYXSFGXPXLFNNFFEWFXFENWTIPXXGXQPFWDFGEIIDLGXNLPXXDPLLVNXWITGXVFRMS

SEQ ID NO: 201049 - protein, 88 aa, Triticum aestivum
  unsure (1)..(88): unsure at all Xaa locations
  Clone ID: PAT_TA_95467.pep
XFXTKGARSISXXRFSXGFNLXXGRTLTKKXPPHIKLFLTNVFLXXKHTGMGXQARETRTAGRLXSIKXXFCLHPXKXGGXLVVVLMP

SEQ ID NO: 201050 - protein, 126 aa, Triticum aestivum
  unsure (1)..(126): unsure at all Xaa locations
  Clone ID: PAT_TA_95468.pep
TVKPVTLELGGKSPIVVFDDVDIDKAVEWTLFGCFWTNGQICXSATSXRLLIHKNIAKESSDRMVAWXKNTRCPDPPPKXGCKLXAXLXERHYEKFKNFXPNAXKLKCHILTGVXKAQHLEKGSSI

SEQ ID NO: 201051 - protein, 83 aa, Triticum aestivum
  unsure (1)..(83): unsure at all Xaa locations
  Clone ID: PAT_TA_95469.pep
VXDVSXKLDLPFRVRHXTGLPSSKKLVCFSQKPVFXGLGCSPFRSPLLTGIAFAFFSSWLLKMFQFAQVVSCLLMDSAGSLKG

SEQ ID NO: 201052 - protein, 167 aa, Triticum aestivum
  unsure (1)..(167): unsure at all Xaa locations
  Clone ID: PAT_TA_95470.pep
EGIMXMYFCSKELHXYIXTGHGGSHFAAPXXGGVLMCLQGKRPGXTHCSECSQDSTVTPGKFQRPSELLLLVMSADDFSQHCSISIHCNTQANWMTRPLDKAIDLIVNCSLLLCRIKYKGSISKFSGPTTIMAYFWYIRLNLHALGISCYIFEQMHQRHVISIEQMH

SEQ ID NO: 201053 - protein, 164 aa, Triticum aestivum
  unsure (1)..(164): unsure at all Xaa locations
  Clone ID: PAT_TA_95471.pep
PGRGVMSHYEKLSARLDLWEHCALYGGHVGNCFARAGHDPCVQELPLGVFXRKNPLXNAESNMHLGSSSLNLVQRVFKDPKIRGLRKLDISYAGXWLMKIXXKFXPXRWDPXPXGNLDSNSNSXRTTCVTYPSVSNKPRXXVETHHIKXLRLPKXXNNLKPXQL

SEQ ID NO: 201054 - protein, 117 aa, Triticum aestivum
  unsure (1)..(117): unsure at all Xaa locations
  Clone ID: PAT_TA_95472.pep
MAAAGDAGEKKMITLKSSDGEEFEVEEAVAMESQTXRHMIEDDCADNGIPVPNVNSXKILSKVIQVLQQALQANPPTGPXPPPGAXTRRPAAPAEDXKNXTXFXKXTSNSXLNLVQY

SEQ ID NO: 201055 - protein, 54 aa, Triticum aestivum
  Clone ID: PAT_TA_95473.pep
ILNKLFFHLFLTGAAWLVSISNFVEDWVRIGFLARKKVKAECSEMPFEDQCGVL

SEQ ID NO: 201056 - protein, 157 aa, Triticum aestivum
  unsure (1)..(157): unsure at all Xaa locations
  Clone ID: PAT_TA_95474.pep
NNLAYLLKRSELAPADLVMCQEKLVQEAVDTLLDSGSRGQPTRDGHNKVYKSLSRXVFEGKEGXFRETLLXGKRXDYXGXLSCCGPSLQLHXCGLLLRDNNKLFQHLVSAILXTKRALXKXRIAXKXNFXEKXPFFWEILPRIFAGNPVRXNXYPHN

SEQ ID NO: 201057 - protein, 142 aa, Triticum aestivum
  unsure (1)..(142): unsure at all Xaa locations
  Clone ID: PAT_TA_95475.pep
RARRSSRSPRPSTGLTCSLIFIDRHGMEEEERRRVVFARRLTVPRRRAGEGPQRARPDGHRLRRARGGCRWRLLRDPVHPRSCFDMAAQQLRVRPARAFCGSMRPRTFRRSVQRXAAQSRLXARVHLXMCXIHMQQFHWXXI

SEQ ID NO: 201058 - protein, 76 aa, Triticum aestivum
  Clone ID: PAT_TA_95476.pep
APSMGPWHDWQANGSPSSIIGGRSMAHVFILDAGVKGGRGKPGGVLNCQGLATSHPRSHHEGGGVASSVGVVQAPP

SEQ ID NO: 201059 - protein, 68 aa, Triticum aestivum
  unsure (1)..(68): unsure at all Xaa locations
  Clone ID: PAT_TA_95477.pep
GXQGGCRPARCLFLTQNRXXFEWDLLKAGPKVDVCLFAPCALCRGFVSVYLKWARPDHMGWGLNLNLT

SEQ ID NO: 201060 - protein, 89 aa, Triticum aestivum
  unsure (1)..(89): unsure at all Xaa locations
  Clone ID: PAT_TA_95478.pep
NGSDLCNKHDVKWTMRYIYGAHNVTTNPINIRGKHVSGFRFHIXDLPWSLNLPRDYFIHPXIPVELXVLLXIYMHXAXRQTTKLXLILR

SEQ ID NO: 201061 - protein, 86 aa, Triticum aestivum
  unsure (1)..(86): unsure at all Xaa locations
  Clone ID: PAT_TA_95479.pep
MSCCGGNCGCGTACKCGNGCGGCNMYPEAEAAGATLLVSATATHXASPXMEWRRENGAALHQFXSGTTCGXXCCNCKIYRQYHELS

SEQ ID NO: 201062 - protein, 135 aa, Triticum aestivum
  unsure (1)..(135): unsure at all Xaa locations
  Clone ID: PAT_TA_95480.pep
ANYDRPPNANKEXKHPXQXTKQVPNTRXXCXLYXLXPRYIXXTFISXGATXPGSSXLANTTXKWXIXXTXSGIXPQPLHFRXNPXGSEKTRXSCQPXXKNGGXNLQVXXXNXKXGFPXRENIITKXIXCQXKXLT

SEQ ID NO: 201063 - protein, 105 aa, Triticum aestivum
  unsure (1)..(105): unsure at all Xaa locations
  Clone ID: PAT_TA_95481.pep
AAAKEGGKAKKKAKKSVETYKIYIFKVLKQVHPDIGISSKAMSIMNSFINDIFEKXLAGEAAKLARYNKXPTITPGRFKLRPLLLPRRXAKHAVSRRTKCHLTPP

SEQ ID NO: 201064 - protein, 132 aa, Triticum aestivum
  unsure (1)..(132): unsure at all Xaa locations
  Clone ID: PAT_TA_95482.pep
MALSPSSFAGKAVKDLPSSALFGEARVTMRKTAAKAKPVSSGSPWYGSDRVLYLRPALRRPPXYLTGDSPGDYGWDTPAFXGDPXTFAKKRXXEVIQXRLACWASPCVFPXLSPILSFCPQNKGAILNQLFK

SEQ ID NO: 201065 - protein, 111 aa, Triticum aestivum
  unsure (1)..(111): unsure at all Xaa locations
  Clone ID: PAT_TA_95483.pep
DFYSTITRARFEELNMDLFRKCMEPVEKCLRDAKMDKSTIHDVVLVXGGSTXIPKSSAAAADFFNREGLCXXXQPXEAXAXGAAVXGXNLXXLRXNXXVQDLSXWDSPQVS

SEQ ID NO: 201066 - protein, 61 aa, Triticum aestivum
  Clone ID: PAT_TA_95484.pep
KNQSGAHSSTPSEGEIITGGHLHHPGSHHDEEGVVHPQGRGFVPVAMCLISLCLSLSLSCS

SEQ ID NO: 201067 - protein, 86 aa, Triticum aestivum
  Clone ID: PAT_TA_95485.pep
GGTPPLSPAHGGTPPPSPPAPALPSSQQHPPSPPRQQGRKRPAAAPAAPARRTPSPPPRKQARKKIDVAAAPSAPASSSTTRGGRQ

SEQ ID NO: 201068 - protein, 89 aa, Triticum aestivum
  unsure (1)..(89): unsure at all Xaa locations
  Clone ID: PAT_TA_95486.pep
AXRGKKGTSFSLSLKXNVAVXVXEGGVGXADACGGGRXRQRGGXAAWRGSPPWGGVGVGCLILXRSRRMMQSLGRDAGGAAAGFGQRSR

SEQ ID NO: 201069 - protein, 98 aa, Triticum aestivum
  unsure (1)..(98): unsure at all Xaa locations
  Clone ID: PAT_TA_95487.pep
CTVRYPXXHWMRIXDKGAXFCSVRRPRKPTLEIGRAGPKPVGIKTGHGVMSHYGCQQLARGILYSLQWYVDFFCRAGHGLFCLRSSLDYSEKEPTLQC

SEQ ID NO: 201070 - protein, 63 aa, Triticum aestivum
  unsure (1)..(63): unsure at all Xaa locations
  Clone ID: PAT_TA_95488.pep
MAETEYRCFVGGLAWATDXNNLXQAFSQYGXILDAXIINXRXIGXSXXFXFXTFXIXRSXQRN

SEQ ID NO: 201071 - protein, 155 aa, Triticum aestivum
  unsure (1)..(155): unsure at all Xaa locations
  Clone ID: PAT_TA_95489.pep
MMRSAPGLRARCRVGGMPCRRTPPVSQSRPDLQHLIGGRDREKYPLVSKAWTXTEFIHVDIRNSSRLKEVLEGVDLVVHAAWPFPEGXKCTVLQAATFTKTRYTDICDGVDYSWRAKSFHEQAKASGVPALITAGISPGVSNVMAAELVRTAKGE

SEQ ID NO: 201072 - protein, 144 aa, Triticum aestivum
  unsure (1)..(144): unsure at all Xaa locations
  Clone ID: PAT_TA_95490.pep
RGAPKSSFRGSVSHRFVASMADARRARAERRAALAARNAQTASIGGPPRHSPLPTANDATRPAGNEQQASSLHPSVRRELRTATPSLTPAGSSSHVIAPPRTHKPRCSWHVKLLHYSRRRXLQGVVASSSTRXNARGPXAPSXR

SEQ ID NO: 201073 - protein, 72 aa, Triticum aestivum
  unsure (1)..(72): unsure at all Xaa locations
  Clone ID: PAT_TA_95491.pep
TXLVMLIICCFYFGQVCLFLLLNYVCYISSTNVMMQVHRSSMTKKCNVGSIRRVAGVSGPRCTGFRFPRDSQ

SEQ ID NO: 201074 - protein, 100 aa, Triticum aestivum
  unsure (1)..(100): unsure at all Xaa locations
  Clone ID: PAT_TA_95492.pep
CFILXTXVPLPLNAPMKYPGWNGCLALAGTRTCCPMVPIRGAGNQCAGSMADSILIXGLYRTRGIYITYLSKMEQNVIVSSFFVSQKNGTMTLLGVRGRR

SEQ ID NO: 201075 - protein, 104 aa, Triticum aestivum
  unsure (1)..(104): unsure at all Xaa locations
  Clone ID: PAT_TA_95493.pep
SVESCFAVRHTLSMNRTPISTVGGRGEVCFLRFAVRHTPPDQXDPISTVGAQTEXRFHSXRYAKXSNEHNPFRHTRSKXGHFXXSVXXIPXSXFIQAXGSHXXT

SEQ ID NO: 201076 - protein, 81 aa, Triticum aestivum
  unsure (1)..(81): unsure at all Xaa locations
  Clone ID: PAT_TA_95494.pep
ASIFIFLFICFSINFFLASSLDSYHAHYIVSLLTCNQSASQTHIYFNLWTTXGISNTKLRSPSKLHLHLGTXXIPRQILXX

SEQ ID NO: 201077 - protein, 84 aa, Triticum aestivum
  unsure (1)..(84): unsure at all Xaa locations
  Clone ID: PAT_TA_95495.pep
GAXXPSWPPGCPPTPTPTIYLLSEIKNREKKSSRFTIRSRRQALKPLVRADLESLRAPERGIHRSRHHQPSSITNFMMLTAVRE

SEQ ID NO: 201078 - protein, 122 aa, Triticum aestivum
  Clone ID: PAT_TA_95496.pep
PPSAAPPSPAVSRVASSPTRAPLPPSSATSTTPCARRTRRPSSCRLPPRRLSSPSPPPPRASLSTSSPTSLTTPSTTPTAACCSSAGKPQFDTRGFSSANPVSRRRFAALLRNGGVLRAPPP

SEQ ID NO: 201079 - protein, 99 aa, Triticum aestivum
  unsure (1)..(99): unsure at all Xaa locations
  Clone ID: PAT_TA_95497.pep
GWSRYVILFQITAVERLDRPLRQLGLRTTCLLDTQLDTSLQETFPAIADACSPSCCKYLSPTLGEIMSLGRPHVRTXELHSMCIWIPGHIXTFCHGKVS

SEQ ID NO: 201080 - protein, 159 aa, Triticum aestivum
  unsure (1)..(159): unsure at all Xaa locations
  Clone ID: PAT_TA_95498.pep
RAEFGTRFPLLPPHPDPNSTPLPSLPRFRCTPXATTRSSSPSRSRRHPATPTSHPPPSPLPSPSPPATSPPSAAAHTHLTSASPHRLPLPXVPDXAGQPGGHGAPRLTTDPRPRPPPSCSTKTKTTHATASFLGRGCPVGGFDAALLRAMEGSERTSQL

SEQ ID NO: 201081 - protein, 141 aa, Triticum aestivum
  unsure (1)..(141): unsure at all Xaa locations
  Clone ID: PAT_TA_95499.pep
MARKMLKDGEAPAVADADGGGGEGSYDYDLFVIGAGSGGVRGSRTAAGFGAKVAICXLPFHPISSEWLGGHGGTCVIRGCVPKKIXVXGASFRGESMTXKQFGWEXXGDINYNWEKXLENKXXEIVRLTXXNLVWTCRAGI

SEQ ID NO: 201082 - protein, 164 aa, Triticum aestivum
  unsure (1)..(164): unsure at all Xaa locations
  Clone ID: PAT_TA_95500.pep
MLSTVDHLKRLCIDHYFQDEIDNIMESSVDLLHSDDLLDATLSLRLMREVGYYISADDVLQKFTNDNGDFNLRHSKDLRGLLSLHDMSHLNMGEXSLYKAKESQSKHLKXSLKYLGPNLAEICDESLDHPYHVSLXQYKASIIDYLKNLPTMHTQLENWHCRIR

SEQ ID NO: 201083 - protein, 211 aa, Triticum aestivum
  unsure (1)..(211): unsure at all Xaa locations
  Clone ID: PAT_TA_95501.pep
LVPNSARGPIQFGGLXVHDLERTGLALRMRWQWLSRVDDSRAWNGLDLQFAPEERTLFLASTTMTIGNGQRALFWEDRWINGRALRVIXPLLFAHIXKRXRNXRTVSGRLHANQWATDIHGAIGVPEIGXYCASGTCSTXCLTDLQXAFXWKWTXXAISANPHTRHFQGQKCSLLLCGTLGSHFNPSDATLTTATKVPLHSSPAFTEKFRG

SEQ ID NO: 201084 - protein, 88 aa, Triticum aestivum
  unsure (1)..(88): unsure at all Xaa locations
  Clone ID: PAT_TA_95502.pep
QLWPGTTPSMVTVVRPYKACGLRXRSGVLVLGXNXRLLXTDAALRSWGFTQSXXEQNPRKLPXRXCTXTRXXAHNVXXYSKEXPMLAR

SEQ ID NO: 201085 - protein, 146 aa, Triticum aestivum
  unsure (1)..(146): unsure at all Xaa locations
  Clone ID: PAT_TA_95503.pep
MEKVPIERLSHQQERLLLGIGIGIGCGLGAIILALGIMAFVSKWKRGIXKRIRRAYFKKNQGLLLEQLILDESATDKTKIFSLEELDKATNNFDVSRILGRGGHGTVYKGILSDQRVVAIKKSKLVEQVEIDQFINEVAILSQIIH

SEQ ID NO: 201086 - protein, 113 aa, Triticum aestivum
  unsure (1)..(113): unsure at all Xaa locations
  Clone ID: PAT_TA_95504.pep
DTSCSHPGQIVNNNGGPGLERIDSCHGVSNSAHPIVIGSALNTLVDSTPSLKTDGSKAESEIRKNGESVNKMTDKEREDLSFENSSYRGDLKRLVNDLHVIYLXKGGERALGF

SEQ ID NO: 201087 - protein, 165 aa, Triticum aestivum
  unsure (1)..(165): unsure at all Xaa locations
  Clone ID: PAT_TA_95505.pep
AXDXIIXERLFCKLEFYLSYIVLXTRGQPDMSEQCVHXAPVSIXXEFRARXRRTGXTXGFRRRVVRRWGPAXXCVYYRRMGHRRARCAGLACSGVGXAWQQGGAXVXRVPGVRRRKGKVHGGALVVSWLPSWASKLRVIDARAACAHWILLASIYGFQYLPWRAV

SEQ ID NO: 201088 - protein, 137 aa, Triticum aestivum
  unsure (1)..(137): unsure at all Xaa locations
  Clone ID: PAT_TA_95506.pep
MAVTFSDLHTADGLKALEAHLAGKTYISGDGITKDDVKVFAAVPVNPAXFPNAARWXYDTVAAAVASRSLAILWGECTSVLLHCPAASKDEDDDDDMVCLAMKTEEDKKLQLSVRCQPAKKKKWKPCLMDXKPWDMR

SEQ ID NO: 201089 - protein, 96 aa, Triticum aestivum
  unsure (1)..(96): unsure at all Xaa locations
  Clone ID: PAT_TA_95507.pep
MADVEYRCFVGGLAWATDDQSLQNAFSKYXDVIDSKIITXRXTGRSRGFGFVTFASDEAMRQAIXAMNGQDLDGRNIXVNEDXSRRSGGGXXXFXG

SEQ ID NO: 201090 - protein, 192 aa, Triticum aestivum
  unsure (1)..(192): unsure at all Xaa locations
  Clone ID: PAT_TA_95508.pep
QIFVKTLTGKTITLEVESSDTIDNVKAKIQDKEGIPPDQQRLIFAGKQLEDGRTLADYNIQKESTLHLXVLRLRGGMQIFXVRPSLGKTITLXGLILRTPLDNVKAKIQGQGGIPPGQQRLIFXAGKHXEDGXTLADYNTKKXXTFTWVLKSRGGMXILWKTSRQDITLRSNLGHIDNVKVSQDKEXSSDNR

SEQ ID NO: 201091 - protein, 91 aa, Triticum aestivum
  unsure (1)..(91): unsure at all Xaa locations
  Clone ID: PAT_TA_95509.pep
MKGTKLAAILILQAVLVMGVLSHVNADYFPKCCNNCRSFSGVDVCDDAHPKXAPKGCSACRVXVXXXPEMWALRGYESTVXGTXGXAXKKY

SEQ ID NO: 201092 - protein, 68 aa, Triticum aestivum
  unsure (1)..(68): unsure at all Xaa locations
  Clone ID: PAT_TA_95510.pep
XFCFXLLFXRXRFXFGHXIRXEGGXLELGAATQAGRGGTAREVKGVVKIGRGEGGWDGATSSCRIRHE

SEQ ID NO: 201093 - protein, 55 aa, Triticum aestivum
  unsure (1)..(55): unsure at all Xaa locations
  Clone ID: PAT_TA_95511.pep
PLQXEGXXGXSEIRNGCFREGQLIVICHFTELKSKIDPCKEEIKLCYVVKKKKKK

SEQ ID NO: 201094 - protein, 49 aa, Triticum aestivum
  unsure (1)..(49): unsure at all Xaa locations
  Clone ID: PAT_TA_95512.pep
CLXXQLXXQPXXIVFISPSLYKYFXLXMQXXKIXXLFIFXHKRAPLLIH

SEQ ID NO: 201095 - protein, 63 aa, Triticum aestivum
  unsure (1)..(63): unsure at all Xaa locations
  Clone ID: PAT_TA_95513.pep
PGXXLXFKNWXNPFXXGSPXFGXXKTPLXRTGPAPCSKRHKSLGTRKPRRTATSLSPYHDSQF

SEQ ID NO: 201096 - protein, 58 aa, Triticum aestivum
  Clone ID: PAT_TA_95514.pep
RYTGRRSCFLCQQHEMLVMNNLCHSLHVLFLANNSFHALVRVYFIRVLKSVILYTHNI

SEQ ID NO: 201097 - protein, 108 aa, Triticum aestivum
  unsure (1)..(108): unsure at all Xaa locations
  Clone ID: PAT_TA_95515.pep
SCRIRHEEDAKNGAGSYQSTPALVTSHFLLHLHSRYVRSFRRLRPPACSMGGYTPEGGGGRAARPGRYPPLASLVVSTIXAFSAGQSSSPSXTRXVVXAVDSLHLIXH

SEQ ID NO: 201098 - protein, 73 aa, Triticum aestivum
  unsure (1)..(73): unsure at all Xaa locations
  Clone ID: PAT_TA_95516.pep
TXSEXVKXQLIXAHYRGXXEDXXVXDSXYXXGRPLTIMXGLGELXKGWDXCXAGVEXIPXMRVXGKRSLRLPP

SEQ ID NO: 201099 - protein, 66 aa, Triticum aestivum
  unsure (1)..(66): unsure at all Xaa locations
  Clone ID: PAT_TA_95517.pep
MHNXXXEEXSXVLDSXCACXYSYIXFISICKKFLGRACVXNXCHLVINYPTVVKLPLYILSPSEXQ

SEQ ID NO: 201100 - protein, 130 aa, Triticum aestivum
  unsure (1)..(130): unsure at all Xaa locations
  Clone ID: PAT_TA_95518.pep
MPRRQQGPGLKAELLFPGGKSLLPLFDAVGDENXRPCTTQQPPMVRRNRPSPCSPKEQERLAIIEEVDHVYERLQALEADKEFLRHCIKSLKKGDKGMHLLQEILQHLRELRGVELHAKHAGDAIVANSA

SEQ ID NO: 201101 - protein, 174 aa, Triticum aestivum
  unsure (1)..(174): unsure at all Xaa locations
  Clone ID: PAT_TA_95519.pep
TTCACSRRRVCLVCGLVAMSSYSSLLSVSPXEQIGGYADGGDHDDMAAAANYLSSFCFDFGEEYYSLAEAATASYPLHAQQQQKPQTXGRXPPQGXXSXTTSSHXDXDNINTSLTSKRREEQRXXSXXKRGXRWRCGXTGTLGGSXARYGKDNQTQGILPFSXRVPXKXGGXIX

SEQ ID NO: 201102 - protein, 81 aa, Triticum aestivum
  Clone ID: PAT_TA_95520.pep
IASSAAPLPFHAHQPPPALRFPRGPSSSPTQPLLLLLVVVFGAVREHGHRPRVALQGAPPQRTGGSWEAAPWSRTKRRRSE

SEQ ID NO: 201103 - protein, 180 aa, Triticum aestivum
  unsure (1)..(180): unsure at all Xaa locations
  Clone ID: PAT_TA_95521.pep
LSGDPPSYLTGEFPGDYGWDTAGLSADPETFAKNRELEVIHCRWAMLGALGCVFPELLARNGVKFGEAVWFKAGSQIFSEGGLDYLGNPSLXHAQSILAIWACQVVLMGAVGGLPRGRRPLGEIVDPLYPXXQLRPLGLAEDPRLRGVKVKEIRTAARMFSCSALRXAIVTXRALGGRYQ

SEQ ID NO: 201104 - protein, 179 aa, Triticum aestivum
  unsure (1)..(179): unsure at all Xaa locations
  Clone ID: PAT_TA_95522.pep
SDSFPYRELENGVLWEVDGHWVVQGAVDVDIGANPSAEGGGDDEGVDDQAVKVVDIVDTFRLQEQPAFDKKQFISHMKRYIKNLSAKLXEGDDLDAFKKNVESATKYLLSKLKDFKFFXVGESMHDDGGVVFAYYKEGAADPTFLYFAHGLKEASANALYAKSKLPHICPNHGCNRPQC

SEQ ID NO: 201105 - protein, 143 aa, Triticum aestivum
  unsure (1)..(143): unsure at all Xaa locations
  Clone ID: PAT_TA_95523.pep
MAVGKNKRISKGXRKGSKKKAVDPFTKKQWYDIKAPLLFTSRNVGKTLVSRTQGTKIASXEGLKHRVFEVSLADLQNDEDQAYRKIRLRAEDVQGMNVLTNFWGMDFTTDKLKSLVKEVEDTQLRSCGCXXNDNYMSACSHWF

SEQ ID NO: 201106 - protein, 102 aa, Triticum aestivum
  unsure (1)..(102): unsure at all Xaa locations
  Clone ID: PAT_TA_95524.pep
RLGXRCRAVGAAHVGAHHHHLHPKGGRVLHGASRAWCCLTAVVPPSLMVDVASDPPMLMLLLLLLLPLPVPSSSPAHSMLPLSPLWVGGSFLCLSSTRLSFS

SEQ ID NO: 201107 - protein, 166 aa, Triticum aestivum
  Clone ID: PAT_TA_95525.pep
LAEAAPRIRARPAPPPLRLPGWSRRSTAPKPPPATASTWPCSSASPSAPPPPPRPPPRRPPSPPSSLASPQPRPPRSPPSPPAAPPPTAPPPPSPRPPPPSTTSSASSRRLPLPPAVRVRSALAAVSDSVPPTSSPPPRFGQEASFRNKKHKTPARSPACQLGEQS

SEQ ID NO: 201108 - protein, 80 aa, Triticum aestivum
  unsure (1)..(80): unsure at all Xaa locations
  Clone ID: PAT_TA_95526.pep
MSCCGGNCGCGTACKCGNGCGGCNMYPEVEAAGATLLVSATATHKASSGGMEMAAXENGGCGCTQXCKCGTSCGCSLLQC

SEQ ID NO: 201109 - protein, 124 aa, Triticum aestivum
  unsure (1)..(124): unsure at all Xaa locations
  Clone ID: PAT_TA_95527.pep
MAMAQGQGAATSLPPGFRFHPDGRGVILHYLRNRAAAAPCPVPIIADVDIYNSXPWDSLXKAVYGDCDGIXXPGGTAXXKRNRPNGAAGXGYWKAPGPTTHHPQRASGKKRLLKAPPRDKTLSQ

SEQ ID NO: 201110 - protein, 89 aa, Triticum aestivum
  Clone ID: PAT_TA_95528.pep
PAASSHGDHHLPPPPSPPWPSLRAPSPPQALPAPLQSAPPRPASDPSPPRRPPPPSRRRPSSVPDARPGSGDLSRSASYETGKGGRWKR

SEQ ID NO: 201111 - protein, 188 aa, Triticum aestivum
  Clone ID: PAT_TA_95529.pep
VTFSKRRRGLFKKAEELSVLCDADVALIVFSSTGKLSQFASSRCIRPSSAPLARLGSSPPVPSRLVFSRRHVDLPASLPLPPFRAQDPARLGFMLRLLAGPVSVSRALPRLARPAGIMRRAGGADRVAWHRPQRIFWLRSRMSSFLPKWGFYSVTVVSTLVLVDISVDSFSFRSGVTWRSQCAGLLNC

SEQ ID NO: 201112 - protein, 101 aa, Triticum aestivum
  unsure (1)..(101): unsure at all Xaa locations
  Clone ID: PAT_TA_95530.pep
QMAIQMNGHMAAGGRFINGDEWGSSPCYFSSSSSGSSFEPCVALLAHIASAHSNLXVFQVSSVMWHHTTVRSGRQLSIFSPXCLMKXPLWINMKXHKQKSY

SEQ ID NO: 201113 - protein, 120 aa, Triticum aestivum
  unsure (1)..(120): unsure at all Xaa locations
  Clone ID: PAT_TA_95531.pep
MLIIRQLPQDRGGERVRELXVAGEXPGNLXNXSRPELXXRDFPEHLIXVRSRLPCLXXLHASXVLGEVQREGRAGGLVEWTRHRAPPXLXXRNXPXLGAGVXPLXLPHKKCLXLXNSLXG

SEQ ID NO: 201114 - protein, 101 aa, Triticum aestivum
  Clone ID: PAT_TA_95532.pep
LRVQSARDRLAAERARRRPSKGGPPRLASPAVRSARQMGRGRRRRSRRRGGPKRISGLAPRGGGSNRLGIWWWEGGKGGDWGGREERGSRTKRNERQIGHG

SEQ ID NO: 201115 - protein, 89 aa, Triticum aestivum
  unsure (1)..(89): unsure at all Xaa locations
  Clone ID: PAT_TA_95533.pep
MKGTKLAAILILQAVLVMGVLSHVNADFFPKCCNNCRSFSGVDVCDDAHPKCPKGCSACRVVSTTPXMWRCXDMXSTVXGTCGXTCKKY

SEQ ID NO: 201116 - protein, 51 aa, Triticum aestivum
  unsure (1)..(51): unsure at all Xaa locations
  Clone ID: PAT_TA_95534.pep
MAFEKIKVANPIVXMDGDEMTRVFWXSIKXKLIFQFLXXEIXXFDLGSSKC

SEQ ID NO: 201117 - protein, 170 aa, Triticum aestivum
  unsure (1)..(170): unsure at all Xaa locations
  Clone ID: PAT_TA_95535.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGXCTDATQVINEVEEVKKEYPDAXSDHRFETSVQCVSSLLQARLQDPEG

SEQ ID NO: 201118 - protein, 128 aa, Triticum aestivum
  unsure (1)..(128): unsure at all Xaa locations
  Clone ID: PAT_TA_95536.pep
MPKPQNCYSALRLPLFGQIINTYLCNPXSSQREEFRLLFXFYXRXTGGMGRAVLNLGLXGCXTSSXXMEXGIRHVGRSKXSRXVXRIXWPPGTFQXGLXEMIPPCPIWVRDHQXRXHXKXVKFXMEPL

SEQ ID NO: 201119 - protein, 127 aa, Triticum aestivum
  unsure (1)..(127): unsure at all Xaa locations
  Clone ID: PAT_TA_95537.pep
MGKEKIHISIVVIGHVDSGKSTTTGHLIYKLGGIDKRVIERFEKEAAEMNKRSFKYAWVLDKLKAERERGITIXDIALWEFETTKYSXCTVIDAPXGHRDFIKNMITGTXQVDCAXLTTHHFEGVPG

SEQ ID NO: 201120 - protein, 61 aa, Triticum aestivum
  unsure (1)..(61): unsure at all Xaa locations
  Clone ID: PAT_TA_95538.pep
XASIKFRDDDRPLLRAKVPIXVLGLPFLSGVSAGGXSKDLRFXLSNAFPSGPGLRLSAQPL

SEQ ID NO: 201121 - protein, 164 aa, Triticum aestivum
  unsure (1)..(164): unsure at all Xaa locations
  Clone ID: PAT_TA_95539.pep
GSIAELLHRLPNCSQNKLQDLSLSDNNLTGSLPTTLVEPLRNLSWLNLDGNKLTGXVPVWIGEXTQLTNLGXLSSNNLXDGVIHGRHLSXGLGMLGGIDIXQDNSIPSLWSPTWGPPFQVLRTIELPALSTKAKSPCGLXXKHTLWXLDISNTSINDMVQSWFG

SEQ ID NO: 201122 - protein, 77 aa, Triticum aestivum
  unsure (1)..(77): unsure at all Xaa locations
  Clone ID: PAT_TA_95540.pep
CVALFFCEWAGIGQLYIWLNVNXNFXKXSXXPKXISXFPGFQKCFFFSTYSALLFIWXXYXXGXRGKQXXFXXXFNL

SEQ ID NO: 201123 - protein, 49 aa, Triticum aestivum
  Clone ID: PAT_TA_95541.pep
RGYDQCVTCAADDLQILKTRSSTLRTPGIQSQQTIAYISNQSKIMGTLK

SEQ ID NO: 201124 - protein, 122 aa, Triticum aestivum
  unsure (1)..(122): unsure at all Xaa locations
  Clone ID: PAT_TA_95542.pep
MARLNSKAVVAAVVLAAVVLMMAGREASAALSCGQVDSKLAPCVAYVTGRASSDSARSAAPGVQGLNGMARSXPDAKIACKXLKDLATKHQXINMGKXPACPGXXAQCPFPXNXSTNCDTVN

SEQ ID NO: 201125 - protein, 124 aa, Triticum aestivum
  unsure (1)..(124): unsure at all Xaa locations
  Clone ID: PAT_TA_95543.pep
AKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWXYDNEWGXYSTRVVDLIRHMHTPK

SEQ ID NO: 201126 - protein, 122 aa, Triticum aestivum
  unsure (1)..(122): unsure at all Xaa locations
  Clone ID: PAT_TA_95544.pep
RVLXKALXXSGGDHIHSGXVXXKLSXGTRXVTLGFVELXXDDFTXXXXXHGIFFTXDWXSMPXVXPVXLXGXHVWHXPXLTNIFGDXSVLQFXGRXFXDILEGXAPXAXAXLLALXXXVKAR

SEQ ID NO: 201127 - protein, 100 aa, Triticum aestivum
  unsure (1)..(100): unsure at all Xaa locations
  Clone ID: PAT_TA_95545.pep
FFFFVLXLYLLMCRVTFVSRCALVVCSIYKAGAEXFFCYLPNASLVNAKISRECNPLRKLVEKKEKKDTARRFLTQXEEPNRTVRYPSHHGSHAGGRSPD

SEQ ID NO: 201128 - protein, 46 aa, Triticum aestivum
  unsure (1)..(46): unsure at all Xaa locations
  Clone ID: PAT_TA_95546.pep
KFVNILLSHEHVFQLMNICFEIINILKLKTIFLNHISYRIREHFXN

SEQ ID NO: 201129 - protein, 85 aa, Triticum aestivum
  unsure (1)..(85): unsure at all Xaa locations
  Clone ID: PAT_TA_95547.pep
MXAMKIALLAVAAMDVLLXTASXVTYNVGDXGGWXLXTDYXSWVSGMKFNVGDDXXFTXXTXTHXXXDVTXXPXYXSCSXXGXKN

SEQ ID NO: 201130 - protein, 83 aa, Triticum aestivum
  unsure (1)..(83): unsure at all Xaa locations
  Clone ID: PAT_TA_95548.pep
HXPXEXXXXDEGDDGXQXPARPPXAXRRNRAAAQMRRXRXRPRRRVPRHRVGRRGRLHALRRWSRARSSWCCRSSLRKWGMAT

SEQ ID NO: 201131 - protein, 69 aa, Triticum aestivum
  unsure (1)..(69): unsure at all Xaa locations
  Clone ID: PAT_TA_95549.pep
RVPSXXSPGAAVPXGXGDXELAEEARRGRGXXRLRLALRRAXRAGKAHARPLQEIYXXEFEPRYRAFGS

SEQ ID NO: 201132 - protein, 169 aa, Triticum aestivum
  unsure (1)..(169): unsure at all Xaa locations
  Clone ID: PAT_TA_95550.pep
XSLAVXPPAPXHTSHFXFPAXCLXACPSXXPAQXRXVHRCGGSSDGRNAQVDPPAAAAALXRXPRRPFRXPSDXPPGGGTVGCGAPXTGVAPVRGVPDAGWQHPETEAGPNPAPSQLGSRPAAKQSASVGAWGFRVELHSTAVERRRGGGWVGARRGGGFGRGGRIESG

SEQ ID NO: 201133 - protein, 166 aa, Triticum aestivum
  unsure (1)..(166): unsure at all Xaa locations
  Clone ID: PAT_TA_95551.pep
MDATADPLLPQPAAAVDHLGRPVSRLTSGRWPAAFFIIGVEISERFAYTGISGNLIAYLTGPLGQSTASAAATINAWNGVALLLPLLGVAAVADSWXLGRYRTVVCASLLYILGLGMLTLSSILATXLQNQFGDRMDSALYSTSXAHLPFFKSPVYGGLAQXXKNL

SEQ ID NO: 201134 - protein, 157 aa, Triticum aestivum
  unsure (1)..(157): unsure at all Xaa locations
  Clone ID: PAT_TA_95552.pep
MKPISSAAILLAAVVALLLVAAVRGDDDCGSPESAAQDRARAKPLKIAAFFSILVCGALGCSLPVLGRRVPALRPEGDVFFLVKAFAAGVILATGFIHILPDAFENLTSDCLPSXGPWKDSVRRLGAMVGASDARRRHCPTGTQARQLNKDGTDGNG

SEQ ID NO: 201135 - protein, 124 aa, Triticum aestivum
  unsure (1)..(124): unsure at all Xaa locations
  Clone ID: PAT_TA_95553.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSXGVPGXXGVSVXPFPISMSTNCNNVN

SEQ ID NO: 201136 - protein, 59 aa, Triticum aestivum
  unsure (1)..(59): unsure at all Xaa locations
  Clone ID: PAT_TA_95554.pep
QWMQLSSSRPWXQPEASLPSCCSAPWTRPSPPXCATASASSXCTRRXRPSRXWXSXPRP

SEQ ID NO: 201137 - protein, 52 aa, Triticum aestivum
  Clone ID: PAT_TA_95555.pep
FTVTEIIRELCEPSPLACICYPFTVIRPFMQGFLHTHDFPSGKVSKTLTLYS

SEQ ID NO: 201138 - protein, 114 aa, Triticum aestivum
  Clone ID: PAT_TA_95556.pep
RAEFGTRDEKEVESSALRKNKVQHAWSWIRYPHMTVSAMFFNPEAVKPISRLLDNVIVPDKTITEADIRKRPMWHTYPGPRPRRPHVTHKPDTHWKASSPATPREEHKLAGEGL

SEQ ID NO: 201139 - protein, 175 aa, Triticum aestivum
  unsure (1)..(175): unsure at all Xaa locations
  Clone ID: PAT_TA_95557.pep
DAGDETSRKENGRAKAAGFCGVHVTRATIEHGERRRGRLLPRRPVRLRLLVLAATARAVGDVVPHVPVPGHGVPPRRRVALLALRVRDGEPRRPAPGRRRPVPVRPPPRGAVLVRDRAPLAVVALVLVVVIAARXSAVGDVVGTATAWYDSGTXRGALPWXLPGAGLVCYISTIG

SEQ ID NO: 201140 - protein, 85 aa, Triticum aestivum
  unsure (1)..(85): unsure at all Xaa locations
  Clone ID: PAT_TA_95558.pep
PCPSSTAVRPFTADRRPPTSQSRASWLQPAAKLIPPACRTPCRSALRIRLGLSGGLVAMGXXGXEKVSLDXRKLQSTTASRXXRI

SEQ ID NO: 201141 - protein, 38 aa, Triticum aestivum
  Clone ID: PAT_TA_95559.pep
FPYCLRPRSGRVQAPTTIVMTFKFSTTIHVLTCDFHPL

SEQ ID NO: 201142 - protein, 146 aa, Triticum aestivum
  unsure (1)..(146): unsure at all Xaa locations
  Clone ID: PAT_TA_95560.pep
LKRDSDIRSFNLPSRSGEGEQSDDNRLIREELSYDACALSKQSLVMFDSLNEDQLVAYKTIVECVQAGRPGFFXLLGYGGYWGKTYLXGVQYVLSLRGERKIVLTVASSGHCVAVVAWVGKTAHPRFKDTYPWKIIHNADIKRVLL

SEQ ID NO: 201143 - protein, 90 aa, Triticum aestivum
  unsure (1)..(90): unsure at all Xaa locations
  Clone ID: PAT_TA_95561.pep
DRXIDXXVCTNXXCVPDFGXEKRXNSCXILXCXHRASHLPNQRMHIXHTVASSTLVQKHXPITXACLLSIFRGXLGFXSCXVXQLLDWIX

SEQ ID NO: 201144 - protein, 156 aa, Triticum aestivum
  unsure (1)..(156): unsure at all Xaa locations
  Clone ID: PAT_TA_95562.pep
MAPTVMASSATSVAPFQGLKSTAGLPVSRRSNGASLGSVSNGGRIRCMQVWPIEGIKKFETLSYLXPLSTEALLKQVDYLIRXKWVPCLXXSKVGFIFREHNASPGYXDGRYWTXWKLPISGCTXXTQSDNXVXEVKRXPDAYVXIIXFXNIXKML

SEQ ID NO: 201145 - protein, 99 aa, Triticum aestivum
  unsure (1)..(99): unsure at all Xaa locations
  Clone ID: PAT_TA_95563.pep
MAASASASTSLFGPCALTXRLGAGRPSGGXRRRDXARGRGRLSVVAVQTGPQXPSPSPSLSXPAXDEXEALQXLXKREXKYXFVXDFXXFSIXXXLXGP

SEQ ID NO: 201146 - protein, 162 aa, Triticum aestivum
  unsure (1)..(162): unsure at all Xaa locations
  Clone ID: PAT_TA_95564.pep
MARTKQTARKSTGGKAPRKQLATKAARKSAPTTGGVKKPHRYRPGTVALREIRKYQKSTELLIRKLPFXRLVREIAQDFKTDLRFXSHAVLALXXAAEAYLVGLFEDTNLCAIHAKRVTIMPKDXQLARRIRGXRAAKEANCRVSCIGFWGDQRQHWIVIPG

SEQ ID NO: 201147 - protein, 178 aa, Triticum aestivum
  unsure (1)..(178): unsure at all Xaa locations
  Clone ID: PAT_TA_95565.pep
MQAPPXAALAGSXWAXHRPAILXAPXILLRPRXGALRLXAWXXAGGGXAPXLPXKGTVLASDTGAXEXVTGPSPLXDVRXEQDFVLXVRKEVDRGKLXPDVAXXFENLXNNXXNAVXQNGDQXAYXXMLSNMMDLFXXXLLXEXNXFXFKLIXGIXEXFDXXISXXXNXAXXIXXSNR

SEQ ID NO: 201148 - protein, 83 aa, Triticum aestivum
  unsure (1)..(83): unsure at all Xaa locations
  Clone ID: PAT_TA_95566.pep
LXAXXRNAXQTLXVXPDHAXSXVAXXTXFIPEPYXGSSTLASRXXSLRSTSASSRDPXSXWHPSIWIQDHRRTASXSSLXNIV

SEQ ID NO: 201149 - protein, 55 aa, Triticum aestivum
  unsure (1)..(55): unsure at all Xaa locations
  Clone ID: PAT_TA_95567.pep
LSSXATSSVXXVASTGPGIRFFXLYVYKDRKVVEXLVXRRAEXAXFKAIXLXVYT

SEQ ID NO: 201150 - protein, 208 aa, Triticum aestivum
  unsure (1)..(208): unsure at all Xaa locations
  Clone ID: PAT_TA_95568.pep
LRPGTHRLGCIYRKLADDPHAPSNAMAVDLQRLRHKLLTTGAGGGHHQLASAAAVPASGPSYGAAVPSQRGHQPYADLFTLPPPPPMSSSAPYHCSEFWEWPXCSGXKGSARRCSXNDYQQAEARRAVSVLGALTFSRXAHRXYRRHXSAKHAKXVILGGEGRQQGSLGVRQAGTVRQXRVTLDMMDHXLDLMXXWHSITAANXGXXG

SEQ ID NO: 201151 - protein, 120 aa, Triticum aestivum
  Clone ID: PAT_TA_95569.pep
IDERPPSPPICRTPPRAPLAPPLRPPRHRPAPPGDPTAVDEPPAGDEPLSLAPCHGLFLTDPAIVAVTSSPDAIAGLLPPRRPVVPDFFSSPTAASLPGPTTRPTLMSPSTTTSPTTLLV

SEQ ID NO: 201152 - protein, 177 aa, Triticum aestivum
  unsure (1)..(177): unsure at all Xaa locations
  Clone ID: PAT_TA_95570.pep
ALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGXDYLGNPSLVNAQSILXIWACXVVLMGAVXGYRVAGGRSADLNRLPGQPWARDDPIAD

SEQ ID NO: 201153 - protein, 93 aa, Triticum aestivum
  Clone ID: PAT_TA_95571.pep
QHNACIALPQPRFHGLGCSHFARRYYGNRFCFLFLWLLRCFSSPGCLLPAHGFSRQFKRLTYLGISGSMLIFNSPKHFVACYALPRLWVPRYP

SEQ ID NO: 201154 - protein, 60 aa, Triticum aestivum
  unsure (1)..(60): unsure at all Xaa locations
  Clone ID: PAT_TA_95572.pep
MHFESHSFGRSLSPVHLQRKGARSVXISLFKGWLLXGKPPGCLCTPTSFITERSFRGLSW

SEQ ID NO: 201155 - protein, 100 aa, Triticum aestivum
  Clone ID: PAT_TA_95573.pep
TPGASNCCSHCSTSSIYHSIVPSGDCLRVCLGCYFSAGISVWRLRQHDYGSDADGLGNLKPALDILYSIALLQGVISATKLYLVCKGSVAKCSTQKKRVG

SEQ ID NO: 201156 - protein, 54 aa, Triticum aestivum
  unsure (1)..(54): unsure at all Xaa locations
  Clone ID: PAT_TA_95574.pep
MAMATQASAXTRHLITAAWSPSXKPRPXTLAMRSSARGXDPLCAXXPDTPGXRA

SEQ ID NO: 201157 - protein, 70 aa, Triticum aestivum
  unsure (1)..(70): unsure at all Xaa locations
  Clone ID: PAT_TA_95575.pep
NFKLRRNILGDLPCHPNINLSPGCNSTGTRKXFWSMXHVHIILTHSTIXPTXIHXFTXYVWGDEPRXDDX

SEQ ID NO: 201158 - protein, 139 aa, Triticum aestivum
  unsure (1)..(139): unsure at all Xaa locations
  Clone ID: PAT_TA_95576.pep
PPGLSAVLLDSPRFLSFLHGPGDALAMDAAVIYQSDPAAILYSSGTTGSAKAVVLTHRNLMTTRVLPGPAPPDEVLMLTVPLFHVYGFVFCLRPVMAXQTLVLHTARRFDTRAVLXXVGRFRVTRLTLAPPALLXLCKN

SEQ ID NO: 201159 - protein, 152 aa, Triticum aestivum
  unsure (1)..(152): unsure at all Xaa locations
  Clone ID: PAT_TA_95577.pep
PDPIGIEAKTPPPPDPIWIGTRPPLPSLLPLLCPMGLGNXAPSPSPCRVDHAPRRPTPVPPPRXRPVIDARNAPPPRRSAPASGRHPPVASXAPPVITATSSRVILILAGTTSPEQAPPRRPQRSLADVPLMIPLPVTRYELLLAVQYVDPL

SEQ ID NO: 201160 - protein, 66 aa, Triticum aestivum
  unsure (1)..(66): unsure at all Xaa locations
  Clone ID: PAT_TA_95578.pep
XIXTQSLGLXPSXATVSPSLQXCGSGRRTWQGRAPRRXSPRRXXRKXGRXPPXPAPXVPXLTRSQF

SEQ ID NO: 201161 - protein, 131 aa, Triticum aestivum
  unsure (1)..(131): unsure at all Xaa locations
  Clone ID: PAT_TA_95579.pep
MRPDRGRRRMIVCGLEADPLSRLKERAAVAQDAGATTHVTGVRVSADGGGYLWEGGGAVGGAGQXGGGGAGQGGRSGGGGAGQGGRSGGGAGQVRRRRRRGEGQEAAAVRGGEGAGGQMGSGEDREGFFFF

SEQ ID NO: 201162 - protein, 175 aa, Triticum aestivum
  unsure (1)..(175): unsure at all Xaa locations
  Clone ID: PAT_TA_95580.pep
VPTAPPPSSNLSMATASASRPSGHVLLSPFPNYQSASLTRVKLSAGGSPVKFVSVSSPPSSPVGGAAKIRRSCMCSPTNHPGSFRCSSTRSARRVPRRRQLQQAVSPPSPPPIRQRLLXAHGKRASATRPNGERDWXXXRSRRPXAAELQQXKAPTGXXGQPVRXHGGGAKXRTV

SEQ ID NO: 201163 - protein, 151 aa, Triticum aestivum
  Clone ID: PAT_TA_95581.pep
SCRIRHELDRGLFPLKEEAQLSNGYLDTTIDWIPAMPKDMRLRDLPTFLRATDPDDIMFNFFVHETAAMSQASAVVINTWDELESPLLDAMSKLLPPIYTVGPLHLTGPQQRTGRRPRRHWVQPVAGAGRAPSGSAGRRAQWANSISGASR

SEQ ID NO: 201164 - protein, 166 aa, Triticum aestivum
  unsure (1)..(166): unsure at all Xaa locations
  Clone ID: PAT_TA_95582.pep
KAEKKPAAKKPAEEEPAAEKAPAAKKPKAEKRLPAGKSAAGKDGDKKGKKKAKKSVETYKIYIFKVLKQVHPXDIGISSXKAMSIMNPSSNDIFXEKSXGEAAKSARYNKEPTITPREIQTSXRLVLPXAXRQTXVSEGTRRHKTPPSPALSEPADSTRGPVIAYY

SEQ ID NO: 201165 - protein, 134 aa, Triticum aestivum
  unsure (1)..(134): unsure at all Xaa locations
  Clone ID: PAT_TA_95583.pep
MAAATMALSSPAMAGTPVKASRAAPFGEGRITMRKTAGKPKVAASSSPWXYGSDRVLYLRPXSGDPPEYLTGESPGDYGWGHRXLSADPGDFAKEPGAGVIHCRWGHAGRVGALPGTVARNAQFREACGQRRSS

SEQ ID NO: 201166 - protein, 139 aa, Triticum aestivum
  unsure (1)..(139): unsure at all Xaa locations
  Clone ID: PAT_TA_95584.pep
MADQLTDEQIAEFKEAFSLFDKDGDGCITTKELGTVMRSLGQNPTEAELQDMINEVDADGNGTIDFPRVPGTWMARKMKDTDSGGGVKEAFXRVFDKDQNGSSRXAGLRHVMTTXXXNLTDEKWTNDPGGGLDGTGSLD

SEQ ID NO: 201167 - protein, 69 aa, Triticum aestivum
  unsure (1)..(69): unsure at all Xaa locations
  Clone ID: PAT_TA_95585.pep
ASLQXPNXQTATLNXVGKYMPRTLGELTXYHIFRPDVKIWPIELHLGDCAHQSXXENYXNXTTEEXDXC

SEQ ID NO: 201168 - protein, 77 aa, Triticum aestivum
  unsure (1)..(77): unsure at all Xaa locations
  Clone ID: PAT_TA_95586.pep
SMPVRFDFFKNLYPPYFFFARKLLIYSSTVKVVQRTLEVKFTSRSARPPSDDYKHWSAPRRHRPPPLSSXAGQTLLY

SEQ ID NO: 201169 - protein, 79 aa, Triticum aestivum
  unsure (1)..(79): unsure at all Xaa locations
  Clone ID: PAT_TA_95587.pep
FLLLEWSMTLQRTMVPFESFXWXDLRNTPGFRVFSIRAGRKRITCXXPNLYSXSLXLSFLYFYIIIPNIXLFATYCXQX

SEQ ID NO: 201170 - protein, 68 aa, Triticum aestivum
  unsure (1)..(68): unsure at all Xaa locations
  Clone ID: PAT_TA_95588.pep
ACTQGVXQXXRXXXKNXSPIEXKXTGKNXXDXLXLVRSIXVRDSXSTGSXWRVADDDGRPVILIXEXE

SEQ ID NO: 201171 - protein, 120 aa, Triticum aestivum
  unsure (1)..(120): unsure at all Xaa locations
  Clone ID: PAT_TA_95589.pep
ANXLAVFAPPPPLSLSGHLGALAGDPGCFPLDDEAYPPSSHWPTLTPVIFGSYLVFRVCLDLVPLAQPAPKQCFTPRCPVNCCASTHFGENQLALGSSGISPLTTTHPLILQHQSVRTSA

SEQ ID NO: 201172 - protein, 156 aa, Triticum aestivum
  unsure (1)..(156): unsure at all Xaa locations
  Clone ID: PAT_TA_95590.pep
KPTFSSLIXNXLXXLXXDYLICFSKRXPFRLPXFNMTSDXPXPDCSIXDILGGFGXNHQFISVLAASAXXSFSTFLQRAAEAETGFSSSNTSTVXQPRRLLVILELGXYGELLLEHSVLLAPQQEGRRRLVTLRLPRGLLRLLVTTRRVGARVGIG

SEQ ID NO: 201173 - protein, 124 aa, Triticum aestivum
  unsure (1)..(124): unsure at all Xaa locations
  Clone ID: PAT_TA_95591.pep
KRSEEIFGFEYGFLALSKKVLCALKLFTAERSWGGCNTWKPWQPGLCLLNXWPLLHMIVILRSGSSGRHHDGPFHSDQLSMIKCLFNCVRPWRWNNGFSMHSGFRLYLSFKHHISFRFHIGFRR

SEQ ID NO: 201174 - protein, 135 aa, Triticum aestivum
  unsure (1)..(135): unsure at all Xaa locations
  Clone ID: PAT_TA_95592.pep
MGKEKTHINIVVIGHVDSGKSTTTGXTWIYKLGGIDKRVIERFEKEAAEMNKRSFKYAWVLDKLKAERERGITIDIALLEFETXKYYCTVIDAPGXHRDFIXKNMITGYSQADCAVLTSIHNXWFXXGISKDGKH

SEQ ID NO: 201175 - protein, 65 aa, Triticum aestivum
  unsure (1)..(65): unsure at all Xaa locations
  Clone ID: PAT_TA_95593.pep
INQLMMQNRXMRGVNARSANXFFTSTDQISEXYQALATXISXTXLMISTXXNVKFCLEPXXPGXX

SEQ ID NO: 201176 - protein, 86 aa, Triticum aestivum
  unsure (1)..(86): unsure at all Xaa locations
  Clone ID: PAT_TA_95594.pep
MLDKLWDDVXAGPRPETGLDKLRRAAAXQPLAINTAAGEAIKQSPSMPTXPXTPVXPSSSTPRXXXXVWXSVFXPXXTWXXKXSGK

SEQ ID NO: 201177 - protein, 178 aa, Triticum aestivum
  unsure (1)..(178): unsure at all Xaa locations
  Clone ID: PAT_TA_95595.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVINCRWACXGRARCVFPELLARNGXKFGEACGSRAVQIFXKXAHYSPAVRKLALGCKWMLETLALNDRQPGEDPGSDPGR

SEQ ID NO: 201178 - protein, 120 aa, Triticum aestivum
  unsure (1)..(120): unsure at all Xaa locations
  Clone ID: PAT_TA_95596.pep
MAPTLSLLLATTSMALLLFSRAVAHDTLPLGSSLAVEAFQTDVLQSPDGTFSCGFYSIYTDAFTFSIWHSKAADKTVVWSANRGRPVXVKRAAFTLXRDGNMXXKLYGXVVWXLAELHEC

SEQ ID NO: 201179 - protein, 151 aa, Triticum aestivum
  unsure (1)..(151): unsure at all Xaa locations
  Clone ID: PAT_TA_95597.pep
SCRIRHERKHTSNTHHKMSTAMAPLLFAVLVLPFAAPAAVTMARRNCSSYCGYPSNPPPPYPFGVGPSCSMPGFNLTCDADNGTYLLLGSPTMKVSFYSNEFNHNLRTSISYFVGDDCRRPRLLPQLGSSCKPFVISGVVRHVXGCCWAVV

SEQ ID NO: 201180 - protein, 144 aa, Triticum aestivum
  unsure (1)..(144): unsure at all Xaa locations
  Clone ID: PAT_TA_95598.pep
NGGRIRCMQVWPIEGIKKFETLSYLPPLSTEALLKQVDYLIRSKWVPCLEFSKVGFIFREHNASPGYYDGRYWXTMWKLPMFGCTDATQVINEVEEXKKEYPDAYVRIIGFDNMRQVQCVSFIAFXPPGCXDPXRPKSLTTGHI

SEQ ID NO: 201181 - protein, 111 aa, Triticum aestivum
  Clone ID: PAT_TA_95599.pep
FLTHEACKSSGKTMSPRLSTCRVPTQLLGIQLILLVFFINGSLLVLPAASAYYNASAPAAARVYLPFGKSGIYLPPGKSGNLNVFGGPRTATPHPHANQPEGIPRRRERKH

SEQ ID NO: 201182 - protein, 137 aa, Triticum aestivum
  unsure (1)..(137): unsure at all Xaa locations
  Clone ID: PAT_TA_95600.pep
AFNRXLAXAAPPXPGRSPXFSRYHRQIHEARARAGAESRRCXPPRLFATSLDCRATRALPRTSIWLPFPHAVILLTSSCSYTPTLCGPALPCSPIRNHCVHGRRIERRIEAKQGAAWWWRLESMGGGEERRRCTRKG

SEQ ID NO: 201183 - protein, 182 aa, Triticum aestivum
  unsure (1)..(182): unsure at all Xaa locations
  Clone ID: PAT_TA_95601.pep
RAEFGTRLNLCDSDAARARASKILAGLGFDQAMQARSTKSFSGGWRMRISLARALFMQPTLLLLDEPTNHLDLRAVLWLEQYLCSQWKKTLIVVSHDRDFLNTVCNDIIHLHDKSLHVYRGNFDDFESGYEQKXKEMNKXFEVYEKQMKAQGRLGTXAAQDKVKASMSKAIKNCKGRQGKNW

SEQ ID NO: 201184 - protein, 95 aa, Triticum aestivum
  unsure (1)..(95): unsure at all Xaa locations
  Clone ID: PAT_TA_95602.pep
ARRILLPRRLKMQIFVKTLTGKTITLEVESSDTIDNVKAKIQDKEGIPPDQQRLIFAXGKQLEDGRTLADYNIQKESTLXLVLRLRGGMQIFVKT

SEQ ID NO: 201185 - protein, 114 aa, Triticum aestivum
  unsure (1)..(114): unsure at all Xaa locations
  Clone ID: PAT_TA_95603.pep
HFLGTFLSSPALPFESRPVYPACHGGGAARSGDGMGDRVALVYNRFRSVLALVASGLVLFGSFSPDQASGFQWPAFSSSYCLRRQARNPKVPRHPSQLQSTAVPFFLSXISNRQ

SEQ ID NO: 201186 - protein, 71 aa, Triticum aestivum
  unsure (1)..(71): unsure at all Xaa locations
  Clone ID: PAT_TA_95604.pep
WAFPXSDMXGDPRTRAAGXPSSSPARRXLQALPLXAPPXLALITPXPPXPMXAVFYHQVVCXSPSASPXSL

SEQ ID NO: 201187 - protein, 164 aa, Triticum aestivum
  unsure (1)..(164): unsure at all Xaa locations
  Clone ID: PAT_TA_95605.pep
ASQNSYSNVFSSLKCVSVWLKLLVPRSGVSIYAIRVQMALAIKGLPYDYLPEDPGCKSDLLLASNPVHKTLPVLIHGGRPVCESLIIVEYLDDTFPGNGASILPTDPHRRAVARFWADYIDXKMFLASAFGKQQEVQGGNLAGSGPKGSLAAQWWGGALWGLCN

SEQ ID NO: 201188 - protein, 83 aa, Triticum aestivum
  unsure (1)..(83): unsure at all Xaa locations
  Clone ID: PAT_TA_95606.pep
ASKLPAXDXXKIEDAIDAAIXWXDXNXLAEAXEFEDXMKELXALCNPIIAXMYXGAGADMEGGMDDXTPXXSGGPGPKIXXVD

SEQ ID NO: 201189 - protein, 151 aa, Triticum aestivum
  unsure (1)..(151): unsure at all Xaa locations
  Clone ID: PAT_TA_95607.pep
MGKEKTHINIVVIGHVDSGKSTTTGHLIYKLGGIDKRVIERFEKEAAEMNKRSFKYAWVLDKLKAERERGITIXDIALWEFXETTKYYCTVIXDAPXHRDFXSKNMITGXTSQADCAVLXIDPTXGGFEXGYSXDGKPLXASLLQPVNYLR

SEQ ID NO: 201190 - protein, 172 aa, Triticum aestivum
  unsure (1)..(172): unsure at all Xaa locations
  Clone ID: PAT_TA_95608.pep
MANPRVFFDMTVGGAPAGRIVMELYKDAVPRTVENFRALCTGEKGVGKSGKPLHYKGSAFHRVIPDFMCQGGDFTRGNGTXGGESIYGEXFAXEXXVHKHTNPGSLXGPTPANTNGPILNLDVPAIGSTGTRFGKPMDSQEIKRSTVKKSIAMSNRRVARLSPPVCKKCSCL

SEQ ID NO: 201191 - protein, 103 aa, Triticum aestivum
  Clone ID: PAT_TA_95609.pep
MEHKETGCQSREGPILCVNNCGFFGSAATMNMCSKCHKEMAMKQEQAKLAASSFDSIVNGGDAAKEHLAAGSTAVAVAHLRRAYRTAADIAGPSGHGNASGAH

SEQ ID NO: 201192 - protein, 93 aa, Triticum aestivum
  unsure (1)..(93): unsure at all Xaa locations
  Clone ID: PAT_TA_95610.pep
GWSXXXTAXXRXXCXRRGXXSNXRSHSLNVVHXHVTVQRPGXRXXVPDLHIKLIXXRPSLXRXGLAWPSMYECMYLSELMSTYWLILXRRVRL

SEQ ID NO: 201193 - protein, 111 aa, Triticum aestivum
  unsure (1)..(111): unsure at all Xaa locations
  Clone ID: PAT_TA_95611.pep
MRECISIHIGQAGIQVGNACWELYCLEHGIQPDGQMPGDKTVGGGDDAFNTFFSETGAGKHVPRAVFGNXEPTVIDEVRTGAXASLQPGXFIXGKEDXANNLAVAFTLRNC

SEQ ID NO: 201194 - protein, 150 aa, Triticum aestivum
  unsure (1)..(150): unsure at all Xaa locations
  Clone ID: PAT_TA_95612.pep
FNXXAXFEXRXXSXPPXMGXLXFLNPSXDEFSXFYPXSPFHXDNEPLXXXTQIYDRHESKDXSLELLGSSAVIPGYFYPLSESXSTRDSRIICRFXLCSTQSVFTVRQVYTISSRAESTLEPTFAHLRYSLGGIRPQINYPPRSVPPPPE

SEQ ID NO: 201195 - protein, 40 aa, Triticum aestivum
  unsure (1)..(40): unsure at all Xaa locations
  Clone ID: PAT_TA_95613.pep
MPAGHGLXSRTXXLFXRPFRXXGYIPLTXYLRTYKVXEYX

SEQ ID NO: 201196 - protein, 104 aa, Triticum aestivum
  Clone ID: PAT_TA_95614.pep
FGTLASCAAAAAAQRIRQAPELAGSDGRHVLRPPHRRRAQGPPRRTSAGKTYISRRWDSPKDDVKVFRGGAPLKPAPIPRTLPAGYTPSPRLFFKVPWQSSGGD

SEQ ID NO: 201197 - protein, 115 aa, Triticum aestivum
  unsure (1)..(115): unsure at all Xaa locations
  Clone ID: PAT_TA_95615.pep
MAAAFSSTVGAPASTPTNFLGKKLKKQVTSAVELPWQESKANRFTVMAAENIDEKRNTDKWKGLPYDISXDDQAGITQXGKXIVGSLFQXRPTGERTHXAVLNSYXYFXQGIQEY

SEQ ID NO: 201198 - protein, 79 aa, Triticum aestivum
  unsure (1)..(79): unsure at all Xaa locations
  Clone ID: PAT_TA_95616.pep
RGVRPPPPRAPAAGSSRRTEAFLLLRGPRLPPPVWATVDXPLGMPLEXAEGHAXRFFLWGFXCLTFXWAINCCYXXXVS

SEQ ID NO: 201199 - protein, 82 aa, Triticum aestivum
  unsure (1)..(82): unsure at all Xaa locations
  Clone ID: PAT_TA_95617.pep
GVAPRTFKLGGGIXTPPPNVXNYPRVRVXHXXSPKXXGXXWHXPKHWSSIXALXTRPELDLALXPXPXIPPGPXLNXFKPLF

SEQ ID NO: 201200 - protein, 143 aa, Triticum aestivum
  unsure (1)..(143): unsure at all Xaa locations
  Clone ID: PAT_TA_95618.pep
PDVQNLTLQLGSQRLESRWTLNSPRVFCHLRHAQILLIIHREDSDKILYLVSFLRVAPFNWRGWEVHFMALYFVXCNRMGPSETRNTAVWKDKYVNLKDLRVTGFKRXKRQLIPPACRLKCPCNKGLTTQLSLDNDPNLIPLR

SEQ ID NO: 201201 - protein, 121 aa, Triticum aestivum
  unsure (1)..(121): unsure at all Xaa locations
  Clone ID: PAT_TA_95619.pep
XSIXLVCSSIVSLGGXIVGPKLLFACSPISQNAFLPWELXWGCXHVCRXEVLSXPLSSMVFQAPREPIMVVASILGVRNIHSDGGRPLISVSLRTKKMLVYTGDILLIENDVSMLKSVKNH

SEQ ID NO: 201202 - protein, 115 aa, Triticum aestivum
  unsure (1)..(115): unsure at all Xaa locations
  Clone ID: PAT_TA_95620.pep
MKLQVAFFLLVTMAATARAVTFDASNTASGTAGGKRXFDNAVGLAXTQKQASPDAPTFIWETXNQRAAADXXLXXAVTSSXGGIXGXPFNNGXRINLXGNNXGGKRREVXKGGYR

SEQ ID NO: 201203 - protein, 90 aa, Triticum aestivum
  unsure (1)..(90): unsure at all Xaa locations
  Clone ID: PAT_TA_95621.pep
MAPTVMASSATSVAPFKGLKVNRRLPSSRRSNGXLTSXSVXNGGRIXGACKCWPTQGXKXXXTFPNLQXSNNGASLXKXDYLIPSKWXLA

SEQ ID NO: 201204 - protein, 205 aa, Triticum aestivum
  unsure (1)..(205): unsure at all Xaa locations
  Clone ID: PAT_TA_95622.pep
XKSKGLRGSIGEAXXLYLPRLPSGSXGLXIVXEPXCXXSXLXFXVGXXGGSCXSXHKRFRXGXAAVSGLACKSCLRGGGVSLVXHNLFXGXRRGAFVXXGLPPACLXRXELSLHKGTRRVGLSFFHQPPPPTGRRSPALVFLXAPLPAXSELGTVPFSKLQRPAAQFRRRRARPFAFLQACSRRSRGXALPCHQFSPSLSTQXAA

SEQ ID NO: 201205 - protein, 125 aa, Triticum aestivum
  unsure (1)..(125): unsure at all Xaa locations
  Clone ID: PAT_TA_95623.pep
YMIIPSIVEVHAXQXGTXLGWKSTKDHGGLYIIGLVAQXPGDHXGKCXIKNCSRAPPIGHLCLQXGXLXKEVFFNQSNGWTEVDGGAAGEDAPGGEGGDVRGLDAAGGEEAGEGGAGRRESHRRR

SEQ ID NO: 201206 - protein, 71 aa, Triticum aestivum
  unsure (1)..(71): unsure at all Xaa locations
  Clone ID: PAT_TA_95624.pep
SNLGTLMTRIGLRFPQACLXCYXXCXXRDPRSRXFEDSPIGERLNKMKEDGEDAVGVAPTPRFPHQHVSXA

SEQ ID NO: 201207 - protein, 128 aa, Triticum aestivum
  unsure (1)..(128): unsure at all Xaa locations
  Clone ID: PAT_TA_95625.pep
MAPAVMASSATTVAPFQGLKSTAGLPVSRRSSASLGSVSNGGRIRCMQVWPIXGHQEFRALSYLPPLSTEXSLKQXDYLIRPXGXPCLXFXKVGSXSRXXKXPXGNXNGXIXEIWXCQWVETKQQGEK

SEQ ID NO: 201208 - protein, 152 aa, Triticum aestivum
  unsure (1)..(152): unsure at all Xaa locations
  Clone ID: PAT_TA_95626.pep
LVPKAFRYQQHRWSCGPANLFRKMVMEIIKNKKVTLWXKIHVVYNFFFLRKVVAHIMTFVFYCLVIPATVLVPEVEVPKWGCVYIPAIITLLSXLGTPRSVHLVIFWALFENVXSLHXTXAXIGHWGAHXXNEWGXDRKLGDTXKTXCQNEN

SEQ ID NO: 201209 - protein, 180 aa, Triticum aestivum
  unsure (1)..(180): unsure at all Xaa locations
  Clone ID: PAT_TA_95627.pep
IFEVKATAGDTHLGGEDFXNRMVNHFVXEFKRKHKKDISGNPRSLRRLRTSCERAKRTLSSTAQTTIEIDSLFEGVDFYSTITRARFEELNMDLFRKCMEPVXEKCLTDXXMDXSTSMSRACWWSTRIPRVNSFARLFXRKDSARHQPDEXVAYXXASSSSPMLGRRDFPPSPRLWCGDV

SEQ ID NO: 201210 - protein, 96 aa, Triticum aestivum
  unsure (1)..(96): unsure at all Xaa locations
  Clone ID: PAT_TA_95628.pep
SXVGFVVGXXAPXCXAVVIAYGHRHKGYILSLKHQYVPNRXSLHPWHVQPCIYHTXERXRSFPFHXXQRXXXAXSYLXKXIXKXEEDSASXRIRHX

SEQ ID NO: 201211 - protein, 96 aa, Triticum aestivum
  unsure (1)..(96): unsure at all Xaa locations
  Clone ID: PAT_TA_95629.pep
RAEFGTRPSVRPSSAPPISPWTAPPRTLPPPPPQPPPSGRPSGRTRPKQEPGARSTAPXPXKDPGPAPPXQLNSPPXXPRPXSPPPTPXTPGGGLT

SEQ ID NO: 201212 - protein, 120 aa, Triticum aestivum
  unsure (1)..(120): unsure at all Xaa locations
  Clone ID: PAT_TA_95630.pep
MEQRKYGRSVPGMSGGEGSARRRGPLLSHPLTAAARRPLATAALRRVGVLAWRPPPRGPLLLPWPPPPPXPPGRRAPWPSPPSPAPRPCPSPCPPTPTRPGSPPPPWPRPPRSPRPASLS

SEQ ID NO: 201213 - protein, 147 aa, Triticum aestivum
  unsure (1)..(147): unsure at all Xaa locations
  Clone ID: PAT_TA_95631.pep
GMXAXXFENWQTGRHXRGRIGFXLRPXTLHRSTXGSGXRPRDGQGIXNLNRYWTRKHXVSSXNGLRLRASYLALGPKGRHFPPRXPKGGEEGLXGLNRQXFRHPWEGXDHAPKDQGPTGSPRSIKGEPKDVLRGMSFAQVRLRMXRH

SEQ ID NO: 201214 - protein, 190 aa, Triticum aestivum
  unsure (1)..(190): unsure at all Xaa locations
  Clone ID: PAT_TA_95632.pep
GXXXXNFGLVTYQXSSIGXCPRQRXPXPPPTFXLSPRLFLGRLXAGHAXXQXLXAHRXVCLGXXXMDPGVFXXTLGXNRAXLRNPVRPTPGSASSPALVPGDAXWRLQQAQGASRPLPATATATERKRRPRPPRSSDARTTMAVAVLLVPAGDASPLFWPFPHIFFLRLVVVVGRNDREEGGLGGAPGLA

SEQ ID NO: 201215 - protein, 126 aa, Triticum aestivum
  unsure (1)..(126): unsure at all Xaa locations
  Clone ID: PAT_TA_95633.pep
CLGGSQRSLGLVKQXFCTGSXWPNGPDRCIGLVQHCVGSTFRQSKPYPXNCLTTIPLLAFCGLWGFDMVGLSKGEXNKKYLLVMVDKFTKWIGAKPVKRAEARPVIDFISGVVHHYGVPPRAEFGT

SEQ ID NO: 201216 - protein, 178 aa, Triticum aestivum
  unsure (1)..(178): unsure at all Xaa locations
  Clone ID: PAT_TA_95634.pep
GLXFWNRLPSHQGGCXGILVXNXXGLAVGLGRGSPGXLWTRXRAXESXALXXAAXXKARXEEATRRXAVRLIVKKIRSVGHGXGLXCRXVAAVQDSPAGGGGCKPEALQVGRRSQELLLLLQVGCGGRHQGAGQRAAQDPQWIPGTAPSASTRWISRRSRDPSECAYWNLATIDVDRN

SEQ ID NO: 201217 - protein, 102 aa, Triticum aestivum
  unsure (1)..(102): unsure at all Xaa locations
  Clone ID: PAT_TA_95635.pep
QTTLYALPTKPFXGFXCSXFRSPLLTGIAFAFFSSWYLRCFQFAQVVSLPAHGFSRQFKRLTYLGISGSMLIFNSPKHLVACYALPRLWVPRYPPPRAEFGT

SEQ ID NO: 201218 - protein, 98 aa, Triticum aestivum
  unsure (1)..(98): unsure at all Xaa locations
  Clone ID: PAT_TA_95636.pep
MKGTKLAAILILQAVLVMGVLSHVNADYFPKCCNNCRPSPGSDVCDDAHPKCPKGAPACRVVSDXPRMWRCAGYESTVXDGPCGGPWQELRHPHICSA

SEQ ID NO: 201219 - protein, 101 aa, Triticum aestivum
  unsure (1)..(101): unsure at all Xaa locations
  Clone ID: PAT_TA_95637.pep
RFPASVRPSRERNTSRSTSSMAVRCHAAAALVSSRARLPSYLPPLLPSARPRPGTTRXGGYRRTAVRAMGAAPSXXSPSGQAXGKXXNASLXDXXVEXXLI

SEQ ID NO: 201220 - protein, 78 aa, Triticum aestivum
  unsure (1)..(78): unsure at all Xaa locations
  Clone ID: PAT_TA_95638.pep
MSCCGGNCGCGTACKCGNGCGGCNMYPEVEAAGATLLVSATATHKASSGGMEMAAXNGGCGCTQCKCXTSCGCSCCXC

SEQ ID NO: 201221 - protein, 85 aa, Triticum aestivum
  unsure (1)..(85): unsure at all Xaa locations
  Clone ID: PAT_TA_95639.pep
LVPNSARAPLCSPLLCSASSSCKRLDRSFKQAPRFDLIARAGTPMDHLLHHGHEMRRPSVPSHDAALRSVQKPPAKPWRAXAXLT

SEQ ID NO: 201222 - protein, 66 aa, Triticum aestivum
  unsure (1)..(66): unsure at all Xaa locations
  Clone ID: PAT_TA_95640.pep
PLSXPXRXXXRRHLXXXXSTXKRGRIXHGGRHDHXGWSXSVXALFMTNXLLXRXQFVLXVXHPRLL

SEQ ID NO: 201223 - protein, 166 aa, Triticum aestivum
  unsure (1)..(166): unsure at all Xaa locations
  Clone ID: PAT_TA_95641.pep
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDXRYWTMLKLPKFGCXDATQVLNXWRSQEGVPDPMSRIGSQLRKCMRNSLKHGKDPRLT

SEQ ID NO: 201224 - protein, 211 aa, Triticum aestivum
  unsure (1)..(211): unsure at all Xaa locations
  Clone ID: PAT_TA_95642.pep
ANFCSGIIATFAVGSSRRSARRCALPIPDPRPVHKGRPRHRRHGRRRRAGAGVRYAGRPARAQERPRPSASDGVRTVXPPPPGDPANGVVXKTWAXDPRPNLRPLYSLRRRRRRSPQDSRLTSSTGGXLLXTPLPLYKRTPGFXAVEXLQRIWADTXTTXXPGDXGIGTXFCHTXTCGSDGXLPRDXXVDEXIQARXXFIXIXQXLGPRGF

SEQ ID NO: 201225 - protein, 128 aa, Triticum aestivum
  unsure (1)..(128): unsure at all Xaa locations
  Clone ID: PAT_TA_95643.pep
MSGRKKTREPKEENVTLGPAVREGEHVFGVXHIFASFNDTFIHVTDLSGRGDAXVRITGGHEGQSDSDEHPLYASYAXISXMFLXDVXELGITVWHINSLLLGGKQDKIPSPGVXLALXSLHFRDNWT

SEQ ID NO: 201226 - protein, 72 aa, Triticum aestivum
  unsure (1)..(72): unsure at all Xaa locations
  Clone ID: PAT_TA_95644.pep
TNFVPPKKXPYLSSLFMMRSSTRCIHFTTLLHELKVPGHGKYMLKITQCVXGILPNNTXLTSIYXAXLRSKN

SEQ ID NO: 201227 - protein, 172 aa, Triticum aestivum
  unsure (1)..(172): unsure at all Xaa locations
  Clone ID: PAT_TA_95645.pep
RAEFGTRPAAKESRGDGGGDGDGAGAARTRRARVGRGGVPAGHPAGARPLLPHPLPRRLLRPSATNPTRTSSSAAASSDGPSASFSAVLLHRLLRPPPTPPPSGRRRRWSTRLHRPKRIRPVYTPXLQHSIQXVSSTXGXRNSGWRWXNQTASASLXKXIXTILWVTNMKLG

SEQ ID NO: 201228 - protein, 133 aa, Triticum aestivum
  unsure (1)..(133): unsure at all Xaa locations
  Clone ID: PAT_TA_95646.pep
PPVXGNLEXFTLSCRETPSRNGHAHVXGRFLLRXVEPTGYIMSYRTALRQHLPSVGALGRFRCGGGVPWAPAGGRGRRDGGGSRLKACRRWLRGREDRIQSPEQAAGGGGHIPGAKALGIVGSSGSSRAEFGT

SEQ ID NO: 201229 - protein, 34 aa, Triticum aestivum
  Clone ID: PAT_TA_95647.pep
PYEIVQNHRVDAAGPSTACALNMIISTWVVSTVS

SEQ ID NO: 201230 - protein, 149 aa, Triticum aestivum
  unsure (1)..(149): unsure at all Xaa locations
  Clone ID: PAT_TA_95648.pep
MAASLQAAXTLMPAKIGGRASSARPSSHVARAFGVDAGARITCSLQSDIREVASKCADAAKMAGFALATSALLVSGASXEGAPKRLTFDXIQSMTYMXVKGTGTANXXPTXTAASILPFKAXXXHEXVCLEPLNVKKDQNRGFKRQKTV

SEQ ID NO: 201231 - protein, 113 aa, Triticum aestivum
  unsure (1)..(113): unsure at all Xaa locations
  Clone ID: PAT_TA_95649.pep
LAXFPXGRGVXAXGSAKEILNXNXXWTRKQCRKSLKDSAWRLLLALGXQAVISSRPPKEEKRPQGLTGNSFATLGRVDHAAQDQEPHRGREVLRRDQDRSWRCPRQARLDGSA

SEQ ID NO: 201232 - protein, 73 aa, Triticum aestivum
  unsure (1)..(73): unsure at all Xaa locations
  Clone ID: PAT_TA_95650.pep
LVPNARGSNEEIARALRIALLLXNKSIQXVXQVYTXSDDLVLXKQFSYIIARHGLXXEIDDXIXAYENDXEML

SEQ ID NO: 201233 - protein, 95 aa, Triticum aestivum
  unsure (1)..(95): unsure at all Xaa locations
  Clone ID: PAT_TA_95651.pep
QXEHXSSIKILYFLTQCXNRXRRRACTAGLXXSARRGRPTRIFPNLPXGHRHASPLPRPPAPRTLAPDLSGEATASGGEGGGRRRRRRGAARGAD

SEQ ID NO: 201234 - protein, 87 aa, Triticum aestivum
  unsure (1)..(87): unsure at all Xaa locations
  Clone ID: PAT_TA_95652.pep
MXETEYRCFVGGLAWAXDDNNLXXXFSXYGEILXAXIINXRXTXRSHGFGFVXFXSXEXMRQAXQEXXGXELXRXXISVNXGQPGXS

SEQ ID NO: 201235 - protein, 87 aa, Triticum aestivum
  Clone ID: PAT_TA_95653.pep
LGAIGIIVFQCCCPSVAAALLLAEEEAQLWGVAGTRELSLVSALAPRALVICSPLFFFKARVSTVTYKTYGMCVCVPRVLPFPPPLI

SEQ ID NO: 201236 - protein, 136 aa, Triticum aestivum
  Clone ID: PAT_TA_95654.pep
MPSLVWLCLLLILSFHDGVAAIDQFLYNGFAGSNLHLDGVASVTQDGVLTLTTSAYNMQGHAFHPEAVPLGQFQWGGREFLRPLSVFRHHARTTTAVLAMGMGFVISVTQDCPMHSKGHTWGSPTIRVQSTSVSSP

SEQ ID NO: 201237 - protein, 106 aa, Triticum aestivum
  unsure (1)..(106): unsure at all Xaa locations
  Clone ID: PAT_TA_95655.pep
SWGXPEXXSXXXGQAXXXKGXLRXMQGLQPCXKCGTHAGDYNSSRXSSXVVLGSPCHRPLSPRRARQAQGSPGXMDRLACTRARPFXICRAAGYLPTELDRQQQIS

SEQ ID NO: 201238 - protein, 83 aa, Triticum aestivum
  unsure (1)..(83): unsure at all Xaa locations
  Clone ID: PAT_TA_95656.pep
YMEMPAKEKIYLIVXRTISIFXKKXQXFSXFFXNIKKXEXNXNGIXNIIFIRXLKEXKGVXLQPXTSYILAYIISRXXXRFGT

SEQ ID NO: 201239 - protein, 44 aa, Triticum aestivum
  unsure (1)..(44): unsure at all Xaa locations
  Clone ID: PAT_TA_95657.pep
FLXLISKIXSLLXLFXLSHXQIKRXIFXFEVXIXHCFXWCLXYI

SEQ ID NO: 201240 - protein, 142 aa, Triticum aestivum
  unsure (1)..(142): unsure at all Xaa locations
  Clone ID: PAT_TA_95658.pep
SSSALAVRAAAPGISIGEQKDGSEWPAARATRTRSVADMVRXMPVVYTSGLRNGERIDGFLYQYSRAEEVRIVCVCHGXFLTPAEFVAHAGXGEVXHPMRHIXXNPPSSSLTGRMHAGQVLRVWLQQPVSLEKSHRETAFFT

SEQ ID NO: 201241 - protein, 160 aa, Triticum aestivum
  Clone ID: PAT_TA_95659.pep
SCRIRHEVGMGSCSIYLQKDVPAFGLTVDRLKGVSTLSGQRQGLYNTIKVFMAGHYSFHVTDIYSSRIDERNIHAAFLGMAITDQPRCESAKKKRSSYACGDNSDCMDVQSGGYSCQCRPGHKRPQSVPYRWVSTTAQYNPIIKEVHKICGNTIWSPFWA

SEQ ID NO: 201242 - protein, 140 aa, Triticum aestivum
  unsure (1)..(140): unsure at all Xaa locations
  Clone ID: PAT_TA_95660.pep
MAPTVMASSATSVAPFQGLKSTAGLPVSRRSNGASLGSVSNGGRIRCMQVWPIEGIKKFETLSYLPPLSTEALLKXVDYLIRSXWVPCLEFSKVGFIFREHNASPGYYDGRYWTMWKLPMFXCTDXTQVINEVEESRXDT

SEQ ID NO: 201243 - protein, 122 aa, Triticum aestivum
  unsure (1)..(122): unsure at all Xaa locations
  Clone ID: PAT_TA_95661.pep
LVPNSARGRGFRVSAVXXXPRXPEGXXAEXYXSXLGXMPXXSPXXIXXXYYNCMXACHPXISRGNDPXVXNFCMFIXXVYTVXTXPVXXAVYDXINGFTAXTITPFMGDAPRDHVXVDXFTS

SEQ ID NO: 201244 - protein, 122 aa, Triticum aestivum
  unsure (1)..(122): unsure at all Xaa locations
  Clone ID: PAT_TA_95662.pep
MATTAMALSPSSFAGKAVKDLPSSXLFGEARVTMRKTXAKAKPVSSGSPWYGSDRVLYLGPLSGXPPXSYLTGEFPXDYGWDXAGLSXXPRLSKGSVSPVASGRSGALPVAAWQFKLLRRSK

SEQ ID NO: 201245 - protein, 59 aa, Triticum aestivum
  unsure (1)..(59): unsure at all Xaa locations
  Clone ID: PAT_TA_95663.pep
MASATLLXSSFLPKKAEWGVTRQVSAPRVXMVXRXGAYXDELXKTXXTIXXXXRGILAM

SEQ ID NO: 201246 - protein, 86 aa, Triticum aestivum
  unsure (1)..(86): unsure at all Xaa locations
  Clone ID: PAT_TA_95664.pep
DALRQTRVDDSWITQXDILNXPQVSGHTKATKXVSFHHLIKKXXXNMGTPMXTGFVMVPXKRRQEVRLLXYXXDTDXXXGPGFXTX

SEQ ID NO: 201247 - protein, 197 aa, Triticum aestivum
  unsure (1)..(197): unsure at all Xaa locations
  Clone ID: PAT_TA_95665.pep
WQELAGVLVFSAVPFTAVKAIANSPLGASLRRRLESRKAFAAAEADALRAAAREARSSSFWXYGGARPRWLGPLRYDYPEHLAGDXPGDYXFDIAGXGGTRCFPPTTSTLEILHCPWACLLLLGVVVPELLVLFGIMILWDLFVEIGIKIKGDILDYLGSWVMLVGKNACCKPLMVGYCGSLNGITLGTVRHPWCQR

SEQ ID NO: 201248 - protein, 156 aa, Triticum aestivum
  unsure (1)..(156): unsure at all Xaa locations
  Clone ID: PAT_TA_95666.pep
MSPQTETKAGVGFKAGVKDYKLTYYTPEYETKDTDILAAFRVSPQPGVPPEEAGAAVAAESSTGXTWTTVWXTDGLTSLDRYKXRCYHIXPVAGEDSQWICYVAYPLDLFEXVPLLTMFTSIGGNVFGSXALRAXXLXDLRIPLLIKNFQGPLMQI

SEQ ID NO: 201249 - protein, 94 aa, Triticum aestivum
  unsure (1)..(94): unsure at all Xaa locations
  Clone ID: PAT_TA_95667.pep
MAAATMALSSPAMAGTPVKASRAAPFGEGRITMRKTAGKPKVAASSXPWYGPDRVLYXGPLSGRPPEYFNGXFPXYXWETXGFPADPELRKNRS

SEQ ID NO: 201250 - protein, 94 aa, Triticum aestivum
  unsure (1)..(94): unsure at all Xaa locations
  Clone ID: PAT_TA_95668.pep
XPLGNIXGVXFFPVFQILRXTXPIKLXGRSLKCFLCQTGYLTVPFLGGMSINFQIHFAAPVATXTVFLIGTVVALWLGIGATLPIDKSLTLGLF

SEQ ID NO: 201251 - protein, 55 aa, Triticum aestivum
  unsure (1)..(55): unsure at all Xaa locations
  Clone ID: PAT_TA_95669.pep
MDRRCASXLXXKWXSGXPGXXPXXXXPWXLRPISTNSETSXVREPRRSNQVXVXG

SEQ ID NO: 201252 - protein, 66 aa, Triticum aestivum
  unsure (1)..(66): unsure at all Xaa locations
  Clone ID: PAT_TA_95670.pep
MAAAGDAGXKKMITLXNXDGXEFXVXXEVAMXSHTIRHIIXDDCAXNXIXAPXNVNXEDXXXVIEY

SEQ ID NO: 201253 - protein, 101 aa, Triticum aestivum
  unsure (1)..(101): unsure at all Xaa locations
  Clone ID: PAT_TA_95671.pep
AVDPKKGSLGTIAPIAIGFIVGANILVGGAFSGASMNPAVSFGXALVXWEWGYQXWVYWVXPXIXGXLAXGVIYEAAPHLQHPRSSXXLXTXATKLACEPL

SEQ ID NO: 201254 - protein, 98 aa, Triticum aestivum
  unsure (1)..(98): unsure at all Xaa locations
  Clone ID: PAT_TA_95672.pep
LVPNSARSFLXILXXLAGKGFXXRGCXXXSPQXGGXLPXFXXRXXAXLGSFSSSSNIXLLQXAXXCRXQXRLLWKAQXPXHXNTAXKPRQNICXXGRP

SEQ ID NO: 201255 - protein, 101 aa, Triticum aestivum
  unsure (1)..(101): unsure at all Xaa locations
  Clone ID: PAT_TA_95673.pep
MAWPPSHTPPPPAPPSEPTPPRDSSTTQPSTPASCEPTAALPXRPRRPPPPPFRFLAVAAGGHSPPPSPARVPLRSPFGAVSPRARAVRRLPKAAARPAGA

SEQ ID NO: 201256 - protein, 147 aa, Triticum aestivum
  unsure (1)..(147): unsure at all Xaa locations
  Clone ID: PAT_TA_95674.pep
VLYLGPLSGDPPSYLTGEFPGDYGWDTAGLSADPETFAKNRELEVIHCRWAMLGALGCVFPELLARNGVNSAEAVWVKAGXVFSEGGSTTSGNXNLVHAQXILAIWAASGXNGAVXGYAXPXAXPQIXAPLPRGSFTPGPKTSLKRN

SEQ ID NO: 201257 - protein, 147 aa, Triticum aestivum
  unsure (1)..(147): unsure at all Xaa locations
  Clone ID: PAT_TA_95675.pep
VEFHPPRCNYRAVRRPARVLRAKTPPRKKHPTPTFDSNDHXTRCDSANSEACRAYGASIDXXARMAATXNAKSXXRRGVRRLXRCIKTXXXGGGXXLSLIRTXXPTQHRWSXRRPKYTLGGSMSDKXAKAPMSXXSRNQXSGRGLMR

SEQ ID NO: 201258 - protein, 121 aa, Triticum aestivum
  unsure (1)..(121): unsure at all Xaa locations
  Clone ID: PAT_TA_95676.pep
MSFSSSSRRLCIAWVLLLCLCVLLCRVQGGSSRKLYIVYLGDVKHGHPDHVVASHHDMLTDLLGSKEESVASVVYNYKHGFSGFAAMLTXEQAKQLAEFPEVVRVHRSKTHTATTXKSWDF

SEQ ID NO: 201259 - protein, 157 aa, Triticum aestivum
  unsure (1)..(157): unsure at all Xaa locations
  Clone ID: PAT_TA_95677.pep
MAPAVMASSATTVAPFQGLKSTAGLPVSRRSSASLGSVSNGGRIRCMQVWPIEGIKKFETLSYLPPLSTEALLKQVDYLIRSKWVPCLEFSKVXFVFREHNSXPGYYNGRYWTXWKLPMFGCTDAXXVLNEVXEXXKXYPDPIRFIGFKTAQVXXSV

SEQ ID NO: 201260 - protein, 106 aa, Triticum aestivum
  unsure (1)..(106): unsure at all Xaa locations
  Clone ID: PAT_TA_95678.pep
PLSSPPRRRQPSSPSRAFSSPPSAPSQGSSSPRPSPKSRSPPPSNRSLSSSSCLTSLSPPPNPSPAPAXPAPPPSSPSPSRPPPHRTRWDARRQASRGWGAAETRG

SEQ ID NO: 201261 - protein, 78 aa, Triticum aestivum
  unsure (1)..(78): unsure at all Xaa locations
  Clone ID: PAT_TA_95679.pep
MAETXYRCFVGXLAWXTDDHXLQXAFSQXXEILDAKIINDRETGRSRGFGFVXFXNXESNXQAIXXXNXXXHASTSPS

SEQ ID NO: 201262 - protein, 158 aa, Triticum aestivum
  unsure (1)..(158): unsure at all Xaa locations
  Clone ID: PAT_TA_95680.pep
IQSSPPTISPGNLRSERSEGSLVLLLKMQIFVKTLTGKTITLEVESSDTIDNVKAKIQDKEGIPPDQQRLIFAGKQLEDGRTLADYNIQXKESTLHLVLRLRGGXMQIFVKTLTGKTITLXEXESSXDTIDNVKAKXQDKEGSPGXXRLILPATTGWP

SEQ ID NO: 201263 - protein, 75 aa, Triticum aestivum
  unsure (1)..(75): unsure at all Xaa locations
  Clone ID: PAT_TA_95681.pep
VVISNXVXDLARTSNACVTKXNCEYXHFFHVNFCVGSSTEIRGACRHGGTHXRSVTRQLDCLAIHEVIGSCMMAS

SEQ ID NO: 201264 - protein, 165 aa, Triticum aestivum
  unsure (1)..(165): unsure at all Xaa locations
  Clone ID: PAT_TA_95682.pep
LASALDAHDARCLNAMRVLRNLCAYSGEEHRTRLSTVTKAMPTVLGATMTGRDKILEVSVGLTTQICRFVDIEQFTAELRRAGLNERAYXSGWVGILRQYRYPEIKXVPRMRRFVVQQIAWLMTSSTRRDGGGFVDLLRELGMRSARGGARYQAYIYYRAHGVKS

SEQ ID NO: 201265 - protein, 209 aa, Triticum aestivum
  unsure (1)..(209): unsure at all Xaa locations
  Clone ID: PAT_TA_95683.pep
EGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLXADYNIQKESTLHLXVLRLRGGMQIFVKTXTGQDIXLEVDPLTXIDNVKXKIKDKEGIPGQQRLXFLVNTEDGAPGYTSEGSPGRGAIILQGSRGWSKLKSQGPFVFSSR

SEQ ID NO: 201266 - protein, 195 aa, Triticum aestivum
  Clone ID: PAT_TA_95684.pep
MLCAPPQTLRPSRPLLPPPRCSGSAQPSPSSAGNIRRQVLQPEGRAKLDPRSDRDFYAFPRLVKHVDDGFLATLTDLYRERLRPESDVLDLMSSWVSHLPPEMRFRRVVGTGQRARAGKEPRLDYSSSVTQPGQRRDSRRSFTPCSDVSTESPKNFPEITGNVDKLRCSQKLRKVAKPSIVYSGYHSSALDRESP

SEQ ID NO: 201267 - protein, 101 aa, Triticum aestivum
  unsure (1)..(101): unsure at all Xaa locations
  Clone ID: PAT_TA_95685.pep
LHRGGGPSHTTXKPSGICPPXTHAQQNEFVCDRRAIKYGYIYNSAKKFNYTGKIVFGXKFVPHSQSPLNISILIYIPCSCSKENSSVCXVHHTQCSPLNRL

SEQ ID NO: 201268 - protein, 158 aa, Triticum aestivum
  unsure (1)..(158): unsure at all Xaa locations
  Clone ID: PAT_TA_95686.pep
MASMVAAARLAXGVSRLXAQGXTAXGLPPGXLXLPPPRXRLRSVRCCAVRHPXGGGGGXVDAGEEFVGFFXEAWPYIRGHRGSTFEXVISNXVVXGPHLDRILHDISLLHXGLGINFVLVPGTHVXIDKLLSXKXNXXXYVGQYRXTDSDXLEAAMEL

SEQ ID NO: 201269 - protein, 164 aa, Triticum aestivum
  unsure (1)..(164): unsure at all Xaa locations
  Clone ID: PAT_TA_95687.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLXSSYEYVSXGLKKYDFDNTWEASNRSCFMDNLLSLQELMTCQHQDSSGYWGRKVKESSMELSQDG

SEQ ID NO: 201270 - protein, 138 aa, Triticum aestivum
  unsure (1)..(138): unsure at all Xaa locations
  Clone ID: PAT_TA_95688.pep
NLRGPFLDRRQRIPDRTSSCFFERRSRACVRLPQAEXWARGVGAFMTHCGXNSALEAIMSXLPMYAWLREGXVKAEEIDAKLRLVMETEEGRKLREMLAAARKMASDAIGDGGSSEVAFAEFLRDLESSSMENEGCNN

SEQ ID NO: 201271 - protein, 55 aa, Triticum aestivum
  unsure (1)..(55): unsure at all Xaa locations
  Clone ID: PAT_TA_95689.pep
PXTXASXALSXKCGXPLRXXXDAAXRSXLDTXMXCAVIXSLIVXIYYXHTMITXT

SEQ ID NO: 201272 - protein, 98 aa, Triticum aestivum
  unsure (1)..(98): unsure at all Xaa locations
  Clone ID: PAT_TA_95690.pep
MAHLPVRHYAVYMAGRGPLLLTSSFSSPLLSISSSPPXHLPFSPXYYPPPPPPXPVXPPPPLRXPPPPSSPPLTVSPPSSPVXSSSLLSGEPLLPPLW

SEQ ID NO: 201273 - protein, 90 aa, Triticum aestivum
  unsure (1)..(90): unsure at all Xaa locations
  Clone ID: PAT_TA_95691.pep
AERXEXQXEXGAPERXXRXGQXRAGXRSASEDRASAASPLHAPCXPXLSXGAPPXXPXGIDXRPIPPLARWILLLPLAELERRKWXXLIN

SEQ ID NO: 201274 - protein, 171 aa, Triticum aestivum
  unsure (1)..(171): unsure at all Xaa locations
  Clone ID: PAT_TA_95692.pep
LVPNSARGKTAGKPKVAASSXPWYGSDRVLYLGPLSGDPPSYLTGEFPGDYGWDTAGLSADPXTFXKNRELXVIHCRWAMLGALGCVFPELLARNGVXFGEAFXSKAGXQSSSXGGXHYLXNPTWCTRXHLXIWAASGLNGPLXVRVAXGPRQIXTVYPXXLPWLPKTQPD

SEQ ID NO: 201275 - protein, 92 aa, Triticum aestivum
  unsure (1)..(92): unsure at all Xaa locations
  Clone ID: PAT_TA_95693.pep
XVXXSAIXNIINXMFRXEXEDEVEEHPLXEGDXLDGCXXFAYXXAADXXCXTVLXXCRRPQXCXLXTALRXCXXFSLSLSLRGNFSCRIRHE

SEQ ID NO: 201276 - protein, 143 aa, Triticum aestivum
  unsure (1)..(143): unsure at all Xaa locations
  Clone ID: PAT_TA_95694.pep
IDMLIKKKIANAHHHQQQQQQLLQQQSNSQQQHHQAVSSQQSQSSNQLLQQEKPGXGNMPVDGGMPILFGGXDQSTKKRKXLVFLRVRANISXTGNTAXPSPKFAPPTLPIHTPRDSDANTTLSADGVSSKTLGMFGXXXTGT

SEQ ID NO: 201277 - protein, 107 aa, Triticum aestivum
  unsure (1)..(107): unsure at all Xaa locations
  Clone ID: PAT_TA_95695.pep
SALAXAXRTLPXAXGFSPRXXPSFPSQXIXANRXWLWFPXPRFGWGRGNDXLRDEEEXVXPEAXPTRREARRRGEEEREAGEVRRGGIEAFPCLAFCGGVAQMLRRL

SEQ ID NO: 201278 - protein, 107 aa, Triticum aestivum
  unsure (1)..(107): unsure at all Xaa locations
  Clone ID: PAT_TA_95696.pep
FXXXPYVPVGQTAYXPCLIWXSCRRFRSXXKVAWQIHPPCRVXIRQPTSGWQADRQCPVVHVRLIXEAHRFSLXSPFGRRPCRPVXGERTGRRQVVVAMQVVTEEEE

SEQ ID NO: 201279 - protein, 61 aa, Triticum aestivum
  Clone ID: PAT_TA_95697.pep
YRAPGTQALDLIIRFLAEPGDTVLLDDPCYFSFQALARAHRLRMVGVPFGPEGPDLAAFEQ

SEQ ID NO: 201280 - protein, 88 aa, Triticum aestivum
  unsure (1)..(88): unsure at all Xaa locations
  Clone ID: PAT_TA_95698.pep
XSXXVFXXXLMXSYIYIYIYIYIYIYIYIYIYNMPTEAQSIQGQFHPKPSLRSHKLKPQLGAITYLFTHAEQLPSNTMEMICRPTLSG

SEQ ID NO: 201281 - protein, 125 aa, Triticum aestivum
  unsure (1)..(125): unsure at all Xaa locations
  Clone ID: PAT_TA_95699.pep
LTXXEXFYXPTGXFIILXFXXXKRLKLGSRSWKPXLTKSTRFFEFPMLFGXFLTLPTLNFSTRFSTVPLNPRVNHASKICSAVKFIITYPGSLFFCCYIFSSVQNNQYLRFQILTDDGQLKGLYL

SEQ ID NO: 201282 - protein, 128 aa, Triticum aestivum
  unsure (1)..(128): unsure at all Xaa locations
  Clone ID: PAT_TA_95700.pep
MANPRVFFDMTVGGAPAGRIVMELYKDAVPRTVENFRALCTGEKGVGKSGKXLHYKGSPFHRVIPDFMCQXGGDFNQRATDRRRSIYGEXFADEXFVHKHTNPDSLHGKRGPNTNVPFSSARPLHGST

SEQ ID NO: 201283 - protein, 99 aa, Triticum aestivum
  Clone ID: PAT_TA_95701.pep
VEFAGVQCAAQHLTRVQKAYVQQLYVEAFEQRHSLQEAEPLPAAMLLHASSSSNSLPMLQNAAPVAPPPLPATPLWFQSNQELDLQIVDELPDQNGCFG

SEQ ID NO: 201284 - protein, 96 aa, Triticum aestivum
  unsure (1)..(96): unsure at all Xaa locations
  Clone ID: PAT_TA_95702.pep
ARYRSXRRIGTGPPLDAPRLTSLICCRPPLXDYXSSHMSHATIAXAQPSLSDRSSSIVCISLPKSSTRFGGRNPHEDLSVTTAIHRGATAAGQSGC

SEQ ID NO: 201285 - protein, 103 aa, Triticum aestivum
  unsure (1)..(103): unsure at all Xaa locations
  Clone ID: PAT_TA_95703.pep
LWQQKYFITLSLLQNSQEKXTLIRNDLXLIRAFLKEIXMKLHXWXXRTWXGNPILAXDIXXLWXILXLWXHTKXYGAXXINLENPXXLPSKXRLXXTILNLLK

SEQ ID NO: 201286 - protein, 152 aa, Triticum aestivum
  unsure (1)..(152): unsure at all Xaa locations
  Clone ID: PAT_TA_95704.pep
MASTFSGDETAPFFGFLGAAAALVFSCMGAAYGTAKSGVGVASMGVMRPELVMKSIVPVVMAGVLGIYGLIIAVIISTGXNPKAKPYFLFDGYAQLSSXLACGXAGLAAGMXIGIVGDAGVXATRRTKLXSECTLPKPCLGSCRNILACGNP

SEQ ID NO: 201287 - protein, 65 aa, Triticum aestivum
  unsure (1)..(65): unsure at all Xaa locations
  Clone ID: PAT_TA_95705.pep
FTHHMWIGXFLIVXAAAHAXXFMVRDYDPTTXYNDLXDRVLRHRDAXISHLNWXXIXLXFHSXGL

SEQ ID NO: 201288 - protein, 163 aa, Triticum aestivum
  unsure (1)..(163): unsure at all Xaa locations
  Clone ID: PAT_TA_95706.pep
MAAQSLLFAAAAPLFQAPASARPFQSLRIVCTPXGATAAAKGAPSVAXDATKESKSAVLKGTSXVRGVRHVTQERRRPTTVNVRXTGLLPGLHGSTSHEFGXDTTXGCISTSHIFNPKRLTIXXPXDESVMPGDLGNCCAEWRGTHFIPILDGKHCLENVGIN

SEQ ID NO: 201289 - protein, 138 aa, Triticum aestivum
  Clone ID: PAT_TA_95707.pep
VGSLSPSPLPPPPPPPPTKMLAARRHAASTPAPLLLRRLSAQPQPKAPVPPPPPPPSDEGAAAWARRAAALSLLGLTGAVAASTFKRLLRLPLLSNQAMGKTKNNKAIRANGPWVHASIAVRAVLSLFPFRAQGTVSN

SEQ ID NO: 201290 - protein, 131 aa, Triticum aestivum
  unsure (1)..(131): unsure at all Xaa locations
  Clone ID: PAT_TA_95708.pep
SRACRTGVANYKLQIICNYKVATGLLIIQAITNYLQLQSKCGLANFDAQVSEYPIRTARRYDNRFRRGAGSQGNSHAPPCVQRGRKRKAKRRSHGLLRRATPGIGPGXCPPAWGFVFRADSSSXQNSVXQV

SEQ ID NO: 201291 - protein, 175 aa, Triticum aestivum
  unsure (1)..(175): unsure at all Xaa locations
  Clone ID: PAT_TA_95709.pep
STFPHPSFPQPRCCXAPXNVATDEXFSCSLTEFHXDGELKXTAXDVAXVLGVDTQFVLPQAVSSLSDGGNSFLMEGRXDEVXGGCSSLKAVEQQLSTGVXXLQREFNIVAAAGRSHGSVGVDPDVLAHRDRNRDILLQKLAASVESRDKVLVEMSRLLILESRFRVGSNFNLEVL

SEQ ID NO: 201292 - protein, 167 aa, Triticum aestivum
  unsure (1)..(167): unsure at all Xaa locations
  Clone ID: PAT_TA_95710.pep
MASTSCFLHQSTARLAASARPAPAVGRTQLFVCKAQKSDEAASDAAVVTSRRAALSLLXAGAAAVAVKXSPAAAAYGEAANVSGKRRKNTDSXAYSGKGXKLMIXAKWDPTXSVXXPGASVRYEGNFXANXXSPVIXXPTTKKNRYPRRILSKSVLPTSTVENDRGW

SEQ ID NO: 201293 - protein, 154 aa, Triticum aestivum
  unsure (1)..(154): unsure at all Xaa locations
  Clone ID: PAT_TA_95711.pep
MTEVCVKAAVGHPDTLGDCPFSQRVLLSLEEKKVPYQMKLIDVSNKPDWVLKINPEGKVPXVYNGGDGKWXADSDVIIQSLRRIPTPHLYPAEYHXWIXNFSTFVNFXXDKDANXGSXKXXXXYLQGXKKNXKPMXXINGAXTPLSTWYNSKPG

SEQ ID NO: 201294 - protein, 156 aa, Triticum aestivum
  unsure (1)..(156): unsure at all Xaa locations
  Clone ID: PAT_TA_95712.pep
MSPQTETKAGVGFKAGVKDYKLTYYTPEYETKDTDILAAFRVSPXPGVPPEEAGAAVAAESSTGTWTTVWXTDGLTSLDRYKGRCYHIEPVAGEDSQWIXYVXYPLDLXEXGSLTNMLLPLEVTILVQSLSAPRLEXLXFPYXSKLQRPPKDPIKI

SEQ ID NO: 201295 - protein, 95 aa, Triticum aestivum
  unsure (1)..(95): unsure at all Xaa locations
  Clone ID: PAT_TA_95713.pep
MASATLLKSSFLPKKAEWGTTRQAAAPKPVTVSMVVRASAYADDFVKTAKTXASPXQGILAMDXXNAPVXKTCSIGLXDXEPPVYSCIQAWNNPG

SEQ ID NO: 201296 - protein, 160 aa, Triticum aestivum
  unsure (1)..(160): unsure at all Xaa locations
  Clone ID: PAT_TA_95714.pep
XFXFFXFFYHQXXLIFICFNMCPXNINVHSFNTWXTLGLCXIXATGHLENTKAGGHXXXQXXISKXTXSNTKVQXEAIXIAXRKXGXXXSXXATSFXITTHIGAQIXNNHDDITFHTEQXRXPXSXAHRQVNXXLKSPWNIXILXXVXXMXASXGLVTTQ

SEQ ID NO: 201297 - protein, 79 aa, Triticum aestivum
  unsure (1)..(79): unsure at all Xaa locations
  Clone ID: PAT_TA_95715.pep
MMQPPPPSQPQPGMGAXMPPQGAGGXPPHWGXIXPVNDHXAQPPPQQQPPPQAMWGQPPPQAXPYXQVPAPQQVLRAAP

SEQ ID NO: 201298 - protein, 166 aa, Triticum aestivum
  unsure (1)..(166): unsure at all Xaa locations
  Clone ID: PAT_TA_95716.pep
LVPNSARGGVMLGADQPVILHMLDIEFAAEALKGVKMELIDAAFPLLKGVVATTDVVQACTGXVNVAVMVGGSPXKGRNGKGRMFMTKNVSNPTKVXXLSLELQCNPQTASLGVSNPTNTNXLNLEGVXXTYPWRKNHCXTXLNHNXAXXXFLKXWXPIPDXKNAG

SEQ ID NO: 201299 - protein, 162 aa, Triticum aestivum
  unsure (1)..(162): unsure at all Xaa locations
  Clone ID: PAT_TA_95717.pep
MAPAVMASSATTVAPFQGLKSTAGLPVSRRSSASLGSVSNGGRIRCMQVWPIXEGIKNSETLSYLPPLSTEXXWKQVDYLDXSKWXPAPXQASWFLSRXXNXSPXYYDGPYWDKXNLPCLXGPHKLNEWRSQEGLTLFPFNCAKWMRQASSNGVRGSGKAKY

SEQ ID NO: 201300 - protein, 121 aa, Triticum aestivum
  unsure (1)..(121): unsure at all Xaa locations
  Clone ID: PAT_TA_95718.pep
MASATLLKSSFLPKKAEWGTTRQAAAPKPVTVSMVVRASAYADELVKTAKTSASPGRGXLAMDXXNATCGKRLPPIGLXEHRGNRXVTGPSXHPTXLGKLISGGYLFGGDLYNXLLMERNC

SEQ ID NO: 201301 - protein, 144 aa, Triticum aestivum
  unsure (1)..(144): unsure at all Xaa locations
  Clone ID: PAT_TA_95719.pep
TARVVHPRLRLHLPPLAHWRRRRLRRLTASFGRNPSPGAVRRLARLIGSCPSPRACMLASRASERANERRERLTLPGERPESFPRAAARVPSRRRPPRRRXQAAGTGLPGDXPXVTDXCCYVINVCIFPTGAILIRNQWDTMTI

SEQ ID NO: 201302 - protein, 79 aa, Triticum aestivum
  unsure (1)..(79): unsure at all Xaa locations
  Clone ID: PAT_TA_95720.pep
MGVRAXFQRFXKXKXQVIMLEQEEAXPXRHNXXGTEQILLGLIGEGTGMHKGLNLWDNPKDARVEXKYGRAWVCCEIIP

SEQ ID NO: 201303 - protein, 196 aa, Triticum aestivum
  unsure (1)..(196): unsure at all Xaa locations
  Clone ID: PAT_TA_95721.pep
KFDNLYGCRHSLPDGLMRATDVMIAGKVAVVCGYGDVGKGCAAALKQAGXARVIXVTEIDPXCALPGPGWEGIQVLTXWEDVVSWMLTSFVTTNWGNKDTXMXDHIRKDERTMPLSCNIGHFXDNEFXXERLGTYPGVKXTTTTSKRPLVSPTDMCRLLVCAPNVCQNKANWIKKARKRVPTLTKPLEGQAPITGS

SEQ ID NO: 201304 - protein, 122 aa, Triticum aestivum
  unsure (1)..(122): unsure at all Xaa locations
  Clone ID: PAT_TA_95722.pep
CPXKDQGDHGVAACSSVTPVPPQFQXASSAXVEYFGIWWWRSAVCXSAAVVQGKMFYRSPATLLLDCSHGGLAAPEFYCAAERERERAVRKSWARLRLSATIAVLMAHKLQSYCFSLHAAVA

SEQ ID NO: 201305 - protein, 116 aa, Triticum aestivum
  unsure (1)..(116): unsure at all Xaa locations
  Clone ID: PAT_TA_95723.pep
HMGSPKSCNNNHNTSTTRSKSTLQRSLDKLANTTKYLRGIRKARFYXPSLGACFRSSLVSSSAGXSVMSGXQEVQVSRKDFMIXGCLXRSFVXXPTXEWLXXSRFXXXQXHXXIXV

SEQ ID NO: 201306 - protein, 71 aa, Triticum aestivum
  Clone ID: PAT_TA_95724.pep
SHRRMSSNYPKPTHGGTTCSFSMYVDKTSMFLHFFTFFLYFTVITETRDHILHVRLSLTPPRFLLEAYLDY

SEQ ID NO: 201307 - protein, 181 aa, Triticum aestivum
  unsure (1)..(181): unsure at all Xaa locations
  Clone ID: PAT_TA_95725.pep
MDDAGLVLAAALTGAIFVVLLVLLVVVLVRRRWLDREGVASGRGFLLFGVCCQGRHPRAXPPDDSLARSRQRAAAAAKEADDXPGEGXSQKWKKFPVGPTXAXPTIRGGTEKGTSXVEPAFVXPELPPPKNPSFQTLCRVSNFSSNFPGPLHIHNWENTRYHGNNQHICICNQGIIFKKKK

SEQ ID NO: 201308 - protein, 151 aa, Triticum aestivum
  unsure (1)..(151): unsure at all Xaa locations
  Clone ID: PAT_TA_95726.pep
MATETETFAFQAEINQXLLSLIINTFYSNKEIFLRELISNXSDALGQVQVEELTDKSKSDAQXRXFIHIIPDKATNTSRFVRQADLDDQGSSTLSQVRGPKDSRELRPGPTHDGIWFNRYSKGVSHKKTHLWIQAVVRTGNGSRSSTMIQF

SEQ ID NO: 201309 - protein, 180 aa, Triticum aestivum
  unsure (1)..(180): unsure at all Xaa locations
  Clone ID: PAT_TA_95727.pep
QTRALVVSSPRAAEAVLRTHDHIFASRPPNAFADALLDGGADVAFAPYGEFWRQARRLVTTHLLSARKVHSXRRGREEEARLGDGKIRAXAXAGASVDMTNCSLQQRHSVPSVSGKSSGRKAGTVQGSDRNWARRVNCWIFRAGKVAVADALPNIEKWTLSINIDTFRANTIEKELSLPT

SEQ ID NO: 201310 - protein, 64 aa, Triticum aestivum
  Clone ID: PAT_TA_95728.pep
GARPPPLSPPCSSSDLHCKSPGFLLGPRKTSVNVLFRLGLPFGYSFSYEGSKNKGKIRNWALGS

SEQ ID NO: 201311 - protein, 138 aa, Triticum aestivum
  unsure (1)..(138): unsure at all Xaa locations
  Clone ID: PAT_TA_95729.pep
MAAQGLLSGRQLLGRPLQSSISRSSSSRKSPFVVRASSSPPAKQNDNRQLWFASKHPSPTSTARCPGDFGFHPLGAVRPRRXTGGFIQPKWLGLRRXXQNGRTAXMGVVGIXPREALGKVGLXPRKGXPWFQAGHFPR

SEQ ID NO: 201312 - protein, 176 aa, Triticum aestivum
  unsure (1)..(176): unsure at all Xaa locations
  Clone ID: PAT_TA_95730.pep
RAEFGTSLRPLLPPKPFLSTPKPQVPIAPITAVRCTAAPKPTTSTPKPAQQEGNQEQEPTPDEADANPHRIPDDETPPSATATTPSRWVPALPSASXTDGRLRRTXDQXEPPNYEXXGWKRTRLPWEKPKGGHRRPGLEGYGPAGPALGTWRLLDREEGLMAKAAGQPGPSVRVNA

SEQ ID NO: 201313 - protein, 92 aa, Triticum aestivum
  unsure (1)..(92): unsure at all Xaa locations
  Clone ID: PAT_TA_95731.pep
MAETEYRCFVGGLAWATDDNNLQQAFSQYGEILDAKIINDRETGRSRGFGFVTFGSEXEXMRQAIXEMNGKELDGRXITVNQXQSRRSGGXG

SEQ ID NO: 201314 - protein, 99 aa, Triticum aestivum
  unsure (1)..(99): unsure at all Xaa locations
  Clone ID: PAT_TA_95732.pep
MQIFVKTLTGKTITLEVESSDTIDNVKAKIQXDKEGIPPDQXQRLIFXAGKQLXDGRTLADYNIQEGXTLHWVLRLRGGAKERKKKPTPTPRXKXXHKK

SEQ ID NO: 201315 - protein, 86 aa, Triticum aestivum
  unsure (1)..(86): unsure at all Xaa locations
  Clone ID: PAT_TA_95733.pep
RRRTTTASDVGPXAXGTPPPPPGSSAPPPRPXDHHXXPPLSLPPPGSSAPPPRPSGHPRXPPLPLPPPPPGTLVPNSARARAEFGT

SEQ ID NO: 201316 - protein, 150 aa, Triticum aestivum
  unsure (1)..(150): unsure at all Xaa locations
  Clone ID: PAT_TA_95734.pep
ADIAARFRVDAQAVLHANNLTDSENIYPFTTLLIPLKSAPTPDMLVSPAPPPAPAPPQAQQPPPSGGSGSGKGVAVGVGVGVGVLALAGLXGLMFLCVRRRRRPRPGVVEDGIRGRASRLPSSADYTSCLGQAYSSTTNPRNVFNRRGGS

SEQ ID NO: 201317 - protein, 124 aa, Triticum aestivum
  unsure (1)..(124): unsure at all Xaa locations
  Clone ID: PAT_TA_95735.pep
GGAPCLVSXGSRCPGAXVHVHGVNLPESLXXTPAPPPXGVWNPRSEGVDGPLLRQRRPVRRXALRRTDPPLLLLKSMIPSVPPHLSSLSIKRTRTPRREFASGRSGSHAFPGDDGDDEFVAVWV

SEQ ID NO: 201318 - protein, 79 aa, Triticum aestivum
  Clone ID: PAT_TA_95736.pep
RPSVAAGVICSLLEKLGSLAAAEYAMFSSDRRQVELLVDELSSMKAVLEKLAYMENLDPLTRQWRDQVRELTCDTEDSI

SEQ ID NO: 201319 - protein, 135 aa, Triticum aestivum
  unsure (1)..(135): unsure at all Xaa locations
  Clone ID: PAT_TA_95737.pep
LSFPPTPPSPPPPPLPPAAAASPTGSMDQTPRRRRRRRAEAAPSDGAPDTAEYSLDEPTMAEKLAALSPPADAAGVAAXGAPQRPTPSTSCSSRPASRRPRRAAPVPVTTTQVIVNRNPDTDAVNSSNPGYRSCI

SEQ ID NO: 201320 - protein, 89 aa, Triticum aestivum
  unsure (1)..(89): unsure at all Xaa locations
  Clone ID: PAT_TA_95738.pep
VHCGIHSCKTFLVFPWLNFLYNKTPPSESPQQVTGIDAASLQERTINETPDXSCSRVQTEXPXRSVIPLTVNMSLXXTXXGKXAIQKKK

SEQ ID NO: 201321 - protein, 78 aa, Triticum aestivum
  unsure (1)..(78): unsure at all Xaa locations
  Clone ID: PAT_TA_95739.pep
LPTLAGATTARGTPCPPRPSPPYYLPLASPYSTRKPPHPPHLLRWGTPPRAQAPPSIFSGAAHHPERRQSSPPSXGXN

SEQ ID NO: 201322 - protein, 83 aa, Triticum aestivum
  unsure (1)..(83): unsure at all Xaa locations
  Clone ID: PAT_TA_95740.pep
VAFFIFSQFFCFLFCFIFLFLLIYFIKIYFILFCSYLLLKFILFLLIYFILFFVFLLXFMKIPFPYNVLNRKYFDNFSCINFI

SEQ ID NO: 201323 - protein, 201 aa, Triticum aestivum
  unsure (1)..(201): unsure at all Xaa locations
  Clone ID: PAT_TA_95741.pep
PANAVLPGQNGAPVYCNGVGPVPQYYLGAPFMYPWSMGWNNLPVMVPGGSMPESASPSESCSTSSAPWMNSPMMPGSRLPAPPFPYPLVPPALWGCLPNWAAAAWNTPWXRDQXGCISPSGSKQHSCSSNGLXPGEHSKDSIHRKMTRRKRGSKNRIHTKSYGNWKLRPLNLNGKQAHNPASKPTFRISEPNEAQNLKNVN

SEQ ID NO: 201324 - protein, 169 aa, Triticum aestivum
  unsure (1)..(169): unsure at all Xaa locations
  Clone ID: PAT_TA_95742.pep
MATTAMALSPSSFAGKAVKDLPSSALFGEXARVTMRKTAAKAKPVSSGSPWYGSDRVLYLRPLXRRPPDYLTGDSPGDYGWDTAGSSADPELXAKNRXWSDHCRWXMLGALGALPGLSPATLNSASVSRSFPRRLNTREPSSSSKDLHRAAVCMLVTLPPSIPTGLTWP

SEQ ID NO: 201325 - protein, 108 aa, Triticum aestivum
  Clone ID: PAT_TA_95743.pep
MEATAVSLTRTVLDGVLGSAGTAMADEAALLLGVRREVGFIRSELQMMQSFLRGAVLRALGRRRRGCRTVRTCVKQCTRVRLEDCSTCTLRAGCSGPGPHCRRIGAKR

SEQ ID NO: 201326 - protein, 102 aa, Triticum aestivum
  unsure (1)..(102): unsure at all Xaa locations
  Clone ID: PAT_TA_95744.pep
PCAPLTLNKGNKSSLNGEWDAPCSGALSAAGVVVTRSVTATLASALAPAPFAFFPSFLATFAGFPRQALNRGLPLGFRFSALRHLDPKKLDXGDGHVVGPSP

SEQ ID NO: 201327 - protein, 64 aa, Triticum aestivum
  unsure (1)..(64): unsure at all Xaa locations
  Clone ID: PAT_TA_95745.pep
XEYLXRGMKFSXLXQXIVNSIXSSVKYGNVYSXXSDISVYLVMXHNTRXXIXLSLLVGXLQIXP

SEQ ID NO: 201328 - protein, 154 aa, Triticum aestivum
  unsure (1)..(154): unsure at all Xaa locations
  Clone ID: PAT_TA_95746.pep
PQWSFCDXXGSXQRRFVKDLKVGXLXPNXKVXXPRXGQXFTSQXIILNXPCQIGNGYAPVLGXNTFHMLSSLLDLVPKMDRRSGKXLEALPKFLKNGDAGIVKMIPTXKPMVVETFATYPPLGRFAVRDMRQTVAVGVIKGVEKKDPTGAKVTK

SEQ ID NO: 201329 - protein, 140 aa, Triticum aestivum
  unsure (1)..(140): unsure at all Xaa locations
  Clone ID: PAT_TA_95747.pep
KEGMERKDVMTKNVSIYKAQASALEAHAAPNCKVLVVANPANTNALILKEFAPSIPEKNXCLTRLDHNRALGQVSERLXVQFPDVKNAIIWGYQPXQSXTLMLTSNFXTPXGKKLFKFSKMGQCVQQLGLHHQRLASCHL

SEQ ID NO: 201330 - protein, 46 aa, Triticum aestivum
  Clone ID: PAT_TA_95748.pep
SCRIRHEATATHKASSGGMEMAAEDGGCGCTQCKCGTSCGCSCCSC

SEQ ID NO: 201331 - protein, 85 aa, Triticum aestivum
  unsure (1)..(85): unsure at all Xaa locations
  Clone ID: PAT_TA_95749.pep
TDQLCQSMNFLLESRMRDIYYICCLCWEGNQIKRSLFLVVIPNRVAHENSKQNRKVLWHFNTETNRVLKKLDGYKPPCIXXRGGG

SEQ ID NO: 201332 - protein, 99 aa, Triticum aestivum
  unsure (1)..(99): unsure at all Xaa locations
  Clone ID: PAT_TA_95750.pep
MEASKLKAARLLEQMSAHLATDAGKEIANKVGFVYQLNISPKKMGVDEEXSVRGPQRRGLSTGXYEGTPDAASLHRRHSSPSANGKLNRRCVYKGQXKI

SEQ ID NO: 201333 - protein, 95 aa, Triticum aestivum
  unsure (1)..(95): unsure at all Xaa locations
  Clone ID: PAT_TA_95751.pep
VGFLAAEAATHAPHHNLDSPPAASRLQNPRLTPAPLGFASPRSAAPPQPWAHRSRPRRQPLQIIVNHMKLSNXKKRXKGANSIXKNFXEHWEFXH

SEQ ID NO: 201334 - protein, 78 aa, Triticum aestivum
  unsure (1)..(78): unsure at all Xaa locations
  Clone ID: PAT_TA_95752.pep
MSCCGGNCGCGTACKCGNGCGGCNMYPEVEAAGATLLVSATATHKASXGGMEMAAENGGCGCTQCKCGXNCGCPAAAC

SEQ ID NO: 201335 - protein, 229 aa, Triticum aestivum
  unsure (1)..(229): unsure at all Xaa locations
  Clone ID: PAT_TA_95753.pep
SPPPAAAAARPAWRRATAPSPASTSTNPSPRRRQHTPPIHPATRATASPPRLHPMLARSTRRGAWVPRATIPTLLLLFPRPWMLLCLRPXSAAPSSISCCFSSSIPKNCCCPHPQLPXLSSFFNHASAFPNVLFLSSPXFPACASPSPLTAAILSLQIFAVPAEPQAVSPSXXKXCCPSAKLXALSLXTLXRIFPXPXKSYXIXLXIVXCRTXVSNXGIXXKKXXGGHX

SEQ ID NO: 201336 - protein, 146 aa, Triticum aestivum
  unsure (1)..(146): unsure at all Xaa locations
  Clone ID: PAT_TA_95754.pep
EWWQXLXLVXRLFXKNXLVNQSRMXVFICSCYLFXSWFITGQDIXVXEDGGHYPXQQNMLRYRRQIFRELKRCTYTKGISPXEDVLVIRKIHPCLPSFKSEFTATVPLTRIRDIAHRNDIPHELKQEIKHTIQNKLHRSAGPEDLV

SEQ ID NO: 201337 - protein, 129 aa, Triticum aestivum
  unsure (1)..(129): unsure at all Xaa locations
  Clone ID: PAT_TA_95755.pep
TLHLVLRLRGGMQIFVKTLTGKTITLEVESSDTIDNVKAKIQDKEGIPPDQQRLIFAGKQLEDGRTLADYNIQKESTLHLVLKLRWWHAVLRQRPLTGKTSTLEXXPPDTSDXSKASSKTRRDPTGQQR

SEQ ID NO: 201338 - protein, 135 aa, Triticum aestivum
  unsure (1)..(135): unsure at all Xaa locations
  Clone ID: PAT_TA_95756.pep
RVKXLNLHKPXXXXHQXGXKCXAXEGXFFKMQVWKLXFCCFLLXIEVGAGVFEXXXGKFXGHXPEMMAVGVLVGPGAGSPFPSMNVDARHPKLPAPVALPLLASALAPLNMEQLCKVLMHAMDATLPCPRAEFGT

SEQ ID NO: 201339 - protein, 85 aa, Triticum aestivum
  unsure (1)..(85): unsure at all Xaa locations
  Clone ID: PAT_TA_95757.pep
MFXRAPKKSDNTKYYDVLGVPKNAAQDDLKKAYRKXAINNHPDNGXDPEKFKXELAHAYEVLXDPXKXEIXDXYGERCLNEDWLR

SEQ ID NO: 201340 - protein, 106 aa, Triticum aestivum
  unsure (1)..(106): unsure at all Xaa locations
  Clone ID: PAT_TA_95758.pep
TPVXXIPDXXXRLSMXLAXXXAXNXGNXIAXAXCXAMAXXFLPXIWSVPDSXSAAXLIXXRGVYVFVXLXPCGWRAGRPDXRGGCVYKKWGGRVEVNXDSCRIRHE

SEQ ID NO: 201341 - protein, 100 aa, Triticum aestivum
  unsure (1)..(100): unsure at all Xaa locations
  Clone ID: PAT_TA_95759.pep
SVASQYTMLTVAIYSLSTVHAYTVTRYTVLCPSLGISVRRAGPDIGTAARLLXRRRRGRGRRWAPNDSSLDRPPAAPERHADFXADFPKNVSRPLDQLXQ

SEQ ID NO: 201342 - protein, 82 aa, Triticum aestivum
  unsure (1)..(82): unsure at all Xaa locations
  Clone ID: PAT_TA_95760.pep
MGRVRTKTVKKXSRQVIXKXYSRMTLDFHTNXXVXEEVXILQSXRLXNKXXXFTTHLMLXIQAXXPCXGISLKLXEEXXXRR

SEQ ID NO: 201343 - protein, 134 aa, Triticum aestivum
  unsure (1)..(134): unsure at all Xaa locations
  Clone ID: PAT_TA_95761.pep
SLSLFLSPSARRLACSVSQLFLGIRLLVLSVVAAVLAGRPFPFLGGSPGPSSPPPLRRCPSPPPLPPTCRRPRHRFSGARFKGSKXSSIASPSRSSGLGLXLRQVRRRDFRARFILXPRTLRXRXPRGFXKSXL

SEQ ID NO: 201344 - protein, 153 aa, Triticum aestivum
  unsure (1)..(153): unsure at all Xaa locations
  Clone ID: PAT_TA_95762.pep
MAAATMALSSPAMAGTPVKASRAAPFGEXGRITMRKTAGKPXVAASSSRGYGPTACSTSGRLRDPPSTHRRXPGDYGGNAGCPPNPTFAKTGLESSPLACSGVGALPRLSPQSPASVQRPINKALTRNPTCDKSGLKCMAREVPPGALQILPG

SEQ ID NO: 201345 - protein, 96 aa, Triticum aestivum
  unsure (1)..(96): unsure at all Xaa locations
  Clone ID: PAT_TA_95763.pep
MQIFVKTLTGKTITLEVESSDTIDNVKAKIQXDKEGIPPDSAASHLPLGKQSEDGRTLADYNIQKESTXHWVLKSVGGMXFFRQNPGPANITWRLL

SEQ ID NO: 201346 - protein, 106 aa, Triticum aestivum
  unsure (1)..(106): unsure at all Xaa locations
  Clone ID: PAT_TA_95764.pep
LVPNSAPVYVRGTILGYKRSKSNQYETASLVQIEGVNTREDVAWXYGGKRMAYVYKAKTKSNGTHYRCIWGKVXRPHGNTGVLRANSPPTCPPEAMGKKSGLQFPI

SEQ ID NO: 201347 - protein, 110 aa, Triticum aestivum
  unsure (1)..(110): unsure at all Xaa locations
  Clone ID: PAT_TA_95765.pep
MARGLKKHLKRLNAPSHWMLDKLGWSFAPKPSSXGPHKARECLPLILILEEQTEYXLTYRXNASILYQRHIMVDGKXSRTDXLPAGSNXTFPFPKXGXNKVPLIHKGLSP

SEQ ID NO: 201348 - protein, 146 aa, Triticum aestivum
  unsure (1)..(146): unsure at all Xaa locations
  Clone ID: PAT_TA_95766.pep
RXLNFXKSXDVVNFXLTQDWSPLLGXCCWKLLMAXPRXGIHRSXLRHVXXNAVDALCSLLNXLVVDDLHQIRXCNRNSNLSAFRRTWSFGARMAGVGRRTFAEDAAGXIFPRXTPRPPGPPPAGKRGGPDGGGADTGEGEDTPXSP

SEQ ID NO: 201349 - protein, 143 aa, Triticum aestivum
  unsure (1)..(143): unsure at all Xaa locations
  Clone ID: PAT_TA_95767.pep
MASIAGSAVSFAKPVKAINTNSLSFSGARRGNAFLXRLQPVPXRFXAVCCSXAKQDTVEKVCXEIVXKQLAVXEAXICGTTXFPDLGSXSTGHVQIVMGLXEXFQLSVGGEERAGIXTVEMLHLIYNLSLESLEGSPNNDWDS

SEQ ID NO: 201350 - protein, 96 aa, Triticum aestivum
  unsure (1)..(96): unsure at all Xaa locations
  Clone ID: PAT_TA_95768.pep
MAASALHQTTSFLGTAPRRDDLVRSVXDFCGRITXRRTVXSAPQEHLXYXPDRPKYXAFSEQTPXYLTGXXPGDXXGWXNAGFXAXPXTSXXNXNW

SEQ ID NO: 201351 - protein, 96 aa, Triticum aestivum
  unsure (1)..(96): unsure at all Xaa locations
  Clone ID: PAT_TA_95769.pep
NDYRRRTTQVPLPSTSERPHGTSKYFPVTSQHPTNVPRLQNGVPLPLPETRCNGSSXPDYRSPLNNYFQLRPFXENATSLXQLDSFXDXDLSXLSS

SEQ ID NO: 201352 - protein, 103 aa, Triticum aestivum
  unsure (1)..(103): unsure at all Xaa locations
  Clone ID: PAT_TA_95770.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRXGRNLYGFGG

SEQ ID NO: 201353 - protein, 98 aa, Triticum aestivum
  unsure (1)..(98): unsure at all Xaa locations
  Clone ID: PAT_TA_95771.pep
PPSTRRRTTSCSSSTRSRPTSPTASPPSPPPRSRGSRGQCSRWRSSPSCSTPWCPRTPRSGTPSPWAPWAPRSPXPPPTASPPTARPLRQGARRAQRR

SEQ ID NO: 201354 - protein, 113 aa, Triticum aestivum
  unsure (1)..(113): unsure at all Xaa locations
  Clone ID: PAT_TA_95772.pep
PRSPLSFPSAPPNPSAFEASDHHPSMAPRPVPSKVTHGSVPTGHHHPWLLRYWDTTSSHLRSRHHHVTPTLGLLLHHGPARTTPLSMPPLRIHPNSSSSTASWRKXRATALQI

SEQ ID NO: 201355 - protein, 74 aa, Triticum aestivum
  unsure (1)..(74): unsure at all Xaa locations
  Clone ID: PAT_TA_95773.pep
RAFTRPEGGKEXQLSXMTSVPXFHXLRSYXSPRSMVXLPSLMNXSQGIRCDXIXSSXNIIMVXTXILMLFXXRF

SEQ ID NO: 201356 - protein, 78 aa, Triticum aestivum
  Clone ID: PAT_TA_95774.pep
NMRQSLFWSISVNMFICLIFHNMLVLSAKLVDLVMGSDVDSLSSQKNKIAITLLSDVTYVIHRESNTNIAYARAEFGT

SEQ ID NO: 201357 - protein, 62 aa, Triticum aestivum
  unsure (1)..(62): unsure at all Xaa locations
  Clone ID: PAT_TA_95775.pep
SXXVHCXSGCWLSAIVCQVHANLASXVLNETDNFIVSPCMSINQSWWLGPXYTTRDSQRSVS

SEQ ID NO: 201358 - protein, 140 aa, Triticum aestivum
  unsure (1)..(140): unsure at all Xaa locations
  Clone ID: PAT_TA_95776.pep
ASPYPASSSPSSAATARTASSSRTTAARHRRPSQSPPRSEYRRSSPRRGRCTDRPSTPRSRSSRSTTSPGPPANLPGQHHRRRQLRVRVPRRAPGRRTPFAVKRLSAGQXRPRRXREXRAELEVLGKLSNATRAPAYAPR

SEQ ID NO: 201359 - protein, 124 aa, Triticum aestivum
  Clone ID: PAT_TA_95777.pep
MAYMCADSGNLMAIAQQVIQQQQQHNQQQQRHHHHHHHLVPPPMPMPPAPAPPHAQIPGSLPFGAAGSAAWPQAENFFSDVFGASAADAVFSDLAAGTDFDSDVWMESLIGDAPVFKDSDLDGS

SEQ ID NO: 201360 - protein, 88 aa, Triticum aestivum
  unsure (1)..(88): unsure at all Xaa locations
  Clone ID: PAT_TA_95778.pep
LYIMLLGLQAYSCNSNTHHHQHHKTNYDASSCLKLAACCGSPVSPLFSVSSSSLSSSCEATPLQCSPHPPPHPPHHHSHPQSPNLHNX

SEQ ID NO: 201361 - protein, 143 aa, Triticum aestivum
  Clone ID: PAT_TA_95779.pep
QASPRPILTVRETTLVAPSTSTGAAPPECSLPLTFFDIFWLNLPPVERVFFYRLAADADVPAILSNLKASLSQALHAYYPLAGRLRLAPGTADRYEIHYQPGDGVTSRSRVPWGRTTSWPTSRGKITRRRCAAIPGGGLPLKP

SEQ ID NO: 201362 - protein, 63 aa, Triticum aestivum; identical to SEQ ID NO: 168560
  Clone ID: PAT_TA_95780.pep

SEQ ID NO: 201363 - protein, 78 aa, Triticum aestivum
  unsure (1)..(78): unsure at all Xaa locations
  Clone ID: PAT_TA_95781.pep
MSCCGGNCGCGTACKCGNGCGGCNMYPEVEAAGATLLVSATATHKASSGGMEMAAENGGCGCTQCKCGTXCGCSCCNC

SEQ ID NO: 201364 - protein, 144 aa, Triticum aestivum
  unsure (1)..(144): unsure at all Xaa locations
  Clone ID: PAT_TA_95782.pep
MANPRVFFDMTVGGAPAGRIVMELYKDAVPRTVENFRALCTGEKGVGKSGKPLHYKGSAFHRVIPDFMCQGGDFTRXNGTGGEXIYGEKFADEKFVXKHTKPGILXMANAGPNTTAPVLICTSLXWLXXSTVFGXSRGLVKKSK

SEQ ID NO: 201365 - protein, 102 aa, Triticum aestivum
  Clone ID: PAT_TA_95783.pep
LSYILDFIVKLIKLQQYFDLSRRMYRRQMKCSCIAHSFSLCSFETSNSSSSSIYFFQCLCNPSVNAVLNTYAHGSSFFGLLGRALKRINMLVAPRPIKKKKK

SEQ ID NO: 201366 - protein, 201 aa, Triticum aestivum
  unsure (1)..(201): unsure at all Xaa locations
  Clone ID: PAT_TA_95784.pep
ELPENVSAQFDHNISSIPNMRTKAFSSHSYYLEKVLPKLLELGAVRIAPFSNRLANSVPSNINALRCLANYEALRFSEPIRILADNMVDRMIKKSALTNGKYMSIQPPLLKEDMVAFSSCIYDGDWEGEXLQWENARERGWRGKFRRPSRVINPRRQSEEWEIPLTPIXVGMMLHGMGLIIQLTVPPVKYQAENNDLPSCS

SEQ ID NO: 201367 - protein, 156 aa, Triticum aestivum
  unsure (1)..(156): unsure at all Xaa locations
  Clone ID: PAT_TA_95785.pep
MRECISIHIGQAGIQVGNACWELYCLEHGIQPDGQMPGDKTVGGGDDAFNTFFSETGAGKHVPRAVFVDLEPTVIDEVRTGXAYRQLFHPEQLISGKEDAANNFARGHYTIGKEIVDLCLDLSRSXSDNCTGLKDPCLKAVGGGMXLAWSLPRSVR

SEQ ID NO: 201368 - protein, 173 aa, Triticum aestivum
  unsure (1)..(173): unsure at all Xaa locations
  Clone ID: PAT_TA_95786.pep
RSREYKLCSKHTEGKRPLYAIGFNFIDARYYDVFATVGGNRVTTYRGLPDGNLAVLQAYIDADDAQSFYTLSWACDLDGTPLLVAAGSNAVIRVINCANREFVKSFLGNGESLIGIXXQPLXLRLNSASKDNLXLWNVNTRYXILIXLGGRSHRNEXLXVDSTFQRIAWKVIR

SEQ ID NO: 201369 - protein, 85 aa, Triticum aestivum
  unsure (1)..(85): unsure at all Xaa locations
  Clone ID: PAT_TA_95787.pep
DKKTSRHKSKSRGRSKHRRSRKSDSEDDSEEERTKDKKKNRRKKHRSSDEDSESDSDRKRHMKSXKDRKRRRTHRRKDDSSEDDT

SEQ ID NO: 201370 - protein, 138 aa, Triticum aestivum
  unsure (1)..(138): unsure at all Xaa locations
  Clone ID: PAT_TA_95788.pep
GLERDGPTHADRDPETRRASNSKHHRPXCKLSXQTXASLAQLVAAPSSLRPEQRXSSFXPVTEVVKKGCXRRVAXXCHPXXSNXXAXEKMXAGTXXREXAGXARVTPAARXLVPAXSXAXXXRKHSDSGNXDFXGDRW

SEQ ID NO: 201371 - protein, 182 aa, Triticum aestivum
  unsure (1)..(182): unsure at all Xaa locations
  Clone ID: PAT_TA_95789.pep
MQIFVKTLTGKTITLEVESSDTIDNVKAKIQDKEGIPPDQQRLIFAGKQLEDGRTLADYNIQKESTLHLXVLKLRGRHADFSSRPQPGKDINLEVESSDTIDNXKAKFKTKEGIPPGQQRLXXAGKQLEGWPQPGWTTTSRINLQLVLKLEGSFCQKAHKTSTWRWVSAHNVRQQDKDSPNL

SEQ ID NO: 201372 - protein, 51 aa, Triticum aestivum
  unsure (1)..(51): unsure at all Xaa locations
  Clone ID: PAT_TA_95790.pep
YHLDMTDTSWGASKPFFLSRXLALXRXIITNEENYKXSMQVARKXRDPHDS

SEQ ID NO: 201373 - protein, 136 aa, Triticum aestivum
  unsure (1)..(136): unsure at all Xaa locations
  Clone ID: PAT_TA_95791.pep
MAPKAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKPNITSREIQTSVRLVLPASXPKXAVSEGTKASQVSA

SEQ ID NO: 201374 - protein, 181 aa, Triticum aestivum
  unsure (1)..(181): unsure at all Xaa locations
  Clone ID: PAT_TA_95792.pep
GKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIKNREKHKGXFETXHVEDXQGHKFATRLGNVFTXGXGTSRGELPKGXGIKLTSLRTKEAD

SEQ ID NO: 201375 - protein, 140 aa, Triticum aestivum
  unsure (1)..(140): unsure at all Xaa locations
  Clone ID: PAT_TA_95793.pep
MSSTGAGVAGRGKAKATKSVSRSSKAGLQFPVGRIARYLKAGKYAERVGAGAPVYLSAVLEYLAAEVLELAGNAARDNKKTRIVPRHIQLAVRNDEELSKLLGSVTXANGGVMPNINXVLLPKKAGPKGDLGSARKLSRA

SEQ ID NO: 201376 - protein, 48 aa, Triticum aestivum
  Clone ID: PAT_TA_95794.pep
MSYPICHICLNPSSGLTGLEPAASALTGRCSDQLNYNPRGVYGIPILK

SEQ ID NO: 201377 - protein, 164 aa, Triticum aestivum
  unsure (1)..(164): unsure at all Xaa locations
  Clone ID: PAT_TA_95795.pep
DLLHSGPNKKLXIRNSSQNGIAVPDANRVPVASTSDVVDLMNLGQKNRAVCSTAMNDRSSRSHSCVTVHVQGRDLTSGTVLRGCMHLVDLAGSERVDKSEVVGDRLKXEAQHINKSLAALXDVIASLAQKNXHVPYRNSXLTXLLQDLLGGQQNXELSPDRHEH

SEQ ID NO: 201378 - protein, 154 aa, Triticum aestivum
  unsure (1)..(154): unsure at all Xaa locations
  Clone ID: PAT_TA_95796.pep
LQLASLSHSGHFLASTTAMATADVQNPTAALTEEAPAVETPVAAEEAPKDGGGPRAGGRPRSRRLPPSRFKATKEEGAGRRLDGGSQGDRPSNCXRPGGXGAQRPXRATLVQTXTKEAXXKGNRGXXVKXXKAPXCQQKNXFPRKTXNGXXPRL

SEQ ID NO: 201379 - protein, 71 aa, Triticum aestivum
  unsure (1)..(71): unsure at all Xaa locations
  Clone ID: PAT_TA_95797.pep
MSWQTYVDDHLCCEIDGQHLTSAAILXGHDGSVWGASPNFPXFKPEELLASLKXXEEPGNLSPMAFPWEDK

SEQ ID NO: 201380 - protein, 159 aa, Triticum aestivum
  unsure (1)..(159): unsure at all Xaa locations
  Clone ID: PAT_TA_95798.pep
MNKRSFKYAWVLDKLKAERERGITIDIALWKFETTKYYCTVIDAPGXHRDFIKNMITGTSQADCAVLIIDSTTGWFEAXGISKDGQDTXSXPPCFHSLGVKQMIXCCCNKMGRHNPQITRRSFTKEIVKEXSSYLKKXXYNPGQGPFRPXSGSKGDNMX

SEQ ID NO: 201381 - protein, 118 aa, Triticum aestivum
  unsure (1)..(118): unsure at all Xaa locations
  Clone ID: PAT_TA_95799.pep
MSCCGGNCGCGAGCKCGNGCGGCKMFPDVEATAGAAAMVMPTASHKGSXGXFETAGGETGGCDCTTAXAERPAAAPAAAAMTXAQEGRPARHRIRDNWQATTTTTTTSTTADPRPRAR

SEQ ID NO: 201382 - protein, 135 aa, Triticum aestivum
  unsure (1)..(135): unsure at all Xaa locations
  Clone ID: PAT_TA_95800.pep
MARAQVMLMAVALVLMLAAVPRAAVAIDCGHVDSLVXRPAWSYVQGRPTXLGNCCGGVQELHNQGASKSDXQAAFNCLXKGISPWIQHPPTKDNARTSPPXCVSTSPYTSSSTSTATCFNDDIRTQSSILILTPL

SEQ ID NO: 201383 - protein, 123 aa, Triticum aestivum
  unsure (1)..(123): unsure at all Xaa locations
  Clone ID: PAT_TA_95801.pep
EDGYSGVEVRVTPMRTEIIIRATRTQNVLGEKGRRIRELTSVVQKRFNFPENGVELYAEKVVNRGXLCAIAXADHSRYXLRWLSVRRACYGVFPLLWRVGAKGCEVIFERQLKAQRXVEFKGR

SEQ ID NO: 201384 - protein, 176 aa, Triticum aestivum
  unsure (1)..(176): unsure at all Xaa locations
  Clone ID: PAT_TA_95802.pep
EKPVTVFGVRNPEEIPWGEAGADYVVESTGVFTDKDKAAAHLKGGAKKVXVISAPSKDAPMFXVFGVNEDNYTSXDVNISPNANFTTNXLXPLAKXINDNFXLLXFXMTLFNAINWPHKKTFYXPPSKGXKGXKAXXLKXNPNXXGLPRCLXXFXELNGTYRIFPVHVFIVVSRNR

SEQ ID NO: 201385 - protein, 97 aa, Triticum aestivum
  unsure (1)..(97): unsure at all Xaa locations
  Clone ID: PAT_TA_95803.pep
KASKVLPGKTMXDLLGETISHTLMTQINTXPYYXKNXWGKEESXMGVTXGKCXPVSSFIXTIKKXQNASRXKLVXXHDHSLSXQXNNXPAXGXXSHH

SEQ ID NO: 201386 - protein, 85 aa, Triticum aestivum
  unsure (1)..(85): unsure at all Xaa locations
  Clone ID: PAT_TA_95804.pep
SRARTISSKESWAPPTXGRSKXHRSXXAVGXIPPSIGEKRXAAGXCKXPXKWLRXWTXPCVIPTLGGNLNQXLAXTTFPXGFSXQ

SEQ ID NO: 201387 - protein, 104 aa, Triticum aestivum
  unsure (1)..(104): unsure at all Xaa locations
  Clone ID: PAT_TA_95805.pep
MALPNQNTVDYPSFKLVIVGDGGTGKTXFVKRHLTGRXGEXKYDPPLGVEXTIGFTTNCXNSXSTAGDTAGQRNFXGLXNGYYIHXQVCNNXFESLPKADLKNF

SEQ ID NO: 201388 - protein, 96 aa, Triticum aestivum
  unsure (1)..(96): unsure at all Xaa locations
  Clone ID: PAT_TA_95806.pep
AFSPGASPPRRAPTSCRSPSSPPGASRRKLPASARGPRPASPPPSPDVLPEXLRHPCPSSRRRLLRXPPSKVQPAGPPKGGXRPLGCPRSAQPLRS

SEQ ID NO: 201389 - protein, 146 aa, Triticum aestivum
  unsure (1)..(146): unsure at all Xaa locations
  Clone ID: PAT_TA_95807.pep
MARTKQTARKSTGGKAPRKQLATKAARKSXAPATGGVKKPHRFRPRHRPRSGRXRXYQKETELSSRKCPSQXLVREIFXRLXKTDSRXXKXPPFXRAPKEPPEPTPLGFFPRHNFCASXAQXXTSMPKNSTPADPLKGLSSCCWER

SEQ ID NO: 201390 - protein, 105 aa, Triticum aestivum
  unsure (1)..(105): unsure at all Xaa locations
  Clone ID: PAT_TA_95808.pep
RSAEHEHSGAATSPPPTKREKTMAAVGGAGNGAGEEAGGAEFYLRVLRWAQGQFGDDSSIRFRPDGNSATQHPTTRTNNIRRSLRSLXCSAXQEVNPRXRNIXGG

SEQ ID NO: 201391 - protein, 73 aa, Triticum aestivum
  unsure (1)..(73): unsure at all Xaa locations
  Clone ID: PAT_TA_95809.pep
WARRTRXWXGXAEAAAXRAACXEAVVVVRDAIGRKXXAGSGGAXXRSXXERIRRGEGTEGETRPVPYXCWLAX

SEQ ID NO: 201392 - protein, 163 aa, Triticum aestivum
  unsure (1)..(163): unsure at all Xaa locations
  Clone ID: PAT_TA_95810.pep
MGFTDLVSEAGLTLLNNYVKTRSYIVGYSPSQADVKVYQANQAVPAPEKYPYAWRWXYNHMLTFXGRXRSLPGXTQPRLTAYGPXLPVTSTRQAPEKELXDDDDESLFRTRGGDCQLRDVWFNKKKAASQPAASLSHYGTMDDQNGQGNSFKRPSGCSCCVVR

SEQ ID NO: 201393 - protein, 171 aa, Triticum aestivum
  unsure (1)..(171): unsure at all Xaa locations
  Clone ID: PAT_TA_95811.pep
LAVASPLKTLNPTLSPSPSPSRRRGLLLGSSHLRLPPLLSRSGRLRCSAGYGDAAAPQQAAPTTQRPDEIPWSRELCNSVRLIXTVGTDIDCAKLPXXARSRGGALPSGXRQPRQLGTLDFGTXAVCSXHLNKRRXVXDXVQTVKRAETELQSVLNHXDLXFVLNHRCEHE

SEQ ID NO: 201394 - protein, 89 aa, Triticum aestivum
  unsure (1)..(89): unsure at all Xaa locations
  Clone ID: PAT_TA_95812.pep
MSCNCGSGCSCGSDCKCGKMYPDLTEQGSAAXAQVAAVVRPPAWAPGEQGGXFELAAGXPGEGCSCGDNCXCNPCNCTACTPVMVLRVY

SEQ ID NO: 201395 - protein, 78 aa, Triticum aestivum
  Clone ID: PAT_TA_95813.pep
MSCCGGNCGCGAGCKCGNGCGGCGCSCCSCNWSRRTGGRPAEASTRMRKEEPSIIITTTTTQRINYTTAACARRAPLN

SEQ ID NO: 201396 - protein, 63 aa, Triticum aestivum
  unsure (1)..(63): unsure at all Xaa locations
  Clone ID: PAT_TA_95814.pep
GGVKRISGLIYEETRGVLKIFLENVIRDAVTYTEHARRKTVTAMDVXVYALKRQGRTLYGFRR

SEQ ID NO: 201397 - protein, 159 aa, Triticum aestivum
  unsure (1)..(159): unsure at all Xaa locations
  Clone ID: PAT_TA_95815.pep
MANPRVFFDMTVGGAPAGRIVMELYKDAVPRTVENFRALCTGEKGVGKSGKPLHYKGSAFHRVIPDFMCQGGDXTRGNGTGGESIYGENCRREFVHKHTKPGILSMANAGPNTTAPVLHLHVPCKWLDXKHVVFGXSQGHGRVKKSRSGSRNCQVSHAV

SEQ ID NO: 201398 - protein, 141 aa, Triticum aestivum
  unsure (1)..(141): unsure at all Xaa locations
  Clone ID: PAT_TA_95816.pep
MAPKAEKKPAAKKPAEEEPAAEKAEKAPAGKKPRAEKRVPAGKTASKEGGEKRGRKKGKKSVETYKIYIFKVLKXVQPDIGISSKGMSIMNSFINDIFEKLAGEAAKLARYNKKPTSLQGDSNLLRLVSLGSPTSLSKQVT

SEQ ID NO: 201399 - protein, 117 aa, Triticum aestivum
  unsure (1)..(117): unsure at all Xaa locations
  Clone ID: PAT_TA_95817.pep
MAAPRGAAVVLAMVLAAMVVAPPATVHAAISCSTVYSTLMPCLQYVQQGGSPARGCCTGIQNLLAEXNNXPERRNICGCLKNVAXXXSXGPYITAAXAPSKCNVRLPYKXSPSQLDQ

SEQ ID NO: 201400 - protein, 109 aa, Triticum aestivum
  unsure (1)..(109): unsure at all Xaa locations
  Clone ID: PAT_TA_95818.pep
GVQHLLKLRMXIAPRPTXHXXPLIXXVPPPRPLLLRRHXHRVXRPPXLPLPHVLXVXVXXLLPNRXTVAEAPWWLCRRXRPXXCXCXSXMXSXKXVXPXSSSSTSXARG

SEQ ID NO: 201401 - protein, 121 aa, Triticum aestivum
  unsure (1)..(121): unsure at all Xaa locations
  Clone ID: PAT_TA_95819.pep
MPAGHGLRSRTRDLFARPFRKKGYIPLTTYLRTYKVGEHVDVKVNGAVHKGMPHKFYXGRTGRVCNVXXRXIRXEINKQVRNXIIXXRXHVRXEHVQPSKCNEDSPETHNDKLMRQGVGES

SEQ ID NO: 201402 - protein, 148 aa, Triticum aestivum
  unsure (1)..(148): unsure at all Xaa locations
  Clone ID: PAT_TA_95820.pep
MANPRVFFDMTVGGAPAGRIVMELYKDAVPRTVENFRALCTGEKGVGKSGKPLHYKGSAFHRVXPDFMCXGGEFTRGNGTGGESIYGENSRREXVHKHTKPGISHGQRRANTTVQFLSATSLHCNTGRESPMTQDSGSHGLNRSHPLR

SEQ ID NO: 201403 - protein, 41 aa, Triticum aestivum
  Clone ID: PAT_TA_95821.pep
RACLKCCSVCRCVPAGTAGNKETCGKCYTDWTMHGNNTKCP

SEQ ID NO: 201404 - protein, 113 aa, Triticum aestivum
  unsure (1)..(113): unsure at all Xaa locations
  Clone ID: PAT_TA_95822.pep
MANPRVFFDMTVGGAPAGRIVMELYKDAVPRTVENXRALCTGEKASGKSXKPLHYXGTLPRXIPDLIXQGGXXTKGNGTEGFIYGKISPTNQKQPFSPNPATKAHEPLNGLPG

SEQ ID NO: 201405 - protein, 75 aa, Triticum aestivum
  unsure (1)..(75): unsure at all Xaa locations
  Clone ID: PAT_TA_95823.pep
MSCNCGSGCSCGSDCKCGKMYPDLTEQGNAAAQVAAVVLLXVAPXNKAGHFEVGRPASGEGCNXRRXLQXNPATV

SEQ ID NO: 201406 - protein, 130 aa, Triticum aestivum
  unsure (1)..(130): unsure at all Xaa locations
  Clone ID: PAT_TA_95824.pep
MAPKAEKKPAAKKPAEEEPAAEKAPAAKKPKAEKRLPAGKSAAGKDGDKKGKKKAKKTWETXVYIFKVLKQVHPDIGXSSKGXSINESFINESFEXSPGEAXLARYNKNPHTPGNSAPPWPAFPRDKGQF

SEQ ID NO: 201407 - protein, 115 aa, Triticum aestivum
  unsure (1)..(115): unsure at all Xaa locations
  Clone ID: PAT_TA_95825.pep
MARAQVMLMAVALVLMLAAVPRAAVAIDCGHVDSLXVRPCLSYVQGGPARLGNCCGGVQSSITKAQSKERFAKPACNCLKGIXPGXHNLNXDNAAASXPXACQLPYNHLESTEHV

SEQ ID NO: 201408 - protein, 56 aa, Triticum aestivum
  unsure (1)..(56): unsure at all Xaa locations
  Clone ID: PAT_TA_95826.pep
MAGAQESLVYAXXMRXXNDXVTGIAXPXDNSPXXVSSSRXXXLLXWESPHTSTQSN

SEQ ID NO: 201409 - protein, 147 aa, Triticum aestivum
  unsure (1)..(147): unsure at all Xaa locations
  Clone ID: PAT_TA_95827.pep
MATETETFAFQAEINQLLSLIINTFYSNKEIFLRELISNSSDALDKIRFESLTGKSKLDAQPELFIHIIXDKXXXTLTIVDXGIXMNKSXLVNNLREHRQVGGXMXXMVGLAAGXADVSMIXGQFGFGFYSGQXXXXKVLGTTXKTT

SEQ ID NO: 201410 - protein, 79 aa, Triticum aestivum
  unsure (1)..(79): unsure at all Xaa locations
  Clone ID: PAT_TA_95828.pep
KGAKSXGAXKADTXLAVXXXGAEXXAAKGKKGKXXKDPNKPXRGPSAFFVFXGEXRXEFXQXXPKXKSVXAVXKXGXER

SEQ ID NO: 201411 - protein, 57 aa, Triticum aestivum
  unsure (1)..(57): unsure at all Xaa locations
  Clone ID: PAT_TA_95829.pep
XRDXXRSXRRXXXSPXMESSXDTXSGLNRCELGSGPAPSLPPPSTSGACGWGWGWVS

SEQ ID NO: 201412 - protein, 143 aa, Triticum aestivum
  unsure (1)..(143): unsure at all Xaa locations
  Clone ID: PAT_TA_95830.pep
WCMEDERAGAAAANRSSSMRPSAPTSPFLGDTQGRRPSDGSGQCRLQTSPISRTSSWPPHRAAYPYPSVKQEQALGEVDRGSLLLLTCDTLRRVARTXAPLPKATFTMDSPNMTEIWTRHATSTRTINYSVFFELYLSFITSF

SEQ ID NO: 201413 - protein, 100 aa, Triticum aestivum
  unsure (1)..(100): unsure at all Xaa locations
  Clone ID: PAT_TA_95831.pep
RFGGGGPCRRLHRGHLGRRRVRGRFXXGGGXFRDXGPPAXVVKVSXFLHACXGDAVIKLXIXKCPTSXXPYXSKNKTHXXKVHEXXQXHQXIIFPVKIST

SEQ ID NO: 201414 - protein, 110 aa, Triticum aestivum
  Clone ID: PAT_TA_95832.pep
SFCSLVIVTITGFLCLLGKLLFLLLDRRVSSAVGPFCPSQEHLLCFKGVPYSTFCTAGCSRAASNQSVFLYLKYNGESTKQIYLFIFVKKKGQSKCNAHLSFLQDLENSR

SEQ ID NO: 201415 - protein, 128 aa, Triticum aestivum
  unsure (1)..(128): unsure at all Xaa locations
  Clone ID: PAT_TA_95833.pep
MARAQVMLMAVALVLMLAAVPRAAVAIDCGHVDSLVRPCLSYVXGGPGPSGQCCDGVKNXHNQARFQSDFQSAXNCLKGXLXIHNLNEDNAADPPKCGVNXPYTSSQNRLNRCNHIPSTGVTHQPLEF

SEQ ID NO: 201416 - protein, 123 aa, Triticum aestivum
  unsure (1)..(123): unsure at all Xaa locations
  Clone ID: PAT_TA_95834.pep
MARTKQTARKSTGGKAPRKQLATKAARKSAPTTGGVKKPHRYRPGTVALREIRKYQEEHGVLIRKCXFQRLXREDXARXQDGLRFQSHAXSASKEAAEPTRRLFRRHNSGXIXAKHIIPRIHS

SEQ ID NO: 201417 - protein, 75 aa, Triticum aestivum
  unsure (1)..(75): unsure at all Xaa locations
  Clone ID: PAT_TA_95835.pep
MAPKAEKKPVAEKAEKTTAAKKTKAEKRPPASKEGGXKKGKKKSKXNVETXKXYIXKVLKQVQPXIGISSKASSS

SEQ ID NO: 201418 - protein, 150 aa, Triticum aestivum
  unsure (1)..(150): unsure at all Xaa locations
  Clone ID: PAT_TA_95836.pep
DNEAIYDICRRSLDIERPTYTNLNRLVSQVISSLTASLRFDGALNVDVNEXQTNLVPYPRXHFMLSSXAPVISXXXGFXXQIXXXEITKKGXXXXSXIGKFXPRHGKXMGWCLXXXGDVXPKDXXAAVATSRRSAHQFVDWCPVQVINTV

SEQ ID NO: 201419 - protein, 101 aa, Triticum aestivum
  unsure (1)..(101): unsure at all Xaa locations
  Clone ID: PAT_TA_95837.pep
VSXVGVEADXALXXVPXTGXEIXLRXXXXDKXRGRPRTTXWXXXPPSTXAAHXPQPSQRAYASRTLVVSSSSEPVTYTXXFXPXXWXWTGRGGGWNPXVXX

SEQ ID NO: 201420 - protein, 110 aa, Triticum aestivum
  unsure (1)..(110): unsure at all Xaa locations
  Clone ID: PAT_TA_95838.pep
GSEWTILEGSRSVRSLGGLRAVRCGGVGRAKGLSSXASSLIPPTSPEXDLEAGAGEQLXCRXCLQNDXERLIAPCKXKGTSKYVQRDCLDHWRTVKEGFAFSQCTNCKAP

SEQ ID NO: 201421 - protein, 88 aa, Triticum aestivum
  unsure (1)..(88): unsure at all Xaa locations
  Clone ID: PAT_TA_95839.pep
MRECISXHIGXAGIQVGNACWELYCLXHGIQPDGQXPGDKTVXGGDDASTTFFXRDWVLGTFPPXVFVDFRATVIDXVKTGAYGSLQP

SEQ ID NO: 201422 - protein, 106 aa, Triticum aestivum
  Clone ID: PAT_TA_95840.pep
EADDLFKDTGRHQDPEDGGEPAQKSRPAPPPTAVSGAMWAVAPNSGAGGGGAFWMQPAWAFGAGNTVQAPLHSFQRSTFPAGWGDTNLRHAPRAQSWRPSTGGDNP

SEQ ID NO: 201423 - protein, 126 aa, Triticum aestivum
  unsure (1)..(126): unsure at all Xaa locations
  Clone ID: PAT_TA_95841.pep
PVPSTSSPAVQDFNFELDNLHPAXTNLTHPSLPSHIKSRQPRIRHQRKSHPSIRTGGRRAXGHGARVVQXXGGASAXRAGVPNXLGRXKXGSWVPPXXXGXSSSLXXQGVVLSXXLXGFSSAAVXX

SEQ ID NO: 201424 - protein, 155 aa, Triticum aestivum
  unsure (1)..(155): unsure at all Xaa locations
  Clone ID: PAT_TA_95842.pep
ERQLAPPPVKPXPPPLGARLQASTTAPNPPNNSQQWRTLPPSAATRSPSRSTSSAXSRPPPPPGAXSRXXSTXPPCPPPRASXSXRSTNPPPRSPPPAPLPGQGPPXAPLXSXPAGNPXGPQXXPPPSTTTRRCRPGGGSCGARGLTAAARVVRR

SEQ ID NO: 201425 - protein, 132 aa, Triticum aestivum
  unsure (1)..(132): unsure at all Xaa locations
  Clone ID: PAT_TA_95843.pep
MKFIAAYLLAYLSGNASPSAEDLTSILESVGCEIDNEKMELMLSQVKGKDITELLAAGKEXFAAVPSGGGGVAVSXAAPAAGGAAGPAXESKKEEKXWEXEENDDDMGSICSTNLGHPVSQYLWARNKINDV

SEQ ID NO: 201426 - protein, 102 aa, Triticum aestivum
  unsure (1)..(102): unsure at all Xaa locations
  Clone ID: PAT_TA_95844.pep
MAGRKGGDRKKEVTPSXKXGVKFPVGXXWGYSKKGRLTQSFGPXPRXXXRRXXXLAAEVLELXGXAGKDNKEDRIIPRQLLXPXRKTKSEGPLGQPKGGDFQ

SEQ ID NO: 201427 - protein, 170 aa, Triticum aestivum
  Clone ID: PAT_TA_95845.pep
STLKLTDDDRGVPGQRVHPGRTTERPADQGLEMDSHRFLQKVTQALKTLSTQAVLAAGKTAQTAWHMAGEVSSHPARHFVRQAIWASGHANPPPAGAGAVGVGYPSPTVVWSSNMTQMATTAAVLRVSAEAAAIGDGCALTRADERPATRKGIIPRKLDHQNQNTNSWAA

SEQ ID NO: 201428 - protein, 152 aa, Triticum aestivum
  unsure (1)..(152): unsure at all Xaa locations
  Clone ID: PAT_TA_95846.pep
MAPKAAEKKPAAATAEKTTAGKKPKAEKRAPASKEAGGEGKTRGRKKGSKAKKGVETYKIYIFKVLKQVHPDIGISSKAMSIMNSFINDIFEKLAGESAKLARYNKKPTITSREXQXTSVRLVLPGELAKHAVSEGTKGVTKFXSSASSSVS

SEQ ID NO: 201429 - protein, 77 aa, Triticum aestivum
  Clone ID: PAT_TA_95847.pep
AEQQICAPMACLLSGPRVYIHLIILLHSTITHSYTPSMLNFPSVSLSYLMKKTTATSTLVNRLSGTSFDLSNPRKTQ

SEQ ID NO: 201430 - protein, 158 aa, Triticum aestivum
  unsure (1)..(158): unsure at all Xaa locations
  Clone ID: PAT_TA_95848.pep
MVSGSGVCAKRVVVDARHHMLXRLXSIVAKELLNGQRVVVVRCEEICMSGGLVRQKMKYLRFLRKRMNXKPSHGPIHFRAPAKIXWRTIRGMIPHKNAKGEGALAKLKXYXGXPPXYNKTXRMGIPDALKGLRLNLGKSXGLLRQLXXESGWTKPXTI

SEQ ID NO: 201431 - protein, 156 aa, Triticum aestivum
  unsure (1)..(156): unsure at all Xaa locations
  Clone ID: PAT_TA_95849.pep
MEPAVRAEDEAMSTEELLQAQTDLYHHSLAYIKSMALGAAAELGVADAIHGRGGAITLSHLAAATGVHPTKVQHFGRLMRALTVTGVFTSEEKEGGGGALYKLTRISRLLVGVGKRRLSPMVRMLVSEVSFTTPMSICEWXTLRPQGHVRGQFDST

SEQ ID NO: 201432 - protein, 166 aa, Triticum aestivum
  unsure (1)..(166): unsure at all Xaa locations
  Clone ID: PAT_TA_95850.pep
MGIDLVAGGRNKRTKRVAPKSDDVYLKLLVKLYRFLVRRTKSKFNAVILKRLFMSKTNRPPLSMRRLXTLMKGKEEKNIAVVVGTITXDDMRXQXVQQXKVTALRXTETAXRARIVNAGGECLTXFDQLALRCSNWGRTISCLXGPXMXVKAVRXFXKAPGXAQNQ

SEQ ID NO: 201433 - protein, 136 aa, Triticum aestivum
  unsure (1)..(136): unsure at all Xaa locations
  Clone ID: PAT_TA_95851.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGEXA

SEQ ID NO: 201434 - protein, 142 aa, Triticum aestivum
  unsure (1)..(142): unsure at all Xaa locations
  Clone ID: PAT_TA_95852.pep
MAAKEPMRVLVTGAAGQIGYALVPMIARGVMLGADXPVILHMLDIEFAAEALKGVKMELXDAAFPLLKGVVATTDVVXACTGVNVXVMVGXFPXKEGMERXDVMTKNVSIYKAQASAPEAQATPNCXGLGVANQQNNNGSHP

SEQ ID NO: 201435 - protein, 74 aa, Triticum aestivum
  unsure (1)..(74): unsure at all Xaa locations
  Clone ID: PAT_TA_95853.pep
XYQKQSTDHQERIKQINPLIMTLICVNEFLPCHFFLFHEFLFIFSFNKFLLNQWTTPSMSTNKMKLTNNWFHTP

SEQ ID NO: 201436 - protein, 75 aa, Triticum aestivum; identical to SEQ ID NO: 106874
  Clone ID: PAT_TA_95854.pep

SEQ ID NO: 201437 - protein, 80 aa, Triticum aestivum
  unsure (1)..(80): unsure at all Xaa locations
  Clone ID: PAT_TA_95855.pep
HASLSLTHSLTHTRSHXWSPFIHGMQSVGLXKXDXCMHSQPCHARTXCSHTVLQLXASHVRGHAGRPACVXCVPTYXRLT

SEQ ID NO: 201438 - protein, 156 aa, Triticum aestivum
  unsure (1)..(156): unsure at all Xaa locations
  Clone ID: PAT_TA_95856.pep
MQIFVKTLTGKTITLEVESSDTIDNVKAKIQDKEGIPPDQQRLIFAGKQLEDGRTLADYNIQKESTLHLVLRLRGGAKXRKKKTTPKPKEXKKHKHKKVKARRPPSSTKVDDATXKVNKAQGKDCPNAQLRGPEPSWANNXNGNXCGXCGSPFKTK

SEQ ID NO: 201439 - protein, 158 aa, Triticum aestivum
  unsure (1)..(158): unsure at all Xaa locations
  Clone ID: PAT_TA_95857.pep
MASWDELVDSTLATLAGKNLLFMQRLITLPPPVPPSRTFAGPGPWDRPTVEIRLDGASTQEWLALNGLVSEEGDEVDRKVVLFSGNDYIGLATHPAVLEAAAXAAQGPGMGPRSSSLILGTLLTTKLAXESLADLLKMEDCLLVQRISAKTSSCSVHH

SEQ ID NO: 201440 - protein, 123 aa, Triticum aestivum
  Clone ID: PAT_TA_95858.pep
MRSGVSARLLPQAVAIAIAVAVACCMAAAPSSAQGTTTPADASGAVPSCASKLVTCAGYLNTTDTPPESCCDPLKEAATTQAACMCAILMNKAALQAFGVAPEQGVLLAKRCGVTNDASTCAK

SEQ ID NO: 201441 - protein, 44 aa, Triticum aestivum
  unsure (1)..(44): unsure at all Xaa locations
  Clone ID: PAT_TA_95859.pep
XXWWRLXLSMXQXRPPHEVSXXHXXRHXSIXFSPLRXYXXPRXX

SEQ ID NO: 201442 - protein, 78 aa, Triticum aestivum
  unsure (1)..(78): unsure at all Xaa locations
  Clone ID: PAT_TA_95860.pep
SVVVNAHFEAPCLYGIYLLFMFKCPQNSIKMSLQSVHVVPVIMPFENGLRVXPVLQITECPSNIINLQRATTLNYIAQ

SEQ ID NO: 201443 - protein, 153 aa, Triticum aestivum
  unsure (1)..(153): unsure at all Xaa locations
  Clone ID: PAT_TA_95861.pep
MAPKADKKPAAENKVEKAAEKTPAGKKPKAEKRLPAGKTASKEAGGEGKTRGRKKGSKAKKGVETYKIYIFKVLKQVHPDIGISSKAMSIMNSFINDIFEXKLAGESAKLARYNKKPTITSREIRPPXRLVLPGELXKHAVSXGTKASQVQSS

SEQ ID NO: 201444 - protein, 70 aa, Triticum aestivum
  unsure (1)..(70): unsure at all Xaa locations
  Clone ID: PAT_TA_95862.pep
GLLLGPTQSEKIAKVVKAAGIKVEXYWPALFAKLLEXKXSVDELILSVGXGKTLPPGNPLFQFDHVRWCT

SEQ ID NO: 201445 - protein, 131 aa, Triticum aestivum
  Clone ID: PAT_TA_95863.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAESYLVGLFEDTNLCAIHAKRVTSCQGHQLARRIR

SEQ ID NO: 201446 - protein, 180 aa, Triticum aestivum
  unsure (1)..(180): unsure at all Xaa locations
  Clone ID: PAT_TA_95864.pep
MWMPPHQLPPHQLPASHLPVPHFPPRTAPPPSPPSPARRAPXPFSPSPAAPPTTTSDSVPQEPPLYAGRRPPLSQAPSSRSWRDPAAHGRRRGLSHQIRLPSAAGVALASLGRIHRLPNPSAGKRMGRQPCNTVEIRWVASAPNSPPPSRENPLPRHQATNPAPTGCCGPQQILSRVAPS

SEQ ID NO: 201447 - protein, 176 aa, Triticum aestivum
  unsure (1)..(176): unsure at all Xaa locations
  Clone ID: PAT_TA_95865.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYXXAGNWAMWKLPKFGXCTDXTQXVXTKWKEVKKEYPDAXVRIIXFDNMRQVXXVSFXAXKPTGCEVRKG

SEQ ID NO: 201448 - protein, 165 aa, Triticum aestivum
  unsure (1)..(165): unsure at all Xaa locations
  Clone ID: PAT_TA_95866.pep
PHLRRRVTRKRETQQETTTATAMRSHALQLVARAVRASAPRPHPQRHLHQVAALRASTGFFSTEAAAGASAAATAGAAQGGSKSAAAAAASSGAAQAASKPAAVASGSDGGGGGNGRDGKSQQGDSGKSVRRRAVSRFNFPLLLVTGGXIIXYYDKGEETSQXKN

SEQ ID NO: 201449 - protein, 94 aa, Triticum aestivum
  unsure (1)..(94): unsure at all Xaa locations
  Clone ID: PAT_TA_95867.pep
XPPPYQXFSIALLADGRSQDFPPRSXRSSSSTRALLXXPWADSASSLXRRGXAHAGVHXSASLXSFLPLKXXXWIXDGFSRVXGVXEXLXLXLA

SEQ ID NO: 201450 - protein, 119 aa, Triticum aestivum
  unsure (1)..(119): unsure at all Xaa locations
  Clone ID: PAT_TA_95868.pep
MARTKQTARKSTGGKAPRKQLATKAARKSAPTTGGVKKPHRYRPGTVALREIRKYQKSTELLIRKLPFQRLVREIXQDFKTDLRFKSTPXVXLQEAAKAYSRAVQDTTLRIKQAVTSCQ

SEQ ID NO: 201451 - protein, 154 aa, Triticum aestivum
  unsure (1)..(154): unsure at all Xaa locations
  Clone ID: PAT_TA_95869.pep
MAPKAAEKKPVEKTPAGKKPKAEKKVPASKEGGGDKKGKKKAKKSVETYKIYIFKVLKQVHPDIGISSKAMSIMNSFINDIFEKLAGESAKLARYNKKPTITSREIQXTSVRLVLPGEXLAKHAVSEGNKGVTKLTRLIRLSCVCPGGIDVPVF

SEQ ID NO: 201452 - protein, 145 aa, Triticum aestivum
  unsure (1)..(145): unsure at all Xaa locations
  Clone ID: PAT_TA_95870.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCHIPLTGPNSIVGRAVVVHGDADDXLAKGGHXLSKSTGNAGARVA

SEQ ID NO: 201453 - protein, 159 aa, Triticum aestivum
  unsure (1)..(159): unsure at all Xaa locations
  Clone ID: PAT_TA_95871.pep
MARTKQTARKSTGGKAPRKQLATKAARKSAPATGGVKKPHRFRPGTVALREIRKYQXKSTELLIRKLPFQXRLVREIAQDFKTDLRFQSSAVVRAARGRRGVPRRALRGHQTSALSTPKRVTIMPKDIKLARRIRGERPQRSVPSFQKSSVMFRSLGGT

SEQ ID NO: 201454 - protein, 125 aa, Triticum aestivum
  unsure (1)..(125): unsure at all Xaa locations
  Clone ID: PAT_TA_95872.pep
HLAPGIPHLKAPLKGKKVLLRLSXSQGHQQRSSRSRSTRRLGGRFRSSRRSKWRKPAVVVEEADGAVVFRGGRRGRGGAAGPSRPDLVYEEEEGVRDGAVGQLGTERGGWWLHPWRWRALGTASG

SEQ ID NO: 201455 - protein, 151 aa, Triticum aestivum
  unsure (1)..(151): unsure at all Xaa locations
  Clone ID: PAT_TA_95873.pep
MDASATVAAGKAKKGAAGRKAGGPRKKSVARSVKAGLQFPVGRIGRFLKKGRYAQRVGSGAPVYLAAVLEYLAAELLELAGNAAKDNKKXRIIPRHLLLAVRNDQELGRLLAGVNIAQGGVIPNIKPVLLAKKTAXKFPXGAQVPQKERQI

SEQ ID NO: 201456 - protein, 174 aa, Triticum aestivum
  unsure (1)..(174): unsure at all Xaa locations
  Clone ID: PAT_TA_95874.pep
MMNAHANLALAALAFPAHMPNSKFSHIRSRCTRRPPLPLSMAAHPPIRSNPTQITMSTTGSASAGGEQAGISGTDRFRMLDFHHVEFWCADAASAAGRFSFGLGVPLAAESGLSTGNTAHASHLLHSRSGSLAFLFSAPYAXGNAVNASVPPSNADNGSRFTETAFGPAFGPPP

SEQ ID NO: 201457 - protein, 85 aa, Triticum aestivum
  unsure (1)..(85): unsure at all Xaa locations
  Clone ID: PAT_TA_95875.pep
GDVIDSKIITDRETGRSRGFGFVTFASDEXMRQAIEAMNGXDLXGRNIIVNEAXSRRSXXXCXSXFQPAPAHGRWPEEASSNKCA

SEQ ID NO: 201458 - protein, 50 aa, Triticum aestivum
  Clone ID: PAT_TA_95876.pep
FPSRLYSTNPDRIEAKKILAASQRHRIQQQSLRRCPIVSSSSRRRLRRRR

SEQ ID NO: 201459 - protein, 177 aa, Triticum aestivum
  unsure (1)..(177): unsure at all Xaa locations
  Clone ID: PAT_TA_95877.pep
STPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEXSKQAPSPPVHHQPTYHQQPPHALAGAALNKIKPPFVFLIPLASFFKLAFPP

SEQ ID NO: 201460 - protein, 136 aa, Triticum aestivum
  unsure (1)..(136): unsure at all Xaa locations
  Clone ID: PAT_TA_95878.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGEXX

SEQ ID NO: 201461 - protein, 175 aa, Triticum aestivum
  unsure (1)..(175): unsure at all Xaa locations
  Clone ID: PAT_TA_95879.pep
SPGNLRSERSEGSLVLLLKMQIFVKTLTGKTITLEVESSDTIDNVKAKIQDKEGIPPDQQRLIFAGKQLEDGRTLADYNIQXKESTLHLVLKLRGGMQIFVKTLTGKTITLEVESSXDTIDNVXAKIQDKEGIPPDQQRLILCRQASSKDGRNPLRXYNIQKGVQPPWGRSGNSN

SEQ ID NO: 201462 - protein, 85 aa, Triticum aestivum
  Clone ID: PAT_TA_95880.pep
YNQHVSSSELLSYNSMLCMISSKVSMNFALHQKLNRTPSRTKVNNTTYLDINPLSSMPQFLVLHIHFYLHSILIFLKTGTYFYHA

SEQ ID NO: 201463 - protein, 136 aa, Triticum aestivum
  unsure (1)..(136): unsure at all Xaa locations
  Clone ID: PAT_TA_95881.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRNRGXKA

SEQ ID NO: 201464 - protein, 61 aa, Triticum aestivum
  unsure (1)..(61): unsure at all Xaa locations
  Clone ID: PAT_TA_95882.pep
XRXNCXXRXRLRSXLRRLSSXPYWPEFVQLRXRGYQXQAGEXXQVDPXXAMIDTLWFFSXL

SEQ ID NO: 201465 - protein, 145 aa, Triticum aestivum
  unsure (1)..(145): unsure at all Xaa locations
  Clone ID: PAT_TA_95883.pep
HREWSEERYQEIIKETSNFIKKVGYNPKHVPFVPISGFNGDNMIEASSNCPWYKGWEKETKAKATGKTLLEAIDAIDPPSRPTDKPLRLPLQDVYKIGGIGTVPVGRVETGIIKAGMVVTFAPAGVTLXXQSVEMXHXXLVXGVP

SEQ ID NO: 201466 - protein, 47 aa, Triticum aestivum
  Clone ID: PAT_TA_95884.pep
TFEWQIPLTGPNSIVGRAVVVHGDADDLGKGNALETLESYIFMSPCA

SEQ ID NO: 201467 - protein, 160 aa, Triticum aestivum
  unsure (1)..(160): unsure at all Xaa locations
  Clone ID: PAT_TA_95885.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKNGGXGXXKAPNSPKKGANXPXKAAKTLKK

SEQ ID NO: 201468 - protein, 62 aa, Triticum aestivum
  unsure (1)..(62): unsure at all Xaa locations
  Clone ID: PAT_TA_95886.pep
LDFFFFFEHHNIDFIIGQMKGIFXSRPVASPTXXPXEDXQLCLLACCXGXTXXTWVXWPCKS

SEQ ID NO: 201469 - protein, 158 aa, Triticum aestivum
  Clone ID: PAT_TA_95887.pep
MDASKLKKVAGKKFGGPRKKSVTRSVKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKNAAKSPKKGNKSQEGTRLNLIMRVV

SEQ ID NO: 201470 - protein, 55 aa, Triticum aestivum
  Clone ID: PAT_TA_95888.pep
LGARRRRRARRALIPFLGRRGAAAAAAQRFRASDRHLPCFAVARFRSSLLVCELY

SEQ ID NO: 201471 - protein, 163 aa, Triticum aestivum
  unsure (1)..(163): unsure at all Xaa locations
  Clone ID: PAT_TA_95889.pep
MAFAASASGDVIVAANYADSGRTLIYDAAAGGVSPGPEMRSVKHHLFLVPVGDRMFFAMSAYSRLDFPRGGPWFEALQQQPLPCGGGGRWAWSALPDLPGIARGRREDVRAYFVAGARVWXSLHLXGTYSFDTARQRWRXEGAWELPEGRESWRLSGQRPVVF

SEQ ID NO: 201472 - protein, 124 aa, Triticum aestivum
  unsure (1)..(124): unsure at all Xaa locations
  Clone ID: PAT_TA_95890.pep
MREILHIQGGXCGNXIXXKFWEVVCXEHXIDPTGRYAGDTXLQLXRXNVYYXXASCGRFXPRAVLMDLXPGTXMXSVCSXTXYGGIFRPDNXXFGXQSXXRXTSWXXGXLHRRAXXLIXSVLRS

SEQ ID NO: 201473 - protein, 118 aa, Triticum aestivum
  unsure (1)..(118): unsure at all Xaa locations
  Clone ID: PAT_TA_95891.pep
MALLPRTXRLXLFSASXRTXXAXXAXGAXPTXXAPYAGVPPPAAGSKXADXVXSXVDDLMNWVRSGSIWXMIFGXACCXXXMMHAGXXXYDXNRFXVXFXPXXXXQSNCIIVAGTLTN

SEQ ID NO: 201474 - protein, 133 aa, Triticum aestivum
  unsure (1)..(133): unsure at all Xaa locations
  Clone ID: PAT_TA_95892.pep
ARRAQIYLRDPPAPPSSRPPDPPRPRAWRTRPRTAASAHRSAATTSTTAASSAPARSPXSXTPRSSPAPSAPPPPRAXSRPPRLLPRRPRRPAPCRTSSGARGAVCGTRSRKIARGVVVPDVDLMSSVLREPR

SEQ ID NO: 201475 - protein, 147 aa, Triticum aestivum
  Clone ID: PAT_TA_95893.pep
MAAAAKLSVSSQAFAALLDCCGTAAGDCDGLLFGRARPPAPPPSLFDYRAFLLVDSRLFPTSLQVVNVGPGFRGQYHTFAAESPMPWLPRPPAKGFSIRDQKAMDGMIDAFGLGRVEALVASATGQSTEVEEMYSGMLRRLERLARE

SEQ ID NO: 201476 - protein, 146 aa, Triticum aestivum
  unsure (1)..(146): unsure at all Xaa locations
  Clone ID: PAT_TA_95894.pep
AAEKKPVATAEKTTAGKKPKAEKRAPASKEAGGEGKQRGRKKGSKAKKGVETYKIYIFKVLKQVHPDVGISSKAMSIMNSFINDIFEKLAGESAKLARYNKKPTITSREXQTSVRLVLPGELAKHAVSEGTKAVTKFTSSASSSSF

SEQ ID NO: 201477 - protein, 65 aa, Triticum aestivum
  unsure (1)..(65): unsure at all Xaa locations
  Clone ID: PAT_TA_95895.pep
HCTPLSPSSALRPLAAILDGVAGMYRRHCAPSDFMGERXKXXXFTERTSSXXSCXFXFXQTXAXK

SEQ ID NO: 201478 - protein, 124 aa, Triticum aestivum
  Clone ID: PAT_TA_95896.pep
QTRTHNIDAEKEEELDHNTTVLWECFQSLWVLDLRHTDCDQILSARVMDLMIQLRELNVMGARNWDMSHLQGRLRNIRKLRVTKSTCYFNNNVFSDMWNMELLDFSGNIIKTRHDNLIWARKQQ

SEQ ID NO: 201479 - protein, 155 aa, Triticum aestivum
  unsure (1)..(155): unsure at all Xaa locations
  Clone ID: PAT_TA_95897.pep
MXIFVXTLTGKTITLEVESSDTIDNVKAKIXDKEGIPPDXQRLIFAGKXLEDGRTLADYNIQKESTLHLVLRLRGGMQIFVKTLTGXTITLEVESSXTIXNVKAXIXDKEXIPPXQQSLIFAGKQXLEDXRTLAXYNIXRSNLHLGLKLRGGMQI

SEQ ID NO: 201480 - protein, 84 aa, Triticum aestivum
  Clone ID: PAT_TA_95898.pep
LTPISLHHPREQLKKGNVIMFPSFISSFFAFQANAVHYNHTQPIIPKGFLWMFLTLAHGPHKLKHLDGLTNQNQIITPVGLRKY

SEQ ID NO: 201481 - protein, 130 aa, Triticum aestivum
  Clone ID: PAT_TA_95899.pep
MPATKIPIVKKRTKKFARHQSDRFKTVSESWRKPKGIDNCVRRRFRGKMSMPKIGYGSNKKTRHLMPNGYRRLVVSNVRDMDLLLMHNGSFAAEIAHNVSSRKRIEILEKAKVLGVKVTNASARVRAEEA

SEQ ID NO: 201482 - protein, 139 aa, Triticum aestivum
  unsure (1)..(139): unsure at all Xaa locations
  Clone ID: PAT_TA_95900.pep
LSSVSRYIESTPHHPPFQPWLASKTSFLSRRRSLHLRLPLKQCSMTSGGVYLCTIASRRSYAPKLSFARATKVSCGARATALSCTDRHLQCHPRELFLAQDKHSGNCIGSQDQDTVLHPSDQRWRQNSGKKXNKKSPLS

SEQ ID NO: 201483 - protein, 107 aa, Triticum aestivum
  Clone ID: PAT_TA_95901.pep
PTHARLPPVTANGELPSDHRGVTDFAWRGRSPPGRRRPCPGGWGPGPRRSWAAAPTTRGAPARWCWSWTRRGRRRRPRRAPRARSSVASSSRGYPCSAYFSTGSFQI

SEQ ID NO: 201484 - protein, 165 aa, Triticum aestivum
  unsure (1)..(165): unsure at all Xaa locations
  Clone ID: PAT_TA_95902.pep
SNRVIWLRSMAIRSLLLPLALLVLAXXSSAXVAQLEXGFYSKTCPDAEKXXGXEMAKIIAAAPXLAXPLLRLHFHDXFXRGCDASVLXESXDXNVAEKXAKPNKXLRRFGSVXRVKGKLEGACPGIXSCAEVLNLKFPRXVLLGKGPXWXMAFGKXNGRGPSTGA

SEQ ID NO: 201485 - protein, 141 aa, Triticum aestivum
  Clone ID: PAT_TA_95903.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILNLC

SEQ ID NO: 201486 - protein, 89 aa, Triticum aestivum
  Clone ID: PAT_TA_95904.pep
QSCCVRLLSILFTPPFLPLYSPGLVPFNTHYLTVDLYTHPFTIIQFSVAGPLSRNTQFYLLETNFQTHNDNAILATLYETLNTQLLQQS

SEQ ID NO: 201487 - protein, 152 aa, Triticum aestivum
  unsure (1)..(152): unsure at all Xaa locations
  Clone ID: PAT_TA_95905.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWXYLTHYGVEIGXKKKAAATAKKEAAEGTRRLVAACCHKQ

SEQ ID NO: 201488 - protein, 164 aa, Triticum aestivum
  unsure (1)..(164): unsure at all Xaa locations
  Clone ID: PAT_TA_95906.pep
MXAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSKVQXRSSSKGKLKQRQXLKAEGQXVXGEGHQPPRXNQASPKPGFKXEGXTIETVTPXPXEVXNDX

SEQ ID NO: 201489 - protein, 57 aa, Triticum aestivum
  unsure (1)..(57): unsure at all Xaa locations
  Clone ID: PAT_TA_95907.pep
LIVRXXGXGRGQRXGFWERSRKGPGVPAPVPGMGNXXPCGSGSGRXGCGXNRXSRGL

SEQ ID NO: 201490 - protein, 182 aa, Triticum aestivum
  Clone ID: PAT_TA_95908.pep
PASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPSRRMRSRARALNKIKPFVFRSSVCPCPCVQQCPPLPPLLM

SEQ ID NO: 201491 - protein, 164 aa, Triticum aestivum
  unsure (1)..(164): unsure at all Xaa locations
  Clone ID: PAT_TA_95909.pep
MAVGKNKRIXRGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQXTLIEAHVDVKTTDNYMLRMFAIGXTKXTPEPXXRXCYAQXSXITV

SEQ ID NO: 201492 - protein, 94 aa, Triticum aestivum
  Clone ID: PAT_TA_95910.pep
MAAQEQEQQAKTSTTSSLPSSSDRSSSSGPNNLKKGGAESDEEIRRVPEMGGGSASSGAGDGKQLQLAAAGGGQAPAGKKRGRAAGDKEQNRLK

SEQ ID NO: 201493 - protein, 53 aa, Triticum aestivum
  Clone ID: PAT_TA_95911.pep
CLVSERGEVSMKLRDLMQGIHLFFQDMLLLRGELELFSIEVTSDVQNACSCVV

SEQ ID NO: 201494 - protein, 172 aa, Triticum aestivum
  unsure (1)..(172): unsure at all Xaa locations
  Clone ID: PAT_TA_95912.pep
PSRARSRPGGASPASAGGRSPAPAAGGLARRHPALGSTAAAPWWLSCASVYRRSHGTPPPACRRLRWPCLAPSAVTGCFLVQRGLSPRSTSRSATPCPDLQLLLTLPTAPPSGPAMPPPFGWLWMLLAWPCLLLVGCGYYWCWRFRVSLPKSGPRWMVGDXVPATRLAMVGF

SEQ ID NO: 201495 - protein, 139 aa, Triticum aestivum
  unsure (1)..(139): unsure at all Xaa locations
  Clone ID: PAT_TA_95913.pep
DPAEEAPVASDAAGKASGLPLAREAGVREAAGAGRNFVISPLSIHAALAMVTAXARGDTRRELLGFLGSXSLDELHRSPAIKLVGRLNGLTQTSFACGVWVDQRRALRPEXFTATGASRYAATAESVDFVSGGRGEAAR

SEQ ID NO: 201496 - protein, 146 aa, Triticum aestivum
  unsure (1)..(146): unsure at all Xaa locations
  Clone ID: PAT_TA_95914.pep
MAMVISSGVQAPCSLLMATLMLLIVQAQSFTRHYNFNVQMANVTRLCATKSIVTVNGEYPGPALVAREGGRVVVRVTNHVAXAHNMTLHWHGVRQLRNGWVIVVYGVVIVVYRRLWRQLHFSGXRGTLWWHRTFVATSKSSSPNKG

SEQ ID NO: 201497 - protein, 148 aa, Triticum aestivum
  unsure (1)..(148): unsure at all Xaa locations
  Clone ID: PAT_TA_95915.pep
MAGRKGGERKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKAAGAAEKESNKSPKKXGANKSPRRRXQXTKE

SEQ ID NO: 201498 - protein, 142 aa, Triticum aestivum
  unsure (1)..(142): unsure at all Xaa locations
  Clone ID: PAT_TA_95916.pep
MAKVHPDAVVALPEAPAAGHSRPVGAGAEEEEPPPEAMALTVWRKSLLFNCDGFTVFDATGGLAFRVDCYGTSGRRRRHAEDVVLMDAAGFPLLTVRRRRLSLAXHWVIYDGDGGEVDAPKPLLSVRRCHAGLLRKPNAFSS

SEQ ID NO: 201499 - protein, 179 aa, Triticum aestivum
  unsure (1)..(179): unsure at all Xaa locations
  Clone ID: PAT_TA_95917.pep
TLHNTPSSTPSSTPFNTLSTHSEAYQEENSAPPAYHTVVDPTLPIPNMTNPYDPQEEDCDTQETQDDTPEITINAATQIRGHGNIISIAQMDSVRIANLIATVLSGETIETGKIGEEDGAAGRPLTPESPTTQATARGECTSTTQVRGVKRYSNINITVNCGANIIGDKDIXGTGLGDI

SEQ ID NO: 201500 - protein, 128 aa, Triticum aestivum
  unsure (1)..(128): unsure at all Xaa locations
  Clone ID: PAT_TA_95918.pep
MEDPGKSLNNPSPDYEDEVSRQYSEDKEEEYKDLNSQDEHTSTQPNDDSVAGHHEQKAQTEIGQEVEMEELPIQQGERVXLASXGAXLXPTXKGXFXRGRHSLFRQQRRLVAPKESPLHVALTAIMKR

SEQ ID NO: 201501 - protein, 104 aa, Triticum aestivum
  unsure (1)..(104): unsure at all Xaa locations
  Clone ID: PAT_TA_95919.pep
ASPRGQQSAPFTASAPFTAAGMSLMVATAGEEDGASGRRSSAWDLLLHAMVMYLFFFLGERVLSLVSLQNHRCSYKNMLNGNNFGTIXFNSVTKFXNIPVXKKK

SEQ ID NO: 201502 - protein, 128 aa, Triticum aestivum
  unsure (1)..(128): unsure at all Xaa locations
  Clone ID: PAT_TA_95920.pep
RVPEHRRAPLHLPLPELELAASTSTPNVTVFLPGLPHAVDGSGQLESSSGRPXNXNDXFQEXXDAXDDYYYPEDANYYMTTADDWDSMXVPSKRPCLSIVGALCXLLKXNCLTKFXPXMVLPLTLXXN

SEQ ID NO: 201503 - protein, 100 aa, Triticum aestivum
  unsure (1)..(100): unsure at all Xaa locations
  Clone ID: PAT_TA_95921.pep
MGLTFXKLFSRLFAKKEMRILMVGLDXAGKTTILXKLKLGEXVTTXPTIXVNVKLXSXXXINXTFXISXSGQDXALXXHIXKXTNGLILHXMTVSVVRHI

SEQ ID NO: 201504 - protein, 114 aa, Triticum aestivum
  unsure (1)..(114): unsure at all Xaa locations
  Clone ID: PAT_TA_95922.pep
MSTEKKQLNPMRDIKVQKLVLNISVGESGDRLTRASKVLEXLSGQSPVFSKARYTVRSFGIKRNEKIACYVTIXGEKGMQLLENGLXVXEYNCSXGTXTTTXCFGSXSKEHSEV

SEQ ID NO: 201505 - protein, 105 aa, Triticum aestivum
  unsure (1)..(105): unsure at all Xaa locations
  Clone ID: PAT_TA_95923.pep
PEEGHRGRVPRGRAADRHDHHGRRARAPPRAAAAPPPPPPRGAARRGAAPPREAAADGVERARQEPGXQTXAEPGQLRRRRXXKXLXIKEKQRXXSKHPQPAAMQ

SEQ ID NO: 201506 - protein, 91 aa, Triticum aestivum
  unsure (1)..(91): unsure at all Xaa locations
  Clone ID: PAT_TA_95924.pep
KPKEEEEHQGTQLRPPPFKSPESWVDPLPPRPAPKLLPISDKGLXXQIPTXFDPFXEANAGDAGAXAXXKDYVXVRXXXRXXPKSLPMSXG

SEQ ID NO: 201507 - protein, 53 aa, Triticum aestivum
  unsure (1)..(53): unsure at all Xaa locations
  Clone ID: PAT_TA_95925.pep
PVTRSPIIXTKWENYXALPXXFLDXXAGKXSSCXPPVRRSRKNXXXPAXXFFI

SEQ ID NO: 201508 - protein, 75 aa, Triticum aestivum
  unsure (1)..(75): unsure at all Xaa locations
  Clone ID: PAT_TA_95926.pep
QTRAESATRRWRRCPSPRPHPSPPPPPAVSPCPRPARHSSASXQFGXSANAXPGVGGGXAAXRGRXXXGXVKXGK

SEQ ID NO: 201509 - protein, 72 aa, Triticum aestivum
  Clone ID: PAT_TA_95927.pep
MKNASLLTDDNYGSVKKVYVVAKADGSSTEEMQRWMVMLSPGTEVEEIAGADHAIMSSRPRELCDALGQDRQ

SEQ ID NO: 201510 - protein, 116 aa, Triticum aestivum
  unsure (1)..(116): unsure at all Xaa locations
  Clone ID: PAT_TA_95928.pep
MKFIAAYLLAYLSGNASPSAEDLTSILESVGCEIDNEKMELMLSQVKGKDITELLAAXGREKFAAVPSGXGGGXGRFKLLPLLLGGAAAPAAESKKEEKSLEKEESDDDMGFNLFD

SEQ ID NO: 201511 - protein, 148 aa, Triticum aestivum
  unsure (1)..(148): unsure at all Xaa locations
  Clone ID: PAT_TA_95929.pep
MAPKAAEKKPAAKKPAEEEPATEKAPAGKKPKAEKRLPAAKTAAKEGEGKTRGRKKGGKAKKGVETYKIYIFKVLKQVHPDVGISSKGMSIMNXFINDIFEKLPXKAASXRYNKKPHHSREVKTSSALSRELPKKPLEGQGSQNSRNS

SEQ ID NO: 201512 - protein, 51 aa, Triticum aestivum
  Clone ID: PAT_TA_95930.pep
WTWSIARPPSRCTRWRRKTCAHGSLDLLPFLRRGRRQRRGQEGGEPLVNGR

SEQ ID NO: 201513 - protein, 136 aa, Triticum aestivum
  unsure (1)..(136): unsure at all Xaa locations
  Clone ID: PAT_TA_95931.pep
MAPKAEKKPVAEKAEKTTAGKKTKAEKRPPASKEGGEKKGKKKNKKSVETYKIYIFKVLKQVHPDIGISSKAMSIMNSFINDIFEKLAGESAKLARYNKKPTITSREIQTSVASSSPAKLAKHAVSXGTRASQVSS

SEQ ID NO: 201514 - protein, 158 aa, Triticum aestivum
  unsure (1)..(158): unsure at all Xaa locations
  Clone ID: PAT_TA_95932.pep
VAAAENARLIDPGNAEVGMILNNVRLVARARAQGNELFKAAKFSDASIAYGEGLKYDPSNPVLHCNRAACWWKLDGWEKAVDDCNEALRIQPTYTKALLRRSXSYSKLDRWADCVRDYEALRKRLPADTEVAEAXFHAQVALKTTRXEDVXNMKFGES

SEQ ID NO: 201515 - protein, 56 aa, Triticum aestivum
  Clone ID: PAT_TA_95933.pep
LPPPTLPILSPLLLAWELGFLSSAAILFSSTMVPSRIRFARQIPLPCCSDTEEEEG

SEQ ID NO: 201516 - protein, 144 aa, Triticum aestivum
  unsure (1)..(144): unsure at all Xaa locations
  Clone ID: PAT_TA_95934.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAESYLVGLFEDXNLCAIHAKRVTSCXKDIKSPRIRGEXLSLSSLCYLS

SEQ ID NO: 201517 - protein, 175 aa, Triticum aestivum
  unsure (1)..(175): unsure at all Xaa locations
  Clone ID: PAT_TA_95935.pep
MGISRDSMHKRRATGGKQKAWRKKRKYELGRQPANTKLSSNKTVRRVRVRGGNVKWRALRLDTGNFSWGSEAVTRKTRLLDVXYNXSNNELVRTQDLVKNAXLCKVDAAPFKQWYLTQYGVXIXXKKXAAATAKKELLKGKRLXCCCSTXGTKKSNXSXELXXRNKDVTXLPHXE

SEQ ID NO: 201518 - protein, 78 aa, Triticum aestivum; identical to SEQ ID NO: 106952
  Clone ID: PAT_TA_95936.pep

SEQ ID NO: 201519 - protein, 175 aa, Triticum aestivum
  unsure (1)..(175): unsure at all Xaa locations
  Clone ID: PAT_TA_95937.pep
NMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPXDKPLRLPXKDVYKIGGIGTVPXGRVETGVIKPGMVVTLXQWTEAI

SEQ ID NO: 201520 - protein, 125 aa, Triticum aestivum
  unsure (1)..(125): unsure at all Xaa locations
  Clone ID: PAT_TA_95938.pep
GGCLAAAATADAAPAASAATAAAGARCSPTLRPPPAPPPWSCPPPPTRGAPAGSRRPAGRPAAATAPPASAARPAAAPAAAATEPAPRRPAGXGEHEDEEDNWTSNHXPPPPPSLAAACARPRAR

SEQ ID NO: 201521 - protein, 166 aa, Triticum aestivum
  unsure (1)..(166): unsure at all Xaa locations
  Clone ID: PAT_TA_95939.pep
ISDETPLPTLLAPRSPSGSGQQPRRLAPRCLPRHSPVAWRSPDPVCAVPSSLPRPRSRPKAADAAAIAALLGPRRTPSPDCLPIVLFVAYSSPSSSSTAPTSLAAPRPCNMDAGVQEPDATVDDDYYYLGGAYYYVQPLTATRVVKRSKXEAALFDRIQXVXPSKE

SEQ ID NO: 201522 - protein, 149 aa, Triticum aestivum
  unsure (1)..(149): unsure at all Xaa locations
  Clone ID: PAT_TA_95940.pep
GCGGGCGNMASEGTKSGFAKSGGCGSGCGGGCGSMVIEGSKTTFTKSGGCGSGCGGGCGSGCGGGCGNMVIEGSKTAFTKSGGCGSGCGGGCXSMXIGSKTAFTXSGGCGSXCGGRCLKAVACRHISLEAINCIIFNTLADLTEIYVWV

SEQ ID NO: 201523 - protein, 164 aa, Triticum aestivum
  unsure (1)..(164): unsure at all Xaa locations
  Clone ID: PAT_TA_95941.pep
AKALELQLSEDVKRRLLIERANAEREKWVQAINTTFEHIGGGLRTILTDQNKLVVAVGGATALAAGIYTTREGARVVWGYVDRILGQPSLIRESSRGKYPWSGVPSRAMSTAIWGKDGKRFGDVILNPLLXKRVNQLAYATANTSSQSPFRNIFYGLLHRKTWK

SEQ ID NO: 201524 - protein, 128 aa, Triticum aestivum
  unsure (1)..(128): unsure at all Xaa locations
  Clone ID: PAT_TA_95942.pep
LPSLATTHSQGGCLAAAATAGAAPAASAATAAAGARCSPTWRPPPARPPWSCPPPPTRGAPAGSRWPAGRPAAATAPPASAAPRAAAPAAAATEXPAHXRPAGRGEHEDEXRSKQSSSPPPPTSVSIH

SEQ ID NO: 201525 - protein, 111 aa, Triticum aestivum
  Clone ID: PAT_TA_95943.pep
QQQVINVSVMAEQSSRISHSDTSPYNASNLEKDSHDGQQLPDQQQKETTEAEKNTENAKKRKKMPRREIPVNNEENEELLANLEDAILQELSDLSVANAKSGYKCWCPHHH

SEQ ID NO: 201526 - protein, 151 aa, Triticum aestivum
  unsure (1)..(151): unsure at all Xaa locations
  Clone ID: PAT_TA_95944.pep
DTADNEGCQGGLMDNAFEYIKXQNSPVVVHIDGHQDVPANSEEALAQAVANQPVSVAVEASGKAFMFYSEGVFTGSCGTELDHGVAVVGYGVAEDGKAYWXTVKESVGASWGEQGYIRVEXDPGAAGRVCXIAMEAXYXXRPTXXPAXPTX

SEQ ID NO: 201527 - protein, 105 aa, Triticum aestivum
  unsure (1)..(105): unsure at all Xaa locations
  Clone ID: PAT_TA_95945.pep
MRSKANGDTAFKASGKNKTATGGVAKPKRAPTPFFAFLAEFRPQYMEKHPEAKASPAVTKAAGEXKWRSIPDEEKAKYGGKKADAPASKAVNKKESTSPRRPRLR

SEQ ID NO: 201528 - protein, 113 aa, Triticum aestivum
  unsure (1)..(113): unsure at all Xaa locations
  Clone ID: PAT_TA_95946.pep
IACYCSLPRXISPVPNLQFDLLHHDKISMMCICMXIFTLNSVFLYILHACRSHIRGQICXKLLSTCMNXNSVSNGKAGFTSDMGGTFPHIYFIKXHKYILCQHLCXXXNGXSI

SEQ ID NO: 201529 - protein, 136 aa, Triticum aestivum
  unsure (1)..(136): unsure at all Xaa locations
  Clone ID: PAT_TA_95947.pep
REREQRLEACPVHSSCSPSAIAGVRTRVLFFLFKGSVQVACSFFHCWXRIDLFSGXIFCCXRRXXXLXFSIFLGGVCSCRGPSXIDSAASMLLFGRQRLLPAVSGFVISCLQVNHGASXSLXGSEPKLQDRSSIGS

SEQ ID NO: 201530 - protein, 134 aa, Triticum aestivum
  unsure (1)..(134): unsure at all Xaa locations
  Clone ID: PAT_TA_95948.pep
MGRVIRAQRKGAGSVFKSHTHHRKGPARFRSLDFGERNXGYLKGVVTDVIHDPGRGXAPLAKVTFRHPFRYKHQEGVFVAAEGMYTGXFVYCGRRATLSVGNSSRPSVPXGRLICNVQHKSGDRCVQGSATHLI

SEQ ID NO: 201531 - protein, 129 aa, Triticum aestivum
  unsure (1)..(129): unsure at all Xaa locations
  Clone ID: PAT_TA_95949.pep
MGQLSKKLLVASMVVAVLAVAAVELCGAIPLEDNDLESEEALWDLYERWQTAHRVPRHHAEKHRXRFGTSKSNVHLIHSHNKARRPPYRFXXNRFGELAXPIPRTXXGPAXRRGRXGPPSNVPGVNPPL

SEQ ID NO: 201532 - protein, 76 aa, Triticum aestivum
  unsure (1)..(76): unsure at all Xaa locations
  Clone ID: PAT_TA_95950.pep
SPSDEGTVLNNDLIXKTDGYLSDXHSFEHNQNADSNGDMSTTXXXLXDLTIHXGKXXKXXXMIXXAXITXGXLXVS

SEQ ID NO: 201533 - protein, 157 aa, Triticum aestivum
  unsure (1)..(157): unsure at all Xaa locations
  Clone ID: PAT_TA_95951.pep
LVDIXXSSAXKPDARXDDQLETWLXLSPLIAASMXXSCLSGTGGGILEIQALSTATXSPAGRAGPPRLLVAAPELLQRPVLLDEGXLPAPLLVRQRRRLPVPAGPLRHXHDQARDPXPQPPVHRGERALRERRRRDGAASSARMRHHAAELGRRRXD

SEQ ID NO: 201534 - protein, 78 aa, Triticum aestivum; identical to SEQ ID NO: 106980
  Clone ID: PAT_TA_95952.pep

SEQ ID NO: 201535 - protein, 141 aa, Triticum aestivum
  unsure (1)..(141): unsure at all Xaa locations
  Clone ID: PAT_TA_95953.pep
MAPKAAEKKPAEKTPAGKKPKAEKKVPASKEGGXXKXGKKKSKKSVETYKIYIFKVLKQVHPDIGISSKAMSIMNSFINDIFENLVGEXAXXARYXXXPTITSREIQTSVRLVLPXELXKXAVSXGNXXXTKFTSALIADG

SEQ ID NO: 201536 - protein, 130 aa, Triticum aestivum
  unsure (1)..(130): unsure at all Xaa locations
  Clone ID: PAT_TA_95954.pep
MARTKQTARKSTGGKAPRKQLATKAARKSAPATGGVKKPHRFRPGTVALREIRKYQXKSTELLIRKLPFQRLVREIAQDFKXTDLRFQSSAVXALXEAARGILVGLFXDTNSGAINAKARHIMPXDINSQ

SEQ ID NO: 201537 - protein, 146 aa, Triticum aestivum
  unsure (1)..(146): unsure at all Xaa locations
  Clone ID: PAT_TA_95955.pep
MARTKQTARKSTGGKAPRKQLATKAARKSAPATGGVKKPHRFRPGTVALREIRKYQKSTELLIRKSPSKRLVREIRAXDFKDRLRFQSSAVSALKKAPRLLVRVSKDTTVRINATRHIMPKESAADRRESLPVRQYCLSVSGFPLL

SEQ ID NO: 201538 - protein, 148 aa, Triticum aestivum
  unsure (1)..(148): unsure at all Xaa locations
  Clone ID: PAT_TA_95956.pep
ACQFALAALEQVDSIVDLDNGSEVEDLPETTAMIKGRLWANVFKYSLDLKNFRDAYCAIISNPDDDSKYVCLRRFIIVFVSLGETKXICNGEIPFTGLVEKVXQELFWKAERSXDLPSKPNLYKXLYPXEAYKDNWRKXLDQVQXFGR

SEQ ID NO: 201539 - protein, 143 aa, Triticum aestivum
  unsure (1)..(143): unsure at all Xaa locations
  Clone ID: PAT_TA_95957.pep
MAGRKGGDRKKAVTRSVKAGLQFPVGRIGRYLKKGRYAQRVGXGAPVYLAAVLEYLAAEVLELAGNAAKDNKKTRIIPRHLLLAVRNDKESGCRRRHIAHAGLSPTSIRAAPQESPPPPRRRQVAKKLNNPPRRNAHKDSHTT

SEQ ID NO: 201540 - protein, 105 aa, Triticum aestivum
  Clone ID: PAT_TA_95958.pep
YFHRYCLIDQGSTATAAPATPWRRHRNPGCYCSPLSPLLISSLTRCLLSLSLSLSQANFNLTPSWGATVRAIHALLGLLFLDIPRSVKLDKQKILHISALSIKLI

SEQ ID NO: 201541 - protein, 142 aa, Triticum aestivum
  unsure (1)..(142): unsure at all Xaa locations
  Clone ID: PAT_TA_95959.pep
MVCLLEGVGFQKAFHSFLVLLIALYVVYIKMQQHTCFKISEDLHPVALVTDNDAXKLXHLNFKRTEYMLSKLELCFVNXVAWAILACNFXILXQCRLQAXPCXXGSNWPQTXYXAGLQKWEGFGPLXPANLXGPXPPXXPXQ

SEQ ID NO: 201542 - protein, 164 aa, Triticum aestivum
  unsure (1)..(164): unsure at all Xaa locations
  Clone ID: PAT_TA_95960.pep
MGTSNARRLMVVSCLAVLALAAGARRPSVHHAAAPSAAAPAPSNGGVEAKVGGFARADGARFTVGGRPFYPNGFNAYWLMYMASNPGDRSKVLATLDQXSHVGATVIXTWAFNDGGSNRALQXNPGVYXKDVFLGLDFLIAEXKXXXXXYLILSLANNWXDFGG

SEQ ID NO: 201543 - protein, 116 aa, Triticum aestivum; identical to SEQ ID NO: 130498
  Clone ID: PAT_TA_95961.pep

SEQ ID NO: 201544 - protein, 54 aa, Triticum aestivum
  Clone ID: PAT_TA_95962.pep
AMHGLTLLIDLLLITALDVLCSIFSIPAIKHYVSLNCNTLLWNYISAWNFYLYS

SEQ ID NO: 201545 - protein, 57 aa, Triticum aestivum
  Clone ID: PAT_TA_95963.pep
SPTPSPCPSAARRLSSTAPRPACRCPSSSPRAAAAACTCSPAPPPPAGGSRPSPAGR

SEQ ID NO: 201546 - protein, 72 aa, Triticum aestivum
  Clone ID: PAT_TA_95964.pep
RKQVPCNIKILIKLRRCPPIVHTSGLGAIVCLVVTCPVAAFVRKIKVTLWFRSVSRFSIKILIVSGHINNST

SEQ ID NO: 201547 - protein, 186 aa, Triticum aestivum
  unsure (1)..(186): unsure at all Xaa locations
  Clone ID: PAT_TA_95965.pep
GRIGEARELFDRMPERNVVSWNVMLGGYLRLSHMDEAYRLFAEMPDKNSISWTTMISALVRAGKLQEAKDMLNKMPFDSFAAKTALMHSYLQSKMINDARHIFDALEVRDAVCWNTMISGYVHXECFDEAKVLFQQMPNKDMXSWDNLIAGYAQRXQMRKAVSIFXKMSQRNAXXWXSVISGFGQX

SEQ ID NO: 201548 - protein, 76 aa, Triticum aestivum
  unsure (1)..(76): unsure at all Xaa locations
  Clone ID: PAT_TA_95966.pep
GEAPIDLCWRTHRLQLTTKNQHGLLXXVQXFLLRPLFSTSXFDVXPSTSSTCIELXSFXYLXIXSXRXXYLXXSSX

SEQ ID NO: 201549 - protein, 154 aa, Triticum aestivum
  Clone ID: PAT_TA_95967.pep
MARTKQTARKFTGGKAPRKQLATKAARKSAPATGGVKKPHRFRPGTVALREIRKYQKSTELLIRKLPFQRLVREVAQDFKTDLRFQSSAVSALQEAAEAYLVGLFEDTNLCAIHAKRVTIMPKDIKLARRIRGERAALHAPRRRALVANCFMTP

SEQ ID NO: 201550 - protein, 164 aa, Triticum aestivum
  unsure (1)..(164): unsure at all Xaa locations
  Clone ID: PAT_TA_95968.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAQLSSGLACXLAGLAAGMAIGIVGDAGVRANAQQPKLFVXMISSSSLLKPLALYGSSRNHLSSRAGNPRRL

SEQ ID NO: 201551 - protein, 76 aa, Triticum aestivum
  Clone ID: PAT_TA_95969.pep
AQPFEESAELYLSIVAANLGRYLLNCDITRCKFHPILMRDGWFIFRWTKKFHWLSGLVFVYKMVMATEVLLVVKIA

SEQ ID NO: 201552 - protein, 155 aa, Triticum aestivum
  unsure (1)..(155): unsure at all Xaa locations
  Clone ID: PAT_TA_95970.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDAXGKVTRLRKECPNADCGAGTFMAXHFXRHYCGKLRLTYVYXXXG

SEQ ID NO: 201553 - protein, 155 aa, Triticum aestivum
  unsure (1)..(155): unsure at all Xaa locations
  Clone ID: PAT_TA_95971.pep
MAPKADKKPAAENKVEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGEXLAKHAVSEGNKAVXKLTLLD

SEQ ID NO: 201554 - protein, 170 aa, Triticum aestivum
  unsure (1)..(170): unsure at all Xaa locations
  Clone ID: PAT_TA_95972.pep
MAATTAAAAAAAAAHLLTSPPVASPRPVPRRHRRTGAARRLSCRASLGPDAPLPALAVPRPSPARGRTYLREHSCLLFPPPRGARPLAVVKFLXXAFIGAAPEATYGYLLELLAQEGFLVVCVPYNVTFDQAXAAREVFEXFTAAKKRSERRACRKAGAKGSGHPGSSPL

SEQ ID NO: 201555 - protein, 132 aa, Triticum aestivum
  unsure (1)..(132): unsure at all Xaa locations
  Clone ID: PAT_TA_95973.pep
TTGRGCQKRYQDGFFAQFEYAAENFLAPPAGRTXSMLXPRGXSYIXEXXXLDFLPPFDSISTXTKGXWEKLYGNPDPERARLFRFRXQEFPSPNTDLEPSRRVLLSXFXSYLAAVVTAARXRGWXEFXCNEX

SEQ ID NO: 201556 - protein, 104 aa, Triticum aestivum
  Clone ID: PAT_TA_95974.pep
MAGCGEKSDAGVGLYAVLGVASDCSDAELRSAYRKLAMKWHPDKCGSGSSGGSEAAKARFQKIQAAYAVLSDPNKRILYDVGAYAYARSSKSSSSSSKISAGKK

SEQ ID NO: 201557 - protein, 170 aa, Triticum aestivum
  unsure (1)..(170): unsure at all Xaa locations
  Clone ID: PAT_TA_95975.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLKLRGGMQXFVKXLTGKTSWRSSL

SEQ ID NO: 201558 - protein, 131 aa, Triticum aestivum
  unsure (1)..(131): unsure at all Xaa locations
  Clone ID: PAT_TA_95976.pep
EPSAAAATSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEXEESDDDMGFSLFD

SEQ ID NO: 201559 - protein, 116 aa, Triticum aestivum
  unsure (1)..(116): unsure at all Xaa locations
  Clone ID: PAT_TA_95977.pep
MXRAQVMLMXVALELMLAAVTRAAVXXXCGHVDXLVXPCLXYVQGXPXPSGQCCGGVXSLHNXXQSNXDRQAACXCLKGIAXGIHXLNEDNARSLAPKCGVNLPYXISXXIDCNSV

SEQ ID NO: 201560 - protein, 62 aa, Triticum aestivum
  unsure (1)..(62): unsure at all Xaa locations
  Clone ID: PAT_TA_95978.pep
LINGXSSGWLXSXXTAXEXERSSFGXCXXVXGRYRTCYRGRKQEDCIGEAKKKKKNSRLVLS

SEQ ID NO: 201561 - protein, 114 aa, Triticum aestivum
  unsure (1)..(114): unsure at all Xaa locations
  Clone ID: PAT_TA_95979.pep
RRGVGGRRGRGVRSRRRRGAQLDPLDVVEVEEGGGALGHRREAQGGPGARXRRRRDDSNARAAARARGRGANGDXGSRRRGKRRRSYRRGVAGEGRRMAATAMAGAVAGIGAAT

SEQ ID NO: 201562 - protein, 66 aa, Triticum aestivum
  unsure (1)..(66): unsure at all Xaa locations
  Clone ID: PAT_TA_95980.pep
PCKSPRKFDLHGRPPSFHLCAPXLRLRRQLHRSLVPHDQLARHAAAGNNHRPRVCSPVTLHQPSSE

SEQ ID NO: 201563 - protein, 97 aa, Triticum aestivum
  Clone ID: PAT_TA_95981.pep
QYGKVPRRRAPPTGGARVLRREGAEPEGSGTSNGTRCRCWWCCRRVQSTRAARPAACRNRYRYQHHYRPAGGASWDPCSPMIISCSCAYKMKLTLWL

SEQ ID NO: 201564 - protein, 88 aa, Triticum aestivum
  unsure (1)..(88): unsure at all Xaa locations
  Clone ID: PAT_TA_95982.pep
GDFXXLKESHVXWTNPPXGKHSXPKGLGKTVPLESEFVKWRDDVVVPCGKPVPSSIRSSELMYNEYIVYNTSQVKMQFLLKVRFHHKR

SEQ ID NO: 201565 - protein, 151 aa, Triticum aestivum
  unsure (1)..(151): unsure at all Xaa locations
  Clone ID: PAT_TA_95983.pep
MARAQVMLMAVALVLMLAAVPRAAVAIDCGHVDSLVRPCLSYVQGGPGPSGQCCDGVKNLHNQARSQXSDRQSACNCLKGIARGXIHNLNEXDNAASIPPKCGVNLPYNIXSLNIDCNKGVMGDDSSKLVLKLINQRGVEARKPLSLCSKG

SEQ ID NO: 201566 - protein, 142 aa, Triticum aestivum
  unsure (1)..(142): unsure at all Xaa locations
  Clone ID: PAT_TA_95984.pep
MARTKQTARKSTGGKAPRKQLATKAARKSAPATGGVKKPHRFRPGTVALREIRKYQKSTELLIRKLPFQRLVREIAQDFKTDLRFQSSAVSALXEXAAXAYLVXGLFEDNQPVAPSNAKAASTSMPKGHPNFARRIRXGSAA

SEQ ID NO: 201567 - protein, 121 aa, Triticum aestivum
  Clone ID: PAT_TA_95985.pep
PPTRCVPKTTLVRTNSHSRRPIHGSTHLHDLTLAPPPLFSAANQARGCRRLPVAGRRRGAVHRPPPFHHFPRPQPPGRGRPLRGSAPGCSPRPGLRNCSRARCAVRRRASFPTSLPYQNKS

SEQ ID NO: 201568 - protein, 104 aa, Triticum aestivum
  Clone ID: PAT_TA_95986.pep
HAGPWFCICIDSVPQPTINGQLHALLSCYWIKFRCPAGIVSGFTAEATVWHAPWCSTARTTSWPTNVLPEISGFDSMLSKSIHAYYLQLLLSANAIWNFFGSAL

SEQ ID NO: 201569 - protein, 116 aa, Triticum aestivum; identical to SEQ ID NO: 134375
  Clone ID: PAT_TA_95987.pep

SEQ ID NO: 201570 - protein, 150 aa, Triticum aestivum
  unsure (1)..(150): unsure at all Xaa locations
  Clone ID: PAT_TA_95988.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQXLARRIRGERAALYPPCVSCLESR

SEQ ID NO: 201571 - protein, 135 aa, Triticum aestivum
  Clone ID: PAT_TA_95989.pep
SRSVEPSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 201572 - protein, 93 aa, Triticum aestivum
  unsure (1)..(93): unsure at all Xaa locations
  Clone ID: PAT_TA_95990.pep
MAAACWLRRAASAAALHRLPSGITLTPTPPPLXLSEAKSLVFPGLGAVIAPAMKLMAVPKKKVSSLFVPVIFRVCPRHLHVRALFLMISWALV

SEQ ID NO: 201573 - protein, 82 aa, Triticum aestivum
  unsure (1)..(82): unsure at all Xaa locations
  Clone ID: PAT_TA_95991.pep
IKSSLPFSLASPLHFPFPRGGRRRDLRAHARTMWRRLQTLAPALXRAAAAAXAAPSXAXAXAAHLSTXXRXASAXXGXSSLR

SEQ ID NO: 201574 - protein, 101 aa, Triticum aestivum
  Clone ID: PAT_TA_95992.pep
SDAIEGITHSICTLEFESHRPLYEWFLDNLPVPCKPRQYEFSRLNLNYTITSKRKLKQLVDEKHVHGWDDPRMSTLSGFRRRGYTPASIRKKKATKTKKKK

SEQ ID NO: 201575 - protein, 181 aa, Triticum aestivum
  Clone ID: PAT_TA_95993.pep
FRSNRSRRRRPPWARRWCPWWTLARCPSRSSWRSRPHRPTPSTPAAGAATPTSSRPLRSIAPSSTRVPAPASRPSPAAAPPPISPTISPLAPLPPPPSPSPPRRIPRTASLCSTSSSSLRATTPPICQHHRRFHSNKLPPIPIPHPTYRCRTPVAPCRFNNSRDQNGIDEEGVAVDLVKSR

SEQ ID NO: 201576 - protein, 135 aa, Triticum aestivum
  unsure (1)..(135): unsure at all Xaa locations
  Clone ID: PAT_TA_95994.pep
MKFLKVGRVVIITRGRYAGKKCVIISPLDNGTKSHPFPHALVAGIETYPSKVTRRMSKTKQAKKSKVKPFVKQVNYTHIMPTRYTIELENLKGVVSADTFKEVSQREEAKKTVKKXFEERYXSGKNRWFFTPLQF

SEQ ID NO: 201577 - protein, 144 aa, Triticum aestivum
  Clone ID: PAT_TA_95995.pep
DPPRRAPASPAISSYRGHHAPPPPRTASVRFVVFLCINWCHPLELLTLQRRIEASSSSGRRRTTTTPATSAAPKPLDGPPCACSTLRPALMPPSTTTSPTTLLPVQQSFQMLEPRIQDATVDDDYYSRGAYYYVQAADDDQGVV

SEQ ID NO: 201578 - protein, 98 aa, Triticum aestivum
  Clone ID: PAT_TA_95996.pep
KNFMQEKRTQRRLLAIIPWHRPLLDACSPKSACGCLSPPPHTWCYAEQGGCRGGGGAHDMAEASQSASLAGIRASPPSLVGDARLSSSSRGFLMSWAG

SEQ ID NO: 201579 - protein, 116 aa, Triticum aestivum; identical to SEQ ID NO: 134375
  Clone ID: PAT_TA_95997.pep

SEQ ID NO: 201580 - protein, 65 aa, Triticum aestivum
  Clone ID: PAT_TA_95998.pep
QTLRQLRNGGIRGRISRKGSGASCGNHRKCYEENGILGKSTVPCQATRFCFQPQNAHLTSCVFSI

SEQ ID NO: 201581 - protein, 161 aa, Triticum aestivum
  unsure (1)..(161): unsure at all Xaa locations
  Clone ID: PAT_TA_95999.pep
HRRSTHTLTHPSSPMARTKQTARKSTGGKAPRKQLATKAARKSAPATGGVKKPHRFRPGTVALREIRXYQKSTELLIRKLPFQRLVREIAQDFKTDLRFQSSAVSALQEAAEAYLVGLFEDTNLCAIHAKRVTIMPKDIQXAXRIRGGRLGFRCRPLTITG

SEQ ID NO: 201582 - protein, 157 aa, Triticum aestivum
  unsure (1)..(157): unsure at all Xaa locations
  Clone ID: PAT_TA_96000.pep
MAPKAEKKPAAKKPAEEEPAAEKAEKAPAAKKPKAEKRLPAGKTASKEGGEKKGKKKSKKSVETYKIYIFKVLKQVHPDIGISSKAMSIMNSFINDIFEKLAGEASKLARYNKEANITSREIQTSVRLVLPGELXKQAVSEGNKGLNKXNSSKLRRL

SEQ ID NO: 201583 - protein, 122 aa, Triticum aestivum
  unsure (1)..(122): unsure at all Xaa locations
  Clone ID: PAT_TA_96001.pep
MSCCGGNCGCGAGCKCGNGCGGCKMFPDVEATAGAAAMVMPTASHKGSSGGFETAGETGGCDCTTCKCGTRAAAPAAAATEPGAQGSRPARGQHEDXEDKQAHHTIYNNQRFITTAHRSARA

SEQ ID NO: 201584 - protein, 47 aa, Triticum aestivum
  unsure (1)..(47): unsure at all Xaa locations
  Clone ID: PAT_TA_96002.pep
AVXWXPFWXXWXRAPPXGXFYFILLFFASCLGNNNLSSLLVRFVFVF

SEQ ID NO: 201585 - protein, 103 aa, Triticum aestivum
  unsure (1)..(103): unsure at all Xaa locations
  Clone ID: PAT_TA_96003.pep
AFHADFELDTEGDVHTADPAGRCXANLAAYHAVAALTWEEVLIHGTKHYSDXLSRFCXANMSEVVSSLGWARARPWXEPLLXAXFLQGHFRVRLLALFVHPAL

SEQ ID NO: 201586 - protein, 85 aa, Triticum aestivum
  unsure (1)..(85): unsure at all Xaa locations
  Clone ID: PAT_TA_96004.pep
KRKAAXXAXSXLXEGRCXXAGDRYGARRXGLXSGDDXEXGDRXDXEDGHXPWTRXWRRPXVRSXGGAICXGGGEXLSRIXVEKXS

SEQ ID NO: 201587 - protein, 95 aa, Triticum aestivum
  unsure (1)..(95): unsure at all Xaa locations
  Clone ID: PAT_TA_96005.pep
SKHIQSEPPFCCXAXVAEWIHRSDXTVQVGRPTLMATLDEMHWVVIAVLGMQNIVSSFFTQQMNTWSLQILYPCSPYLTILDTQCLPLFTGTVAI

SEQ ID NO: 201588 - protein, 135 aa, Triticum aestivum
  unsure (1)..(135): unsure at all Xaa locations
  Clone ID: PAT_TA_96006.pep
AISGMAFMASGRVAIAPTRARFVTPRSLFNWGRGAKDAETPXRNFXYNGLSPLFXISXWXXXTQEDAESXAVQGXPLXVNAXXFNRGCXXKXPWSSSXXRGKXFKFRXXNPXGYRTRTYYNVELLFXXPGXPEXP

SEQ ID NO: 201589 - protein, 134 aa, Triticum aestivum
  unsure (1)..(134): unsure at all Xaa locations
  Clone ID: PAT_TA_96007.pep
MARTKQTARKSTGGKAPRKQLATKAARKSAPATGGVKKPHRFRPGTVALREIRKYQKSTELLIRKLPFQRLXVREIAQDFKTDLRFQESAVSALQEAARGYSSGSSEDTNFCAIHAKRVNIMPKGIQSPADPRG

SEQ ID NO: 201590 - protein, 54 aa, Triticum aestivum
  Clone ID: PAT_TA_96008.pep
RQQRYLFLFFFAHHTLFIQSKVQFDGNRVGEGGVSIATMPAGLLHSARHDGRSM

SEQ ID NO: 201591 - protein, 66 aa, Triticum aestivum
  unsure (1)..(66): unsure at all Xaa locations
  Clone ID: PAT_TA_96009.pep
YFIHDIWXELGGTFAXYVXDXGSXFNXIYIRXTCVXVXYCXXWSIFCCWGXRXXSGXSKCCCSKNX

SEQ ID NO: 201592 - protein, 139 aa, Triticum aestivum
  unsure (1)..(139): unsure at all Xaa locations
  Clone ID: PAT_TA_96010.pep
MARTKQTARKSTGGKAPRKQLATKAARKSAPATGGVKKPHRFRPGTVALREIRKYQXKSTELLIRKSPSSAWVREIAQDFKTDLRFQXSAVSALQXEAAEGLLVRVFXDTNSAHQARXHIMPRINCRDSCKAKPKSLLR

SEQ ID NO: 201593 - protein, 107 aa, Triticum aestivum
  Clone ID: PAT_TA_96011.pep
YILTSIIRNHTAPSTEPCHLGSSSLPSPQPDQSHGTIVQGVPREAQHIPRRDAHQSVFQHKSHQELVLQDRRLGGMMPQSQEVCGRPPHGGGHAPPKALDVDNNFIR

SEQ ID NO: 201594 - protein, 139 aa, Triticum aestivum
  unsure (1)..(139): unsure at all Xaa locations
  Clone ID: PAT_TA_96012.pep
MATLVVHNQTSSAQDAEALQQAFKGWGADDKAIIAILGHRNVHQRQEIRKAYEEIYQEDLIKRLESEISGDFERAMYRWMLQPADRDAVLVNVAIKNGTKDYHVIAEIACVLTAEXLLAVRRAYXRRYKCSXEEDVQLT

SEQ ID NO: 201595 - protein, 133 aa, Triticum aestivum
  unsure (1)..(133): unsure at all Xaa locations
  Clone ID: PAT_TA_96013.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAXAYWWGCSRTQPVRHPSKRVTSCQGHQLARPSAGAA

SEQ ID NO: 201596 - protein, 122 aa, Triticum aestivum
  unsure (1)..(122): unsure at all Xaa locations
  Clone ID: PAT_TA_96014.pep
PPXEIFYXGXFSDXNSTQLFDXQSHNATKSRPIIPLKKYHKANLDPNQVESTSLFHSFLRVQASDFGGDSRERRKRRRRLAAQGNQRIRQAERARRRDPQITDRTVPWRPGRDQGRAGGPGS

SEQ ID NO: 201597 - protein, 121 aa, Triticum aestivum
  unsure (1)..(121): unsure at all Xaa locations
  Clone ID: PAT_TA_96015.pep
MSCCGGNCGCGAGCKCGNGCGGCKMFPDVEATAGAAAMVMPTASHKGSPAXRDGRGDRRCDCTTCKLRTAXGXPAATQRTRAQEPAATRGLGGQATSQHHNQRHNNRDRARLINNTSQKKK

SEQ ID NO: 201598 - protein, 131 aa, Triticum aestivum
  unsure (1)..(131): unsure at all Xaa locations
  Clone ID: PAT_TA_96016.pep
MARTKQTARKSTGGKAPRKQLATKAARKSAPATGGVKKPHRFRPGTVASGRFRKYQKRTEXLIRKSPSKRSXRKFAQDXKTDFXXXSXVSAFKEAPEAILWGLSXTQLCASXPRRHIIPRNQXXRXXKGTL

SEQ ID NO: 201599 - protein, 114 aa, Triticum aestivum
  unsure (1)..(114): unsure at all Xaa locations
  Clone ID: PAT_TA_96017.pep
MADRANHPSVMQKFGGQFHLASSFSEGVRARNICPSVPSYERRFTTSCYMTQXTLASSVPMMSSSPLFANAPPEKXSVKNFAIDFLMGRVSAAVSRXATPXERVKLLXQNQDEM

SEQ ID NO: 201600 - protein, 173 aa, Triticum aestivum
  unsure (1)..(173): unsure at all Xaa locations
  Clone ID: PAT_TA_96018.pep
VGSLNHYAKRRLPGLNRRKSISDVSNCLSVSTLTAMPSEEEQRYLLEEIDRLLPFQRGVTSCKLLFGXLLRTAIFLKASXSCMSNLERXRIGCSLDKALLEDXLITNMSEPNGNAPKMWMPYIRILGHFLGKXSKNGXXSPGXGEDGTMVLNSNADTRCNLSTLLIHKSTKKF

SEQ ID NO: 201601 - protein, 159 aa, Triticum aestivum
  unsure (1)..(159): unsure at all Xaa locations
  Clone ID: PAT_TA_96019.pep
XSNILXXXYDXNFXKXXFPRXPITMXXVTGEDSLDKXLNLFQXVEXXTLQXLPXXVXLSSXIRNKITLAPRRRFLGQNCEARSLCSXTCASSFAYACRFLILPGHLVDLQWKRRPTGARRASAGARSPAAVTRGAVRLRRRTGAEPAAGGGGGDAVSVT

SEQ ID NO: 201602 - protein, 152 aa, Triticum aestivum
  unsure (1)..(152): unsure at all Xaa locations
  Clone ID: PAT_TA_96020.pep
LXVXLXXQRGERXREEDXGXRNRFAKXXXPYPLVLXRSALDRRKKXCXCWXAXFSLFPPSVRSGTSVAGLPTCRTPPSAASHLDVRHLPASPASSLSLELFRSRYLSMRKEEILLSASLTAAEATISAIRTFDRSPIYMSDSSALLAKKGKF

SEQ ID NO: 201603 - protein, 154 aa, Triticum aestivum
  unsure (1)..(154): unsure at all Xaa locations
  Clone ID: PAT_TA_96021.pep
RVENVVAELTLVLGINEGVIPVIKDAAALAMSDLSTSIVTXEFTSLAGIMARHYALRDGLPEXEALFEITLPKXSLGDVFPKTDAGIVLAVADRLDSLVGLFGAGCQPSSSNDSFGLRRSLRIGQILXENKKNLTSXRLDLGXKVQPIRIDNDL

SEQ ID NO: 201604 - protein, 123 aa, Triticum aestivum
  unsure (1)..(123): unsure at all Xaa locations
  Clone ID: PAT_TA_96022.pep
TVKSVSSAQIEAEEXXDXYXRIFYNYXTXIHGFAARLDXDEAERXAXAAGVLXVLPETVLXLHXTRSPDFLRIGXEVXNXIXASXLXDXDVILSVLXTXIXPDSPNFXXXGLXXVPSXWKSSH

SEQ ID NO: 201605 - protein, 95 aa, Triticum aestivum
  Clone ID: PAT_TA_96023.pep
FFFFFFFFFGGKSNCKFDTETCTHPLLPLALLLLAFIRVKRILPVSQNVRPFLALRWSRKHKSRGRVYGNYKSAPAFHRSVALLRSASWFTELIY

SEQ ID NO: 201606 - protein, 150 aa, Triticum aestivum
  unsure (1)..(150): unsure at all Xaa locations
  Clone ID: PAT_TA_96024.pep
DEDYEFLSEIELLSRLNHCHVVPLLGYCSERQGRQLERLLVFECMTNGNLRECLDDLNRKPMDWATRVGVALGAARGSEYXHEAAXPRILHRDINQPNPAXRQFKARIXGLGMAXPHERRRNCQFAGNLLRVPPDQSSRVPSDSTSACLS

SEQ ID NO: 201607 - protein, 133 aa, Triticum aestivum
  unsure (1)..(133): unsure at all Xaa locations
  Clone ID: PAT_TA_96025.pep
MAGRGKAIGAGAAKKATXRSSKAGLQFPXGRXARFLKAGXYAQRVWSXXPXXLAAVLXYSPLKSLEXCRXAPXDNKKXRIVPAXQXAFRKKSYNFSGPHRQRVLSKSTLSPSLLQGHLYTHAFLNAALGKLIK

SEQ ID NO: 201608 - protein, 115 aa, Triticum aestivum
  unsure (1)..(115): unsure at all Xaa locations
  Clone ID: PAT_TA_96026.pep
MARVALVAVFAVLAALAVAEMASGAVTCGDVTSAVAPCMSXARGQASAPSGACCSGVRTLNAKASTPADRKAACNWLKNLAGSGISMGNAANIPGKCGVSVSFPINTKTNCNNLH

SEQ ID NO: 201609 - protein, 145 aa, Triticum aestivum
  unsure (1)..(145): unsure at all Xaa locations
  Clone ID: PAT_TA_96027.pep
MAPSGKPSPSAAAAAAASSTADRKPWRRPQMKSKAAGKKKAAAAHNKKPKSGGFESMGLCEEVYRGVRXXGYRVPTPIQRKAMPLILAGLDVXAMARXGSGKTAAFLVPMLQRLRHXXPXXGIRAXILXPXRDLTRILXFTNSPI

SEQ ID NO: 201610 - protein, 128 aa, Triticum aestivum
  unsure (1)..(128): unsure at all Xaa locations
  Clone ID: PAT_TA_96028.pep
PIPHRRPRISSSFQLAGEAASKMAGRKGGDRKKAVTRSVKAGLQFPVGRIGRYLKKGRYAQRFGXGAPVYSPPSSITPPLKFWSFAGXAGQGQQETRIIPXQLLFAXRNDKSXEVVPXVYISXXGXFP

SEQ ID NO: 201611 - protein, 130 aa, Triticum aestivum
  unsure (1)..(130): unsure at all Xaa locations
  Clone ID: PAT_TA_96029.pep
MATQISKKKKFVSDGVFYAELNEMLTRELAEDGYSGVEVRVTPMRTEIIIRATPDARTCLGEKGRRXKGVTPFVQXVQFPENAFDFYPRSLNRGXCAIAQAXXIPLQXLRGLALRKDVGVLPFVMEMXLR

SEQ ID NO: 201612 - protein, 142 aa, Triticum aestivum
  unsure (1)..(142): unsure at all Xaa locations
  Clone ID: PAT_TA_96030.pep
MQIFVKTLTGKTITLEVESSDTIDNVKAKIQDKEGIPPDXQRLIFAGQAVEDGRTLXADYNIQEGSTLHLVLXVRLWHAIFXKTLTGKDITLEVXSSGHNRQLKAXIQGQGGFPRTTXSXLLGTLQDGRTLTNPGSTSTGLK

SEQ ID NO: 201613 - protein, 116 aa, Triticum aestivum
  unsure (1)..(116): unsure at all Xaa locations
  Clone ID: PAT_TA_96031.pep
FPFLLSPTPSPSYSTDAAFFLSSSPLPHPAAAAFLRRARLVQLLTAXGGKEKRPPLVRPPFGWVQAHAGAGLRDGVRPPATGGQHAXVACHPPXGGVQRHRHHHQXGSPRSGFNSP

SEQ ID NO: 201614 - protein, 95 aa, Triticum aestivum
  unsure (1)..(95): unsure at all Xaa locations
  Clone ID: PAT_TA_96032.pep
MAAPRGAAVVLAMVLAAMVVAPPATVHAAISCSTVYSTLMPXCLQYVQQGRFRRPGACCTGIQNLAGRRQQQPDRRTICGCLXKNFANGASGGPK

SEQ ID NO: 201615 - protein, 170 aa, Triticum aestivum
  unsure (1)..(170): unsure at all Xaa locations
  Clone ID: PAT_TA_96033.pep
SPLLLHLRPPPWPGRRGGAPPRHPSPAPPHPSAPPTPPPSPCASIHHHPQRRLITSRRRPSISLLLLNLSSSPNLLPASPLPFFFPEPAAATSSSFFSFTSLLLYHAAALPSHLCCCPSLRSLLLLFLPPLLVVLLYPXAALFSQASLASQLLNSLELSXVXTLXILXRS

SEQ ID NO: 201616 - protein, 134 aa, Triticum aestivum
  unsure (1)..(134): unsure at all Xaa locations
  Clone ID: PAT_TA_96034.pep
MATTAMALSPSSFAGKAVKDLPSSALFGXARVTMRKTAAKXKPVSSGXPWYXSDRXLYLGPLSGDPPSYLTGEFPGDYGWDTAGLSADPETXXKNRXLEVXHCPWAXLGALXCVFPELLXRKGVXFXEACQGGP

SEQ ID NO: 201617 - protein, 99 aa, Triticum aestivum
  unsure (1)..(99): unsure at all Xaa locations
  Clone ID: PAT_TA_96035.pep
ASPPPPPPAPKSAPIFRNREVKISAGNEIPRLFVSYAPGTDSGPGSFRWGDSIPEPEGMSRALRPINQGIFLKDLHIMDGKEREQXRMPDNSXKERKXD

SEQ ID NO: 201618 - protein, 110 aa, Triticum aestivum
  unsure (1)..(110): unsure at all Xaa locations
  Clone ID: PAT_TA_96036.pep
MKGTKLAAILILQAVLVMGLLSHVNADFFPKCCNNCRSFSGVXDVCDDAHPKCPQXGCSACRVVSDDPEMWRCADMKPPFDGPAVGPCKXTDVNAGIYPPKINKKGNYNP

SEQ ID NO: 201619 - protein, 151 aa, Triticum aestivum
  unsure (1)..(151): unsure at all Xaa locations
  Clone ID: PAT_TA_96037.pep
RAHSPAPAGRRQAAQAQQPNGHHQRRRGDHRRRPCRHRQAAGPRSAPAEDEEREGEVQLLQGRQGGDPCRRRPRGWRSLLAAGGAVTAFRGAGAGAGSTSGCSTGGHRAXPGGXATTAGLGFSWASSGSSGRSTPSTLPAPTKTKIPGLSL

SEQ ID NO: 201620 - protein, 96 aa, Triticum aestivum
  unsure (1)..(96): unsure at all Xaa locations
  Clone ID: PAT_TA_96038.pep
APTTPPPAPPTQPPPAPTTPPPSPPXTPPPAPATPPPSPPMSPPXATPPPMXTPXAXXPXPPXPSXRLXXSPXRPXCXPTSPMTISFSTSSLTLVA

SEQ ID NO: 201621 - protein, 130 aa, Triticum aestivum
  unsure (1)..(130): unsure at all Xaa locations
  Clone ID: PAT_TA_96039.pep
MARVALVAVFAVLAALAVAEMASGAVTCGDVTSAVAPCMSYARGQASAPSGASAXGXGPLXXKGSNXGDRXXGXNCLXNCAGSGSNXLPPKSPGKCGXXFFPXKHQNXXKNFTPIITQGFPPCPFLFSFT

SEQ ID NO: 201622 - protein, 113 aa, Triticum aestivum
  Clone ID: PAT_TA_96040.pep
MKGAGVIVLEPHGGFMCGVPEDATPYPHRRGVLYVIQYIAYWMSADGGPAATSWLDGFYGFMAHHVTKHPREAYVNFPGPWTSGQERAGGRLRRRPRTLGASATFLNNYNSPR

SEQ ID NO: 201623 - protein, 131 aa, Triticum aestivum
  unsure (1)..(131): unsure at all Xaa locations
  Clone ID: PAT_TA_96041.pep
PKNXWEKXXPXXLGGFLKIFEEIXLPXKIGFXGGPKFFPKGFXPXFXGXGIXSNPSLGCFXTWCXIEXLEPVQPXCSPXARGXXXSSTXCXGSRTAPXAXAGTGWRLXEPXXLNPRXGXRRIPRGPLXXNQ

SEQ ID NO: 201624 - protein, 105 aa, Triticum aestivum
  unsure (1)..(105): unsure at all Xaa locations
  Clone ID: PAT_TA_96042.pep
XGPXXCXDXVRVTWHGVSXARXVELXRRVXHVXXEDGQHFHRSXLXLSCSXWNCXCYGGDRGRGERERRMEWRLRMEMGACFIAGARWFRMARAGNIGWIGSQCW

SEQ ID NO: 201625 - protein, 49 aa, Triticum aestivum; identical to SEQ ID NO: 147490
  Clone ID: PAT_TA_96043.pep

SEQ ID NO: 201626 - protein, 103 aa, Triticum aestivum
  unsure (1)..(103): unsure at all Xaa locations
  Clone ID: PAT_TA_96044.pep
MADQLTDDQIAEFKEAFSLFDKDGDGCITTKELGTVMRSLGHNPTEAELQDMINEVDADGNGTIDFPEFLNLMARKMKDTDSEEELKEXFRVFDKDKKXYLCC

SEQ ID NO: 201627 - protein, 69 aa, Triticum aestivum
  unsure (1)..(69): unsure at all Xaa locations
  Clone ID: PAT_TA_96045.pep
APCASSPPPPPPRSNPKPSTETNGVPPXXPPPQNRSPSPPPXSSSPRSRRSPPPSRHPHRRRHSRHHRG

SEQ ID NO: 201628 - protein, 87 aa, Triticum aestivum
  unsure (1)..(87): unsure at all Xaa locations
  Clone ID: PAT_TA_96046.pep
KKFETLSYLPPLXTEASXKXVDDLIRXSKWVPCLXFXXVGXSXSXXXXASPGYYNXRYWXMWXLXMFXXTDATQXXNXVEEXXKEVP

SEQ ID NO: 201629 - protein, 119 aa, Triticum aestivum
  unsure (1)..(119): unsure at all Xaa locations
  Clone ID: PAT_TA_96047.pep
YRVNFMATPESQDENTLFFAEFWVSYPQPPKPNFCCPLQQPYSGRCYFGEASARKIVYPCSTEYFMSDITAYGTKDAEDILDTNFVYFDSRRDLKFATDVNSYYAPGFPVLSXADCLGH

SEQ ID NO: 201630 - protein, 116 aa, Triticum aestivum
  Clone ID: PAT_TA_96048.pep
KRTPPQAGVKTCLQIFSIRVVEINGAYLEWPLEVYGLVATRDSMDHNRNIIFRLRRDACQLLTQQDPFLALTGPAHAIIFTGPVDIEIQLKVKGRTTEHEDKDFISKVLVYERDPK

SEQ ID NO: 201631 - protein, 119 aa, Triticum aestivum
  unsure (1)..(119): unsure at all Xaa locations
  Clone ID: PAT_TA_96049.pep
KKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVXCVSFIAFKPXGCEESGKG

SEQ ID NO: 201632 - protein, 139 aa, Triticum aestivum
  unsure (1)..(139): unsure at all Xaa locations
  Clone ID: PAT_TA_96050.pep
GKTITLEVESSDTIDNVKAKIQDKEGIPPDQQRLIFAGKQLEDGRTLADYNIQKESTLHLVLRLRGGMQIFVKTLTGKTITLEVESSDXIDNXXXKXQDKXGIPXDQQRLNLXGKXLEDGRNLADYNIQXESNLXLVLK

SEQ ID NO: 201633 - protein, 153 aa, Triticum aestivum
  unsure (1)..(153): unsure at all Xaa locations
  Clone ID: PAT_TA_96051.pep
KTLQKKKPKPSKGKHDAQGEEAFVIVEASKFKRVGSKTTLRQDLANALDIXAFXRTTKLGHCDAELLRKEMNETDVPVSYSXTXIPKXSXRXAXPEXXPPKXLXFLKPNXFQGGVKXMXQKKSPPSVPLDWKVLAIMQVRGQTCLLSLGKEGL

SEQ ID NO: 201634 - protein, 107 aa, Triticum aestivum
  Clone ID: PAT_TA_96052.pep
PPFVSSLMEGKAILLCLMVLVHLGNSIHIDKSKDLVHPQRKTCKDLAAAYGRECVLSKCQLACRDLFGAEFKVSWCSNAVPYYWHCMCRVCFRIALNHHVEKWTNDV

SEQ ID NO: 201635 - protein, 185 aa, Triticum aestivum
  unsure (1)..(185): unsure at all Xaa locations
  Clone ID: PAT_TA_96053.pep
VFRGPVESDTFDTLISQALFGDGAGAAIVAADPDARERPLFNMVAASQAVIPDTEHVPRMHLGSGGIDWNISNGLPRLAAGIIERCLLDALGDQLTTVRRXGVVDWNDLFWAVHPGSGGMLGAHPQALRLAPENWAVAELWXREYGTCWAQXVIFVLXEXRARIRKCWTGLANEDGGDDGSDKVT

SEQ ID NO: 201636 - protein, 166 aa, Triticum aestivum
  unsure (1)..(166): unsure at all Xaa locations
  Clone ID: PAT_TA_96054.pep
MLVYQDKLSGDELLSDSFPYRELENGVLWEVDGHWVVQGAVDVDIGANPSAEGGGDDEGVDDQAVKVVDIVDTFRLQEQPAFDKKXFISHMKRYIKNLSAKLEGDDLNVFKKNVESATKYLLNKLKDFIXCWRDMHDDGGCVRLLQGGAADQFLYLQWAERGKCPR

SEQ ID NO: 201637 - protein, 139 aa, Triticum aestivum
  unsure (1)..(139): unsure at all Xaa locations
  Clone ID: PAT_TA_96055.pep
AEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAXGKEVEEEDEEESDKSKSEINDDDDDEVXMKDEDDDX

SEQ ID NO: 201638 - protein, 136 aa, Triticum aestivum; identical to SEQ ID NO: 201433
  unsure (1)..(136): unsure at all Xaa locations
  Clone ID: PAT_TA_96056.pep

SEQ ID NO: 201639 - protein, 81 aa, Triticum aestivum
  unsure (1)..(81): unsure at all Xaa locations
  Clone ID: PAT_TA_96057.pep
CQXXRLMYRCHDRXFDCPTDRVLTAVRSPSIEEELXAMVVSXVXVMCXCXSLLXFCXGXXXRRXXVWXSGXNDPDXNTNXT

SEQ ID NO: 201640 - protein, 109 aa, Triticum aestivum
  unsure (1)..(109): unsure at all Xaa locations
  Clone ID: PAT_TA_96058.pep
EALHHKLLHDSRTLGISVPMMSSSPLFANAPPXERKVSKNFAIDFLMGGVSAAFPKTAAXPIERVKLLIQXNQDEMIKGWQLSEPYKGIGDCFGRTSRMKFGSLWRRTR

SEQ ID NO: 201641 - protein, 135 aa, Triticum aestivum
  Clone ID: PAT_TA_96059.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAHSPPARLRLAGLAAGMASDRRRPGSQRTEPSCSSDDLSSSC

SEQ ID NO: 201642 - protein, 184 aa, Triticum aestivum
  unsure (1)..(184): unsure at all Xaa locations
  Clone ID: PAT_TA_96060.pep
PLVPHSVACSSPLYPSFVAHDDGRESVAGRRPRSWGSGSWASPSRSRRGVRAWAHRRGVDGGRGRRLPRASNDGLGSTGGRRQFMGIPILKPEEPFVRGHIVTGSTVGGVAGFPRVNRRXLDSTEGRAXSWIMAGLPKGEGTAGFEGLGRRILPASKGIWVLXLMMXYGYRXPRLWKXRKLCQN

SEQ ID NO: 201643 - protein, 157 aa, Triticum aestivum
  unsure (1)..(157): unsure at all Xaa locations
  Clone ID: PAT_TA_96061.pep
MAVGKNKRISKGRKGSKKKAVDPFTKKQWYDIKAPLLFTSRNVGKTLVSRTQGTKIASEGLKHRVFEVSLADLXNDEDQAYRKIRLRAEDVQGMNVLTNFWGMDFTTDKLXSLVRKWQTLIEAHVDVKTXDNYMLRMFXIGFTXRXQTEATAIQTIS

SEQ ID NO: 201644 - protein, 149 aa, Triticum aestivum
  unsure (1)..(149): unsure at all Xaa locations
  Clone ID: PAT_TA_96062.pep
SVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPXRPAGXGEHEDEEDKQASTITTSSPPTSVSSXAAACARGRAR

SEQ ID NO: 201645 - protein, 96 aa, Triticum aestivum
  Clone ID: PAT_TA_96063.pep
MKGTKLAAILILQAVLVMGLLSHVNADFFPKCCNNCRSFSGVDVCDDAHPKCPQGCSACRVVSTSPEMWRCADMKSTVDGTCGGPCKEVLIGSCRA

SEQ ID NO: 201646 - protein, 103 aa, Triticum aestivum; identical to SEQ ID NO: 107316
  Clone ID: PAT_TA_96064.pep

SEQ ID NO: 201647 - protein, 147 aa, Triticum aestivum
  unsure (1)..(147): unsure at all Xaa locations
  Clone ID: PAT_TA_96065.pep
SLLTVAASSQSSPSSPRHHPPRKGGCLAAAATADAAPAASAATAAAGARCSPTLRPPPAPPPWSCPPPPTRGAPAGSRRPAGRPAAATAPPASAARPAAAPAAAATEPAPRRPXGXXEHXDEEDNWTSNXXXPPTXSLAACARPRAR

SEQ ID NO: 201648 - protein, 87 aa, Triticum aestivum
  Clone ID: PAT_TA_96066.pep
FFFFLLSYLKWWFAGVVGCEAQAARYPSTVRPASRRACHIMAREAQLSHKPRRTTTQLGTGGPTTAQLDQAHSTTTPSNTTSKPPLG

SEQ ID NO: 201649 - protein, 152 aa, Triticum aestivum
  unsure (1)..(152): unsure at all Xaa locations
  Clone ID: PAT_TA_96067.pep
MAGRKGGDRKKAVTRSVKAGLQFPVGRIGRYLKKGRYAQRVGXGAPVYLAAVLEYLAAEVLELAGNAAKDNKKTRIIPRXHLLLAVRNDQGVXQVLAGVTIAHXGVIPNINPCCPQRXPXPPPKKEAIRQEETPQPKKKPPHKYPYLPCSYY

SEQ ID NO: 201650 - protein, 144 aa, Triticum aestivum
  unsure (1)..(144): unsure at all Xaa locations
  Clone ID: PAT_TA_96068.pep
MANPRVFFDMTVGGAPAGRIVMELYKDAVPRTVENFRALCTGEKGVGKSGKPLHYKGSAFHRVIPDFMCQGGDFTRGNGTGGXSIYGEXFADENSVHKHTXPGILSMATPGQHNGPFFNLHXPCNWTEHLPVSGLSRHQKWSTD

SEQ ID NO: 201651 - protein, 143 aa, Triticum aestivum
  unsure (1)..(143): unsure at all Xaa locations
  Clone ID: PAT_TA_96069.pep
MANPRVFFDMTVGGAPAGRIVMELYKDAVPRTVENFRALCTGEKGVGKSGKPLHYKGSAFHRVIPDFMCQGGDFTRGNGTGRRSIYGEXFADEXFVHKHTNPGSLHGQRGPNXNVPFSSRPLHWSTWSSSLQGWLSRHQKGQR

SEQ ID NO: 201652 - protein, 114 aa, Triticum aestivum
  unsure (1)..(114): unsure at all Xaa locations
  Clone ID: PAT_TA_96070.pep
XXSILAIWACQVVLMGAVEGYRVXXGPLGXIVDPLYPGGSFDPLGLAEDPEAFXELKVKXIKNGRLAMFSMFGFFXQAIVTGTGPLEXLADHLXDSVNNXXXAFAXNFXPCCSQ

SEQ ID NO: 201653 - protein, 177 aa, Triticum aestivum
  unsure (1)..(177): unsure at all Xaa locations
  Clone ID: PAT_TA_96071.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFXREHNASPGYYDGXRYWDNVELPMFGCTDATXVINXVEESRRIPDPYVRIXXSTTCSRECVNLTLQATGARSGKAKSHH

SEQ ID NO: 201654 - protein, 107 aa, Triticum aestivum
  unsure (1)..(107): unsure at all Xaa locations
  Clone ID: PAT_TA_96072.pep
MRCTRPPVPSDKALRVILCLQFLEVSAFYGVYLNLIVYLQDVLHGDSASNVTAVNSWXGSSYLMPLLGAAVXDSYWXKCKXVLIGLCILSEWHGTCQYLPSAAPGST

SEQ ID NO: 201655 - protein, 61 aa, Triticum aestivum
  Clone ID: PAT_TA_96073.pep
FFFLRLLFFMPTNGFIKLFRRTTISGLFFSNQRQKLPANNNHVYIQPENFASFQKQHAVVT

SEQ ID NO: 201656 - protein, 120 aa, Triticum aestivum
  unsure (1)..(120): unsure at all Xaa locations
  Clone ID: PAT_TA_96074.pep
MXXPXGXELVLAMVLAEMLVAPPATVXAISCSTVYSTLMPCLQYVQQGGSPARGCCTGIXNLLXEANNSPDRRTICGCLKNVXNGASGGXYITXAAALPSKCNVALPXKISPXVDCNSIH

SEQ ID NO: 201657 - protein, 100 aa, Triticum aestivum
  Clone ID: PAT_TA_96075.pep
AQPGLLLSAIRRKGSRLESPSCQFCTKHPMSSPSSLEEEASSSPEVQEHPSSTPMSPAAATPEVLKMSDEHPSSHPMLHVAATPEVYIPLKANQFIEAPI

SEQ ID NO: 201658 - protein, 111 aa, Triticum aestivum
  Clone ID: PAT_TA_96076.pep
SRCHACFLLSSNPIKFDCSGVNTLLSTVEKGSSHEKSLPSLKLHALPPSGPALLRSSTWQHLMTSEASFSSENATATENGVKLGLAIIITAVSSTFGKIDLRKATSPCSPR

SEQ ID NO: 201659 - protein, 87 aa, Triticum aestivum
  unsure (1)..(87): unsure at all Xaa locations
  Clone ID: PAT_TA_96077.pep
MAXKWVRPEVYPLFAXTGVAIXICAFXLLRNITGNPXVRVNKMGXAXGVLENHEEGXGYAEHXLXAYVXDKTPEXMPGINKFFTSPK

SEQ ID NO: 201660 - protein, 47 aa, Triticum aestivum
  Clone ID: PAT_TA_96078.pep
TCCIGLENKLHDLRRVVEDWRRYVSRPEWERRAGKIGWRFEGGKCIH

SEQ ID NO: 201661 - protein, 103 aa, Triticum aestivum
  unsure (1)..(103): unsure at all Xaa locations
  Clone ID: PAT_TA_96079.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTXYGFGG

SEQ ID NO: 201662 - protein, 169 aa, Triticum aestivum
  Clone ID: PAT_TA_96080.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYLDAYVPHHPIRQMRQVHCSTHLTGCIRQG

SEQ ID NO: 201663 - protein, 116 aa, Triticum aestivum
  unsure (1)..(116): unsure at all Xaa locations
  Clone ID: PAT_TA_96081.pep
SLKTAGRPLSSVGPVTPRLVNATVKPTSAPVPLATVMPVDAGAHTVLHLKWELSSDCCLIAPRSDNMQNLVFPSCLATCQIPYLGNQTRMSRIGSSXGRCLITCCCDYTLKIKXGL

SEQ ID NO: 201664 - protein, 105 aa, Triticum aestivum
  unsure (1)..(105): unsure at all Xaa locations
  Clone ID: PAT_TA_96082.pep
MSEPVSPSSSSSSSGDREQQQRHGAAERXSETAXLRALVERXRGXEVEAXREVRRLTRASXRHRRKLAGAVEXXXVMLRXXGGAGXXXLLXLHXLXVXDDRXNIT

SEQ ID NO: 201665 - protein, 73 aa, Triticum aestivum
  unsure (1)..(73): unsure at all Xaa locations
  Clone ID: PAT_TA_96083.pep
MSKAXXTLEEVSKHXTNDDCWLIIAGXVYXVTXFLXDHPAGDXVXLSXIAXDXTXDFXXVGXSTXXRAMLAXY

SEQ ID NO: 201666 - protein, 119 aa, Triticum aestivum
  unsure (1)..(119): unsure at all Xaa locations
  Clone ID: PAT_TA_96084.pep
MARTKQTARKSTGGKAPRKQLATKAARKSAPATGGVKKPHRFRPGTVALREIRKYQXKSTELLIRKXPFQRLVREIAXDXKTDLRFKSXAVXALQEAAEATRGVVEDTTLGIPSAHIQM

SEQ ID NO: 201667 - protein, 125 aa, Triticum aestivum
  unsure (1)..(125): unsure at all Xaa locations
  Clone ID: PAT_TA_96085.pep
MSSSEVACTLAALILHDDGIPITSEKIATVVKAAGIKVEAYWPALFAKLLXEKRSVDDLILSVGSGXEVGAPAAAAAAPAAGXGAAAAERRRRKKRKKRPKEESDDDMGSACSTNCSIQFSCGVS

SEQ ID NO: 201668 - protein, 123 aa, Triticum aestivum
  unsure (1)..(123): unsure at all Xaa locations
  Clone ID: PAT_TA_96086.pep
AASISSPAMSGRGKGGKGLGKGGAKRHRKVLRDNIQGITKPAIRRLARRGGVKRISGLIYEETRGVLKIFLENVIRDAVTYTEHARRKTVTXAMDFVYALKRQGAPLRFRLTRLVPGYLLFLV

SEQ ID NO: 201669 - protein, 95 aa, Triticum aestivum
  unsure (1)..(95): unsure at all Xaa locations
  Clone ID: PAT_TA_96087.pep
MDKFVRQEKKRKRAETASPPEGEKGAGGWPHIGPGPNVMEAAGGTLGLGWVKKQGARSTCSDTGGFGALVLLYNCFRCKRTRRCXWPRQRTWRXL

SEQ ID NO: 201670 - protein, 97 aa, Triticum aestivum
  Clone ID: PAT_TA_96088.pep
YAQENIFLFNSPEHTCTAAPKTYIEGSINSWPRQQEQTTVLHQSSSASLVVVVAAVVVVPTAAVHVLLHALRHAVLDLVLHVARPARQRQPAQHARP

SEQ ID NO: 201671 - protein, 157 aa, Triticum aestivum
  unsure (1)..(157): unsure at all Xaa locations
  Clone ID: PAT_TA_96089.pep
MAPTVMASSATSVAPFQGLKSTAGLPVSRRSNGASLGSVSNGGRIRCMQVWPIEGIKKFETXSYLPPLNXGGXLSKQVDYLIAPSWVPCLXFNKVGFIFREHNASPGXYYDGRYXTMLKLPKFGAPTPKNDXQGGGVKKGYPDPMSDNFTWPSSSSP

SEQ ID NO: 201672 - protein, 81 aa, Triticum aestivum
  Clone ID: PAT_TA_96090.pep
NSCVPKQSVLNILFILNAVICKKHVQSTAGPVGRKRPTSHQALAGAAFFSTALLRWWPRSHGEGKQASAQERERGGEGGRG

SEQ ID NO: 201673 - protein, 141 aa, Triticum aestivum
  unsure (1)..(141): unsure at all Xaa locations
  Clone ID: PAT_TA_96091.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAXAYLVGLFEDTTLRIKPSASHHAKDINSPADPWQKAKTLQLGGG

SEQ ID NO: 201674 - protein, 158 aa, Triticum aestivum
  unsure (1)..(158): unsure at all Xaa locations
  Clone ID: PAT_TA_96092.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLXKECPXAECGAGTSWQHFDXHYCGSAAHYVYNRSLKWLLC

SEQ ID NO: 201675 - protein, 76 aa, Triticum aestivum
  Clone ID: PAT_TA_96093.pep
PQPLRHDHDAPAVGASTAAATSGHADVQQLQLRQQLHDGAAAADVQRREPQRMRHLLVLAISDHHMGPWHGYELSM

SEQ ID NO: 201676 - protein, 173 aa, Triticum aestivum
  unsure (1)..(173): unsure at all Xaa locations
  Clone ID: PAT_TA_96094.pep
AADHTPSTKSPPQYVLLAAMGGASVAVSLVSGKGGSLVFSPPSVSGVAAALPVAGHGSTARRRPWLLKKVWRHGQPCLRPETCQVLLQRTASMDELDARYRGHVLLPTXVXPSAFGGMXILRVXPQKSXIKVACEWTXHXTETXIWNADGHVAKDKKLDXPVWVXQEXXEDSX

SEQ ID NO: 201677 - protein, 146 aa, Triticum aestivum
  unsure (1)..(146): unsure at all Xaa locations
  Clone ID: PAT_TA_96095.pep
MAPKAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKXXIXXREXKTSVRLVLPGELAKHAVSEGTXAVTKLHPLRYLLLCFL

SEQ ID NO: 201678 - protein, 60 aa, Triticum aestivum
  Clone ID: PAT_TA_96096.pep
PRASPRCSVITGSGSWCISSPLNRDQRMTPLVSLVRSLCSCPFYWSWMTSCPGSWWNPGL

SEQ ID NO: 201679 - protein, 83 aa, Triticum aestivum
  Clone ID: PAT_TA_96097.pep
FGDFWSCLSILFNSTKLQKYLKNRKQKEMGKAYLAPSTGPTCRPSPAPRQRAACRPGRQAGARRRAPHGCHAPARRLPRPANA

SEQ ID NO: 201680 - protein, 49 aa, Triticum aestivum
  unsure (1)..(49): unsure at all Xaa locations
  Clone ID: PAT_TA_96098.pep
PXGAPXDFAGEKGGAPAEYQPPFRGAGGAARPFGRGGGGGXFGSGATME

SEQ ID NO: 201681 - protein, 161 aa, Triticum aestivum
  unsure (1)..(161): unsure at all Xaa locations
  Clone ID: PAT_TA_96099.pep
MAPERPRHKLCLFLLAALACSLHAGAAAANTSTSTLAIRHKPPSKPRHGSTRQHRPGPRGSHAGSGMASCNMFQGSWVYDDALPMYDAAXCPFVEPEFDCQKYGRPDKLYLKYRWRPASCELPRFDGRDFLSNGRGRSMFVGDHQPEQWESLCDLQPARRL

SEQ ID NO: 201682 - protein, 138 aa, Triticum aestivum
  Clone ID: PAT_TA_96100.pep
PNPEDQEFCFLQEYEDMDSQVLLQHQEGQEEYLTSSQQHVNEPPSNKLDCCRDFIKMEDCPRLCFRCGINGHFARECSLPPHEPLPAMPPRTLVGRASMQHRVPFERRPVATTSINKDLFIICQAGLTTSHLPYGRHG

SEQ ID NO: 201683 - protein, 61 aa, Triticum aestivum
  unsure (1)..(61): unsure at all Xaa locations
  Clone ID: PAT_TA_96101.pep
IAXLIXKDGMXCKAXVVWGGKLPAXVYKVIYNLKXXYXDLFLXCXCFXLTIAITXIVSXIW

SEQ ID NO: 201684 - protein, 74 aa, Triticum aestivum
  Clone ID: PAT_TA_96102.pep
FFFYFLILFAFSFRKIINFLLVPLVFKFEYTFLFSFCFIYFILFPVFFFCFRHYLFSFVFCIKAFQMNSKKVES

SEQ ID NO: 201685 - protein, 136 aa, Triticum aestivum
  Clone ID: PAT_TA_96103.pep
GLTIHTYNMMMSCISFVDELCNGCAVWDEMHRKGICPDVNAYTVFINGHIRHGRPEEACKFIEEMIQKGMKAPQIDYNKFAADFSKAGKPDILFELAQKVKFTGKFDESNVFHQWGERMRSRVKQAVPNQTRSRTL

SEQ ID NO: 201686 - protein, 153 aa, Triticum aestivum
  unsure (1)..(153): unsure at all Xaa locations
  Clone ID: PAT_TA_96104.pep
MQIFVKTLTGKTITLEVESSDTIDNVKAKIQDKEGIPPDQQRLIFAGKQLEDGRTLADYNIQXKESTLHLGLRLRGGMQIFGQDLTGQNHHLRVXPQDTIDNVKXKIQDKEGIPPDNSVSSLAXKXSRXAHLADYNIKKXPXHXGLKXRGXMQ

SEQ ID NO: 201687 - protein, 90 aa, Triticum aestivum
  unsure (1)..(90): unsure at all Xaa locations
  Clone ID: PAT_TA_96105.pep
TICPIQRYRVIPSLLLVLEKKRELLTRSYNMKPNKIKNRVRTLILSLIQYYCGTIAQFRFIARCKRPGVTXLFIEKEISQLRFHLREESM

SEQ ID NO: 201688 - protein, 128 aa, Triticum aestivum
  unsure (1)..(128): unsure at all Xaa locations
  Clone ID: PAT_TA_96106.pep
TGAXXQCFVSNSGSARXAIGSRXSLIPXTXSXXAXXASATASLXXVSTTAGASASGSAAAXGSGXFVSXASTAAGASSLVSSTSTGAGASTSASTGAGASSVFATSSAATGFSTAGASSVSAADGFWT

SEQ ID NO: 201689 - protein, 69 aa, Triticum aestivum
  unsure (1)..(69): unsure at all Xaa locations
  Clone ID: PAT_TA_96107.pep
XKDFVSTLQCSLAHVQKVLGNFSICMSKTRQLKLQLDGYYVCAFLDLVRRTLSIVSAVDPAEFFAFLKS

SEQ ID NO: 201690 - protein, 54 aa, Triticum aestivum
  Clone ID: PAT_TA_96108.pep
SCVENLKLVICVHIWLINQISITAQEKSTMVIQESCLSLFVGDEIIRIFLNSDY

SEQ ID NO: 201691 - protein, 144 aa, Triticum aestivum
  unsure (1)..(144): unsure at all Xaa locations
  Clone ID: PAT_TA_96109.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTXGENYRLLYDTKGRFRLXSCQGRGCLSLNXCXXRSVXXWAKXGIPYLKL

SEQ ID NO: 201692 - protein, 61 aa, Triticum aestivum
  unsure (1)..(61): unsure at all Xaa locations
  Clone ID: PAT_TA_96110.pep
MAETAYXCFVGGXAWAXDDNXLHXAFSQYGEILXAXXINDXDTGRXRGFXFXVTFGSQRXR

SEQ ID NO: 201693 - protein, 162 aa, Triticum aestivum
  unsure (1)..(162): unsure at all Xaa locations
  Clone ID: PAT_TA_96111.pep
ALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAXXVVISAPSKDAPMFVVGCQRGXTXTSDXNNVSNXXLDHXXAXLPXXQIXMDNFPVIIGGFGPQG

SEQ ID NO: 201694 - protein, 91 aa, Triticum aestivum
  unsure (1)..(91): unsure at all Xaa locations
  Clone ID: PAT_TA_96112.pep
MVVLLLWLLWQDVDRVDGVPLRFTNRVDFDQVTGQVYFTDSSMQYKRSQHEMVTTXKTGDSTGRLMMYDPWTSDVTMLQAGMTYPNGVALP

SEQ ID NO: 201695 - protein, 159 aa, Triticum aestivum
  unsure (1)..(159): unsure at all Xaa locations
  Clone ID: PAT_TA_96113.pep
MLVYQDKLSGDELLSDSFPYRELENGVLWEVDGHWVVQGAVDVDIGAYPSAEGGGDDEGVDDQAVKVVDIVDTFRLQEQPAFDKKQFISHMKRYIKNLSAKLEGDDLDAFXKNVEVRHXSXLLXQSSKDLQVPCWAKXXXGXWPXWCSXXXKEGTADXL

SEQ ID NO: 201696 - protein, 79 aa, Triticum aestivum
  unsure (1)..(79): unsure at all Xaa locations
  Clone ID: PAT_TA_96114.pep
KXLKXWNLGXFXLXXLPXGKXPLHWCPXVFAXLNPMKMAHCYGCINHGIIDMKHPGKADAYSWWSLERTFAIWWAQKPS

SEQ ID NO: 201697 - protein, 52 aa, Triticum aestivum
  unsure (1)..(52): unsure at all Xaa locations
  Clone ID: PAT_TA_96115.pep
AXNXSXNVDVXPKELXXRXXEVHXWHXSLGXELANSEPSTTLPCQXLPHTSV

SEQ ID NO: 201698 - protein, 166 aa, Triticum aestivum
  unsure (1)..(166): unsure at all Xaa locations
  Clone ID: PAT_TA_96116.pep
ENPQHEESXRRXXGNQARXXLGVSXRGARPXARRXXXAQLQERPATASPRSXAARGTRXRWLXKNXXKVXQASGXAPPRXPRAXDAXXYQEXRPXGSRPPPXGXGXPXSTXXLPMXSLLPLFWLVXXPAGXXFVXLNRXIGFGFKTWSXWXAKXPFXAMXFXLLTP

SEQ ID NO: 201699 - protein, 123 aa, Triticum aestivum
  Clone ID: PAT_TA_96117.pep
RSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGWTMS

SEQ ID NO: 201700 - protein, 56 aa, Triticum aestivum
  Clone ID: PAT_TA_96118.pep
LIDWIYCLLQSEISLSHNTPDQPATKKVRKNSSSTNRAKGIDRQPWREARTYGSCP

SEQ ID NO: 201701 - protein, 116 aa, Triticum aestivum
  unsure (1)..(116): unsure at all Xaa locations
  Clone ID: PAT_TA_96119.pep
ATQEHKHSPHTRVAKKKSPKLFPPDRSALLLLAGGFSRHXXNPPKAXKRLPAGKSXAKEGGDNKGKKXAXKSVXTYKIYIFKVLKQVXXXDIGISSKAMSINELLQGARVPSNAIG

SEQ ID NO: 201702 - protein, 57 aa, Triticum aestivum
  unsure (1)..(57): unsure at all Xaa locations
  Clone ID: PAT_TA_96120.pep
KFYCSKEXRRCKCSIMFXVLLLAGCLKLLMPLCDLKLHIKKXXXKKKKKXTXKEXTN

SEQ ID NO: 201703 - protein, 63 aa, Triticum aestivum
  Clone ID: PAT_TA_96121.pep
PPRPRPAAPQQWPPPPQPPRDPSSDPDPPPPPSAARPPGPPPAPGRRPPRGGSSPPLPAPASP

SEQ ID NO: 201704 - protein, 100 aa, Triticum aestivum
  Clone ID: PAT_TA_96122.pep
PQSWSTRGRLLVDPRAQGKNSARGEHNASPGYYDGRYWTMWKLPMFGCTDATQVINEVEEVKKEYPDAYVRIIGFDNMRQVQCVSFIAFKPPGCEESGKA

SEQ ID NO: 201705 - protein, 87 aa, Triticum aestivum
  unsure (1)..(87): unsure at all Xaa locations
  Clone ID: PAT_TA_96123.pep
CPRGPRRGLLISPPTQCSKFFPRHRPPSFDXMXCKSAPSSHWYVGEGMEEGEFXEXREDXXLALEKDYEEVGAEFDEGEDGDEGDEY

SEQ ID NO: 201706 - protein, 154 aa, Triticum aestivum
  unsure (1)..(154): unsure at all Xaa locations
  Clone ID: PAT_TA_96124.pep
IXIALWKFETTKYYCTVIDAPGHRDFIKNMITGTSQADCAVLIIDSTTGGFEAGISKDGQXTREHALLAFTLGVXQMICCCNKMDATTPKYSKARYEEIVKEVSSYLKKVGYNPDKVPFVPISGFEGXNMIEXATKPLTGYXGPKPLALKGALD

SEQ ID NO: 201707 - protein, 106 aa, Triticum aestivum
  unsure (1)..(106): unsure at all Xaa locations
  Clone ID: PAT_TA_96125.pep
QPKETEATSSFLLPMALAGSNAHPTVLVLFLVLTMMMPSSPPSRCHALRIWSCINAAVQPCRVVTCMAECXXKGKLQDLISPFPLPTTLSTPEXWLLQERLAQLKW

SEQ ID NO: 201708 - protein, 72 aa, Triticum aestivum
  unsure (1)..(72): unsure at all Xaa locations
  Clone ID: PAT_TA_96126.pep
SSDXLKHEIIATPXKRRTHKSFGMTLSVHRNQSFPKKKFTGTXNPPLHSSKIVNSRGQKRILTICNNAVFNF

SEQ ID NO: 201709 - protein, 136 aa, Triticum aestivum
  unsure (1)..(136): unsure at all Xaa locations
  Clone ID: PAT_TA_96127.pep
MXRTKQTARKSTGGKAPRKQLATKAARKSAPATGGVXKPHRFRPGTVALREIRKYQXKSTELLXRKLPFQRLVREXXXDFKTDLRFQRSAXSALXEGXPEXYLVGLFEDTKPSAAIQGQRVHHHQRTKLPGNPVGE

SEQ ID NO: 201710 - protein, 86 aa, Triticum aestivum
  unsure (1)..(86): unsure at all Xaa locations
  Clone ID: PAT_TA_96128.pep
ANQALSSFPAPRFPSKXTEALXPRWLAWHWXPCSPCSRXWSVAEMASGGGDLXXRXRPAVXPVHXPTAKGXKASGTLXGXXAXIXG

SEQ ID NO: 201711 - protein, 83 aa, Triticum aestivum
  unsure (1)..(83): unsure at all Xaa locations
  Clone ID: PAT_TA_96129.pep
LLASPSRPTPPTQRCRSXRFVXIGRVALAELRQGLRPPRRHRRRRRPRTGHLWMLXIWSGAKMNFKAVFPLTRQSKIDIKAYP

SEQ ID NO: 201712 - protein, 160 aa, Triticum aestivum
  unsure (1)..(160): unsure at all Xaa locations
  Clone ID: PAT_TA_96130.pep
SGSATAHLINSFHTPQGAIQAKQQVSILFKSXSXSFLWSMFHXAFYTAGDSCGFGSFPTFXDGGVQPGGFYFRLLARTYFXGGGWIPAPYIIKXSRLLIGGAINXPWGGNQCWAPFRRSKEGGGPGYRPNPPQTKPNGPSNGLTKVSILPRPMDMGGTAS

SEQ ID NO: 201713 - protein, 95 aa, Triticum aestivum
  unsure (1)..(95): unsure at all Xaa locations
  Clone ID: PAT_TA_96131.pep
PITXHKSGHXVKHRGPMELNQHFLPLRYXDSEXIQXYRALDDGDXGXLXNKFXXQRFXGXNSLPXNHXGLXXNPLXLIAXXTXSSEFSLWGXPFG

SEQ ID NO: 201714 - protein, 165 aa, Triticum aestivum
  unsure (1)..(165): unsure at all Xaa locations
  Clone ID: PAT_TA_96132.pep
VMASSATSVAPFQGLKSTAXLPVSRRSNXASLGSVSNGGRIRCMQVWPIEGIKKFEXTLSYLPPLXAREALLKQVDYLIRSKWVPCLXFTKVXGFIFREHXRISLGTTNGRYWAMWESCPMFGATDPNKRWIKQGEGGSRKGVTPGAVLSGNPSGSNQCGQGGVA

SEQ ID NO: 201715 - protein, 133 aa, Triticum aestivum
  unsure (1)..(133): unsure at all Xaa locations
  Clone ID: PAT_TA_96133.pep
RTPAAGAASSPSRWPSSSRPSPSPPTSPPPXPCDRSPPRRPAGAAVESXASSSGAPRSTGAPSXPPCPPPPPAAPPAXPTAAANFLGFFCGGTRFGKPAFPKLLGLTQTECQGPLACLPDWGGTFSSCPGALS

SEQ ID NO: 201716 - protein, 97 aa, Triticum aestivum
  unsure (1)..(97): unsure at all Xaa locations
  Clone ID: PAT_TA_96134.pep
AQGFFPQVDGLLKTGPVERRRRLLIGRIGVPGPPLVWKKYXYLRLDGHTSXGHERGXLIDRFNDPDXPAFIFLXLSIRAGGVGVNLQAADTVIIFDT

SEQ ID NO: 201717 - protein, 147 aa, Triticum aestivum
  unsure (1)..(147): unsure at all Xaa locations
  Clone ID: PAT_TA_96135.pep
PTHTPPPLSPSPSLPRRAVLPPLHPIAPGRTRDRAQICAPNPTRSLPTPRLPAAAWAGLISLPMRLWVGHERHWRRLAGGPIHTRMELKRRRPQPWELGQAGPAPNDXYQGGKDQGTKGECQGGLGRLRCPVXRRNQARQTPXLGGX

SEQ ID NO: 201718 - protein, 88 aa, Triticum aestivum
  unsure (1)..(88): unsure at all Xaa locations
  Clone ID: PAT_TA_96136.pep
GXXKFXXXXAXXPAXXPINAXPQXALVAKLSQXGXPTGRRGVGXRAXGIGSADXRAIHVXALGRWDGVEGARRGEGGRERERGXVECE

SEQ ID NO: 201719 - protein, 75 aa, Triticum aestivum
  unsure (1)..(75): unsure at all Xaa locations
  Clone ID: PAT_TA_96137.pep
SNEGPXPVSLPGAVXSXXXFXXRXCLLQSLSRSCRKAMPMQLVLRSNTGNLLFPTXXMPNAXLFSSPXXIKAWEA

SEQ ID NO: 201720 - protein, 105 aa, Triticum aestivum
  unsure (1)..(105): unsure at all Xaa locations
  Clone ID: PAT_TA_96138.pep
IQSSPPTISPGNLRSERSESLVLLLKMXIFVKTLTGKTITLEVESSDTIDNVKAKIXDKEGIPPDXQRLIFAXGKXLEDXRTLADYNIQEWXPPLPLGGLRLRGX

SEQ ID NO: 201721 - protein, 153 aa, Triticum aestivum
  unsure (1)..(153): unsure at all Xaa locations
  Clone ID: PAT_TA_96139.pep
QAKLGSIEKLVSSLTQSRSPWPRPPPSSCLCLLLVAAVTFSVAAAXPAPAXPPPFRMVYAFGDSFTXHGATRTPRRGGLTRYGXRXPNPPYGGAXFFQPLPTNRLLPDXXRPXSVXTFXRPTGTPXGRPGPSLFXPRPXKXXPXARPPKXXXA

SEQ ID NO: 201722 - protein, 62 aa, Triticum aestivum
  unsure (1)..(62): unsure at all Xaa locations
  Clone ID: PAT_TA_96140.pep
RAKHIVYYQVPTRPLAHGQTHTHNYTLMTLSLSLRRYXLNSNRSDLLLXDCCFKLHPCGPXX

SEQ ID NO: 201723 - protein, 132 aa, Triticum aestivum
  unsure (1)..(132): unsure at all Xaa locations
  Clone ID: PAT_TA_96141.pep
MARTKQTXRXSTGGXXPRXQLXTKAARKSAPVTGXVKXPHRFRPGTVALREIRKYQXRGTXELLIRKLPFQRLCPAKIAVSRDPSSSRRLRPGEARRAPGWFRRNTQSGQSNQRRRTCSIQGFPGSGGKKKG

SEQ ID NO: 201724 - protein, 132 aa, Triticum aestivum
  unsure (1)..(132): unsure at all Xaa locations
  Clone ID: PAT_TA_96142.pep
MAGAVPLAPPMVAAARPAAGSLYEALRVGRAATQVEIRTAYRSMAKRLHPDVASCGRGGPEAFLEIRRAYEDAVRPGRXGXRYDSSLGVFPPAGGARRLIPGCRLGRPDQIALGDLRPMNPNLPMKTWDLSL

SEQ ID NO: 201725 - protein, 95 aa, Triticum aestivum
  unsure (1)..(95): unsure at all Xaa locations
  Clone ID: PAT_TA_96143.pep
XXEAWXWXQDHXSGXNGXDXXTXWCYFXGGXLXRSXLVVTRXFXLXPWSXLNRHVSSYEDGRXRLTXRLINXXWGGRGGVDXXQARXEERGGRXA

SEQ ID NO: 201726 - protein, 187 aa, Triticum aestivum
  unsure (1)..(187): unsure at all Xaa locations
  Clone ID: PAT_TA_96144.pep
RRHIIXTPTKQKHPTHIRDXKTRTALSQVLPATXNLGPLPSDAAGRSWMSLGMMGDALGVDWRKRLVSSKQXRRRVGLRRASCRGREDXRGGSGKSXEVGLEKSCADLNGTEXAWERGKLCXNEANSRCSSWVNLPGFSAGXGRTGFPGALKXGWGAFFQRPAPVGRAARXXXAXPWVXEASFPPXP

SEQ ID NO: 201727 - protein, 101 aa, Triticum aestivum
  unsure (1)..(101): unsure at all Xaa locations
  Clone ID: PAT_TA_96145.pep
RSLGRSDSTASGDSPKERIVPPXKKPATTSLRIDRFVRPFTLRAVQELLGKXXSVCSFWDGIISTTHCXGYILLEWEGKLQATPVMLSTNLASGPPKQWAN

SEQ ID NO: 201728 - protein, 133 aa, Triticum aestivum
  unsure (1)..(133): unsure at all Xaa locations
  Clone ID: PAT_TA_96146.pep
GLKKHLKRLNAPSHWMLDKLGGAFAPKPSSGPHKARECLPLILILRNRLKYALTYREVQSILMQXRHIMVDGKVRTDKTYPAGFMDIISIPKTXGENYRLLXYDTXGPLSPFTLSGMRNAKVQSARGRVCSGK

SEQ ID NO: 201729 - protein, 51 aa, Triticum aestivum
  unsure (1)..(51): unsure at all Xaa locations
  Clone ID: PAT_TA_96147.pep
VCVPHEPLXRXWYLLVAAICLARHVAGMLHVYTVAELDMNVWGPENFXPLQ

SEQ ID NO: 201730 - protein, 141 aa, Triticum aestivum
  unsure (1)..(141): unsure at all Xaa locations
  Clone ID: PAT_TA_96148.pep
MXRTKQTARKSTGGKAPRKQLATKAARKSAPATGGVKKPHRFRPGTVALREIRKYQXKSTELLIRKLPFQXRLVREIAQDFKTDLRFQSSAVSALQEAAEAYLVGLFEDTNLCAIHAKRVTIMPKXDIQLARRIRXEEGLN

SEQ ID NO: 201731 - protein, 70 aa, Triticum aestivum
  unsure (1)..(70): unsure at all Xaa locations
  Clone ID: PAT_TA_96149.pep
RIPPKVSLLRRSIRRASHRSPRHSXQRRRRRMGRPPXSGGPAFRFTHAEVAGXLXLXLXFLTNGXXPXAL

SEQ ID NO: 201732 - protein, 183 aa, Triticum aestivum
  unsure (1)..(183): unsure at all Xaa locations
  Clone ID: PAT_TA_96150.pep
QSTKQTRWPARSRRRGSPPVGKAPRKQAGHQGGAQVXRRPPXGVKKPHRFRPGHRGAPGKIXQVPRKKHRSCSSAKLPFQAPRQGEIAARDFKGPTWRVPSPPPVVGRWQGRGPPEGHTXVGGLFXKGQXKPSXANPTPKGAFNNQCXXGHSKLRKERHSXGKKKGPKISVRLXFPXWSGTXE

SEQ ID NO: 201733 - protein, 128 aa, Triticum aestivum
  unsure (1)..(128): unsure at all Xaa locations
  Clone ID: PAT_TA_96151.pep
AFGFIHGLDKPHDKREARPTVQPLDQYRSVQPPRRFFFHGGPIDLALPDGSQLCTEFSMQHQHPPPPLRRLQLSTWDRSLEGRASIRDLLQYVPMPDLVPRHASPXVLSSLSCYDLRNHSSVSSGPLG

SEQ ID NO: 201734 - protein, 150 aa, Triticum aestivum
  unsure (1)..(150): unsure at all Xaa locations
  Clone ID: PAT_TA_96152.pep
MVSLKLQKRLASXVLKCGKGKVWLDPNEVNEISMANSRQNIRKLVKDGFIIRKPQKXHSRSRARRAHEAKQKGRHSXGYGKRKGXPXEARLPTKDLWMRXRMXVLRRLLRKYREXAKKXDKHMLHDMXLXGXGNMFXKQKGXHGRSIXKS

SEQ ID NO: 201735 - protein, 121 aa, Triticum aestivum
  unsure (1)..(121): unsure at all Xaa locations
  Clone ID: PAT_TA_96153.pep
MAAAGXAGEKKMITLKSSDGEEFXVEEXVAMESQTIRHMIEDXCVDQXAIPLPNVNSKGLSGSIETRHGSKGPSPAWGLAGEGEPGRPSDPAPAPRPETLNLGTAKFRSRRPKGPLSDSPW

SEQ ID NO: 201736 - protein, 89 aa, Triticum aestivum
  unsure (1)..(89): unsure at all Xaa locations
  Clone ID: PAT_TA_96154.pep
PSQSHRREEKMSGRGKGGKGLGKXGGANRHRKVLRDNIQGXSPKPAIRRLARRGGRESASRGSSTKETRGVLKIFLRGGGPGTQIPPYK

SEQ ID NO: 201737 - protein, 169 aa, Triticum aestivum
  unsure (1)..(169): unsure at all Xaa locations
  Clone ID: PAT_TA_96155.pep
ASGAVAHFSPAXWRXRGARQWCWRWCSRPWWCAPPGDGARXPYPAPRVYKHADAGACKYRASKGGFRRAXGLAAPGIQXTCWAXRAKXTXPEPPATNLRAALKSNVRQTGGLXAGPLQLTPPPAGGLPLXRLQTFPPSPLTXIQAXXRSELXXFGFXLETETXXPXLXP

SEQ ID NO: 201738 - protein, 150 aa, Triticum aestivum
  unsure (1)..(150): unsure at all Xaa locations
  Clone ID: PAT_TA_96156.pep
PSAAPPVGAHRDGAVQGRXCXXDGGXTSAALCTXLRXGXRQRSGQKPLHYKGASAFLPALIPXLHGAKRPGELSPSGANRXTREGEVPSTGGRKFRXNXRKVSSNKGKXQSPGGXFFXWGQAAGGPNTXXXPXVSSXLQPVXLXNXGSEX

SEQ ID NO: 201739 - protein, 93 aa, Triticum aestivum
  unsure (1)..(93): unsure at all Xaa locations
  Clone ID: PAT_TA_96157.pep
YRHLASITGSLDSASLSRPVTSSEVSSLSRLFEIFQQNYTEGPEGAQIEGVGEVGAAGCLRPLHGQHLQADRRSSSGSERXASHRDSSSVLPG

SEQ ID NO: 201740 - protein, 109 aa, Triticum aestivum
  unsure (1)..(109): unsure at all Xaa locations
  Clone ID: PAT_TA_96158.pep
XXVDIXDTIXNVKXKIQDKEGIPXDQXRLIFAGKXLADXRTLADXXIQKESXLHXVLXLRGGIIEPSLQAFARKYNHXNMICPQGATPVLSGCGKKKCQQPLRAQIIKA

SEQ ID NO: 201741 - protein, 161 aa, Triticum aestivum
  unsure (1)..(161): unsure at all Xaa locations
  Clone ID: PAT_TA_96159.pep
APHXFPSLPRXGGTYSSGPPQSPPPPLPPGGRAPPPPPPPPPSPFTFFRSPGDILLAVPFQVSPPIGLLPSFEDISEQQQSLQSVTPKYQIECKSKPNLKQQGHLECPKEDSLGFFGTSRGNGKKKVSPKDLLCINFDRWFQAYYIDPRGWERLFLAGEEI

SEQ ID NO: 201742 - protein, 118 aa, Triticum aestivum
  unsure (1)..(118): unsure at all Xaa locations
  Clone ID: PAT_TA_96160.pep
SPPSDLAGKSLRSKRGEGSLVLLLKMQIFVKTLTGKTITLEVESSDTIDNVKAKIQDKEGIPPDQAXVSSLLAKQLEDGRTLADYNIQKESTLHLVLRLRGGMXIFVKTPHWARTSPL

SEQ ID NO: 201743 - protein, 58 aa, Triticum aestivum
  unsure (1)..(58): unsure at all Xaa locations
  Clone ID: PAT_TA_96161.pep
DXQCPPVQSSKXSTXLLILXXACWVXXHQTVXNNPAGRAASARXTTTXEICXXXIWAG

SEQ ID NO: 201744 - protein, 108 aa, Triticum aestivum
  unsure (1)..(108): unsure at all Xaa locations
  Clone ID: PAT_TA_96162.pep
ALVAVFAVLAAXAVAEMASGAVTCGDVTSAVAPCMSYATGKASAPSGACCSGVRTLNAKASTPADRKAACNCLKNLAGSGINMGNAANIPGKCGVSVSFPINNKTNCK

SEQ ID NO: 201745 - protein, 159 aa, Triticum aestivum
  unsure (1)..(159): unsure at all Xaa locations
  Clone ID: PAT_TA_96163.pep
MVKYSTDPANPTKSAKAMGRDLRVHFKNTRETAFALRKMSLNKAKRYLEDVLAHKQAIPFRRYCRGVGRTAQXKNRQPNGQGRWPAKSAKFVLDLLKNAESNAEVKGLDVDALYISHIQVNKAXKXRRRXTXRAHGRINPYMSXPCHIELILSXERKPG

SEQ ID NO: 201746 - protein, 159 aa, Triticum aestivum
  unsure (1)..(159): unsure at all Xaa locations
  Clone ID: PAT_TA_96164.pep
TSPSLSGNHHCQQWRNPRRPRASRRPSPRNTTTKGTARRPXRRPRGRPRPRARRRRRRRRRSTRTSSRAPTWRASASARXSSRARSPLRRAGPARAAAPAPSRRPRRRXRGXSTKRAKRGRNRLSFADERPALHSRTKLPPLAATTPWEQLASGLRQQK

SEQ ID NO: 201747 - protein, 102 aa, Triticum aestivum
  unsure (1)..(102): unsure at all Xaa locations
  Clone ID: PAT_TA_96165.pep
QVYLTGEKRKEAKMSGRGXGXKGLGKGXAKRXRXVLXDNIQGINKPAIRPLARPGGXKRXSGVXYEEXPXVFKXFLXNXXRXAXXYXXXTRRXNVTXMXVRL

SEQ ID NO: 201748 - protein, 174 aa, Triticum aestivum
  unsure (1)..(174): unsure at all Xaa locations
  Clone ID: PAT_TA_96166.pep
HSRLRHRPWGALSQSPPPPPPPVLTTAIGRGCRRKYSFRCCLRLVACCLPSRPPPSLPPSDLPEASSPACSTHAAIPPQTAPSSAAPSPAIPSEAPLPQPPLNRXSTVGSAHGXARHRRRGLQTPPPQSYWGPAGAPNQSPLSNNVRRSCTDRPKGRLNVTSSTRGRFPKPNPL

SEQ ID NO: 201749 - protein, 174 aa, Triticum aestivum
  unsure (1)..(174): unsure at all Xaa locations
  Clone ID: PAT_TA_96167.pep
EVSSYLKXXGYNPEKVPFVPISGFEGDNMIERSTNLDWYKGPTFLEALDQINEPKRPSDKPLRLPLQDVYKXIGGIGTVPVGRVETGVIKPGMGVTFGPTGLTTEVXSVEMQHXSPSLEGLPXDNVXXNVKESCCXRIXKRGFVCIQLQRDDPAXKEXANFTSSSQHHGNNPGQ

SEQ ID NO: 201750 - protein, 164 aa, Triticum aestivum
  unsure (1)..(164): unsure at all Xaa locations
  Clone ID: PAT_TA_96168.pep
MSPQTETKAGVGFKAGVKDYKLTYYTPEYETKDTDILAAFRVSPQPGVPPEEAGAAVAAESSTGXTWTTVWTDGLTSLDRYKGRCYHIEPVAGEDSQWICYVAYPLDLFEEGSVTNMFTSIGRVTYFGFKSPTLLRFGGILPKFPPTLFQKLSKGPLGYPKERK

SEQ ID NO: 201751 - protein, 82 aa, Triticum aestivum
  unsure (1)..(82): unsure at all Xaa locations
  Clone ID: PAT_TA_96169.pep
TEGEDXXXQHARRDVPLPXLRAXXPVRXAGAQAXPRRRGACXXAVXRGQRXPXSRXXXGRRXARXAVAPLRLXKRAGAPPRA

SEQ ID NO: 201752 - protein, 146 aa, Triticum aestivum
  unsure (1)..(146): unsure at all Xaa locations
  Clone ID: PAT_TA_96170.pep
MAAAGDAGEKKMITLKSSDGEEFEVEEAVAMESQTIRHMIEDDCADNXIPLPNVNSKILSKVIEYCNKHVQAKPAXDXGCRRSRSRSLGTPAPAAPAEGAQRXWXARSSSKGPTRANPLPNSTLGLANYLEQRGLGGTLNPKFADN

SEQ ID NO: 201753 - protein, 89 aa, Triticum aestivum
  unsure (1)..(89): unsure at all Xaa locations
  Clone ID: PAT_TA_96171.pep
SCLXKGYXXHSSWISSTLVLHAALEGPAPLRGPHKXIHDLSKMLDYYRXKYXSXIIHKRAWGXRACCSYXLQRHIPRISLIXKEPSVLX

SEQ ID NO: 201754 - protein, 87 aa, Triticum aestivum
  unsure (1)..(87): unsure at all Xaa locations
  Clone ID: PAT_TA_96172.pep
MAPVKLYGATLSWNVTRCVAALEEAGVEYELVPINFGTGEHKSXDHLARNPFXQXVPALQXGDLYXFESRXAILQVCRCRKNKPRSC

SEQ ID NO: 201755 - protein, 88 aa, Triticum aestivum
  unsure (1)..(88): unsure at all Xaa locations
  Clone ID: PAT_TA_96173.pep
NCEWLIKSVIVCLMVRATRITVVILXANTCNKPRLLGGXHLLYKRLTXALLPDPMIHDNXXGSHGLRAGDASXKXLPLSXFDGRIRGP

SEQ ID NO: 201756 - protein, 138 aa, Triticum aestivum
  unsure (1)..(138): unsure at all Xaa locations
  Clone ID: PAT_TA_96174.pep
MSGRGKGGKGLGKGGAKRHRKVLRDNIQGITKPAIRRLARRGGVXRISGLIYXETRGVAQDLPXRNVIRDAVTYTXHARPQRPSPPMDVVYXPQSAGRHPLTGFRRTTPRIGLRRGLMLSIAWLCTLLVAMGNWGIPI

SEQ ID NO: 201757 - protein, 177 aa, Triticum aestivum
  unsure (1)..(177): unsure at all Xaa locations
  Clone ID: PAT_TA_96175.pep
SVAPFQGLKSTAGLPVSRRSNGASLGSVSNGGRIRCMQVWPIEGIKKFETLSYLPTLSTEALLKQVDYLIRSKWVPCLEFSKVGFIXREHNASPGYYDGRYWXTCGKLPMFGCTDATQVINEVXEKVKKEYPDAXYVRIIRIQTMRQCNCVKLQSPSRQPGLAKESRQRPKTSSLNN

SEQ ID NO: 201758 - protein, 149 aa, Triticum aestivum
  unsure (1)..(149): unsure at all Xaa locations
  Clone ID: PAT_TA_96176.pep
MGSIAGSAVSFAKPVKXINTNSLSFSGPRRGNAFLRLQPVPMRFAVCCSXKXDTVEKVCEIVKKQLAVPEGTESCGNTKFSDLGADSLXTRSXIVMGLEEEFQXXVWRETXSAQGXATVERMLPRLNRQALSPGESQSKGRANNDWERK

SEQ ID NO: 201759 - protein, 75 aa, Triticum aestivum
  unsure (1)..(75): unsure at all Xaa locations
  Clone ID: PAT_TA_96177.pep
PSRVXXTRLGSNSVXRRXSPPRXCAYLFXALAXXGCAGSPSYYVXXIXSRQPGGCXWYGLWXGGRGNVGGREGGL

SEQ ID NO: 201760 - protein, 72 aa, Triticum aestivum
  Clone ID: PAT_TA_96178.pep
LLAVVNSVCRAAILLRLLLTLESKKASISANFAPSSLTKASLHDCNTDENRGKFLCAYKPSSTTLAPVTLVS

SEQ ID NO: 201761 - protein, 66 aa, Triticum aestivum
  Clone ID: PAT_TA_96179.pep
IVLNNAGIRCNIPPVCIVCHVGITLEFISFFHECHELSNSVISPEVHVSYIAMYRSKRFFQVYYNT

SEQ ID NO: 201762 - protein, 59 aa, Triticum aestivum
  unsure (1)..(59): unsure at all Xaa locations
  Clone ID: PAT_TA_96180.pep
WRCRRRRKPPGRRAGPHPLLRGRRRDXKYTHGLHPXAQMEALRAMCGAFIPSLPAXEDA

SEQ ID NO: 201763 - protein, 149 aa, Triticum aestivum
  unsure (1)..(149): unsure at all Xaa locations
  Clone ID: PAT_TA_96181.pep
PTSSLASSQSLASFPRRQPPRKGGCLAXGATAGCGAGCXSGKRLRRGAKCSPTWRXPPXXXPWXCPPXPXRXXPAGSXXAGGDRRLATAPPCKXRHRRSGCSLLASCKLNPXXPKKXRPXQXGXXTKDXGREKXXPSHQSPPSSTXHPS

SEQ ID NO: 201764 - protein, 104 aa, Triticum aestivum
  unsure (1)..(104): unsure at all Xaa locations
  Clone ID: PAT_TA_96182.pep
NSGAXVAILLALLCFCSGTXSYSFRDXAACXGASXMAXPGPGNLLXAEQSGKCXXIKIHYAIAAAPVKQLRPHCHPHXARSLXGENXXPRGQSQXXTFRHQRQT

SEQ ID NO: 201765 - protein, 167 aa, Triticum aestivum
  unsure (1)..(167): unsure at all Xaa locations
  Clone ID: PAT_TA_96183.pep
ATAPPPFPSQSNSKMSGRGKGGKGLGKGGAKRHRKVLRDNIQGITKPAIRRLARRGGVXRISGLIYEETRGVLKIFLGELIRDAVTYTEHXXRKTVNAMDVVXNALKRQGRTLYXFRRGPAPRCSIEVNSAACCCSSAMRFRFLKCVCCFQSCLYLMRAGSECKSNL

SEQ ID NO: 201766 - protein, 147 aa, Triticum aestivum
  unsure (1)..(147): unsure at all Xaa locations
  Clone ID: PAT_TA_96184.pep
MGKIKIGINGFGRIGRLVARVALXSDDVELVAVNDPFITTEYMTYMFKYDTVHGHWKHSDIKLKDDKTLLFGEKPVTVFGVRNPEEIPWGEAGAHYVVESTGVFTDXDXGAAHLKGGCQXKWSSLPQSKDAPNVLWVXVNEGIPQTV

SEQ ID NO: 201767 - protein, 149 aa, Triticum aestivum
  unsure (1)..(149): unsure at all Xaa locations
  Clone ID: PAT_TA_96185.pep
MAAATMALSSPAMAGNPVKXSXAAPFGEGRITMRKTAGKPKVAASXNPWYGSDRVLYLGPLSGEPPSYLTGEXFPGDYGWDTAGLSADPENFAXKNRELEVIHCRWXAMLGALGXCVFPELLARNGVKFGXEASGSKAGSQXFXEGGLD

SEQ ID NO: 201768 - protein, 160 aa, Triticum aestivum
  unsure (1)..(160): unsure at all Xaa locations
  Clone ID: PAT_TA_96186.pep
ALLGSPTPYXMAPXRRXHAAVXXHPPRAGAPRRPKGGXLXXRAXSXNXLXGXRXNAMAXXRDEVPWCPQXQMXLAXGXGVGCAVXCEXPTXXAGVCXVGPPXPASRNQEXNCCRFXGXXGXXQPPXXVXKPMGLGTXXPASXPXARXWLGPSXGVGXXXP

SEQ ID NO: 201769 - protein, 165 aa, Triticum aestivum
  unsure (1)..(165): unsure at all Xaa locations
  Clone ID: PAT_TA_96187.pep
EDPLIVWITGGPGCSALSGLFFEIGPLKFDVATYTEGFPTLVYFEDSWTKVSNVIFLDAPVGTGFSYAREEQGLNVSLTGTGAQLRIFLEKWIADHPEFTSNPLYIGGDSYSAYLVPVTALGIANHNDAGHASGGXKLNLQGYLVGNPGTDXRYEHPGQGAFMHX

SEQ ID NO: 201770 - protein, 170 aa, Triticum aestivum
  unsure (1)..(170): unsure at all Xaa locations
  Clone ID: PAT_TA_96188.pep
SLTTSSQSLSFPRXXPXRKGGCLAAAATAGAAPGASAATAAGGARCSPTWRPXPAPPPWSCPPPPTRGTPXGSRRXGXPAAANAPPASAAPRAXAPACXATEPAPKRAAGKSEHEGXRRDKAKQSNINNNSTTTQRINQQAAAMRSRGAARLNKIKTTRFVVSVISVKKK

SEQ ID NO: 201771 - protein, 151 aa, Triticum aestivum
  unsure (1)..(151): unsure at all Xaa locations
  Clone ID: PAT_TA_96189.pep
MANPRVFFDMTVGGAPAGRIVMELYKDAVPRTVENFRALCTGEKGVGKSGKPLHYKGSSFHXRVIPDFMCQGGDFTKGNGTGGESIYXXEXFADEKFVHKHTKPGILSMXNAXGPNTNGSQFLICTVPCKLGSTGKHVVFGEVVQGQWFKN

SEQ ID NO: 201772 - protein, 122 aa, Triticum aestivum
  unsure (1)..(122): unsure at all Xaa locations
  Clone ID: PAT_TA_96190.pep
MVTGPSPLHSPPYVDAPPAHTLARLPAVTAFPSSTRSTSPPAKLVAXTPAVXSPSDQRRWTRDVEPRRTRPXKPPENPCTRKPLPSRAAPPCVWSPALLRXRAPTWNWGQPWVTGNGPPRGQ

SEQ ID NO: 201773 - protein, 87 aa, Triticum aestivum
  unsure (1)..(87): unsure at all Xaa locations
  Clone ID: PAT_TA_96191.pep
SQPTPGPPLVSSWRPRRRXRXRRRRRRACCGSRSRRSTAXFCSFITHXFPXLXSXLXLPICSXSLLLXXFRXXLTSXFSFLFXXXXS

SEQ ID NO: 201774 - protein, 140 aa, Triticum aestivum
  unsure (1)..(140): unsure at all Xaa locations
  Clone ID: PAT_TA_96192.pep
PSRPRGVLGHLPQXRRRRPFXXPGRXPPAQGLXEXIXXXAARFLETGAVFPRGRGEVALRHPXGGARHVIPRYQGASSALFRRLHFCRTPYVRGRISLLCAEISRXIQIFAVYIVAHSTSVGGHGTSLVMDRFIRHLRHT

SEQ ID NO: 201775 - protein, 171 aa, Triticum aestivum
  unsure (1)..(171): unsure at all Xaa locations
  Clone ID: PAT_TA_96193.pep
EFETLSYLPPLXTEXLLKQVDYLIRSKWVPCLEFSKVGFIFREHNASPGYYDGRYWTMWKXPMFGCTDATQVINEVEXEVKKEYPDAYVRIIGFDNMRQVQCVSFXSPSKPTGCEESGKGLNKLTHHGPHIKCHCGFVNSDIALGFPSPINLSCLVPKICVCPRFKQTMSP

SEQ ID NO: 201776 - protein, 137 aa, Triticum aestivum
  unsure (1)..(137): unsure at all Xaa locations
  Clone ID: PAT_TA_96194.pep
VHSKGQQIHHKIVGTRGRQARGAXRKWEGDHFMNEKNTFNPKPXLPPTTGNGPTGLILRVPVGLAKILKANAKXTGWPALLLLKGAWLXXKQXARFXXLFLPLPSLLXAKLRRNPNYIIPGWTTPXSGRSXXVXLXL

SEQ ID NO: 201777 - protein, 122 aa, Triticum aestivum
  unsure (1)..(122): unsure at all Xaa locations
  Clone ID: PAT_TA_96195.pep
FFFFFTACTRREMLLKKRAALIPALCMLLLLMLPRPSRQQFFDHSXDCYRKXYLECKNAFPMLCKVVCGGSCNDNKDPVVTCMVACCTDSICGLSPAPSACAPDCIHACEKMWGGHGPAKEP

SEQ ID NO: 201778 - protein, 164 aa, Triticum aestivum
  Clone ID: PAT_TA_96196.pep
ASKEAGGEAKTRGRKKGSKAKKSVETYKIYIFKVLKQVHPDIGISSKAMSIMNSFINDIFEKLAAEAAKLARYNKKPTITSREIQTSVRLVLPGELAKHAVSEGNKGVTKVHLLLKLHLHCYLSIYLSNDCSWVCYFCVDSWVIWNYKLVLMLGRGIQLNLCSF

SEQ ID NO: 201779 - protein, 152 aa, Triticum aestivum
  unsure (1)..(152): unsure at all Xaa locations
  Clone ID: PAT_TA_96197.pep
MAPKAAEKKPVATAEKTTAGKKPKAEKRAPASKEAGGEGKQRGRKKGSKAKKGVETYKIYIFKVLKQVHPDVGISSKAMSIMNSFINDIFEXKLAGESAKLXRYNKKPTITSREXQTSVRLVLPGELAKHAVSEGTKGVTKFTHPKVHPSSF

SEQ ID NO: 201780 - protein, 78 aa, Triticum aestivum
  Clone ID: PAT_TA_96198.pep
LPSPRRRSGDHITSAFSTHPESLPYPEHAAPPRSRQESQPVAPQPRRYPRQYPSEAVGVAEEMRFVAMRLRNTKARHS

SEQ ID NO: 201781 - protein, 164 aa, Triticum aestivum
  unsure (1)..(164): unsure at all Xaa locations
  Clone ID: PAT_TA_96199.pep
MAPTVMASSATSVAPFQGLKSTAGLPVSRRSNGASLGSVSNGGRIRCMQVWPIEGIKKFETLSYLPPLSTEALLKQVDYLIRSKWVPCLEXFNKVGFIFREHNASPGYYDGRXYWTMWKAAYXFGCTDATQVXNEVEXESRKEXPDAYVRINRIKTCVWQCVSN

SEQ ID NO: 201782 - protein, 59 aa, Triticum aestivum
  unsure (1)..(59): unsure at all Xaa locations
  Clone ID: PAT_TA_96200.pep
LRPRTRGXAGYIIEPNTNNISIXQISFFSSINFQNHVDHIIFILNPIYLXLIILHPKVL

SEQ ID NO: 201783 - protein, 129 aa, Triticum aestivum
  unsure (1)..(129): unsure at all Xaa locations
  Clone ID: PAT_TA_96201.pep
PRQVYLTGEKXREAKMSGRGKGGKGLGKGGAXRHRXVLRDNIQGITKPAIRRLARRGGVKRISGLIYEETRGVLKIFLENVIRDAVTYTEHARRKTVTAMWSTHSKPGTHPLRVSEGLANHHIIVWGVV

SEQ ID NO: 201784 - protein, 71 aa, Triticum aestivum
  unsure (1)..(71): unsure at all Xaa locations
  Clone ID: PAT_TA_96202.pep
MGISRDSMHKRRATGGKQKAWRKKRKYELGRXPANTKLSSNKTVXRVRVRGGNVKWRALRLDTXNFSWXSE

SEQ ID NO: 201785 - protein, 128 aa, Triticum aestivum
  unsure (1)..(128): unsure at all Xaa locations
  Clone ID: PAT_TA_96203.pep
MSCCGGNCGCGAGCKCGNGCGGCKMFPDVEATAGAAAMVMPTASHKGSSGGFEMAGGETXGGCDCTTCKXCAPRAAAPAAAATEPGAXXPGRAEGEHQDXXGXNNQSSSPPTPPQXYQQLPQPRPPKL

SEQ ID NO: 201786 - protein, 154 aa, Triticum aestivum
  unsure (1)..(154): unsure at all Xaa locations
  Clone ID: PAT_TA_96204.pep
XASGDGPXXXXSKXRGWAXRAPSKCWPLPGRGNXPXSPAARSPSKRGPAGGKAQXQXDXVXXWRFDXXPREVXLGYHAFXNGPLIQNCTXVPMCFRIXWICYSRPNWGVXKXKYSXVKSAXXXQTSGXTCSXQXKXTXIATFKKCXRDXXLSSX

SEQ ID NO: 201787 - protein, 110 aa, Triticum aestivum
  unsure (1)..(110): unsure at all Xaa locations
  Clone ID: PAT_TA_96205.pep
FFXLXAVLPWXVCPXPXXIRLCHLHXWPFXWLGWIWFXERDAHDKRPPXXAPXLQXFIFTRLXXGSSGESMERXLPDGRRLGGLRGGAAGALVTGRAGRSPXRLALAXTA

SEQ ID NO: 201788 - protein, 130 aa, Triticum aestivum
  unsure (1)..(130): unsure at all Xaa locations
  Clone ID: PAT_TA_96206.pep
MYTARKKIQKDKGVEPSEFEDTVAQAFFDLENGNQELKSDLKDLYINTAIXMDVVGNRKAVVIHVXPYRLRKPFRKIHVRLVRELEXEXLSGKDVVFVAXTKKGLVRPPKEGFLLVSSAPPQPRTLNQPV

SEQ ID NO: 201789 - protein, 141 aa, Triticum aestivum
  unsure (1)..(141): unsure at all Xaa locations
  Clone ID: PAT_TA_96207.pep
GRRAVAQEVRRCSNPWNRKNTFLVGSSNYXVEGWKCSATCRHSIVPSARSGLLGSQPPWEWAVADEQEIEFLMQPIKRFTVLEEVNDSDVPMAPCISPSPASAKLQHAAAPELSRDGQICATQAVVAADWQKGKFHPKRLD

SEQ ID NO: 201790 - protein, 66 aa, Triticum aestivum
  unsure (1)..(66): unsure at all Xaa locations
  Clone ID: PAT_TA_96208.pep
YAVVFIRSYLGTRKVALIFVDMTTKKIMNTRTFCLXKKKKKKKKXKXKKKXKKXXGGXXGGQKXPN

SEQ ID NO: 201791 - protein, 82 aa, Triticum aestivum
  unsure (1)..(82): unsure at all Xaa locations
  Clone ID: PAT_TA_96209.pep
GWVEGDVGVGRDGDGRGARGDAGGGGRRGEDGREEEGASRRRRTSGXRRGRRRRRRGRARRRGRGAARGAGRRRARRPSCSP

SEQ ID NO: 201792 - protein, 136 aa, Triticum aestivum
  unsure (1)..(136): unsure at all Xaa locations
  Clone ID: PAT_TA_96210.pep
GGCLAAAATAGAAPAASAATAAAGARCSPTWRPPPARPPWSCPPPPTRGAPAGSRWPAGRPAAATAPPASAAPRAAAPAAAATEPAHXRPAGRGEHEDEEEKQAIIITTNNTRISTTSRPHALARALNKIKPSCVP

SEQ ID NO: 201793 - protein, 159 aa, Triticum aestivum
  unsure (1)..(159): unsure at all Xaa locations
  Clone ID: PAT_TA_96211.pep
STRPLGQXRLPVTFGTRDNYRTELIDFDIAKIDLPYNAILGYPALAQFMAATHPAYNLMKMLGSNGVLTVAGDTKGALQALKLTFXTAASALPGEKXGQEXPXAXPAKXXXLXSXDRAXXKQVXVCEDGTTNPTFKRGGLPQGQEGTLIFFQPTKDPWK

SEQ ID NO: 201794 - protein, 156 aa, Triticum aestivum
  unsure (1)..(156): unsure at all Xaa locations
  Clone ID: PAT_TA_96212.pep
MSLTVSLLIYVAXAHALKPSYSVYRSALRLVXLMXLLPYLKVGYLTAPPANNAIAPHTDWERSQFVXNHEGLQKADASGQPPSQSMDRGRKPTRIAVEDIVSVSASADLTLPPGAGLCVDTVHGPRFLVADSWEALDSWLDALCLVYTIFARGKSG

SEQ ID NO: 201795 - protein, 163 aa, Triticum aestivum
  unsure (1)..(163): unsure at all Xaa locations
  Clone ID: PAT_TA_96213.pep
CSRNPXPRGXSSTTPTFTPLVGRSSNFXRRRRRTAXGTGATPRPSNXEEDAPKPKHPAPGAGHYPAPNPAVAAAPKGPKKPATNGQAKGEDLHMFVWXSSASPVSDVFGGGAPDYNDAAAAKSPRKMDGAKEREDYNVERDDFSFGNRGALDRDTEAAVMFSS

SEQ ID NO: 201796 - protein, 132 aa, Triticum aestivum
  unsure (1)..(132): unsure at all Xaa locations
  Clone ID: PAT_TA_96214.pep
MAAPRXHAAATLALLVAALVLSAGTAPAEGAVXNCXQVVSYLAPXIXYAMGKVSAPGGGCCNGVRCLNAXXXPTPPDRKNXCTCLKQQASGISGIKAQTSFAGIPRQVAGVKXPLTPIKPKETDLLQVRLSR

SEQ ID NO: 201797 - protein, 71 aa, Triticum aestivum
  unsure (1)..(71): unsure at all Xaa locations
  Clone ID: PAT_TA_96215.pep
MGXXLXPXGXNKKNKXTEXKSDXVYLKLVXXLYXFXGGGXKQXFNXLXXKRLFMNKEKQPPLSMSRLLRFI

SEQ ID NO: 201798 - protein, 143 aa, Triticum aestivum
  unsure (1)..(143): unsure at all Xaa locations
  Clone ID: PAT_TA_96216.pep
MAAATMALSSPAMAGXPVKXSRAAPFGEGRIXMRKTAGKPKVAASNSPWXGSDRVLXLGPLSXEPPXSYLNGEFPGEYGXGKTRGLSAEPXNFAKKPGSWEVNQLPAGPMLGALGXRSFPEAGSPRKRXSKFRXRPSWXKGPS

SEQ ID NO: 201799 - protein, 104 aa, Triticum aestivum
  unsure (1)..(104): unsure at all Xaa locations
  Clone ID: PAT_TA_96217.pep
PKTLHSLSMXPQKLQESDYLNTEEFNDAVAAELKSKTGERPPPLQCLNSQYSXIQVNLGMSPIPVKLSIVNKTKLLLEXPNIMVKHANQFCXMPDVMLSGGXKN

SEQ ID NO: 201800 - protein, 86 aa, Triticum aestivum
  unsure (1)..(86): unsure at all Xaa locations
  Clone ID: PAT_TA_96218.pep
EXRKYQKSTELLIRKLPFQRLVREIAQDFKTDLXFXSHAVLALXEAAEAYLVGLFEDTNLCAIHAKRVTIMPKDIQLARRIRGERA

SEQ ID NO: 201801 - protein, 113 aa, Triticum aestivum
  unsure (1)..(113): unsure at all Xaa locations
  Clone ID: PAT_TA_96219.pep
LTGKTITLEVESSDTIDNVKAKIQDKEGIPPDQQRLIFAGKQLEDGRTLADYNIQKESTLHLVLRLRGGIIEPSLXALARKYNQEKMICRKCYPSCIQRAVNXRKEKVGKTNN

SEQ ID NO: 201802 - protein, 175 aa, Triticum aestivum
  unsure (1)..(175): unsure at all Xaa locations
  Clone ID: PAT_TA_96220.pep
KFGXPEFGAPPFPLGGLQXQXXFWFXPCXXXSSRVAQTKAPFXGQTLKQTRPTFXGXXRANKPANXQGXFSXPIRQXVXXLLFERRRQPSFGLXSXPSXTFSFVATLEQIVHWFAXVPKEPTVINNIGXGPLRXVGNPPLFXPSLXNFKXFGEAXAGPEEEXCGXWDSXGVRLDW

SEQ ID NO: 201803 - protein, 136 aa, Triticum aestivum
  unsure (1)..(136): unsure at all Xaa locations
  Clone ID: PAT_TA_96221.pep
SGKRXPXWAAAGXEPPPLAXXXGGWGLPLLHRXLVRPASPPERSPFAALNXTRXCHRREAAFPGPVVERVGLRRGRAPSTRRPCRRRRRGPWRRSRPRGRGRRGSRGGARLDAIGRDGTSSGWIDGLRRRGEGSWA

SEQ ID NO: 201804 - protein, 82 aa, Triticum aestivum
  unsure (1)..(82): unsure at all Xaa locations
  Clone ID: PAT_TA_96222.pep
GXFXILQAXSXPRFLRLQRPWRMGNRXRCXPAPRIFSRPAGLLLDYGAAASSVKQFHEMRPIWIRCKLLHRNSRVWSKKKKK

SEQ ID NO: 201805 - protein, 133 aa, Triticum aestivum
  unsure (1)..(133): unsure at all Xaa locations
  Clone ID: PAT_TA_96223.pep
MXNXRVFFHMXVXGAPAGRIXMELYKDAVPRTVEXFRALCTGEXXVXKXGKPLHYXXSAFHRVXPXFMCXXXDFTKXNXTGXESIYXEKFSXXKFXHKHNKPGDFSMGNAGXNNKGXQFFIWNVPCNLGPNGL

SEQ ID NO: 201806 - protein, 137 aa, Triticum aestivum
  unsure (1)..(137): unsure at all Xaa locations
  Clone ID: PAT_TA_96224.pep
MITGKDIYHXLXXVVPLYVXMFMAYGSVRWWGIFTPDXCSGIKRFXAVFAVALLSFHFISTNEPYAMDXRFLGADSLXXXVILAXLAVWXXVLSXQRCXGGXKAAKAPXLGWDNXLFSLGKVPKXWXRGIPLLGASM

SEQ ID NO: 201807 - protein, 110 aa, Triticum aestivum
  unsure (1)..(110): unsure at all Xaa locations
  Clone ID: PAT_TA_96225.pep
VCIENKSPLTYXKSFQHITKHIDGLYYFSQQQMPTPAVAFILIIXLASAVNLAHIVALKSCWGLAGFLGYAELRPPXXCITGQEGGRHDPGEPPDKRPERCYLVGAMRSG

SEQ ID NO: 201808 - protein, 147 aa, Triticum aestivum
  unsure (1)..(147): unsure at all Xaa locations
  Clone ID: PAT_TA_96226.pep
AAXRQSNKLHSXXQAKAXXVITHXXPXGMGAXRGAXLVLAMVLXGHGGWRRRATVQRHILLHGXTASLIAVXAVTFXQGRVPRAGGLLHRXSKNLLGRGQKXAPDRPXQFLXGCLQXNVXQXGXPPGGGPKIKPGXGRGVSPPKLEN

SEQ ID NO: 201809 - protein, 133 aa, Triticum aestivum
  unsure (1)..(133): unsure at all Xaa locations
  Clone ID: PAT_TA_96227.pep
WSPRAAXKXGKRYKEGGDLXXXTXRHQNXXXGXEPXQKSXPGXPXTAVSGAMLAVAXNNXASXGXAFWMXPAWGFXAGNXVQAPLQFIXXNXFPGGMXDTNLXMXAGLKSWGRSNGGEQXQQQPRRREGALPN

SEQ ID NO: 201810 - protein, 141 aa, Triticum aestivum
  unsure (1)..(141): unsure at all Xaa locations
  Clone ID: PAT_TA_96228.pep
KGVRRLKPTGGXLRRXISGGAGPFPAAETPFGNHPSPPRPLPALRXPALRSTDQPLGRRVPTPCCGVXPQFRGXQRVSXLXQEFSRFEADXLEREGAXASPRXTSAAATARTPIPXCSCHAPAPAPAPTPPAGGNILDTRS

SEQ ID NO: 201811 - protein, 103 aa, Triticum aestivum
  unsure (1)..(103): unsure at all Xaa locations
  Clone ID: PAT_TA_96229.pep
LIKDLCLIIWSSDDXPCTTSPTRNSXQELXSGEHNXGXGCPPCLGPRCLKXLVMXNXAAPKYKKXEPQSGTNPQGGSKVLAXPWKQTFXXPRSKVGXRXKWXE

SEQ ID NO: 201812 - protein, 112 aa, Triticum aestivum
  unsure (1)..(112): unsure at all Xaa locations
  Clone ID: PAT_TA_96230.pep
DLLXSYSTQPLAAAAADXTTDRPKRWPPPPSRPGAWXSSPSCRSPPSXSSPLXRARRRAPCLAPXAXGAVLAAAXRRXPGAXFLFXAVPAIEXGRLRPFPDRRPSNGXILLX

SEQ ID NO: 201813 - protein, 108 aa, Triticum aestivum
  unsure (1)..(108): unsure at all Xaa locations
  Clone ID: PAT_TA_96231.pep
MATQISKKKKFVSDGVFYAELNEMLTRELAEDGYSGVEVRVTPMRTEIIIRATRTXNVLGEKGRKIRELTSVVQKRFNFXENXVELYAXERSVKPXGSGANAQSLSLR

SEQ ID NO: 201814 - protein, 111 aa, Triticum aestivum
  unsure (1)..(111): unsure at all Xaa locations
  Clone ID: PAT_TA_96232.pep
PSXAXGFXSATXXLVSVXTTAGASASGSAAXAGSGSXVSFASTAAGASSLVSSTSTGAGASTSASTGAGASSVFATSSAATGFSTAGASSVSAADGFWTSAVAIAVVDARK

SEQ ID NO: 201815 - protein, 111 aa, Triticum aestivum
  unsure (1)..(111): unsure at all Xaa locations
  Clone ID: PAT_TA_96233.pep
AKCTFADNKSSRRXIMINCIXSLTRENTLTTPKTNKLXPRDTFIFXNGXAXPSXDIERYFRFMXKKQVXKXSLHKXRVPRXXSXKTPLKXXXAPXGFSXINMXLXAXQNSH

SEQ ID NO: 201816 - protein, 138 aa, Triticum aestivum
  unsure (1)..(138): unsure at all Xaa locations
  Clone ID: PAT_TA_96234.pep
RRLSPRSXGXSSSXLARGGGPHPXASLPMPWXPASQRXGPTXLLVKACXPTSAXATAPSAXAGTPVQNLLLTGLPVXTPNFQFXILYIKXSLHIKFXLQFWLDPTNFFXPKGPTEKNLXKKKKKKNPXGXXVPKXPXK

SEQ ID NO: 201817 - protein, 66 aa, Triticum aestivum
  unsure (1)..(66): unsure at all Xaa locations
  Clone ID: PAT_TA_96235.pep
HLLLXVRNDEELGKLLAGVTIAHGGVIPKINPVLLPKKTAEXXAKAPKSPKKGAKSPKKGATPKKA

SEQ ID NO: 201818 - protein, 116 aa, Triticum aestivum
  unsure (1)..(116): unsure at all Xaa locations
  Clone ID: PAT_TA_96236.pep
EVKCVHKHCTYYMNTYDVRYRGKPHKFKSKHRCDHLCPVRVTRHPCEESKHTYLVXQQKEINIQAEQIAIHTSTRKPHYGIKGEEGLPASNLFLSSRKRILQHRRRPLVXPPFAQS

SEQ ID NO: 201819 - protein, 139 aa, Triticum aestivum
  unsure (1)..(139): unsure at all Xaa locations
  Clone ID: PAT_TA_96237.pep
MAPKAAEKKPVEKTPAGKKPKAEKKVPASKEGGDKKGKKKAKXSVXTYXIYIFKVLKQVHXDIGISSKAMXIMNSFINDIFEKLAGESAXLXRXXKESPXXTSRGDSRPSVXLLPPRKLQGTPSSNKGRSPKFNLRKAP

SEQ ID NO: 201820 - protein, 77 aa, Triticum aestivum
  unsure (1)..(77): unsure at all Xaa locations
  Clone ID: PAT_TA_96238.pep
DAVLLKLQGNSQLVSSSFSAAXKPLALDEGXGPXDXELARRLXALKSRPPXPKRASAAPAPXXGGMDEMEGTFAALK

SEQ ID NO: 201821 - protein, 117 aa, Triticum aestivum
  unsure (1)..(117): unsure at all Xaa locations
  Clone ID: PAT_TA_96239.pep
DPPQGPPXPXWTWXRXTXLPXHPRTTXVVTXNVVNPXXEAPGIHLXXRRGGGPPTPXXKIRSDXXXEXGXRQXQXEPRLHHXLWNALFXMXSXPCGGEXDGXERDXXXGXAMXYPRA

SEQ ID NO: 201822 - protein, 128 aa, Triticum aestivum
  unsure (1)..(128): unsure at all Xaa locations
  Clone ID: PAT_TA_96240.pep
MSGRGKGXXGLGKGGXKRQRKVLRXNIQGITKPAIRRXARXXGVKRISGAHLPXDPAVLLKXFLRERHXAXAVNXDARPPARSTRHGVLCSKRQATLLLDFGLKARPRKLAKARPFRPEKTVSYPFAV

SEQ ID NO: 201823 - protein, 139 aa, Triticum aestivum
  unsure (1)..(139): unsure at all Xaa locations
  Clone ID: PAT_TA_96241.pep
MPPXGSKXDXEPXXRPILGXXSSHLKIGIXGXXNVGKSTFFNXXTKLSIPXENFPFCXIEPNEXRVHVPXEXFDYLWQLFKXXSEXXAYLGINDITGLVLGASAXEGLGXALLSXIXAGXWGSFHVPESIFDTGIXHIG

SEQ ID NO: 201824 - protein, 91 aa, Triticum aestivum
  unsure (1)..(91): unsure at all Xaa locations
  Clone ID: PAT_TA_96242.pep
MKGTKLAAILILQAVLVMGLLSHVNADFFPKCCNNCRSFSGVDVCDDAHPKCPQGCSACRVVSTXSPEMWRCADMKSTVDGTCGGXPCKKY

SEQ ID NO: 201825 - protein, 138 aa, Triticum aestivum
  unsure (1)..(138): unsure at all Xaa locations
  Clone ID: PAT_TA_96243.pep
MSGRGKGGKGLGKGXAKRHRKVLRDNIXGITKPXIRRLARXGGVXRISGLXXLETXGXLKXFLXNDIRXAVTYTXHARRKTVTAMDVVYALKRQGRHPLRASAGKPDGPVLRRLQEFRCVKSRPFPKGGGPGTQIPPI

SEQ ID NO: 201826 - protein, 73 aa, Triticum aestivum
  unsure (1)..(73): unsure at all Xaa locations
  Clone ID: PAT_TA_96244.pep
AAAAHSTVDCSAQGRDGFFPRARGSLFARARGGIFPRAWRVTATTEELLPPASATRHCTGARLSPPPPPRXXS

SEQ ID NO: 201827 - protein, 161 aa, Triticum aestivum
  unsure (1)..(161): unsure at all Xaa locations
  Clone ID: PAT_TA_96245.pep
XGTXSSAXKSSSAXXXXLVNXFVLGIPFSSFGXNGRXLKLARGPRRXPLGTEXWLXLRPLKQNXHFSQRIKKLSSGKISPPLEAFFPXKLSRTIQPGXFCFLGFVLELQRQAPDGATHPXFHPSGXWNKAYPPSFLGSAXSPFELSCFRGAELKAPHSSDC

SEQ ID NO: 201828 - protein, 174 aa, Triticum aestivum
  unsure (1)..(174): unsure at all Xaa locations
  Clone ID: PAT_TA_96246.pep
SRGDLDPHLPPALCSNPPPLTLFLTLQGGAPSPHTLPSRASSTLTRRVPLPLAPCRASLCCHSSCSRRASAPPSSHGARTGLPRTHRGTAPLPSSPAGISFLRPRSPPPSTTPSTGSRCWXLXSVAXIHPSISLCRGSTTRRPELPAGEXXXLRRAHNXAVXXSGHLXLTXKWP

SEQ ID NO: 201829 - protein, 123 aa, Triticum aestivum
  unsure (1)..(123): unsure at all Xaa locations
  Clone ID: PAT_TA_96247.pep
MARLNSKAVVAAVVLAAVVLMMAGREASAALSCGQVDSKLAPCVAYVTGRASSISKECCSGVQGLNGMARSSSDRKIACRCLKSLATSIKSINMGXKVSGVPGKCGVSVPFPIXMSTNCDTVN

SEQ ID NO: 201830 - protein, 177 aa, Triticum aestivum
  unsure (1)..(177): unsure at all Xaa locations
  Clone ID: PAT_TA_96248.pep
GKAQLSFPLSNPLAGARASQASKQDGRQARRRRWRRRSSAGPRKKSVTXSIKXAGLQFPVGRIGRXLKKGRYAQRVGSGAPVYLAAVLEYLATXVLEXLAGNAAKDNKKTGSCPRHLLLAIRNDXELXXLLXGVTIAHGGVXPNIKPVLXPKXAAEKVXRAXPPPSSPKKNNKVPEH

SEQ ID NO: 201831 - protein, 58 aa, Triticum aestivum
  unsure (1)..(58): unsure at all Xaa locations
  Clone ID: PAT_TA_96249.pep
LWEIXYWGYXLLSETLVPPMXFKSVLYLLDTKIQCYATDAXXKXNXKKXKXXXQXKKK

SEQ ID NO: 201832 - protein, 145 aa, Triticum aestivum
  unsure (1)..(145): unsure at all Xaa locations
  Clone ID: PAT_TA_96250.pep
THTHREAKMXGRGKGXKGLRKGGAKRHRXVLRDNIXGITKPAIRRXAXXGGXXRISGXIYEETRGVLXIFLENXIXXAXTYXEHARRKTVTAMDVVYALKXXGRTLYXILRLNARWLQSPCSAMGFVSEFKMRRVVWSGSVFFSG

SEQ ID NO: 201833 - protein, 66 aa, Triticum aestivum
  unsure (1)..(66): unsure at all Xaa locations
  Clone ID: PAT_TA_96251.pep
PFTMLYPSVSHEDTVLFLHCRNVCLPAAAKIQSLVIKKKKKXKKKKKKKKKKKPXGGXEXKIXXKK

SEQ ID NO: 201834 - protein, 185 aa, Triticum aestivum
  unsure (1)..(185): unsure at all Xaa locations
  Clone ID: PAT_TA_96252.pep
RVEQIRASPSYIEEKXEXLPSAHASLLXGNLRQAMNGGPGKAPXXQRNNYLKXADAPSATPGKSAGXXRPPXXPQXRPPXAQXXGGPKGPQTXPKARVRGAAPPKGLKDSHWPERPFKGKGRSPGQPTGMPPRAARPPPGPLPPGQRKGQRSTNGWPGLPRGGVPPLNALGRWAAPPVGGVLALC

SEQ ID NO: 201835 - protein, 109 aa, Triticum aestivum
  unsure (1)..(109): unsure at all Xaa locations
  Clone ID: PAT_TA_96253.pep
NRXAHXRDXXDARQXXRXQRMAAGKGCHXRRGGSSPRPRRARREAKSGESSETSGIADERIVRREGAPRRRTGTGGERTMRSNRAVSAASAMAGSGMWPLGVGGGGLGN

SEQ ID NO: 201836 - protein, 123 aa, Triticum aestivum
  unsure (1)..(123): unsure at all Xaa locations
  Clone ID: PAT_TA_96254.pep
GXEGVKXTIFFTQEGXGPTTXTGSVTGLKEXLHGFHVHALGDTTXGXMSTGPHFNPAGHVHGAPEDEIRHAGDLXNVTXGADGVANINVXDCHIXLTXTKFNCWPVLXVVHXWXXDDLXQGWM

SEQ ID NO: 201837 - protein, 94 aa, Triticum aestivum
  unsure (1)..(94): unsure at all Xaa locations
  Clone ID: PAT_TA_96255.pep
MGIDLVAGGRNKRTKRVAPKSDDVYLKLXVKLYRFLVKEDQRASSNAVILKRGLFNEAKTKPPAALHAXASPNFMEGERXGXRTLLWLLGTITG

SEQ ID NO: 201838 - protein, 57 aa, Triticum aestivum
  unsure (1)..(57): unsure at all Xaa locations
  Clone ID: PAT_TA_96256.pep
EXXDKSDVPXIDXKXYLVPADLTVXQFVYLVRXRIKLXPKKXXFVFXXNTXPXTASL

SEQ ID NO: 201839 - protein, 131 aa, Triticum aestivum
  unsure (1)..(131): unsure at all Xaa locations
  Clone ID: PAT_TA_96257.pep
MVSGSGVCAKRVVVDARHHMLGRLASIVAKELLNGQRVVVVRCEEICMSGXLVRQKMKYLRFLRKRMNTKPSHXPIHFRXPAKIXWRTIRGMIXHXTXRGEGRARGFKAPWRARRPYDDQSWSIPRRSKVS

SEQ ID NO: 201840 - protein, 81 aa, Triticum aestivum
  unsure (1)..(81): unsure at all Xaa locations
  Clone ID: PAT_TA_96258.pep
MASKRILXELKDLXKDPPTSXSXAXPVXEXMFHWXQXTIXGPSXQARSPVXLFLVNIHFPXGLPLQXPPKVSFCTKVFPKH

SEQ ID NO: 201841 - protein, 163 aa, Triticum aestivum
  unsure (1)..(163): unsure at all Xaa locations
  Clone ID: PAT_TA_96259.pep
AMDWIGHGGSDGAHGYVSSLDHAVGDLKEFLEDVVLXENYGLPCFLFGHSTGGAIVLKTALDPCVEVXIXGLILTSPAIHVQPSHPIIKVVAPIFSVLAPKYRVSALHNRGPPVSRDPEALKIKYADPLVYTGPIXVXXGNDILRISSYLXXNLKVEXTVPFS

SEQ ID NO: 201842 - protein, 93 aa, Triticum aestivum
  unsure (1)..(93): unsure at all Xaa locations
  Clone ID: PAT_TA_96260.pep
MXSTSCFLXQXSTARLAXASARPAPAVGRNQLFVCKAQKNDEAASDAAVVTKPARRRCPSSPVPAAIAVKVSPRRPPEPTVFRAAERKNFGCY

SEQ ID NO: 201843 - protein, 150 aa, Triticum aestivum
  unsure (1)..(150): unsure at all Xaa locations
  Clone ID: PAT_TA_96261.pep
PSSHSSPPTQRALPPPPQPWRPRSSKKKKFVSDGVFYAELNEMLTRELAEDGYSGVEVRVTPMRTAIIIRATRTQXVLGEXGRRIRELTSVLQKALQLXRKNGGLXFXPRRXSTVXLCAIPKAXHLRYKLLGXPXRFXRACXXGSPWYQW

SEQ ID NO: 201844 - protein, 123 aa, Triticum aestivum
  unsure (1)..(123): unsure at all Xaa locations
  Clone ID: PAT_TA_96262.pep
SRVPSHRPTWQASLQAAATLMPAKIGXRASSARPSSHVARAFGVDAGARITCSLQSDIREVASKCPDAAKMAXFALXATSALLXVSGASAEGAPKXXTFDXIXAKTYMEVNGTGTANXCPTIY

SEQ ID NO: 201845 - protein, 73 aa, Triticum aestivum
  unsure (1)..(73): unsure at all Xaa locations
  Clone ID: PAT_TA_96263.pep
RRRRPRWRSRSPPRRSRRRRKPPRRWRPKSRRLPPSRLRRPRRRRRQQXEAEETKEPEPASCGRTGGRARRGL

SEQ ID NO: 201846 - protein, 91 aa, Triticum aestivum
  unsure (1)..(91): unsure at all Xaa locations
  Clone ID: PAT_TA_96264.pep
MSGRGKGGKGLGKGGAKRHRKVLRDNIQGITKPAIRRLARRGGVNRISGLIYEETRGVLKIFLXENVIRDAVXYTEHAXRKTXTAMDVVXA

SEQ ID NO: 201847 - protein, 158 aa, Triticum aestivum
  unsure (1)..(158): unsure at all Xaa locations
  Clone ID: PAT_TA_96265.pep
INVENVEDXRRALRELLFCTPGALQYLSGVILFEETLYQSTKGGKPFVDILKAGNVLPGIKVDKGTIELAGTNGETTTQGFDDLXKRCAKYXEAGARFPKWRAXLXIXATEAXAALHRTKRSRSSLCHHLPRRMVLVPLWSLRFLLMLNIDRRLHRRS

SEQ ID NO: 201848 - protein, 142 aa, Triticum aestivum
  unsure (1)..(142): unsure at all Xaa locations
  Clone ID: PAT_TA_96266.pep
PSEAHSTRAXWKMQSQEKITPVKPVASRPFSSFTSFSKLXKDFTVTGSATISSPXETVIFXRPKVXRFAPPPSDLXAGIAATMLQDAGLDTTHEKMVIDPEQVVPCDQMTGIPPXQQXKFMAVXKXSVLTMXTNLXXKLWGK

SEQ ID NO: 201849 - protein, 104 aa, Triticum aestivum
  unsure (1)..(104): unsure at all Xaa locations
  Clone ID: PAT_TA_96267.pep
TXGISDTKSXCPFRKRKAHIKRHRVPSSVQERRMAAAAPEHEHVGGGDCGXREFERMRWRWRRRRCYGARTRPSCHTNASSPXGRQPVVLXTVPGSGTILFPSS

SEQ ID NO: 201850 - protein, 158 aa, Triticum aestivum
  unsure (1)..(158): unsure at all Xaa locations
  Clone ID: PAT_TA_96268.pep
VLTASSQSLASFPRRHPPRKGGCLAAAATAGAAPAASAATXAAGARCSPXWRPPPAPPPWSCPPPPTRGAPAGXRRPGRPAAATAPPASAAPRAAAPAAAATEPXPIILAATRIEEGASKHHHQVHQALSFTKPPPCRLAGSRLNIPTGSRLTSCMPL

SEQ ID NO: 201851 - protein, 117 aa, Triticum aestivum
  unsure (1)..(117): unsure at all Xaa locations
  Clone ID: PAT_TA_96269.pep
MGXEKTHINIVVIGHVDSGKSTTTGHLIYKLXGIDKRVIXRXFEKEAAEMNKRSFKYAWVLDKLKAXREXRGITIXXALWQFEXTXYHXTVIXDAPGHPXXSXKNMXXXVPPQRTCA

SEQ ID NO: 201852 - protein, 84 aa, Triticum aestivum
  unsure (1)..(84): unsure at all Xaa locations
  Clone ID: PAT_TA_96270.pep
MGGGNAQKSKMARERNLEKLKGGKGSQLEANKKAMNIQCKICMQTFICTTSEXXCKEHAQAKHPKEXSSSKCFPHLKAVDLNQD

SEQ ID NO: 201853 - protein, 165 aa, Triticum aestivum
  unsure (1)..(165): unsure at all Xaa locations
  Clone ID: PAT_TA_96271.pep
DTVHXHWKHSDIKLKDDKTLLFGEKPVTVFGVRNPEEXPWGEAGADYVVESTGVFTDKDKAAAHLKGGAKXVVISAPSKDAPMFVVGVNEDKYTSDVNIVSNASCTTNCLAPLAKIINDNFGIIEGLMTTVHSITATQKTVDGPXSXKDWXSGKGXSFYIIPNNT

SEQ ID NO: 201854 - protein, 130 aa, Triticum aestivum
  unsure (1)..(130): unsure at all Xaa locations
  Clone ID: PAT_TA_96272.pep
MGRTVTVPGXSVPSTPLLKDELDIVXPXIRNLDFLQMWXPFFQPXXLIIVQDXEPNKXIKXPEGFDXELXNXRNEINRILXPKGSCISXKXDSAXRCFXYMGSKKKYVFNNDERLLSWAKAHLGKEINAP

SEQ ID NO: 201855 - protein, 77 aa, Triticum aestivum
  unsure (1)..(77): unsure at all Xaa locations
  Clone ID: PAT_TA_96273.pep
DGHQDNQAPKIFPLSPNPDATNLLLNELGRIGLCRASXSFRXFPWAILGLQALLSFTRLLPFLPDKISSMWHGXWTC

SEQ ID NO: 201856 - protein, 154 aa, Triticum aestivum
  unsure (1)..(154): unsure at all Xaa locations
  Clone ID: PAT_TA_96274.pep
MYTARKKIQXDKGVXPSEFXDTVAXAFFDLEXNGNQELKSDLKDLYINTAIQMDVVGNXKAVVIHVPYRLRKPFXKIHVRLVRELEKKFSGKXDVVFVATXRIVRATKKXSAVQRPPTKNLTAVHDGILGGCRVPTXIVGKRVKYRLDGAKGIK

SEQ ID NO: 201857 - protein, 89 aa, Triticum aestivum
  unsure (1)..(89): unsure at all Xaa locations
  Clone ID: PAT_TA_96275.pep
NEREYTNKSTRRMEGKTTLCFLTVLLLLXNCADAETCKEHRANKGAACINEGCWADCARDYHGHYVKNAYCTGVYPFTKVYCVCDVCEE

SEQ ID NO: 201858 - protein, 89 aa, Triticum aestivum
  unsure (1)..(89): unsure at all Xaa locations
  Clone ID: PAT_TA_96276.pep
ISKXPTQNXXSLITNXXWXXLTLPKLACLLAGXQCEGKQPXKYCMGETXGXXGGGPXYPIPPXNESFLRPAHWXVXLKRXGTGGKNPGX

SEQ ID NO: 201859 - protein, 146 aa, Triticum aestivum
  unsure (1)..(146): unsure at all Xaa locations
  Clone ID: PAT_TA_96277.pep
MXKETMRVLVTGAAXQIGYALVPXIAXGIMLGANQPVILHMLDIEFAAEALKXVKMELIDAAFPLLKGVVATTDVVEACTGVNVAVMVGGFPXRKEGMERKDVMTKNVSIYKAQXASALEAHATPNCXGLVVCXPXNNNAPQPERS

SEQ ID NO: 201860 - protein, 163 aa, Triticum aestivum
  unsure (1)..(163): unsure at all Xaa locations
  Clone ID: PAT_TA_96278.pep
TGGRFHHPFSTLARSQWEVRPWRRPXPKSXLFVGINKGHVVTKXPELPPPPSDRKGKGTKRVHFVKNLIKEVAGFAPYEKRITELLKVGKXDKRALXVXKXKLGTHKENKXGKEKEMSKLSLRKNEGPAWWWCWVTKKENKNFGPGEFIPGSKSPCINKSRYL

SEQ ID NO: 201861 - protein, 115 aa, Triticum aestivum
  unsure (1)..(115): unsure at all Xaa locations
  Clone ID: PAT_TA_96279.pep
LGVXSSWLPCCXWLXVAPVAXSIXLXIXGXXLGGKPQPPQFQIVAFRLXRICSQPLRKRGVQSSSFSARHFHSSSKATHRXVLXLPXAFCCFPIPXIFFXIXGXSXCCLLGSFLI

SEQ ID NO: 201862 - protein, 110 aa, Triticum aestivum
  unsure (1)..(110): unsure at all Xaa locations
  Clone ID: PAT_TA_96280.pep
RPPGRKKATMGIXLXAXGEXKKXDKAPSRPKSERFXTQSSXVKALTFPGEGGTKXQSLTPVILKXGSSMSKEQTXPPALQWRRPLQTXMXGKRGGEKNICWWVVWYNQQD

SEQ ID NO: 201863 - protein, 156 aa, Triticum aestivum
  unsure (1)..(156): unsure at all Xaa locations
  Clone ID: PAT_TA_96281.pep
GAAGSFAAAVSSAAAVVSWGRPQPPWAAGAXXSFTSWTTXGFASATASLXFVXTTVGASASXSAAXAGSGSLFSSVSAAAGASSLVSSTSTGAAGVXTSATAXVGASSVFATSSATRVVSTAGXSSVSATAGFWTSAVXIXXVDARKCPWQKVVSS

SEQ ID NO: 201864 - protein, 149 aa, Triticum aestivum
  unsure (1)..(149): unsure at all Xaa locations
  Clone ID: PAT_TA_96282.pep
LSSSRFRTKEEPGARRAKGREETTEPARTRAPRRAEMGLTFTKLFXRLFXKKEMRILMVGLXAAGKTTILYKLKLGEXVTTIPTIGFNVETXEYKNINFTVWDVRGQXDKXKALWRXYFQNNQGLIFVVXNNDXXRVVXXKNXLHRMLN

SEQ ID NO: 201865 - protein, 103 aa, Triticum aestivum; identical to SEQ ID NO: 107316
  Clone ID: PAT_TA_96283.pep

SEQ ID NO: 201866 - protein, 120 aa, Triticum aestivum
  unsure (1)..(120): unsure at all Xaa locations
  Clone ID: PAT_TA_96284.pep
KIQNLSYLPTLXTXALLKXVDYLIRSKWVPCLEFSKVGFIFREHNASPGYYDGRYWXTMWKLPMFGCTDATQVINEVEEVKKEYPDAYVRIIGFDNMRQVQCVKXSIAFKPPGCEESGKA

SEQ ID NO: 201867 - protein, 141 aa, Triticum aestivum
  unsure (1)..(141): unsure at all Xaa locations
  Clone ID: PAT_TA_96285.pep
GQQLFEGNFGXFVPAGTFVQSGFPIGXGLAGXFSAGAPLSLQLRCFXAGLQPLRSSQDCXLVRRAFASWEQGXFVVPTLRELAAVTFAFARPVVAGPAEXRLAGLLAPXGTRGPWRRLPVVRQLLDAFGXEKGRDPKSWLX

SEQ ID NO: 201868 - protein, 144 aa, Triticum aestivum
  unsure (1)..(144): unsure at all Xaa locations
  Clone ID: PAT_TA_96286.pep
GNEGVKGNIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVXRAVVVHGDPDDLGKGGHEXLSKSTGKRWPVLPCRHPGSKG

SEQ ID NO: 201869 - protein, 155 aa, Triticum aestivum
  unsure (1)..(155): unsure at all Xaa locations
  Clone ID: PAT_TA_96287.pep
MAPKAEKKPVAEKAEKTTAAKKTKAEKRPPASKEGGEKKGKKKAKKSVETYKIYIFKVLKQVHPDIGISSKAMSIMNSFINDIFXKLAGESAKLARYNKKPTITSXREIQTSVRLVLPGELAKHAVSXGTKAVTKFXSRLSLLCLLGRDGNCFII

SEQ ID NO: 201870 - protein, 178 aa, Triticum aestivum
  unsure (1)..(178): unsure at all Xaa locations
  Clone ID: PAT_TA_96288.pep
LARTRPLKEARMGRXXDXRFCQAGLRMGAPQRLRHGLGPLHPLLQPVRCADGHQGRLLXRPLDXDSVLRWXPSERXGAGRCCSHAAPAGXSVNWGKLLGPRVARRWATAMFQRGQSTSSNQGVLXXQLGLRFXXMXGAXIXWXXMXXPTLVKVKDWRXLGENKXXTXAKPXLKFWPNC

SEQ ID NO: 201871 - protein, 109 aa, Triticum aestivum
  unsure (1)..(109): unsure at all Xaa locations
  Clone ID: PAT_TA_96289.pep
FLRNXSPFSLILEYNNFVYTFFGRXXXXSXCXPNWLVIXPXXWGRAWNSPRGGLXPWVNRPLKPIEXLXWGGGVILSRCTEQKAPKHSHQXXIFKKYAKWIACHRLVSG

SEQ ID NO: 201872 - protein, 109 aa, Triticum aestivum
  unsure (1)..(109): unsure at all Xaa locations
  Clone ID: PAT_TA_96290.pep
SSIPSRGSSGGLWLMWTDEAXVSVYNASFHAILTNVVHVASGVEFCLVCIYGDPYHPQTTVIWNXVATFVYDNLXKPMICMGDMNDILYDINKCNAKCELLSKKKKKKK

SEQ ID NO: 201873 - protein, 116 aa, Triticum aestivum
  unsure (1)..(116): unsure at all Xaa locations
  Clone ID: PAT_TA_96291.pep
XELVTGPPPWTRLELDLGGWRQIRRXPPRERGGARLVGDQFLGPXGLESRKARXXIXPPSFXPAGRAGDGGVHRNXFNRSVRSVQFRXRGFPGGXESWELGFVSLGTRESQGGGRL

SEQ ID NO: 201874 - protein, 63 aa, Triticum aestivum
  unsure (1)..(63): unsure at all Xaa locations
  Clone ID: PAT_TA_96292.pep
PKGSATGEQMKXDTXYGEFGFIVXXQMIHMXSVPQXXXCDXDXHXXTXFXVFFPXQAAXEQXS

SEQ ID NO: 201875 - protein, 163 aa, Triticum aestivum
  Clone ID: PAT_TA_96293.pep
AALPRSHPPRILLCLHPSISSHIGGEESSAPARFRAAGGPPLSFCRTASPSCVNPDGSEELRAGSGRPTSSCGLRCLDAFPMPPSPAPTPLATLKSDAIWSSSSIWSKDEDYKRLGNGSSFCVAAACVACFVGERTGVCRPISFNFAVATVYRASSMCCCYSK

SEQ ID NO: 201876 - protein, 162 aa, Triticum aestivum
  unsure (1)..(162): unsure at all Xaa locations
  Clone ID: PAT_TA_96294.pep
TNEATTTTWIITKWSCGADVTNASXAIGNGLACFSTSTPARTNDATDTTTSAERIESPADCAGAAATSXLNAQHLNQQQRQQQQASPRMXASAAGKPANTAGSQPATPSSGGTAAGANAPHQGGGNCSQLIGKRKIHDLVAQVDPQCEVDPKVEDLILEIAD

SEQ ID NO: 201877 - protein, 110 aa, Triticum aestivum
  Clone ID: PAT_TA_96295.pep
MSSSEVACTLAALILHDDGIPITSEKIATVVKAAGIKVEAYWPALFAKLLEKRSVDDLILSVGSGGGGAPAAAAAAPAAGGAAAAEEKKEEKKEEAKEESDDDMGFNLFD

SEQ ID NO: 201878 - protein, 145 aa, Triticum aestivum
  unsure (1)..(145): unsure at all Xaa locations
  Clone ID: PAT_TA_96296.pep
MPAGHGLRSRTRDLFARPFRKKGYIPLTTYLRTYKVGEHVDVKVNGAVHKGMPHKFYHGRTGRVWNVTKRAIGVEXNKQVGNRIIKKRIHVRVEHVXQPSKCNEGVPPXEAQXRQSLKGXGQSAXEVINTKEGSQQGPSLGXMXG

SEQ ID NO: 201879 - protein, 90 aa, Triticum aestivum
  unsure (1)..(90): unsure at all Xaa locations
  Clone ID: PAT_TA_96297.pep
RAWLVRXPPXGRRFVFXXRGAAQALGXXDVGRGXPXHVAFLGDGGVPREEGRAARGREPRRXPXRLCXCVRYXGRGRGAKASALLCSDCL

SEQ ID NO: 201880 - protein, 90 aa, Triticum aestivum
  unsure (1)..(90): unsure at all Xaa locations
  Clone ID: PAT_TA_96298.pep
RFSPAXREGDAXTGSPHDRERGSRSKTXGGPXXRGGAPRRXMGAEARGEFKWRARLALQLDGVGVERRGGEMXXAEEKFRGRRGGGDERG

SEQ ID NO: 201881 - protein, 119 aa, Triticum aestivum
  unsure (1)..(119): unsure at all Xaa locations
  Clone ID: PAT_TA_96299.pep
PNPTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQXGRTLYGFGG

SEQ ID NO: 201882 - protein, 122 aa, Triticum aestivum; identical to SEQ ID NO: 132374
  Clone ID: PAT_TA_96300.pep

SEQ ID NO: 201883 - protein, 52 aa, Triticum aestivum
  unsure (1)..(52): unsure at all Xaa locations
  Clone ID: PAT_TA_96301.pep
XGSXKRATKKPPKGLHNGRFSAHHPLRSSRSWPWPRPLRRPERXPRQXPQGP

SEQ ID NO: 201884 - protein, 181 aa, Triticum aestivum
  unsure (1)..(181): unsure at all Xaa locations
  Clone ID: PAT_TA_96302.pep
GGRSSFVGEAWGGRNEGAESRQPGARAXSFGKGGGVAXLWDXGRSLXLEXXSEGXGXXPDAEQASXRXMEIXRATGCSGRXCPFLEQFVGAGXKLXRRTVAWTPGLRHLKLETLNDDPENXPGDGNNLTXXYPASFXLXTAXXLFXXPRWVGLFLTXRFRXLALPXAFAGGVSSEFLXARX

SEQ ID NO: 201885 - protein, 125 aa, Triticum aestivum
  unsure (1)..(125): unsure at all Xaa locations
  Clone ID: PAT_TA_96303.pep
NPKXXXAXXETKPRAXGCPGXFXXXLDCLDXKTXXHGRMQWXXGIAIDXXGXNRMXLDLDLXFGIVXXKXNSKCXTNXXPXYYHXXSXSXKGGEXMKXRXQXSVXGXTXXXRGXWXXXFXFTXPG

SEQ ID NO: 201886 - protein, 157 aa, Triticum aestivum
  unsure (1)..(157): unsure at all Xaa locations
  Clone ID: PAT_TA_96304.pep
SKPSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAXESKERRKMSWEXEKSDDDMGFXPVRLSCGATLCLKYPIPWRKLSNDVFF

SEQ ID NO: 201887 - protein, 133 aa, Triticum aestivum
  unsure (1)..(133): unsure at all Xaa locations
  Clone ID: PAT_TA_96305.pep
RPPGRRPSARAASPCARRRGKPKVAASSSPWYGSDRVLYLGPLSGDPPSYLTGEXPGDYGWDTAXLSADPRDLRQEPXSWEVXHCRWAMLRRARXXSSRSCSPANGVKFXEGRXXSRAGSQXFKXRGPRLTSG

SEQ ID NO: 201888 - protein, 172 aa, Triticum aestivum
  unsure (1)..(172): unsure at all Xaa locations
  Clone ID: PAT_TA_96306.pep
PHTTPASSLGAGGGACKEQWQPVFSLGGSCWGGLCSPPSPGRLPPGKSPFVVRASSNPPAKQNDNRQLWFASKQSLTYLDGTLPGDFGFDPLGLSDPXGTXRVQSNPSXWXYGEIFNGRDRRILGGXWGXXPPGXPXGKXGXWVXPGXREFXWFQXXXAIXPGXGPTNYWXR

SEQ ID NO: 201889 - protein, 123 aa, Triticum aestivum
  unsure (1)..(123): unsure at all Xaa locations
  Clone ID: PAT_TA_96307.pep
TPXGRCCXNKIXGITKARHPPPXSEGRXEAISGLIYXETXWRAQRSSSKNVIREXPSPKPSTPRRKDRHRHGXSSTRSKXXGPAPSYXFGXVRLFPXPPLXXSQKSLGXTPXXFVLXSPVCPV

SEQ ID NO: 201890 - protein, 30 aa, Triticum aestivum
  Clone ID: PAT_TA_96308.pep
KVLDRMHLTVYKSIICMVLLFKFITLSLFT

SEQ ID NO: 201891 - protein, 156 aa, Triticum aestivum
  unsure (1)..(156): unsure at all Xaa locations
  Clone ID: PAT_TA_96309.pep
QXXDSSXILRXKGPPNFLXFQGXXVXSNCLQKILRELNAXSGEQDLQRLLTKLKEGSTXEIWXETKKTKLPGRRKSXQLCSXQKKKKGPXVQLGXRESQXIXGANKWXEGQEEKPSXGLXSKGTLKTCLKNKKPISPNGXKLXPGNLEKXEHWXNQ

SEQ ID NO: 201892 - protein, 129 aa, Triticum aestivum
  unsure (1)..(129): unsure at all Xaa locations
  Clone ID: PAT_TA_96310.pep
NIEGKXKWXRMAHYXTXLPSPESWPDAGMVPIAPAGAPNVVVAXPSLGLHIGVVARADGRAGPTRQRCAAAALPFLAAPITVTXCNLQEPCLSRGASPVCAETRPGRNGKGLRDQTHLRSWHPSLWRRL

SEQ ID NO: 201893 - protein, 126 aa, Triticum aestivum
  unsure (1)..(126): unsure at all Xaa locations
  Clone ID: PAT_TA_96311.pep
MAAPRGAAXVLAMVLAAMVVAPPATVHAAISCSTVYSTLMPCLQYVQXGGSPGPGXCTGIQNLLXXPTTAPDRRNICGCLKKVAKRAPPXGPXLTRAAGAPLQSATFAPXLTRXAPSVDCNSDETN

SEQ ID NO: 201894 - protein, 94 aa, Triticum aestivum
  unsure (1)..(94): unsure at all Xaa locations
  Clone ID: PAT_TA_96312.pep
NGFLVFXMNPIVXQLDLPLWSLFFXQFWESXFFIIPXGSWFPCYLGIRYRNSWYYLSSQVFSPGASIGXCFLAMKFEIAICLFVXTXISLILGT

SEQ ID NO: 201895 - protein, 117 aa, Triticum aestivum
  unsure (1)..(117): unsure at all Xaa locations
  Clone ID: PAT_TA_96313.pep
XKNFXXNXTLKRQXXNRAPYLKVPGXXWKXAELTRXRRNGXHPLPRQVXXGSQPAAQRHHIRKLQHTVTTPISVLGSLAXIFRXFLXSASSCXXSFHLALMVGRLLXEISLXAXXAX

SEQ ID NO: 201896 - protein, 140 aa, Triticum aestivum
  unsure (1)..(140): unsure at all Xaa locations
  Clone ID: PAT_TA_96314.pep
MARLNSKAVVSAVVLAAVVLMMAGREATAXCXCGQVDSKLAPCVSYVTGKAPSISKECCSGVQGLNGLARSXPDRKIAWKCLKSLATSIXSINXDKVSGVPGKXCASAXPFPIXMSTNXNKCQLSSIYNPSDVHKDLVVL

SEQ ID NO: 201897 - protein, 124 aa, Triticum aestivum
  unsure (1)..(124): unsure at all Xaa locations
  Clone ID: PAT_TA_96315.pep
TGGFEAGISXDXQTREHALLAFTLGVKXMICCCNKMDATTPKYSKGRYEEIVKEVSSYLKKVGYNPDKVPFVPISGFEGDNMIERSNNLDWYKGPTFLRPWDXXNEPKXPSRQSPLRLSPSRTL

SEQ ID NO: 201898 - protein, 50 aa, Triticum aestivum
  unsure (1)..(50): unsure at all Xaa locations
  Clone ID: PAT_TA_96316.pep
NRXPKTSSTGTGLAKNHHPQVGGTAPPIXGPQAXVTTTHKQCDMLAHNGG

SEQ ID NO: 201899 - protein, 94 aa, Triticum aestivum
  unsure (1)..(94): unsure at all Xaa locations
  Clone ID: PAT_TA_96317.pep
MSCCGGNCGCGSGCKCGNGCGGCKMYPEMDEGVNTASQTLIMGVAPSKGTPSFEAAAENGGCKCXPNCTCNPVHLQVIHEASIKSDQGDGMGWT

SEQ ID NO: 201900 - protein, 132 aa, Triticum aestivum
  unsure (1)..(132): unsure at all Xaa locations
  Clone ID: PAT_TA_96318.pep
LKKVCFKRGPGPFVRXVEGWSPTAASKSPPGTPGRTQFFEXLARGLPXAPLXSXPGAAPLPGRALRGNRLGQQAASNAPVXTQXGAPAAGRKAXVDXIVALAVLVGYLXLASAFASLAXGGGGQGGGSVECG

SEQ ID NO: 201901 - protein, 132 aa, Triticum aestivum
  unsure (1)..(132): unsure at all Xaa locations
  Clone ID: PAT_TA_96319.pep
MATXXNTTEEEPTLAVVRSTXQLAWADAGAEVXDPEVARLCAEGHQHALAGRWLXMASLMLANAXLLLXAPTAPEQSRXXSKCVLXVICKLVNXARVGALNQGSSGAKAPTNPGGQAQLQSKLFNCNLVEAS

SEQ ID NO: 201902 - protein, 71 aa, Triticum aestivum
  unsure (1)..(71): unsure at all Xaa locations
  Clone ID: PAT_TA_96320.pep
EXXXGXGXKXLXGXLLFGGWPXXKARPXSXVTPSXXMIXSPSPFLXYGNPWXRLAYSRTRTEPEXEPEGEL

SEQ ID NO: 201903 - protein, 116 aa, Triticum aestivum
  unsure (1)..(116): unsure at all Xaa locations
  Clone ID: PAT_TA_96321.pep
MAXQLTDEQIAEFKEAFSLFDKDGDGCITTKELGTVMRSLGQNPTEAELQDMINEVDAXDGNGTIDFPEXFLNLMXKERLKGTRDSEGSSREAVPRCLKGPRTGFHLGRAGCAHGD

SEQ ID NO: 201904 - protein, 85 aa, Triticum aestivum
  unsure (1)..(85): unsure at all Xaa locations
  Clone ID: PAT_TA_96322.pep
MSCCGGNCGCGSGCKCGNGCGGCKMYPEMDEGVNTTSETLIMGVAPSKGTPSFEGRRXDRGPRNGGCKXCGPQTCNLNPVATLQR

SEQ ID NO: 201905 - protein, 106 aa, Triticum aestivum
  unsure (1)..(106): unsure at all Xaa locations
  Clone ID: PAT_TA_96323.pep
FGTTAXVSHLXVAAARQSPAXAXWAVKGADALCNXSSXPXXPSPRXPHQGRWXEQGSFKRAIFLTXXRXVQASPPSPXNSRXLNNXPXXXNPARKXXMLRGGGXXV

SEQ ID NO: 201906 - protein, 72 aa, Triticum aestivum
  unsure (1)..(72): unsure at all Xaa locations
  Clone ID: PAT_TA_96324.pep
FFILQNENHWGNKFDWHTRENDQCXIFLXRTXDLLIPLHQMCGRFLRRSDTSTSDLXWTLXGPWRIXATPRN

SEQ ID NO: 201907 - protein, 90 aa, Triticum aestivum
  Clone ID: PAT_TA_96325.pep
CGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 201908 - protein, 75 aa, Triticum aestivum
  unsure (1)..(75): unsure at all Xaa locations
  Clone ID: PAT_TA_96326.pep
MKGTXLAAILILQAVLVMGLLSHVNADFFPKCCNNCRSFSGVDVCYDAHPKCPQGCSXCRVVSTXSPEMWRCAGX

SEQ ID NO: 201909 - protein, 132 aa, Triticum aestivum
  unsure (1)..(132): unsure at all Xaa locations
  Clone ID: PAT_TA_96327.pep
GKGLPIPQWQPGPKDPAERAGRRSTHGAPRAAFIAKVFCPVGRPNFLLRISLYLDVPPSKWPLFGAPSPXSIFGKMTQGLLYIGLSHHNRRHLILDLHPEPTETEQFLSKHTTTRTPLARMFFLCTIHHQPL

SEQ ID NO: 201910 - protein, 133 aa, Triticum aestivum
  unsure (1)..(133): unsure at all Xaa locations
  Clone ID: PAT_TA_96328.pep
ATVSWFCYFSACRLWVIWELQVGIKCWERGIDWNLCFFQKKKKKKLRGGGARVPKFRPIRWKSVINAALNWARRFTNVPLXWGKNPWAVTQNLNPPWQATIPLFRPSLGGKXRKXRPRQPDXXPFPKQVCXNP

SEQ ID NO: 201911 - protein, 66 aa, Triticum aestivum
  Clone ID: PAT_TA_96329.pep
ETHTILYLTEENLIFADSLGTFYCSVHCFCMHIMVMDPTPVSASNGLCTAKNIFHLVMISALPLPA

SEQ ID NO: 201912 - protein, 77 aa, Triticum aestivum
  Clone ID: PAT_TA_96330.pep
LNFFLQGWIEQASLISFPVDDLLNHRPEDLKRHWFGYKVISTGTHERLHGVIISGHPDDLHIGDSHSTDLHDCLRTG

SEQ ID NO: 201913 - protein, 68 aa, Triticum aestivum
  unsure (1)..(68): unsure at all Xaa locations
  Clone ID: PAT_TA_96331.pep
DGWTGGRGXQGGXMXGESPXGXCIVXSWFGRXQWDEGRIXPPAFTXLQKPAQPXVNGXADIHLPXRXX

SEQ ID NO: 201914 - protein, 132 aa, Triticum aestivum
  unsure (1)..(132): unsure at all Xaa locations
  Clone ID: PAT_TA_96332.pep
TREARLPTKILWMRRMRVLRRLLRKYREAKKIDKHMXQXMYXXXKXNXFKNXRVXMXSIHKSXAXKAXEKTXSDQFEAKRAKSKASRERKXXRREERLAHGPXDHAPAPAAGAPAPASKRHQRRRPRSEGLT

SEQ ID NO: 201915 - protein, 135 aa, Triticum aestivum
  unsure (1)..(135): unsure at all Xaa locations
  Clone ID: PAT_TA_96333.pep
MASIAGSAVSFAKPVKAINTNSLSFSGARRGNAFLRLQSVXPMRFAVCCSAKQDTVXKVCEIVXKQLAVPEXTEVCGTTKXFSDLGAEFNWDTGRLMGALEGREFPRSRGGRTCPRQICQVWKAANASIEQALSS

SEQ ID NO: 201916 - protein, 130 aa, Triticum aestivum
  unsure (1)..(130): unsure at all Xaa locations
  Clone ID: PAT_TA_96334.pep
MATISAAAATTVVARAAIARPQALGLPQLRTRSERVRCSYSKDAKEATPAAAVRGAGASLLAAAGAVTASAGPALALVDEXRMSTEGTGLSLGLSNNLLGWILLGVFGLIWSLYTVYTSGLDEDEESGLS

SEQ ID NO: 201917 - protein, 102 aa, Triticum aestivum
  unsure (1)..(102): unsure at all Xaa locations
  Clone ID: PAT_TA_96335.pep
MKGTKLAAILILQAVLXVMGLLSHVNADFFPKCCNNCRSXFSGVRRLRTNAQPKVVPKGCSACRVVSNQAPEMWRCRGIMKSNRXTATCGGTLRKYWGNARE

SEQ ID NO: 201918 - protein, 130 aa, Triticum aestivum
  unsure (1)..(130): unsure at all Xaa locations
  Clone ID: PAT_TA_96336.pep
MDASATVAGAKAKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAXGVTIAHGGVLPNINPVLL

SEQ ID NO: 201919 - protein, 137 aa, Triticum aestivum
  Clone ID: PAT_TA_96337.pep
STRICGCFFSSWVLKKAQRWSILNCNLFGAVFLIPYEIIRHFGVWRYTVKVTNKLFSFYNVQCIYKLILCTFVNEVTIVESMDMALPKLYAAENGGRGGATPWEDTSACCYEVCDGTTNCLGFTSSTDPTLPWRRVF

SEQ ID NO: 201920 - protein, 100 aa, Triticum aestivum
  Clone ID: PAT_TA_96338.pep
AKSRMGMQPILCLLPARHRPDPPRPQPRHRRRQPCASSPSPQNENARHKQGKTIASLLRGAAAPTLLDAMQGRGRCGAGRGLIPSLIYVCLHMLCGCKER

SEQ ID NO: 201921 - protein, 147 aa, Triticum aestivum
  unsure (1)..(147): unsure at all Xaa locations
  Clone ID: PAT_TA_96339.pep
RSPVDARSPRRRDVRVRAPPQGPGAAGVGPQPDLQDLLPRLAPTNPRDDYQHWIKDMRHSNKIRDEEGYPAFALVNMVTGECIKHSTGXGHPVKLVPYNPAYXDESVLWTESRDVGKGFRCVRMVNNIYLNFHAFHGDKGHGGVHEG

SEQ ID NO: 201922 - protein, 125 aa, Triticum aestivum
  Clone ID: PAT_TA_96340.pep
AKPPAASVIGIAGIGMAELLPRVELDLKRASARVIDKAKEHCSHVADVSYEVKEGDARNVLCEAVERHHADMLVMGSHGYGAFKRAVLGSVSDYCTHNAHCTVMIVKKPKHHKKHEQLGFHRKEA

SEQ ID NO: 201923 - protein, 161 aa, Triticum aestivum
  unsure (1)..(161): unsure at all Xaa locations
  Clone ID: PAT_TA_96341.pep
LFSPIXLIXVXTXXXNXFXXFSRXEKEFFLEVXFKXGXMEHSLKLRRFXTILSTPVXNVLRREPYSWRAATPQXETRTLSSGGLGXXTXSXSVARGRDRGRVAGXLRXPGLAWRGRRAGRDEKVGGRRXSPWERSCWPGSARERNGEVLGFWVWGGEGKAX

SEQ ID NO: 201924 - protein, 61 aa, Triticum aestivum
  unsure (1)..(61): unsure at all Xaa locations
  Clone ID: PAT_TA_96342.pep
RTXASXXLGYIPXHLARTPKTXXTPLNTLPQPRXLLWVXXSIALPMXXVYLQARRTVXSVL

SEQ ID NO: 201925 - protein, 87 aa, Triticum aestivum
  Clone ID: PAT_TA_96343.pep
FFFFFFFFFFFFFFFFLARCSLLSSGLQFFHIVNFRRTKVLFGSSPENAQGEKKQKQIEAQLSEIEVGSRRRGGDAYGRKRDTGSGG

SEQ ID NO: 201926 - protein, 66 aa, Triticum aestivum
  unsure (1)..(66): unsure at all Xaa locations
  Clone ID: PAT_TA_96344.pep
MPRHIALLLLLLXSXRAXSAVXAGACAXEKFPXGXTYAXXQDLPHXGAXLHWXYDXAXSXLXXAFV

SEQ ID NO: 201927 - protein, 41 aa, Triticum aestivum
  unsure (1)..(41): unsure at all Xaa locations
  Clone ID: PAT_TA_96345.pep
FFFXFFFFFFFFFFFFFNKHKIIDSKTTQNRVKSDHHNIQI

SEQ ID NO: 201928 - protein, 99 aa, Triticum aestivum
  unsure (1)..(99): unsure at all Xaa locations
  Clone ID: PAT_TA_96346.pep
RVSHIHSLIHQDGGVRAPXRPLRRHPRSCWPPRSSPRPGRPPSPPSPPSSSICPRXPRRXRATPSGSRRHXXSPRXPPVPDPEAXGLSRPPGRAAVRVR

SEQ ID NO: 201929 - protein, 92 aa, Triticum aestivum
  unsure (1)..(92): unsure at all Xaa locations
  Clone ID: PAT_TA_96347.pep
YKTKKAIQIHTIHYDIVLIIITRTPSYSIFTRYXVQSHFRFSPGPHTLHLHPSGLHSAVQVHSGQIWRAWRQTNRQPGRSHGKGVGLIAPAQ

SEQ ID NO: 201930 - protein, 75 aa, Triticum aestivum
  unsure (1)..(75): unsure at all Xaa locations
  Clone ID: PAT_TA_96348.pep
TPLTSAPRRGSFPXVLRXRGXSXMAXSPFPKRLXXQSXYSXLXKLFLXXRWPFXXSLEXXXKPEGXSGKENXGET

SEQ ID NO: 201931 - protein, 91 aa, Triticum aestivum
  unsure (1)..(91): unsure at all Xaa locations
  Clone ID: PAT_TA_96349.pep
GGGGASGXSFPPXRLRRWGHQPPRSKSPEDKGAEVTRPVPNHQNRRGLVPLRSATMRGGEGAGYGLGRWCHGTEGRGGLTGRLGFARCERR

SEQ ID NO: 201932 - protein, 45 aa, Triticum aestivum
  Clone ID: PAT_TA_96350.pep
QSYSITNINPKHACKVSKISYRKVLLLEISLINLYHGLINYQTLA

SEQ ID NO: 201933 - protein, 128 aa, Triticum aestivum
  Clone ID: PAT_TA_96351.pep
DAGQGARRHSFSSSAARRRTAASDSADMAPAPAAEQPLEYELRQELSDIMLQGYITGLRREFETKLCENHNRISTLSKNCKENLSEITALRDELTGILTAVASFRVQCAPSPQQSRESRGDELPEDER

SEQ ID NO: 201934 - protein, 146 aa, Triticum aestivum
  unsure (1)..(146): unsure at all Xaa locations
  Clone ID: PAT_TA_96352.pep
MSSSAKLKRLYQLAVSNIVAIAAVPFAASALLKAAELGPEELLARLRALRPVHMFLAAFVPAAAAAIYLKLRPRAVYMVDYACFRTKPXCRVPFAAFQEHARVWPGFDEXSVRFMSRLLEXRSGLGEENCLPYAQHXIPPSREXRV

SEQ ID NO: 201935 - protein, 147 aa, Triticum aestivum
  unsure (1)..(147): unsure at all Xaa locations
  Clone ID: PAT_TA_96353.pep
MPKNKGKGGXNXKRGKNEADXXKRXLVFXEDGQXYPQVXRXLXNGRCXXICFXXTKRLCHIRGXIXKKVWXXAGXIFLVGLXDYQXEKGDVILKXXNXQAXLXKGXGELPEKXRLXXGXXVXGPQXGEKPNPIARSPISFFPSSFPF

SEQ ID NO: 201936 - protein, 116 aa, Triticum aestivum
  unsure (1)..(116): unsure at all Xaa locations
  Clone ID: PAT_TA_96354.pep
MARTKQTARKSTGGXAPRKQLATKXAARKSAPATGGVKXAHRFRPGTVALREIRXYQEEARELLIRKLPFQRLRPGDRPRLQERSAFQVLRRSPALQGPPEGLRGSKNKPCAHPQR

SEQ ID NO: 201937 - protein, 143 aa, Triticum aestivum
  Clone ID: PAT_TA_96355.pep
DAHFGFGASAYKVSWSPDGAPSEKGFGSSAYAVHWDPDHPPSEKTGFDASAYAGHRDPNHAHSPSSIPEAPTKHKHIKVQTGMLFLKKNLHIGTTLPKGTMFARDGAPKSVHFASTPLESKYLATILSYFMIPHGSTKGKASS

SEQ ID NO: 201938 - protein, 158 aa, Triticum aestivum
  unsure (1)..(158): unsure at all Xaa locations
  Clone ID: PAT_TA_96356.pep
GMQIFVKTLTGKTITLEVESSDTIDNVKAKIQDKEGIPPDQXQRLIFAGKQLEDGRTLADYNIQKESTLHLVLRLRGGMQIFXKTLTGKTITLEXVESSDTXDNVKGXIQXDKXGYPTGXQRLNFAGKATFRVGAPXQXXNIQEVPTQLCGSRLPWWV

SEQ ID NO: 201939 - protein, 49 aa, Triticum aestivum; identical to SEQ ID NO: 186506
  Clone ID: PAT_TA_96357.pep

SEQ ID NO: 201940 - protein, 125 aa, Triticum aestivum
  unsure (1)..(125): unsure at all Xaa locations
  Clone ID: PAT_TA_96358.pep
MPPLPCLLLLFFRPSPLPRRRNAHKDPALTPPPAAPARRRAXXPALPPRPGLPRARLPPQSRXRSPRGPGXTHXHNNPPPCAPRCTRTPTAATPSPSPSGRRPAXAAGAAXTXGSXLNLGWPGTN

SEQ ID NO: 201941 - protein, 79 aa, Triticum aestivum
  unsure (1)..(79): unsure at all Xaa locations
  Clone ID: PAT_TA_96359.pep
PNCXITSXDWNGXGYYLGGGXQFIXATXDTXTXIXPIXPNDXRMTPLTNGGRGASKHRARRCXXYAHVVELSNLTPRHX

SEQ ID NO: 201942 - protein, 154 aa, Triticum aestivum
  unsure (1)..(154): unsure at all Xaa locations
  Clone ID: PAT_TA_96360.pep
KTXGAXXWAXXSXXNLPTXXXFGLXDKEVPKPQGXXQDPAQGVXQPGNGRRFPVXLSGXTLPLLAGRPTRXEAAPPSVNVAPLRRFGVDGACSPVLGTPCVRAFXPILLFHFLDVDVLGRPASSSVSTLPEERSLACNEPRXRPARGPXRXPPP

SEQ ID NO: 201943 - protein, 86 aa, Triticum aestivum
  unsure (1)..(86): unsure at all Xaa locations
  Clone ID: PAT_TA_96361.pep
TNLDXLYSVEXEVGNPXGSXFXDHRAXWDRIAXLXWCTWYTSLTTWGLXDPRMVGXGXIACASSXRSGDAPCFXXLXXTGSRXLXQ

SEQ ID NO: 201944 - protein, 154 aa, Triticum aestivum
  unsure (1)..(154): unsure at all Xaa locations
  Clone ID: PAT_TA_96362.pep
AEPRALLRSPSPSLPPALRLGSIRSPHSVFVSLPPSLTPHASRQRRALAFRPPFPPFLRAACLAPPLFSPRGXXEVKAGFLPGLRPASVRAKIXXRTNRVREAEDPRVMQXGGGGRKVGSXALLHXIASRWXLHXGXXGPXXLGEPVGXPVGAX

SEQ ID NO: 201945 - protein, 118 aa, Triticum aestivum
  unsure (1)..(118): unsure at all Xaa locations
  Clone ID: PAT_TA_96363.pep
MQIFVKTLTGKTITLEVESSDTIDNVKAKXQDKEGIPPDQQRLIFAGKQXLEDGRTLCRLQHPRRESTLHLVLRLXRGGAQEXRKXKTXTKXQXRKKHXHKERRLPVPILGDPHPKVT

SEQ ID NO: 201946 - protein, 95 aa, Triticum aestivum
  unsure (1)..(95): unsure at all Xaa locations
  Clone ID: PAT_TA_96364.pep
DGFNGTAFAYGQTSSGKTFTMNGSGADPGIIPLAVRDIFDTAAEAADRVFLIRVSYMEIYNEEINDLLTLGSEKLPIXESLERGVYVSGLRGRNC

SEQ ID NO: 201947 - protein, 101 aa, Triticum aestivum
  unsure (1)..(101): unsure at all Xaa locations
  Clone ID: PAT_TA_96365.pep
GQHSPSHPSSPXXTPPAAAMVKVLEGIVQPDQVXQGLWQKISGSTSXNTXETSVWLFRKDAFGARPKXGTLEGCFXAHKXKRFPFPXEYWXKVWGPXPPPS

SEQ ID NO: 201948 - protein, 74 aa, Triticum aestivum
  unsure (1)..(74): unsure at all Xaa locations
  Clone ID: PAT_TA_96366.pep
XRNRPXLILXXNRILFNFLNXKGXGQLPXKITGGLXMATXXQQAQXXFDKPXXVWKXXYSLGGGAXVPXFXPYX

SEQ ID NO: 201949 - protein, 60 aa, Triticum aestivum
  unsure (1)..(60): unsure at all Xaa locations
  Clone ID: PAT_TA_96367.pep
SGRGLGGFPXPVXRGERNRGXDXTRRXSXXWXTKARLRNSRPTRRAAXPPRHSXTPXRXA

SEQ ID NO: 201950 - protein, 128 aa, Triticum aestivum
  unsure (1)..(128): unsure at all Xaa locations
  Clone ID: PAT_TA_96368.pep
TPLXATQAQCXPPXRFGLEXRCRLPPXXAFPCXAKYGGAWPPFXPGPAFENXQRAPLRXHLRSMDFDXINFVASLIXSYPSETPPLPSIAXAVPVHGGGGDRRFAWGGGGRTSRRARRAARRRRRRKP

SEQ ID NO: 201951 - protein, 127 aa, Triticum aestivum
  unsure (1)..(127): unsure at all Xaa locations
  Clone ID: PAT_TA_96369.pep
DDXKKVEEAIEGTISWLDANQLAEADEFEDKXMKELEGICNPIIRQDVPRAAAPGHGAAAWGMGRRDMPAGAGGRPGPKRSKGRWGLKAVSSKLSARLTLIGVVPVSGWSLWNARSGWVVKSLSPFI

SEQ ID NO: 201952 - protein, 73 aa, Triticum aestivum
  unsure (1)..(73): unsure at all Xaa locations
  Clone ID: PAT_TA_96370.pep
GRGXLGXGXRPMMRLWEVVITXXVESSGXIFTPSAAVXRXCXRXRTRSCLRSXTWLXMXXCPRXYXLCXVXVX

SEQ ID NO: 201953 - protein, 122 aa, Triticum aestivum
  unsure (1)..(122): unsure at all Xaa locations
  Clone ID: PAT_TA_96371.pep
FLXGRPSXWXFKXPXPITSGQXGTIXHXFPLRGKQGDQAFXFPCHGXARDQQAMTLPEFSLXWRSPGGGCRRRSSWGCTTFSTSTRLKDGIRRRIAAIAAADEIRRRRSSPSPSWETSKKRE

SEQ ID NO: 201954 - protein, 90 aa, Triticum aestivum
  unsure (1)..(90): unsure at all Xaa locations
  Clone ID: PAT_TA_96372.pep
GXRHRAERXKLEXRFDHHHTNHVXLRRQLRGADPGCKXAVNGLPERCKDVTPAXGTKGGCXTTXXGPSXIGXXAPLPKGXPRSFRRAXPP

SEQ ID NO: 201955 - protein, 58 aa, Triticum aestivum
  unsure (1)..(58): unsure at all Xaa locations
  Clone ID: PAT_TA_96373.pep
GSKLXPGRRTFAGRRADSXAAAERDHPRRXDXSEARQSXTTNGTEAXRPXRXVYLTPN

SEQ ID NO: 201956 - protein, 117 aa, Triticum aestivum
  unsure (1)..(117): unsure at all Xaa locations
  Clone ID: PAT_TA_96374.pep
SSLCLXGPIGXNPPYXPSTVYPPTFNQILPYHTRLSRKGFSVPPKSITESIMHSMNEIRRSLSNSNMISWPNPAKTYNFSSKNATSSSSRTGSSSSLKESVTIGGLLIQSVPHSLSS

SEQ ID NO: 201957 - protein, 109 aa, Triticum aestivum
  unsure (1)..(109): unsure at all Xaa locations
  Clone ID: PAT_TA_96375.pep
RLFARKXWXEPXXAXXXIAWLXXRXDLVXTEEGXRLCXXGPRXRTRGANLCPGARXGRRRRSXSGTRGPGRAGWVEKGKGRDLRSLGGAVWXGVFPGRSSPCPSFVPRA

SEQ ID NO: 201958 - protein, 93 aa, Triticum aestivum
  unsure (1)..(93): unsure at all Xaa locations
  Clone ID: PAT_TA_96376.pep
SGGXVXWCSRXPVVXVQPRRGRGXXRSWLFXSESPGATRVSPXPGAYHGRQGXPXXQAXARVGPPPPEXPKIDSELEPEXRWSLLFPFPMENC

SEQ ID NO: 201959 - protein, 121 aa, Triticum aestivum
  unsure (1)..(121): unsure at all Xaa locations
  Clone ID: PAT_TA_96377.pep
LSCLKVTTPPHSSSHGCFASFSFHYTEQSSSSSIRKRDSIVPPTTNQPGQLPTTTTTTTTSTSTTYYLXNELTGMXINTLQILPSLLPXSHSFRRLNDAQMARXDLSSGXGNXAXPHKGNS

SEQ ID NO: 201960 - protein, 104 aa, Triticum aestivum
  Clone ID: PAT_TA_96378.pep
GELGRWGGWGQFPPFQPPSPRDPAGRRRWRPAPAIFRRRTAPPQHSRGGGGLQGPRSRSGGRDGAAPAPPRNGEGSGEPPVEAFAGLPGVETVEMLGSWKTTPR

SEQ ID NO: 201961 - protein, 124 aa, Triticum aestivum
  unsure (1)..(124): unsure at all Xaa locations
  Clone ID: PAT_TA_96379.pep
MAKEVLVTGAAGQIRYALVPMIAXRGVMLGAXXPVXLHMLDIXFAAXXLXGVXMELIDAXFPLLKGXVAPXDVVEACXGAXMLXVMXGXFPRXEGMXRKDVXTKNVSIYKXSCIWLLKLMQAPN

SEQ ID NO: 201962 - protein, 50 aa, Triticum aestivum
  Clone ID: PAT_TA_96380.pep
KNIKRAKAMLPKHVGYDVLTELTRYYPWCPGTAPISCQYNVAFLPTSLCL

SEQ ID NO: 201963 - protein, 53 aa, Triticum aestivum
  unsure (1)..(53): unsure at all Xaa locations
  Clone ID: PAT_TA_96381.pep
PGRPCDEFKGCTLXPNIGYXXDKXTRXYLPNKXFKXFVVHNVSXLXLLMXHXR

SEQ ID NO: 201964 - protein, 42 aa, Triticum aestivum
  Clone ID: PAT_TA_96382.pep
PPFFRQINTTQLPMDQELNHAQIKTIHGSRTQPPGFNKKQKH

SEQ ID NO: 201965 - protein, 167 aa, Triticum aestivum
  unsure (1)..(167): unsure at all Xaa locations
  Clone ID: PAT_TA_96383.pep
QQIPSRNLVDLEWRSRPPPSPRSPSPARXRLGRRIXGAPRLXGPLVGPLPPRXPRRFPGPLXLPXEAARASXPPPAPNPYAPELQXXLTXXVYFDNXALATLSGERMFGXGIVXXGPLMGGXNVSXXTRXXEXFRXXLEXGGRKXGFXITKGNQRFFQPXXXFXXXL

SEQ ID NO: 201966 - protein, 85 aa, Triticum aestivum
  unsure (1)..(85): unsure at all Xaa locations
  Clone ID: PAT_TA_96384.pep
RLRXAGXGHXAAVSXYXXHVCHGYIXXTXVLSVVDLPPAPXTWAPEXSPRATQQRQSLVIGXAXXRSSPSDMPPPXXPPXXLRXV

SEQ ID NO: 201967 - protein, 90 aa, Triticum aestivum
  unsure (1)..(90): unsure at all Xaa locations
  Clone ID: PAT_TA_96385.pep
CGAGHAVNXRWIPEPALEFLWYDADRVXCRPGGLLWVDHLWCRKGDLDGVYAAMLRRLGYKTIKWAVADKTGIGAKDELVYLTALLQKPF

SEQ ID NO: 201968 - protein, 94 aa, Triticum aestivum
  Clone ID: PAT_TA_96386.pep
LPAVWSSKLGRPCRWLASFRYHAELTPQHAGEHAQARCARWRRKAHACKGRPPAHGRIERRTTQPGKAAAAGRPDAGNAELEMDARALLLHLAR

SEQ ID NO: 201969 - protein, 123 aa, Triticum aestivum
  unsure (1)..(123): unsure at all Xaa locations
  Clone ID: PAT_TA_96387.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGXADGVANINVTDCHIPLTXGPNSIVGRAVVVHGD

SEQ ID NO: 201970 - protein, 35 aa, Triticum aestivum
  Clone ID: PAT_TA_96388.pep
FFFFFFFFFFFFFFFFFFFFFFFFFFKHMKGNSCR

SEQ ID NO: 201971 - protein, 82 aa, Triticum aestivum
  unsure (1)..(82): unsure at all Xaa locations
  Clone ID: PAT_TA_96389.pep
HEVXCEFRNXLXEKFXXXRTXGLAXDXNVEVDLCASPRDRXDXVPWAXNRVAVRXXXHXHRCAGANXRRVPPPXPXXXLVSD

SEQ ID NO: 201972 - protein, 106 aa, Triticum aestivum
  unsure (1)..(106): unsure at all Xaa locations
  Clone ID: PAT_TA_96390.pep
PFFLEVAPRXKXFXGSGAVRLHPFAHYSPAVCHSSRVDXXWKSXSTKSQLLYTPFXDQTSPVARTGERPTSXTLQPRRREHRHDGEGTGETIFXCXDVGPXCPQMP

SEQ ID NO: 201973 - protein, 151 aa, Triticum aestivum
  unsure (1)..(151): unsure at all Xaa locations
  Clone ID: PAT_TA_96391.pep
LAGGSRPNESGGDRXGXGGGGYRGGGYGGGGGGYXGGGGGYSGGGGXYRGGGGYRXGGGGGRYRGXXGGGRXCYKCGEEGHISXDCPQGGGGXGGGYRSGGGRXGGGGGGGCFSXCGESGHFSRXCPNKDQTKRALPVKFEVSRFPRLFLA

SEQ ID NO: 201974 - protein, 75 aa, Triticum aestivum
  unsure (1)..(75): unsure at all Xaa locations
  Clone ID: PAT_TA_96392.pep
PGKLRXELPXXXTFSIXGIXLSAXCTSGXKPKKXXXRCXTRNXPPXFLPANPPGEXXXGFPXFWXGRXXLGGLNG

SEQ ID NO: 201975 - protein, 67 aa, Triticum aestivum
  unsure (1)..(67): unsure at all Xaa locations
  Clone ID: PAT_TA_96393.pep
GXWXHRRVGKHXPGASSRXXXVAXQGRDEXHXGRRPRXXSXALQLPXXSXVTCFFXLLEEXEEXXYC

SEQ ID NO: 201976 - protein, 113 aa, Triticum aestivum
  unsure (1)..(113): unsure at all Xaa locations
  Clone ID: PAT_TA_96394.pep
SLQRNQLRNAAPARPFPQPPLPXPPSATTSPPPPADPXSPPPPPSRPSPLLSCPTSAAASSATSPPPSXGASRXTSPPLPSTKKPXFPPLLSPPPPAAVSTRPIPSTTTGLHN

SEQ ID NO: 201977 - protein, 157 aa, Triticum aestivum
  unsure (1)..(157): unsure at all Xaa locations
  Clone ID: PAT_TA_96395.pep
GLFIPSRLTRPSPPRLQNPRPALLSRPPNLQSPLRDLTEKILDRPNDKALSSSSSKMQIFVKTLTGKTITLEVEXSSDTINNVKAKIQDKEGIPPDQQRLIFAGKQLEDGRTLADYNIQXKESTLHLXVLRLRGGMQIFVKDPHRQRHHLWRVSSDT

SEQ ID NO: 201978 - protein, 94 aa, Triticum aestivum
  unsure (1)..(94): unsure at all Xaa locations
  Clone ID: PAT_TA_96396.pep
LGTTXWELVNNGQXFLIXMLXXMRXIXDRSXNYXDTXILXTXFSGXXXSRTNXHXXXHRLXFCNPSHQGXEQIFQKXGTQXXFCQXEXTAGRXX

SEQ ID NO: 201979 - protein, 159 aa, Triticum aestivum
  unsure (1)..(159): unsure at all Xaa locations
  Clone ID: PAT_TA_96397.pep
ETKAXVGFKAGVKDYKLTYYTPEYETKDTDILAAFRVSPXPGVPPEEXXAAVTAESSTGTWTTVWTDGLTNLDRYKGRCYHIXPVAGEDSQWICYVAYPLNLFEEGSVTNMFTSIVGNVFGFKTLRALRLXDLRIPXTYSKTFQXPPHGIQVERNKVVQ

SEQ ID NO: 201980 - protein, 50 aa, Triticum aestivum
  Clone ID: PAT_TA_96398.pep
SYFYRVNFFYRYFLSIFVREFLQMVVWLGTVYYYYYYFDYLGLAQTNHLR

SEQ ID NO: 201981 - protein, 71 aa, Triticum aestivum
  unsure (1)..(71): unsure at all Xaa locations
  Clone ID: PAT_TA_96399.pep
TLHGPIECLPPPYGALLLQPFPPXNPPPPLLAPTASYGPVILSRDNLRGALLRLVQNDDFINMFYREIVKG

SEQ ID NO: 201982 - protein, 87 aa, Triticum aestivum
  unsure (1)..(87): unsure at all Xaa locations
  Clone ID: PAT_TA_96400.pep
SAPRSYGIHSSTGSKXLXPDACYXCNKPWYCHGXWVIPQFVXSGKGYXXXCWDXKALMKFXXXVFRXGXXLLPXMXGXKXLLGYXXI

SEQ ID NO: 201983 - protein, 145 aa, Triticum aestivum
  Clone ID: PAT_TA_96401.pep
MVVTNKARAREMTLITALFVLSCLLKTTTTSPATWAYSRDDALAWRPASSLLHQLRHLGVRALIRDDAEATALASADFGNMSDAQPPAAAVLYPSCPEDIATLLRASCTRPSPFPGVCPGAAGTPTRGQASAPRGVVVRDVAPGA

SEQ ID NO: 201984 - protein, 99 aa, Triticum aestivum
  unsure (1)..(99): unsure at all Xaa locations
  Clone ID: PAT_TA_96402.pep
ISVSSKPSAMSGRGKGGKGLGKGGAKRHRKVLRDNIQGITKPAIRRLARRGGVKRISGLIYEETRGVLKIFLENVIRDAXVTYTEXARPQRPSPPWDVV

SEQ ID NO: 201985 - protein, 65 aa, Triticum aestivum
  Clone ID: PAT_TA_96403.pep
GQIEHLSVIFLSTSELICHLLFSFFICCLLFIEYDWTMMKTMNKTHHLSGLIGALFVPCCENLQF

SEQ ID NO: 201986 - protein, 70 aa, Triticum aestivum
  unsure (1)..(70): unsure at all Xaa locations
  Clone ID: PAT_TA_96404.pep
ERDRXRGXNXAVTQPVAIVSCTRSTLPVSYYRYXGLVKMFLMYKRLNXRNDXXEARKEVSXETENXSSTS

SEQ ID NO: 201987 - protein, 137 aa, Triticum aestivum
  unsure (1)..(137): unsure at all Xaa locations
  Clone ID: PAT_TA_96405.pep
SLSLLSLSLSLSFXGLXXTAGLPVSRRSNXASLGSVSNGGRIRCMQVWPIEXIKXFETLSXXXPLXREALLKQVXYLIXXKWVPCLEFXKVGFIFREQNASPGXYXGRYWXMWKRPMFGXTDATQVDRWRRVRVPLD

SEQ ID NO: 201988 - protein, 138 aa, Triticum aestivum
  unsure (1)..(138): unsure at all Xaa locations
  Clone ID: PAT_TA_96406.pep
MAPTVMASSATSVAPFQGLKSTAGLPVSRRSNGASLGSVSNGGRIRCMQVWPIEGIKKFETLSYLPPLXAXEALLKQVDYLIRSKWVPCLEFXARLGFIFREHNASPWVLRAVLDNGGSCLCSDTDTHVINQVGQRIP

SEQ ID NO: 201989 - protein, 147 aa, Triticum aestivum
  unsure (1)..(147): unsure at all Xaa locations
  Clone ID: PAT_TA_96407.pep
MSPQTETKAXVGFKAGVKDYKLTYYTPEYETKDTDILXAFRVSPQPGVPPEEAGAAVAAESSTGTWTTVWTDGLTXSLDRYKGRCYHIEPVAGEDSQWICYVAYPLDLFEEGSVTNMFTSIVXNVFGFKALRALRLXEDLRXPPTYS

SEQ ID NO: 201990 - protein, 133 aa, Triticum aestivum
  unsure (1)..(133): unsure at all Xaa locations
  Clone ID: PAT_TA_96408.pep
MAPKAAEKKPVATAEKTTAGKKPKAEKRAPASKEAGGEGKTRGRKKGSKAKKGVETYKIYIFKVLKQVHPDIGISSKAMSIMNSFINDIFEKLAGESAKALRYNKKPNITSREXQTSVRLVLPXEAPKHAVSX

SEQ ID NO: 201991 - protein, 153 aa, Triticum aestivum
  unsure (1)..(153): unsure at all Xaa locations
  Clone ID: PAT_TA_96409.pep
MAPTVMASSATSVAPFQGLKSTAGLPVSRRSNGASLGSVSNGGRIRCMQVWPIEGIKKFETLSYLPPLSTEALLKQVDYLIRSKWVPCPRSSSKVGFIFREXHNASPXYYDGXRYWTMWKAAYVXGCTDATQXXKRRWEEVKXEYPDAYVRNH

SEQ ID NO: 201992 - protein, 111 aa, Triticum aestivum
  unsure (1)..(111): unsure at all Xaa locations
  Clone ID: PAT_TA_96410.pep
RLVLLRWPPRSTAVSSYSPSSPSPLSSPAPRPYAPSCWSSPAXTSSRTPLARTPRCHPPTGTARTGMTSRTTPPPPTPSSPRPPGSPSLTPTPPPRRASTHRPMRSSRAAP

SEQ ID NO: 201993 - protein, 128 aa, Triticum aestivum
  unsure (1)..(128): unsure at all Xaa locations
  Clone ID: PAT_TA_96411.pep
KLEAMAVDALMIQAEMADEEPPFEVAPAAGETNVFDALVPSDEWSESRGGSDGRVTLVAAIQLRDPSRRYEAVGAPMIAVVQSARMLGAAGLSGGRFKVRSLHLGGVXTRCLSGVGGSASWRAQPAKS

SEQ ID NO: 201994 - protein, 105 aa, Triticum aestivum
  unsure (1)..(105): unsure at all Xaa locations
  Clone ID: PAT_TA_96412.pep
PPRPHRPPPGTASERGGRGLVGEXGXRVARAYGTDLSAXGXRDISRRLXXAPRRGLQASPXSXXPSPGPRXSPXQGXTFRIDIRPTXWLXPLSLXRCSXSXKVWH

SEQ ID NO: 201995 - protein, 114 aa, Triticum aestivum
  unsure (1)..(114): unsure at all Xaa locations
  Clone ID: PAT_TA_96413.pep
MAPSXPKSGLFVGINKGHVVTKRELPPRPSDRKGKXTXRVHFXRNLXXEVAGFXPXEKRIXELLXVXKDKRALXVAXRXLGTHNRAXKKREEMSXVLMXISLLVVVVLTTNKAW

SEQ ID NO: 201996 - protein, 91 aa, Triticum aestivum
  Clone ID: PAT_TA_96414.pep
CKLRPHNILSDFRRSRQHSSPNHEVKLLGVTYEKIPRESHLDWICLQNTDLTDGRQKKNNGAVRHSAGTHQSFFFVCLSSIVLTLPTIWTN

SEQ ID NO: 201997 - protein, 137 aa, Triticum aestivum
  unsure (1)..(137): unsure at all Xaa locations
  Clone ID: PAT_TA_96415.pep
MGRTKQTARKSTGGKAPRKQLVTKAARKSAPATXXVKKPHRFRPGTVALREIRKYQKSTELLIRKLPFQRLVREIAXDFKTDLRFQXSSAVSALQEAAEAYLVGLFEDTNLCAIHAKRGHHHAQGQSSSPGASWRRG

SEQ ID NO: 201998 - protein, 119 aa, Triticum aestivum
  unsure (1)..(119): unsure at all Xaa locations
  Clone ID: PAT_TA_96416.pep
MSGELSTLSSPSFAASPSPADDARSAGESTPLQVEAEAGSRSGGSGSTGVKLRRRWQRRRQQLGQWQWRVGDTWALDPRARWVREWKRAYLLACAXGLMVDPLFLYAVSVSGPLSSSPR

SEQ ID NO: 201999 - protein, 178 aa, Triticum aestivum
  unsure (1)..(178): unsure at all Xaa locations
  Clone ID: PAT_TA_96417.pep
XFPKPLEILFXKPXIXEDKDIIXFRDQKSKISKXDXXLFPQKWXGCGLXFSIDKFSQQPNQLLVHCFLPRGVFKKFTWAKNPKIDKRLFEDVELXLGFKPLSRXTPXXQTDGLNLPPFSEHCHRRNRGLSXCSXPSDASFQHTHQQPSPRVXPNEDLLSPRSGPFEGXMCNFCXPAXC

SEQ ID NO: 202000 - protein, 83 aa, Triticum aestivum
  unsure (1)..(83): unsure at all Xaa locations
  Clone ID: PAT_TA_96418.pep
RSPPRPRPPPPPAPPAPPAPARSWIRRRPPAPRARRCGGWTPSSXRHALPPQQAQPWCPDHRFALRLPPRQPVSLIKQKNSPS

SEQ ID NO: 202001 - protein, 155 aa, Triticum aestivum
  unsure (1)..(155): unsure at all Xaa locations
  Clone ID: PAT_TA_96419.pep
PKGSSLPNLPAHLRRHGPHQADXEGSPPAARRRGKQWPPKXARKSARAPXASKKPQRFRPXNVALREIRXYQKSTELLIRKLPFQRLVREIAQDFKNXTLRFQSSRRLPRCREGGRRAYLVGLFEGQQFWGHPTPRRRQINPKENPARPLGEKGP

SEQ ID NO: 202002 - protein, 114 aa, Triticum aestivum
  unsure (1)..(114): unsure at all Xaa locations
  Clone ID: PAT_TA_96420.pep
LAXFXVSPXPGVPPEEAGAAVAAESXTGXTWTTVWTDGLTXLDRYKGRCYHIEXPVAGGRQANGICYVTYPLXDLFEXKGSVTNMFTSIVXXTVFGFQKALRALRFGRDLRNSP

SEQ ID NO: 202003 - protein, 110 aa, Triticum aestivum
  unsure (1)..(110): unsure at all Xaa locations
  Clone ID: PAT_TA_96421.pep
HPVLSCXFVAAKXVACAYSLLXLLXPPASPAARHVLVADAVLGMVLTGAAAAAAAISALGKNGNSHAGWQPICGXVPTFCDHVTGALACGFVAVVLHLLVVLHSIYTMNS

SEQ ID NO: 202004 - protein, 140 aa, Triticum aestivum
  unsure (1)..(140): unsure at all Xaa locations
  Clone ID: PAT_TA_96422.pep
ASFPRRHPPRKGGCLAAAATAGAAPAASAATAAAGARCSPTWRPPPAPPPWSCPPPPTRGAPAGSRRPGRPAAATAPPASAAPRAAAPAAXAATEPAPKRPAGRGEHEDXRRTSKQAPSPTVQHQPAYHQQPPHALGARR

SEQ ID NO: 202005 - protein, 165 aa, Triticum aestivum
  unsure (1)..(165): unsure at all Xaa locations
  Clone ID: PAT_TA_96423.pep
MFGFGHHHKDQAPAXSGPNQIFKIYCXASEDYCLAVRDGEVVLAPVNPKDETQHWLKDMRFXSTTVKDEEGMPAFALVNKATGLAVKHSIGQSHPXVKLVPFNPAYEDGGRCWWTGEAKGWGKGVSAASRGSNKTRLKLRRPQTGGQRDQRAGGTNQTGPASWGG

SEQ ID NO: 202006 - protein, 147 aa, Triticum aestivum
  unsure (1)..(147): unsure at all Xaa locations
  Clone ID: PAT_TA_96424.pep
KPRXGRSXSTKQERCTSSRFVKQGXXXRLQRSRTPADGGEGAXPXGGAIRRRGTXLRRRCLSKGRERVRERETGEEEXRRGVVDLAGGLARLVGGESFGGRGYELEEVLGRLDGLASDACNKEEGARAPASRNEARSGTPVRNPWRP

SEQ ID NO: 202007 - protein, 152 aa, Triticum aestivum
  unsure (1)..(152): unsure at all Xaa locations
  Clone ID: PAT_TA_96425.pep
CFDLATYADHLQXTVKALRDITETGVEPLSLNXSNFATIITXDILXGTYTFAQERIRRKFFKRPTLSKEDMEKLRQALKTLSEAEKQLRVSNDKMTWLTAALLQLAPDKQYVLPSSSTSTSFNQGLPTYPDGDIARNSGPHGLSRACDQNNP

SEQ ID NO: 202008 - protein, 86 aa, Triticum aestivum
  unsure (1)..(86): unsure at all Xaa locations
  Clone ID: PAT_TA_96426.pep
XXFRGELXTRAPPLGFFFFFFFLRSXVNTAWSKFAPRFHFAGRRIDQKNINVLGSSRWHETSHAWSCTLVVARAESWRQLTDNKNI

SEQ ID NO: 202009 - protein, 92 aa, Triticum aestivum
  unsure (1)..(92): unsure at all Xaa locations
  Clone ID: PAT_TA_96427.pep
MDVQYHEEYVRNPRGVQLFTCGWLPASSSPKXLVFLCHGYGMECSVFMRACGFKLAAAGYGVFGIDYEGHGKVQWAXRCYNSKVRPTPPPNC

SEQ ID NO: 202010 - protein, 57 aa, Triticum aestivum
  unsure (1)..(57): unsure at all Xaa locations
  Clone ID: PAT_TA_96428.pep
PPXXLRVLHLHAGRXPXWLLGXXAVXHQGXREYGELRGEXXLERPACRLQFWQWSEF

SEQ ID NO: 202011 - protein, 58 aa, Triticum aestivum
  Clone ID: PAT_TA_96429.pep
FFFFFLNQDLIPHLTDMIMSILHAALSFPFLKYLLTYTCGISCIKLSHIHTGKPTCSP

SEQ ID NO: 202012 - protein, 106 aa, Triticum aestivum
  unsure (1)..(106): unsure at all Xaa locations
  Clone ID: PAT_TA_96430.pep
NGPSTFXGFVGRXAVGXPAXXGARGAPFGRPAGGGTPMKLAGSRSXXVAARCRXAWFAAGTPCSAPPCRXSSRAPPPCRWRAPWTPTRSCXGPHGRRLLARPAAVV

SEQ ID NO: 202013 - protein, 114 aa, Triticum aestivum
  unsure (1)..(114): unsure at all Xaa locations
  Clone ID: PAT_TA_96431.pep
WTSVSIWALQDYEGEXLWTLKYRVKLPVAEIGVHDKLDSDWDVVVGSWDGDVVLLVTIDGSNMLFQVDINGKLVATIACCRDLYSAHLWLKQTLALHTFFPTLEGYAVNASPFI

SEQ ID NO: 202014 - protein, 157 aa, Triticum aestivum
  unsure (1)..(157): unsure at all Xaa locations
  Clone ID: PAT_TA_96432.pep
FPSVCSPSHLIFNPSAERLGGLLAREMAGEAGGVLPCELCGNFCHGGADNNFKIDIRDEFLSKATVPCNARVYVNGVTGDYMRFEAHGRKCSVDIVKGAHRTRIKGSGWKKFTSDFSLQKGAVVIFDLDKRPRQAYVVAQSVDLXTIXGSNFKXGML

SEQ ID NO: 202015 - protein, 36 aa, Triticum aestivum
  unsure (1)..(36): unsure at all Xaa locations
  Clone ID: PAT_TA_96433.pep
RTLVISQDHRRESHRCAGKHLKMKVVRAAAWWIAXK

SEQ ID NO: 202016 - protein, 67 aa, Triticum aestivum
  unsure (1)..(67): unsure at all Xaa locations
  Clone ID: PAT_TA_96434.pep
FXKXEGRXGGGXLGRRGASLXFLEGVXXXKXRRXGXVXRRRRAXACRRXHPXXPAETXARRIGGRLP

SEQ ID NO: 202017 - protein, 128 aa, Triticum aestivum
  unsure (1)..(128): unsure at all Xaa locations
  Clone ID: PAT_TA_96435.pep
SIHSTSXDGRRDXLXXMPPCXLRAWXPAXRRGXGLPXMALASIKXRXRXXRXPGTISSVGGGSLPSVDATPRRLQQFGRXFSRRRMWNSSXSAXXICCEXSXXSTSSCIRTXVEXREIXLDNTLXLXL

SEQ ID NO: 202018 - protein, 125 aa, Triticum aestivum
  unsure (1)..(125): unsure at all Xaa locations
  Clone ID: PAT_TA_96436.pep
MEGETTKRLATLVGCNYVGXRYXLXGCIXDXXAVRDTLVTRFGFXPADVTVLTDGRGAXVLPTGANIRRXLADMVARAAPGDVLFFHYNGHGTLVPPHHGDSGAGGKIPSNLIKRFQLGTGFPGL

SEQ ID NO: 202019 - protein, 91 aa, Triticum aestivum
  unsure (1)..(91): unsure at all Xaa locations
  Clone ID: PAT_TA_96437.pep
MIXXXIVGPTXVXSLSRRGSSFAVVCKGGKKIKXDKPLXLXGXLXXDIDANXXKVGXKXVYQFVDKYGANVDGYSPIYXPXEWSESGDRYP

SEQ ID NO: 202020 - protein, 128 aa, Triticum aestivum
  unsure (1)..(128): unsure at all Xaa locations
  Clone ID: PAT_TA_96438.pep
MAATHHPASPTGAGSXGKSPSSSPSPPPAVRLAAXXAAAVAAIQPXSXRYFFSSLAASSSPHRRIAIAVDLSDESAFAVKWAVQNYXXXRATPVVLLHVRPTFVXXGXADWGSIPVFVEXXANXERGR

SEQ ID NO: 202021 - protein, 107 aa, Triticum aestivum
  Clone ID: PAT_TA_96439.pep
VVVPGSPHVDPEDAVAAVVVGRHLVDPPHVAPRRRLGRLHADAPGRHRAASSGEMTPHAAAAPPISRRAPPHAGETRRWRRWSGPSRRRGEGRGWGAAEKPCGGGNE

SEQ ID NO: 202022 - protein, 153 aa, Triticum aestivum
  unsure (1)..(153): unsure at all Xaa locations
  Clone ID: PAT_TA_96440.pep
AISIPLSTKMKNREVQKKKMKNRATTAPPGSIQQPPAPRPHKAITSTNPRTTQSISTAFLLSSCYSLAFSSRQLYCVHCRINETYNNRHIFLSFISMHIIASEKKRXKQRLHHAQTRPRLHQHHQDNQIWXSATAPPXKPFLGRTLPAPSRYT

SEQ ID NO: 202023 - protein, 145 aa, Triticum aestivum
  unsure (1)..(145): unsure at all Xaa locations
  Clone ID: PAT_TA_96441.pep
MHLSQANIPATYLXSANLEWTEQQRILRDLMSPTSTCNYKLLYVTPEKIAKSDALLRQLEILYSRGYLSRIVIDEAHCVSQWGHDFRPDYQXHLGLLKQKFPETPXVLALTATATASVKEDVVQALGLANCVVFKQXSFNRPNLR

SEQ ID NO: 202024 - protein, 60 aa, Triticum aestivum
  Clone ID: PAT_TA_96442.pep
KMVQLEKIIEEKDDELAARVQEKREAIKQLSDTIDYHKNNSDDLVRYIRSHNRPRLPFCL

SEQ ID NO: 202025 - protein, 80 aa, Triticum aestivum
  Clone ID: PAT_TA_96443.pep
GIGKKKKKKLVDGIDKLDIFGTSGGLDFTKDDENVNSQPFMRWRDRFVFCAEAIYKSQAETGEIKGHYLNATAGTCEEMI

SEQ ID NO: 202026 - protein, 151 aa, Triticum aestivum
  unsure (1)..(151): unsure at all Xaa locations
  Clone ID: PAT_TA_96444.pep
HTQAHSIQGSRRSRFEKPAWASAEEEDLPATDMPRVVGVLSALLERVTXRNDAATGPGALEPASGSAFRAMTKPGISVRAYMARIARFAGCSPACFVVGYIYLDRLLRRRRALAVDSYSVHRLLITXVLSAVKFMDDICYNNAYFXKVGGX

SEQ ID NO: 202027 - protein, 78 aa, Triticum aestivum
  unsure (1)..(78): unsure at all Xaa locations
  Clone ID: PAT_TA_96445.pep
YWPGQSLGDYFXGKISXGRANRKGEXESSPAKLLGQVIMSNATLLYSKRHLKLQWRYLVHLRXRMIGFQLDRIDIVFL

SEQ ID NO: 202028 - protein, 133 aa, Triticum aestivum
  unsure (1)..(133): unsure at all Xaa locations
  Clone ID: PAT_TA_96446.pep
SFPRXHPPRKGGCLAAXATAGAXPAASAATAAAGARCSXTWRXPPAPPPWSCPXPPTXGAPAGXKXPGRTAXATAPPASAAPRXXAPAAAATEPAPNXXAGRXEHXDDEDXQASNITNNYQPTHQPPACGRAR

SEQ ID NO: 202029 - protein, 146 aa, Triticum aestivum
  unsure (1)..(146): unsure at all Xaa locations
  Clone ID: PAT_TA_96447.pep
MAQTMASMTGLSQGVRLPGPAGRRASRFTVRASSAEAEAAGRRAVLGLMASGVVGSAFAQVVHAGTVAAIKVXPPPPLSGGLPGTDNSDEARDFDLPLKNRFYLQPLPPAEAAVRAKESAQDILNLKPLIDKKQWPXVMNELRLKG

SEQ ID NO: 202030 - protein, 152 aa, Triticum aestivum
  unsure (1)..(152): unsure at all Xaa locations
  Clone ID: PAT_TA_96448.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTCGKLPMFGCTXDPTQVINEVGGRVKERSXLDPYVRII

SEQ ID NO: 202031 - protein, 130 aa, Triticum aestivum
  unsure (1)..(130): unsure at all Xaa locations
  Clone ID: PAT_TA_96449.pep
MGLLSGRLLGRPLQSSISSSSSRKSAFXVXXXSXPPAKQNDNRQLWFASXQSLXYLDXTLPGDFGFHPLGXXDPEXXXGFIKPXWLAXGEIFNXRTAXMGVVGMXAXEGLGKXGLVPXEXXIPWFQAGAN

SEQ ID NO: 202032 - protein, 108 aa, Triticum aestivum
  unsure (1)..(108): unsure at all Xaa locations
  Clone ID: PAT_TA_96450.pep
IXXGXATXXRXPAGGXGVAXPHAATXGVRRAXXYLALALAIVGHSLYARATVLXIRRRPRVPLXGDRXDPDHSLLGGGRPPXASWSSSWDVRRRLTICSCCRSVNLLD

SEQ ID NO: 202033 - protein, 149 aa, Triticum aestivum
  Clone ID: PAT_TA_96451.pep
KNVISTVHGVEGEIKYDPATGCIVSSVSHTEESSMMMNVEHQSSDSLPIECHKFQPDYDAYQREHLGQAVLHKAQNDKRSETHINLNPGGLCRNSNFGKNIKRATVSGCVKQVRILQKEMISADGTDMWVEGAEQKNVVWNSISMPQQC

SEQ ID NO: 202034 - protein, 56 aa, Triticum aestivum
  Clone ID: PAT_TA_96452.pep
TTHEFKPNSTHNVFVRARGLNYGLITQSIPRDTGGRELDQASSAAAGRSRLASLVY

SEQ ID NO: 202035 - protein, 147 aa, Triticum aestivum
  unsure (1)..(147): unsure at all Xaa locations
  Clone ID: PAT_TA_96453.pep
DVEERIAAPMWRKASLPRRYASMNQASSTPKWRKWYAAVDLRASSHGDGGLAPSRAPPRSASSPHGVHQAIRFVRPMRRLPVATALFCSSPARRTRWPTLPCCFAASQTAIAALALRAXARSCWYAFLPKGGLCPLAVAFLSTXAPF

SEQ ID NO: 202036 - protein, 135 aa, Triticum aestivum
  Clone ID: PAT_TA_96454.pep
RPNGGGRRIQEGKNPSSGLLHHRRRQRGGLANKGQAPRKIVSVRIPMVFHNCIVFSNAEQSCKPAQGRARQFIERVPRLVGNGECLASGRLLASHRGRHRGGAPRRAWSRGGSAGGTTRRPPGLQARGGQDPQGL

SEQ ID NO: 202037 - protein, 120 aa, Triticum aestivum
  unsure (1)..(120): unsure at all Xaa locations
  Clone ID: PAT_TA_96455.pep
MGRGKIEIKRIENATNRQVTFSKRRGGLLKKANELAVLCDARVGVVIFSSTGRMFEYSNPASNLRDLIEQYQNATNSQFEEINHXXQIFVEMTXRMXKRNXXTGMGAIRRYTGETFLPSS

SEQ ID NO: 202038 - protein, 78 aa, Triticum aestivum
  unsure (1)..(78): unsure at all Xaa locations
  Clone ID: PAT_TA_96456.pep
DPPPGFFXFFFRXFLFXXPPXXFFFFFFFFFFFFFFFFFFFFFLVPNIEAGTVTISRDPETSRCDSYTITRPQTHPDS

SEQ ID NO: 202039 - protein, 179 aa, Triticum aestivum
  unsure (1)..(179): unsure at all Xaa locations
  Clone ID: PAT_TA_96457.pep
GGRXALRTKWDSPGAARKFRERGFSLSCWNLKQRPLSLLKLLGLEGXWAXAPLPTKRMPPGXPGXQTFARXSLQGYANKRGTKLGWAXTRKIRLPSFGFGFXXKKXXXPRKAESPXPPWGHPXXRLXNPNEXSSXKSGVXGPWXKGGIXFXPNGXLLXXGSGRXARELPSXXXEXFPRE

SEQ ID NO: 202040 - protein, 73 aa, Triticum aestivum
  unsure (1)..(73): unsure at all Xaa locations
  Clone ID: PAT_TA_96458.pep
FFFFFCMQVPKIFLSAVXPSLTVSLHXPPRTLDSHLGTEKGIMVHFVVNLLRWTEIPHGQDKVTSGAFNFFCS

SEQ ID NO: 202041 - protein, 77 aa, Triticum aestivum
  unsure (1)..(77): unsure at all Xaa locations
  Clone ID: PAT_TA_96459.pep
XIMGFPXAXKEFSXRRTXLXWITHXXTXXQTXXNNXQLTIHGSSQKKKXXGGAXVPCGGGGLLMAXRKAPXGLFFGA

SEQ ID NO: 202042 - protein, 123 aa, Triticum aestivum
  unsure (1)..(123): unsure at all Xaa locations
  Clone ID: PAT_TA_96460.pep
LVILPXXPPRPXSMQCTHWQKFTAEXVDLGSQXALLGRGENLANASSXKXTNTXLWNSRVTGPPVTXKGXWEEQIDKXLLPSKLKTGXDGKTSXXGQRRCXSHFSKCPGQXXPXLSSNXRGSA

SEQ ID NO: 202043 - protein, 70 aa, Triticum aestivum
  unsure (1)..(70): unsure at all Xaa locations
  Clone ID: PAT_TA_96461.pep
MTTLWVLPXGXPFINKKNPXFHKLXXRRPSGXFQXLYDHXQMXYGIHXDMIKMXEXRTCVYGXENEXVXI

SEQ ID NO: 202044 - protein, 103 aa, Triticum aestivum
  unsure (1)..(103): unsure at all Xaa locations
  Clone ID: PAT_TA_96462.pep
KRXAVVVXKEXIPQVQEPXCSEXKGSSKGHTLGTRTISLELDLGHFVRSSLTFXSWXGHKMGTTRNLSHRGXXKVQATDLPSTFGTXIPWDAIRMEAPNLKVQ

SEQ ID NO: 202045 - protein, 151 aa, Triticum aestivum
  unsure (1)..(151): unsure at all Xaa locations
  Clone ID: PAT_TA_96463.pep
DXDGCITTKXELGTIMRSLGXNPTEXELXDMXNEVXADXNXTIDFPXFLNLMXRKMXDTDSXEELKEXFKVFDXDQNGFISAAELRHVMTNLXEKLNXXEVXEMIRXAXVXXDGXINYQGVLXXMMXQMSKRAPCSPNKEEKFCNLILRSF

SEQ ID NO: 202046 - protein, 96 aa, Triticum aestivum
  unsure (1)..(96): unsure at all Xaa locations
  Clone ID: PAT_TA_96464.pep
PVPXNPKXXXVVQSLEXVXXSRXGGGGXQQHSNSXVGGXLVSTSXLSXSRPXXNTQTGLXLFSPPSPSSISSQDLGVALGRRKLVPXSSXGEPIIF

SEQ ID NO: 202047 - protein, 99 aa, Triticum aestivum
  unsure (1)..(99): unsure at all Xaa locations
  Clone ID: PAT_TA_96465.pep
WSRXSSXSXXILXGAXPLGGXSXVQVXLXALFCSRXYTSSXAEXRRXSXXPAXEXFFLPSLSFFPXRGXWVQXNGFEXKQRXXWARNEKGAQVGRNQST

SEQ ID NO: 202048 - protein, 59 aa, Triticum aestivum
  unsure (1)..(59): unsure at all Xaa locations
  Clone ID: PAT_TA_96466.pep
XPLGXFSXXFPXFHGXVXDDALFVPXTPXIXFFAHIGRVFWVNTFFPXPPXLTPXFQIL

SEQ ID NO: 202049 - protein, 57 aa, Triticum aestivum
  unsure (1)..(57): unsure at all Xaa locations
  Clone ID: PAT_TA_96467.pep
KRSXSSGCPXKGGXGXIAXXVXFNLSLVSYXVLIDASFXGLYXXNFCXCPXALXNLI

SEQ ID NO: 202050 - protein, 55 aa, Triticum aestivum
  unsure (1)..(55): unsure at all Xaa locations
  Clone ID: PAT_TA_96468.pep
TSSSIRHLPARSSKEGRXPSTMSXRGXGGXGLGKGGAKRHPKVVRDNIQGXTKAD

SEQ ID NO: 202051 - protein, 130 aa, Triticum aestivum
  unsure (1)..(130): unsure at all Xaa locations
  Clone ID: PAT_TA_96469.pep
QKHLXCKNQTRQXHVPDLFLXGTGKEGAIAPRLDDPCVAPHXGSXXLDPALHLSIRVEFRAFPTDGKQQHAVLQPHEGQGTVXALGPXPQGARQSQIVFSHACCTPRHCHPPRRGHRPYSPQQHCAPCHR

SEQ ID NO: 202052 - protein, 54 aa, Triticum aestivum
  unsure (1)..(54): unsure at all Xaa locations
  Clone ID: PAT_TA_96470.pep
XIIXKXKRSNXEGSGPWSXGPPPKSXLSTRRKRPXGXPXGRPIXXKGXKVXKTL

SEQ ID NO: 202053 - protein, 77 aa, Triticum aestivum
  unsure (1)..(77): unsure at all Xaa locations
  Clone ID: PAT_TA_96471.pep
LLSAKFPGHALFXPTLIVXTILFGXPTPIYSVCFVPHCCCIFPVWGPPRPLGGSLSFSTFTLQXGESXCFLGRPPTX

SEQ ID NO: 202054 - protein, 154 aa, Triticum aestivum
  unsure (1)..(154): unsure at all Xaa locations
  Clone ID: PAT_TA_96472.pep
DYXXFINNFTYIFXQNHQVHHXKYAHXTDYIHQQNLLQVYLDKLVXTYPNLFSSGITYLFFLXKISXFLTNAAFPKSFGSKMATTHLWRSLXMLSDLEHIHPIMHNYIDPXXKMGKFXWAVSNMYVLWDXKPPTKCLVHXXLGNXNXLPXYWGG

SEQ ID NO: 202055 - protein, 181 aa, Triticum aestivum
  unsure (1)..(181): unsure at all Xaa locations
  Clone ID: PAT_TA_96473.pep
QQGKXKVHWVYXGXNPGQQSGRAQPWCTPTLAVANGSWSLWGSXEIQAXRFVXLLQXEAKGXGIFPLKARFARXVFPGGERGXDKXXXFWLKSKSXKRANQPFFRVEKTWXEKXXQTPXXKNXEETGAKKXNKLXPPAXTXXLSLGGFANQKGEGCXVPPXXGATKDXKKXXNXPXNLXPF

SEQ ID NO: 202056 - protein, 114 aa, Triticum aestivum
  unsure (1)..(114): unsure at all Xaa locations
  Clone ID: PAT_TA_96474.pep
MVKGRTGQRVXXXVRGXILXYXXSKSNQYQTXSLVQIEGVKNKEDVAWXXGKXMATFKKAXTKXKGTXXRCIWGKVSPPHXGKXGGRPRQXXLQNWPPXARGKKXXGXMFPXTT

SEQ ID NO: 202057 - protein, 77 aa, Triticum aestivum
  unsure (1)..(77): unsure at all Xaa locations
  Clone ID: PAT_TA_96475.pep
PLFVXXWXKVSGDSRXDPPVLXRXIRKSLYRGPGTRLICGFLXGKFYLPEKKNLSKAFXSKFLCSTKLLLRDIFQXQ

SEQ ID NO: 202058 - protein, 87 aa, Triticum aestivum
  unsure (1)..(87): unsure at all Xaa locations
  Clone ID: PAT_TA_96476.pep
GSPGVEXNSEKKPLPAADLXFFSWXNLRXXGSXIFXXIKLDLPALTXLPPILGXGNXSPKXXPLEXSXKQSLGPQFWWPKGLNXKKK

SEQ ID NO: 202059 - protein, 110 aa, Triticum aestivum
  unsure (1)..(110): unsure at all Xaa locations
  Clone ID: PAT_TA_96477.pep
DFXHTVHANHLPRGDATMXRXLVKAFKPFXELXVDXKXFDVSXLXKFXDASXTXKVVTFXKXPDNQPYLXKXFQXNAPKGKLXLXFSXGPFXSFKSXHXGVFEEXNGKGG

SEQ ID NO: 202060 - protein, 155 aa, Triticum aestivum
  unsure (1)..(155): unsure at all Xaa locations
  Clone ID: PAT_TA_96478.pep
FXXVXLXAXFXSPPCXXXGXPLXGGXPYXXFRXCCXXLIPAPKVQENFGWVPAKLSXPXREPAKXGFFXQFFTNPXPXFYPCFXWSQPNXNFXFXXWACRXXKMHXPLLCPXXKEXXXLFXFXLTGLXERTTAKSRXLKPXGQXXXGSRAXHGRX

SEQ ID NO: 202061 - protein, 86 aa, Triticum aestivum
  unsure (1)..(86): unsure at all Xaa locations
  Clone ID: PAT_TA_96479.pep
GEIXLGEXGXQKKXLKXKSLKLXGGGIPKKXYSGLXFFXXQVGIMQPENFFXPPPSRXETXFNXCSRRVXSYIQGTYXLLDFLPPL

SEQ ID NO: 202062 - protein, 81 aa, Triticum aestivum
  unsure (1)..(81): unsure at all Xaa locations
  Clone ID: PAT_TA_96480.pep
GXKKXGXXEXGPPXXXFPFLGKRGKKGSKPXXLGNLVCPFXRGGRPGFPRPXGDERGEVHHPPPGVCWGEGPLPNLRRIES

SEQ ID NO: 202063 - protein, 172 aa, Triticum aestivum
  unsure (1)..(172): unsure at all Xaa locations
  Clone ID: PAT_TA_96481.pep
PXWGGGGCPPXXFNPFGEVGXDPTKQXCLCPSNSSXFFFAXTFGPTAXLPLPGRXQXPNSPRXVSFLNPQFPLGHYKRXLXFXXPKSFEXLPXGTIDSSHQDCWNPGANKISLVAFLCFXGXRHXXLWGSFXSXPGSGXPRILLGVTNILCIPLTEENVQLPKPRXWPGWXT

SEQ ID NO: 202064 - protein, 143 aa, Triticum aestivum
  unsure (1)..(143): unsure at all Xaa locations
  Clone ID: PAT_TA_96482.pep
LXYTLDEMEGPLEXGADGXLKFEEKXXIDXAXXTVXLPGXEXVAFLFNVKXLVRTXKAERFXGPFPPAQATRVSSFLHPKGGVGGSKWXTXNAVGXYPAGRARGRTREEGQRKGRNAVPPPRGQTINASGQPKNPEPGGGGIW

SEQ ID NO: 202065 - protein, 109 aa, Triticum aestivum
  unsure (1)..(109): unsure at all Xaa locations
  Clone ID: PAT_TA_96483.pep
QGXPWVGWRLILGGTXLSMHSCSARXTRFFSQEFIVEAFAFGAGXLLPDLGSERVTCSPPXXLAGXLLWXPAPVASASRXSPLVILGSRKKGDXXWLELPGEGRVVCLV

SEQ ID NO: 202066 - protein, 226 aa, Triticum aestivum
  unsure (1)..(226): unsure at all Xaa locations
  Clone ID: PAT_TA_96484.pep
VXGRLLRTKWDXPGAGRNFXNEEQXNQPSNQGXNLHIKKQWPGQAVSQTQAKIXXKNNQLTPSFLGQGXFKTQRMAPQTLVQTRPGKAQWSINQLLFPFSXGNFLFLSFDSXCKGASKQPSKQARGEASLETRPQPTNQPRIGXPXAKLSPLPXQAKXARVDGPFGPXNFGXQAMKVSNLPQLVKFSTNQTXXPKKMXWSRALLAXRGXXAVXKXKGKAKAXLXXG

SEQ ID NO: 202067 - protein, 58 aa, Triticum aestivum
  unsure (1)..(58): unsure at all Xaa locations
  Clone ID: PAT_TA_96485.pep
MXGGAILSDIIPPPRRGXGGKXWXGXXKKRGKXDXAAGRXXPXPXEKGPSKARLFKGF

SEQ ID NO: 202068 - protein, 95 aa, Triticum aestivum
  unsure (1)..(95): unsure at all Xaa locations
  Clone ID: PAT_TA_96486.pep
ASPRIQIPPGKGLGXFLPPPXGSQRFLGVAFXQLLTKENLMXXXWXXKIPXGPFXPPFPKXKWXGESWXELARVKKDXRSXFXQXKQXVNXAAKE

SEQ ID NO: 202069 - protein, 79 aa, Triticum aestivum
  unsure (1)..(79): unsure at all Xaa locations
  Clone ID: PAT_TA_96487.pep
SEXKEHVVIPPAWGKVQAKGNDAIXLHVTACNAAGLRVELWVXCXGXVAGYLLLRXLIINYXPXCAXVCARSCEXYVGL

SEQ ID NO: 202070 - protein, 81 aa, Triticum aestivum
  unsure (1)..(81): unsure at all Xaa locations
  Clone ID: PAT_TA_96488.pep
RVDFPPPEGYGXIPLEQPPXRGXYWGXMFNPNWGSXELLPIRVSVVXLRXPDVSALPKKGSHRXFGIXVLXRXFSXTXXGP

SEQ ID NO: 202071 - protein, 112 aa, Triticum aestivum
  unsure (1)..(112): unsure at all Xaa locations
  Clone ID: PAT_TA_96489.pep
XXXVDXKXNFGCFCLGGKIXLMARQXXPRKXVYXLTKKPWXNQSLNSLEKXXSKXKXPPQGAXXPFFGXLXPPXAGFXVPSKNXPXTXGXXGXRXXSXGXKXGXKFPFFGXA

SEQ ID NO: 202072 - protein, 82 aa, Triticum aestivum
  unsure (1)..(82): unsure at all Xaa locations
  Clone ID: PAT_TA_96490.pep
RXVTCPXIXRVLTPSXETXRQPREARPPRPXVXHXXPRXEQXRNLYHRGGGXTTIRACVRSFCHGDLXXRRPVXEMEKIMAE

SEQ ID NO: 202073 - protein, 134 aa, Triticum aestivum
  unsure (1)..(134): unsure at all Xaa locations
  Clone ID: PAT_TA_96491.pep
PNLTLAXFCFIQPAQTYSRAKIATAKQXPREGQNNFSLDDPGIVSSXVVTSYYLATKRVKEPITLENFENNRNGIPFLLGLDRSTKHPCLALLAWGGTCNPVXXARPPGALSLRSLRSLGPPLXXCLLACPFVA

SEQ ID NO: 202074 - protein, 83 aa, Triticum aestivum
  unsure (1)..(83): unsure at all Xaa locations
  Clone ID: PAT_TA_96492.pep
KKRXVQRSGYKERPSKTLPGAPKGESLINPPQNNXASRSXKVWRXKXLCYAVQRFXRSTXSWETMLDXWXLACGXSTNRGVLF

SEQ ID NO: 202075 - protein, 87 aa, Triticum aestivum
  unsure (1)..(87): unsure at all Xaa locations
  Clone ID: PAT_TA_96493.pep
ANCCLRNSLWDRKPHQPIQKKKKKNPGGGRVPNSPXXWSXFXRXQLGXLFKSRXXGKNXGVSQIYXLVRXPPFXXMGGXKXXRAXPR

SEQ ID NO: 202076 - protein, 111 aa, Triticum aestivum
  unsure (1)..(111): unsure at all Xaa locations
  Clone ID: PAT_TA_96494.pep
RSPTTHPNIPGQETLFKLTQLTQIHNKFLFIGVASFGFLGGDFVIIXGAPSKAKHPLKXAHXFSDTYXPXXXRSLGVXPFXSQLLXFXTTXRKVLLQLHFXLELXXLACRX

SEQ ID NO: 202077 - protein, 139 aa, Triticum aestivum
  unsure (1)..(139): unsure at all Xaa locations
  Clone ID: PAT_TA_96495.pep
MARTKQTARKSTGGKAPRKQLATKAARKSAPATGGVKKPHRFRPGTVALREIRKYQXKSTELLIRKLPFQXRLVREXAQDFKTDLRFQXSSAVSALQEGAEGYLVGLFEDNKLCAIHAKRVNIMPXDIQLARRIVGERG

SEQ ID NO: 202078 - protein, 85 aa, Triticum aestivum
  unsure (1)..(85): unsure at all Xaa locations
  Clone ID: PAT_TA_96496.pep
XVNAGXVNKIVGVGXQADVEGIFXDSIPKKKXETFQPNWAGPKTIAREKWGRPVAKARVANSGLVRHGPPNKPCKEGTKGLSFNG

SEQ ID NO: 202079 - protein, 59 aa, Triticum aestivum
  unsure (1)..(59): unsure at all Xaa locations
  Clone ID: PAT_TA_96497.pep
WFNXSXPKARSKGTVSFPXSTNXPTKFFPXSITXGDXKXQQLFASLPEFPXQPGXIXLV

SEQ ID NO: 202080 - protein, 172 aa, Triticum aestivum
  unsure (1)..(172): unsure at all Xaa locations
  Clone ID: PAT_TA_96498.pep
NPWEFPAPPXRSSPPGXTCRKPXSSSKSTSGTKXVGKSMPAGXSSXDKEXFKPRATXLNNXXXEFRXARHGXQSTXKAQQSSKXXEXRWGKQSFXIXLTKXXTYKXXXWPGXPLLGFXXNPQRGGKXXNKXLRXWGXKKREGKXMQNCXXIXSDVXSRKXKVDXXSKKTGXV

SEQ ID NO: 202081 - protein, 66 aa, Triticum aestivum
  unsure (1)..(66): unsure at all Xaa locations
  Clone ID: PAT_TA_96499.pep
FGXASPPTLXXQXXCFLCPXFGSPWVCSALFNAXIFINRVHPACLXRIFHFAXPFXHGNPXHHXPI

SEQ ID NO: 202082 - protein, 110 aa, Triticum aestivum
  unsure (1)..(110): unsure at all Xaa locations
  Clone ID: PAT_TA_96500.pep
MAGRKGGDRKKAVTRSVKAGLQFPVGRIGRYLKKGRYAQRVGSGAPVYLAAVLEYLAAEVLELAGNASKDNKKTRIIPXRHLLLAVXNDQEARQGCSLGLTIRVALIPQK

SEQ ID NO: 202083 - protein, 25 aa, Triticum aestivum
  Clone ID: PAT_TA_96501.pep
FFFFFFFFFFFFFFFFFFFFFFFYF

SEQ ID NO: 202084 - protein, 90 aa, Triticum aestivum
  unsure (1)..(90): unsure at all Xaa locations
  Clone ID: PAT_TA_96502.pep
PIWFXCSNQYPCPLVNXALPXVSQXLQAIXGTNTAXVSQQVXPQXXNPFXGTXTKSAPQXXLIAPIXSSWXXKVXXHHLPXLPSNXXAWX

SEQ ID NO: 202085 - protein, 87 aa, Triticum aestivum
  unsure (1)..(87): unsure at all Xaa locations
  Clone ID: PAT_TA_96503.pep
MNGGGDESGSDHEGGGGTRKPLLLKNTGSWYRMVGSSSRQIVGASSMAVLRESHVSALLCTXIVALGPIQFGFTCGFSSPTQDAMIR

SEQ ID NO: 202086 - protein, 153 aa, Triticum aestivum
  unsure (1)..(153): unsure at all Xaa locations
  Clone ID: PAT_TA_96504.pep
PXXTTFXSAXWSXATTSQKRTWXQQVLIPGRXCXTLSYXPRDLSFPPVCTCFADNTSSKPLGTVXQXLQTYFHVFGXSSIGLGLSDPPVGTGSSSQAPFRXWLLQSTGRSGSRRCPHLLRRRCWSRGERGRXPWSPPXPTWPSLRRRPPAPSP

SEQ ID NO: 202087 - protein, 134 aa, Triticum aestivum
  unsure (1)..(134): unsure at all Xaa locations
  Clone ID: PAT_TA_96505.pep
RSCSGCRRSVRPQCVAALLLGAAVVLSALFWLPPFAGRHRGRRAGPPDPPGDALAADIVASFVLQKTVSELNESIPKLEFDIYEEIGIPNSTVAVNFLQPSGASNWTNVIFSVVPYPKYSXMSSTWLSILRFSI

SEQ ID NO: 202088 - protein, 108 aa, Triticum aestivum
  unsure (1)..(108): unsure at all Xaa locations
  Clone ID: PAT_TA_96506.pep
XEFFFFFFFFFFXTFXXFPLGVKNIMTLLKMFXGXHXHDCLFNLEPXXPXXPXLDLNACRXQLIPXHVHXXYYTHRSXVQXXGXNDXPXMXLVEMXKSWVXTRSXLFL

SEQ ID NO: 202089 - protein, 36 aa, Triticum aestivum
  unsure (1)..(36): unsure at all Xaa locations
  Clone ID: PAT_TA_96507.pep
MGSISGSAVSFAKPVMATNXNXLSFSXAXRGNXFLR

SEQ ID NO: 202090 - protein, 133 aa, Triticum aestivum
  unsure (1)..(133): unsure at all Xaa locations
  Clone ID: PAT_TA_96508.pep
ARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTXNLCAIHAKRXVTIMPKGTSKLAPPAIWRRRA

SEQ ID NO: 202091 - protein, 77 aa, Triticum aestivum
  unsure (1)..(77): unsure at all Xaa locations
  Clone ID: PAT_TA_96509.pep
LSSQDNRVAFDLGQSRCSXLSHLPNLXNVSTKRRTKTGTNPGLXVCLSGRNSIHLKTRSVKPNSLGRGGAPXSPSSR

SEQ ID NO: 202092 - protein, 56 aa, Triticum aestivum
  unsure (1)..(56): unsure at all Xaa locations
  Clone ID: PAT_TA_96510.pep
AFVQFSSICPVYLYLXVRLVEMRLCPVFSGLYWSFMPCLFQSFTMCGSLCASRNCA

SEQ ID NO: 202093 - protein, 53 aa, Triticum aestivum
  unsure (1)..(53): unsure at all Xaa locations
  Clone ID: PAT_TA_96511.pep
GYLYIXWKGWXIXDMXFATKRGLAXACIIVXKHLXQVSQXAHASKXHLAGRXD

SEQ ID NO: 202094 - protein, 85 aa, Triticum aestivum
  Clone ID: PAT_TA_96512.pep
KLLFIYIRSNQLVCFLKFYLLFMYIFTALLSMAQPSGSESSGRGKDNDDLTPIPFTLHRDGNTSLRYLYLEMPSGMEGIFKSTAL

SEQ ID NO: 202095 - protein, 151 aa, Triticum aestivum
  unsure (1)..(151): unsure at all Xaa locations
  Clone ID: PAT_TA_96513.pep
EPAPVLRSCLKESVDPDRWEFAQRXFLHSQMHLLPRIVRRQSVGKRGGKDGKNKEEDDGESSSTMLVMGMVRLRREQTASEESVAEMWRQVXETEHRPKQILAFLLKVVDNPDLLCRLAGSSGNDPDEGAEVKRPWLLLDGDNAWGLGESL

SEQ ID NO: 202096 - protein, 128 aa, Triticum aestivum
  unsure (1)..(128): unsure at all Xaa locations
  Clone ID: PAT_TA_96514.pep
MQAAAAVHRPHLLAASPLGGRASRRPSTVRMALREDGPSVAIVGATGAVGQEFLRVITARDFPYRSLRLLASERSAGKRIDFEGRDYTVQDLAAPGAFDGVDIALFXAGGSINRAQAPAAVAKGRPRG

SEQ ID NO: 202097 - protein, 152 aa, Triticum aestivum
  unsure (1)..(152): unsure at all Xaa locations
  Clone ID: PAT_TA_96515.pep
ASSVLTASSSLASFPRRHPPRKGGCLAAAATAGAAPAASAATAAXGARCSPTWRXPPAPPPWSCPPPPTRGAPAGSXRPGXPAAATAPPASAAPXAAAPAAXATEPAPXRXAGRGEAXGXRRTXXQAPSXPXSPXXSGIITSRPHALGRLNK

SEQ ID NO: 202098 - protein, 147 aa, Triticum aestivum
  unsure (1)..(147): unsure at all Xaa locations
  Clone ID: PAT_TA_96516.pep
MSPQTETKAGVGFKAGVKDYKLTYYTPEYETKDTDILAAFRVSPQPGVPPEEAGAAVAAESSTGTWTTVWXDGLTSLDRYKGRCYHIEPVAGEDSQWICYVAYPLDLFQEGSVTNMFTSIVGNVFGFKGPTVLYVWXDLRISPXXFK

SEQ ID NO: 202099 - protein, 138 aa, Triticum aestivum
  unsure (1)..(138): unsure at all Xaa locations
  Clone ID: PAT_TA_96517.pep
ASTADISQKTVPALSVPSTQPVTETSLINRKVVTRWXPLKLVYGHDIRLGEMPEKCSFQTLREVVAKRFPSSKAVLXKXKDADGDLVTITCTSELRLAEACGVGTDAMEGDTKLPMXRLHIVEVSPXQEPPLPTEAQG

SEQ ID NO: 202100 - protein, 86 aa, Triticum aestivum
  unsure (1)..(86): unsure at all Xaa locations
  Clone ID: PAT_TA_96518.pep
MXRTKQXARXSTGGKAXRKQLATKAARKSAPXTGXVKXPHRFXPGXVXLXEIXKYXXSXELLIXKLPFQXLVQXXSPXXFXXDLRF

SEQ ID NO: 202101 - protein, 89 aa, Triticum aestivum
  unsure (1)..(89): unsure at all Xaa locations
  Clone ID: PAT_TA_96519.pep
MDASATVATGKGKKGAAGRKAGGPRKKSVSRSVKAGLQFPVSRIGRFLKKXGRYAQRVGSGAPRLTSRPVLGVPRPPSCWSSAGQRPPE

SEQ ID NO: 202102 - protein, 88 aa, Triticum aestivum
  Clone ID: PAT_TA_96520.pep
NTEDSKGIITTTVSSHVVQNSYAPSRTLVIGKVAFMGLRSPPKGFTVYVNGAELKAAGTKSRTNGVFSVSGLSLVIGQQFEVKVVTSH

SEQ ID NO: 202103 - protein, 132 aa, Triticum aestivum
  unsure (1)..(132): unsure at all Xaa locations
  Clone ID: PAT_TA_96521.pep
PLPADVPGDSFRDPTTAWVGRDGLWRIAVAAKVGGPNGIASTLIYRSKDFRHWKRNALPLYTSRAAGMVECPDLFPVAEPGVEEGRLGYASGPASSAVRHVLKLSVMNTTQDYYAVGRYXDMGHLWCREGGM

SEQ ID NO: 202104 - protein, 92 aa, Triticum aestivum
  unsure (1)..(92): unsure at all Xaa locations
  Clone ID: PAT_TA_96522.pep
CTAIXTLRGHSSQQLGYLQSSQKTSXLYMPPVKGXQCTXTXCQCMSXMSVPSXXGXIXANSMXDLGIPRETLXNXSWVVXGXTFAXXXXLSN

SEQ ID NO: 202105 - protein, 124 aa, Triticum aestivum
  unsure (1)..(124): unsure at all Xaa locations
  Clone ID: PAT_TA_96523.pep
MANPRVFFDMTVGGAPAGRIVMELYKDAVPRTVENFRALCTGEKGVGKSGKPLHYKGSAFHRVIPDFMCQGGDFTXGGNGTXGESIYGRRKFGPKFGPTITPRGSSSNGPNAGATTNGVPSFNL

SEQ ID NO: 202106 - protein, 136 aa, Triticum aestivum
  unsure (1)..(136): unsure at all Xaa locations
  Clone ID: PAT_TA_96524.pep
MVSGSGVCAKRVVVDARHHMLGRLASIVAKELLNGQRVVVVRCEEICMSGGLVRQKMKYLRFLRKRMNTKPSHGPIHFRAPAKILWRNNRGMIPXKNARXEAALAXLKXXEGVXPXXXEKDQXAXXXPXGXKGLRG

SEQ ID NO: 202107 - protein, 120 aa, Triticum aestivum
  unsure (1)..(120): unsure at all Xaa locations
  Clone ID: PAT_TA_96525.pep
PYAPTHGGPAGTPAVLEGARRTRTAAPRFRLLSHSSPPSPWPWGAGRACSPWRFSPPLGSPTLLHRISRHTATKQYVNCMPCSRTYVAXAYARXLNKPXFLNIMTLPKYLKTLNXCKGTC

SEQ ID NO: 202108 - protein, 81 aa, Triticum aestivum
  unsure (1)..(81): unsure at all Xaa locations
  Clone ID: PAT_TA_96526.pep
MASIAGSAVSFAKPVKAINTNSLSFSGPRRGNAFLRLQPVXMRFAVCCSAKQDTVEKVCEIVKKQLAVPEGTXVCGTTKVL

SEQ ID NO: 202109 - protein, 68 aa, Triticum aestivum
  unsure (1)..(68): unsure at all Xaa locations
  Clone ID: PAT_TA_96527.pep
SGSAVNGGHWFASNRLATQLPLGRPIGQRCSEHGSLQCASTVRCKINQKRVTPXGIKLLTTPLVNSWR

SEQ ID NO: 202110 - protein, 63 aa, Triticum aestivum
  unsure (1)..(63): unsure at all Xaa locations
  Clone ID: PAT_TA_96528.pep
APSLKKRKRKKXQSPIQILLATFSFFWFVRYISQMHIFGTNFKXHRFVKKKTISXSRYNMVXN

SEQ ID NO: 202111 - protein, 119 aa, Triticum aestivum
  unsure (1)..(119): unsure at all Xaa locations
  Clone ID: PAT_TA_96529.pep
MSGRGKXGXGLGKGXAXRHRKVLRDNIQGITKPAIRRLARRGGVKRISGLIYXETRGVLKIFLENVIRDAVTYTEHAXRKTVTAMDXVYALKRQGPAPSTGFGGDWVPRGGSSLDWVCP

SEQ ID NO: 202112 - protein, 87 aa, Triticum aestivum
  unsure (1)..(87): unsure at all Xaa locations
  Clone ID: PAT_TA_96530.pep
LLYESCESFMPRAGLLVKEGPIYWSHPLGFVGDQIHKCMPNYRPXELYVNLVLLYLIIIWGPTKIYIGXSSLKXKGGXRYPXPPNSE

SEQ ID NO: 202113 - protein, 132 aa, Triticum aestivum
  unsure (1)..(132): unsure at all Xaa locations
  Clone ID: PAT_TA_96531.pep
PAPKAAPHPARPTDAPSSPPPPRHARPKPYPLRPSRRPDLPALRRRRGRRRHGGRRHHHAHGHRRLPPQRRRRRLPRRXXRGGPPPLPPHGRXRERGARXPPPSPGFFNERPTFTPDLGSEGVLRVLVYGLG

SEQ ID NO: 202114 - protein, 68 aa, Triticum aestivum
  unsure (1)..(68): unsure at all Xaa locations
  Clone ID: PAT_TA_96532.pep
LNXDGGDDXDDLRRXSXCTGWWYXXRRRXRPSGTAXXCWRTXXRTXSRXTAPXXSXPSLSXAASXYPL

SEQ ID NO: 202115 - protein, 92 aa, Triticum aestivum
  unsure (1)..(92): unsure at all Xaa locations
  Clone ID: PAT_TA_96533.pep
MKGYPREEIQWRQXGPVAQRIRARGYEPRCRGFESLLAHSLPKGXKGLYFPPEGRKIMIGIXDVXLFXLKGMVFPFVESGNRRMLITMKGWW

SEQ ID NO: 202116 - protein, 98 aa, Triticum aestivum
  unsure (1)..(98): unsure at all Xaa locations
  Clone ID: PAT_TA_96534.pep
MLSSHPHEAAMLPYVPRPPSLLVDRRYSTGAEVAPNCPXRCDSPNTXFCYYNKYSXXQAALTSAKGCRRXLGTRAGLLRXVPXRGGCPGTGGEVRVVR

SEQ ID NO: 202117 - protein, 102 aa, Triticum aestivum
  unsure (1)..(102): unsure at all Xaa locations
  Clone ID: PAT_TA_96535.pep
MSPQXXTKAGVXFKAGVKDYKLTYYTPQYETKDTDILAAFRVSPQPGVPPXEAGAAVAAESSTGXTWTTVWTDGLTXSLDRYKGXCYHIXAXXLGXXSQWVR

SEQ ID NO: 202118 - protein, 84 aa, Triticum aestivum
  unsure (1)..(84): unsure at all Xaa locations
  Clone ID: PAT_TA_96536.pep
YXVRFKMPFXKVNPINVCSTQELMKYLCTKGRSKLQPIKIKTVTHSLLFTFIENNVSRRKHKLQSFYIYCLNMVSKLTNKRNKA

SEQ ID NO: 202119 - protein, 147 aa, Triticum aestivum
  unsure (1)..(147): unsure at all Xaa locations
  Clone ID: PAT_TA_96537.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEXKFVQKHNKPGNPLHXQTPGPTXXXSQXFFICXVPWNWVHRKHVXVFGEGXQGM

SEQ ID NO: 202120 - protein, 93 aa, Triticum aestivum
  Clone ID: PAT_TA_96538.pep
SIHPSIRPPQPQHPPRSSPPQRRASAHVHFPPRAVPLQCVTTNRRHATPRRRLSTRPAACMLGRRRRRNSSRSFVLRFLLASWFVGVSAKLNP

SEQ ID NO: 202121 - protein, 159 aa, Triticum aestivum
  unsure (1)..(159): unsure at all Xaa locations
  Clone ID: PAT_TA_96539.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCKRGVPPRGKLNNDXLKAGXQRFRGEGISNQRGQAKQGPKXPGXMVGGXQQXKXXNPHP

SEQ ID NO: 202122 - protein, 70 aa, Triticum aestivum
  unsure (1)..(70): unsure at all Xaa locations
  Clone ID: PAT_TA_96540.pep
XNGTSAXALTPXXDSXXCTCLXXDRHPEWXYPSXRVPXPGRDLFXCSVAXWSGGSRXGKKKKKKKKKKKX

SEQ ID NO: 202123 - protein, 160 aa, Triticum aestivum
  unsure (1)..(160): unsure at all Xaa locations
  Clone ID: PAT_TA_96541.pep
MSPQTETKAGVGFKAGVKDYKLTYYTPEYETKDTDILAAFRVSPQPGVPPEEAGAAVAAESSTGTWTTVWTDGLTXSLDRYKGRCYHIEPVAGEDSQWICYVAYPLDLFEEGSVTNKFTSIVGYVFGFKXLRAPRLXEDXRIPPTYSKTSKGRPKGNXVE

SEQ ID NO: 202124 - protein, 43 aa, Triticum aestivum
  unsure (1)..(43): unsure at all Xaa locations
  Clone ID: PAT_TA_96542.pep
XXEFFFFFFFFFFFFFFFFFFFLRLKIFIHKTPKSKILQTWVS

SEQ ID NO: 202125 - protein, 65 aa, Triticum aestivum
  unsure (1)..(65): unsure at all Xaa locations
  Clone ID: PAT_TA_96543.pep
XFFFFFFFXFXFFFFFYSAQILTFVLLRHMQSYEQVNTSDRLTIRKPNASDCPLNKRKKQLLVIS

SEQ ID NO: 202126 - protein, 49 aa, Triticum aestivum
  unsure (1)..(49): unsure at all Xaa locations
  Clone ID: PAT_TA_96544.pep
KTKKKMEVSYHISEGSKLYISXLKLKIKKSKFKVSNYIFFKYAIISILK

SEQ ID NO: 202127 - protein, 86 aa, Triticum aestivum
  Clone ID: PAT_TA_96545.pep
SCPPILHLDGEVLVIWTPSSFKQEIKTRYVGVSGPGNCHQSVQGLPLHLGALLHGALLAGRPFESKSSGYQHVLEQVTVAAGRWME

SEQ ID NO: 202128 - protein, 56 aa, Triticum aestivum
  unsure (1)..(56): unsure at all Xaa locations
  Clone ID: PAT_TA_96546.pep
AGGXCRXGGVSRAEYGRQKPKAXAAAIGGEEAEEGDRNGVGGGRCHRPLSLXTRXR

SEQ ID NO: 202129 - protein, 123 aa, Triticum aestivum
  unsure (1)..(123): unsure at all Xaa locations
  Clone ID: PAT_TA_96547.pep
MAGATMALSSPAMAGTPVKASRAAPFGEGRITMRXTAGKPKVXASXSXPWYGSDRVLYLGPLSGDPPXYLTXXFPXXYXWDXGGGFGLSPENPPNRGAGGFQLGANSVARGCSFSLLRPQRRV

SEQ ID NO: 202130 - protein, 115 aa, Triticum aestivum
  unsure (1)..(115): unsure at all Xaa locations
  Clone ID: PAT_TA_96548.pep
NPQTQNSRYALHVQIXQTVFAKHMSRRELHSNESVFLHTNATFLHCMFLCSKLHARHEPHHVLPRITWQRRXTKTXXPDRRQKQPPWDETMGSXXXLEXXREXXPPAQLPXXAXF

SEQ ID NO: 202131 - protein, 117 aa, Triticum aestivum
  unsure (1)..(117): unsure at all Xaa locations
  Clone ID: PAT_TA_96549.pep
VPFNGPDNRNNELQRRRENVVPSTGRPQQRLVMKNWSPYNDVSNNKQYNYVQDSFARRNVGDNVVSSPQVPRSAANNINLNIGARNDGSHAXSAHNNDSFMAGSSAMXMPSVAEWEC

SEQ ID NO: 202132 - protein, 77 aa, Triticum aestivum
  Clone ID: PAT_TA_96550.pep
RASEIAINLHPVFYKDSVRSYEWEDTYTLPFHMFSSQGASYIESLQLTFASLKLPGDFDGPLNLRVLDLQTVHVSEG

SEQ ID NO: 202133 - protein, 95 aa, Triticum aestivum
  Clone ID: PAT_TA_96551.pep
MFGFGHHHKDQAPPASGPNQIFKIYCRASEDYCLAVRDGEVVLAPVNPKDETQHWLKDMRFSTTVKDEEGMPGFALVNKGQPGLARQTPSAKSPP

SEQ ID NO: 202134 - protein, 57 aa, Triticum aestivum
  unsure (1)..(57): unsure at all Xaa locations
  Clone ID: PAT_TA_96552.pep
RWEXTAXGAXGDGEXTHALGGRAEERGEGPXHHHGRGSGAGSXXGLCAAAXPXSGVG

SEQ ID NO: 202135 - protein, 68 aa, Triticum aestivum
  unsure (1)..(68): unsure at all Xaa locations
  Clone ID: PAT_TA_96553.pep
ILSMANAGPNTNXSQFFICTVPCNWLDGKHVVFGEVVEGMDVVKNIEKVGSRSGTCSKQVVIADCGQL

SEQ ID NO: 202136 - protein, 88 aa, Triticum aestivum
  unsure (1)..(88): unsure at all Xaa locations
  Clone ID: PAT_TA_96554.pep
ILLETHPWARIQARRRPSRXTGMXREVRPVSLLXRGARQXRRTAPYKQVRLSLSXARWGLXSLPRRCVKPLVPGWWYXPGPXSHPFGX

SEQ ID NO: 202137 - protein, 107 aa, Triticum aestivum
  unsure (1)..(107): unsure at all Xaa locations
  Clone ID: PAT_TA_96555.pep
MANPRVFFDMTVGGAPAGRIVMELYKDAVPRTVENFRALCTGEKGVXKSGKPLHYKGXSSFHRRDXRLHVARAGDFTKGNGNRAGGVPIRKKRPESSVPSTPGPPPW

SEQ ID NO: 202138 - protein, 127 aa, Triticum aestivum
  unsure (1)..(127): unsure at all Xaa locations
  Clone ID: PAT_TA_96556.pep
EHALLAFTLGVKQMICCCNKMDATTPKYSKARYEEIVKEVSSYLKKVGYNPEKVPFVPISGFEGDNMIERSTNLDWYKGPTLLEAXLDKXNXPQRGPQRQSPLSSPMVNLGAGNLPKWKGERLWPLG

SEQ ID NO: 202139 - protein, 77 aa, Triticum aestivum
  Clone ID: PAT_TA_96557.pep
PTTLLTLYYKLDSVCGSSNSNRVCVCLLLGQLYILSLDMPSLCWPHPFLSTEEPFVLDPFVPVIKLMNCGLRPNPVC

SEQ ID NO: 202140 - protein, 112 aa, Triticum aestivum
  unsure (1)..(112): unsure at all Xaa locations
  Clone ID: PAT_TA_96558.pep
MGKEKIHISIVVIGHVDSGKSTTTGHLIYKLGGIDKRVIERFXEGKPXXMNKRSFKXIAWVLDKLKAEXEKGINIXIAPVEIRPTKLLLAGQFESGRSIKETIDQPGDPPKG

SEQ ID NO: 202141 - protein, 105 aa, Triticum aestivum
  unsure (1)..(105): unsure at all Xaa locations
  Clone ID: PAT_TA_96559.pep
PTPASEDAPKPSRPPPRRRLXPPPLHRRPAXPNXRXXSPATFSXGPHXPCTXPXLLDGLXXGRXRGEXASXPXRGRRSRLPWTEXGDGVLQRXRPPXXXDXGRRG

SEQ ID NO: 202142 - protein, 76 aa, Triticum aestivum
  unsure (1)..(76): unsure at all Xaa locations
  Clone ID: PAT_TA_96560.pep
SQIFSEGGLDYLGNPSLVXAQSILAIWACQVVLMGAVEGYRVAGGPLGEIVDPLYPXGSFDPLGLADDPRGILGCS

SEQ ID NO: 202143 - protein, 121 aa, Triticum aestivum
  unsure (1)..(121): unsure at all Xaa locations
  Clone ID: PAT_TA_96561.pep
MAGATMALSSPAMAGTPVKASRAAPFGEGRITMRKTAGKPKVAASSSPWYGSDRVLYLGPLSGDPPSYLTGEFPGDYGWDTAGLSADPXDLRQNRGSLGGSNGGANASGGAGLSFRSPEGQ

SEQ ID NO: 202144 - protein, 141 aa, Triticum aestivum
  unsure (1)..(141): unsure at all Xaa locations
  Clone ID: PAT_TA_96562.pep
GCGSCYQIRCVSAGHPACSGVPETVIITDMNYYPVSRFHFDLSGTAFGAMAKDGRNDELRHAGIIDMQFRRVPCQYPGLTVTFHVQHGSNPYXWPSWVEYXNXDGRWKWDNNANQRAGTPRKGIPGGWWPITVLGGPGGTR

SEQ ID NO: 202145 - protein, 126 aa, Triticum aestivum
  Clone ID: PAT_TA_96563.pep
MSVLRRALLLGHRLRRGLSSGADLPPPRPSASRRVVVTGLGAVTPLGRGVGSTWDRLVAGDCAVRALAAEDLRLSGDAAERTLGQLPSRVAGRRAARGRARPDFDEGGVDQGTSISGFIAWLYFAY

SEQ ID NO: 202146 - protein, 55 aa, Triticum aestivum
  unsure (1)..(55): unsure at all Xaa locations
  Clone ID: PAT_TA_96564.pep
VGSRNQPXRINRPXLWXGXXKXARXXPRGHXXRTQKRLPPPRHEXTTRQKTXPXK

SEQ ID NO: 202147 - protein, 72 aa, Triticum aestivum
  unsure (1)..(72): unsure at all Xaa locations
  Clone ID: PAT_TA_96565.pep
FNSGLARPGAASSEAVXXRSXXNHRLPRXRWNXIRGXEXXQSXEEGRRKERERERERERERERERERERERE

SEQ ID NO: 202148 - protein, 76 aa, Triticum aestivum
  unsure (1)..(76): unsure at all Xaa locations
  Clone ID: PAT_TA_96566.pep
LLMGHSXKLALSFGLLXXGSRXTIPIXXNLRICEDCHWFMRLASRVEQAEIIVXXNMRFHHFKDGECSCGGFXKKK

SEQ ID NO: 202149 - protein, 113 aa, Triticum aestivum
  unsure (1)..(113): unsure at all Xaa locations
  Clone ID: PAT_TA_96567.pep
MXAPRGAALVLAMVLAXMLVAPPXXXHAISCSTVXSTLMPXLHYVQQGGSPARGCCTGIQXLLADANNSPDXRTIXGPRTSPGASGGPRSPAAGRGASCGPPQGSASNCRIQL

SEQ ID NO: 202150 - protein, 120 aa, Triticum aestivum
  unsure (1)..(120): unsure at all Xaa locations
  Clone ID: PAT_TA_96568.pep
AHRDLHAAFIIRSRRTLAPLAFLPAHPSPRLAVSPHAAAKMPFXXFVXIRRVALVNYXKDYGRLVVIVDVVXXSXXLVDAPDXVRCQVNFXPLSXGGDIXIGHQRSLGEGRLLIKGPMGK

SEQ ID NO: 202151 - protein, 90 aa, Triticum aestivum
  unsure (1)..(90): unsure at all Xaa locations
  Clone ID: PAT_TA_96569.pep
MGPDXLXXAAAAEEAAPFSFSIWPPTHRTRDAVXRXLVETLXGDTLLCKRYGPRAGPPARRIEPRAFRRPPAVYCPPPGAEVQPRGCNLL

SEQ ID NO: 202152 - protein, 116 aa, Triticum aestivum
  unsure (1)..(116): unsure at all Xaa locations
  Clone ID: PAT_TA_96570.pep
MARTKQTARKSTXXKAPRKQLAXXAARXSAPATGGVKKXHRFRPGXVALREIRRYQXSSELLIRKAPLPAXLVXEIAQDFKDPTSXSXSSARSPRLGGRRRALGGGFEGQTNLGNA

SEQ ID NO: 202153 - protein, 55 aa, Triticum aestivum
  unsure (1)..(55): unsure at all Xaa locations
  Clone ID: PAT_TA_96571.pep
DLHSEISTSVSVTVEMIRFTCISISKIHTTSCLFLLIIKTRAGAXVRIKSGPDQG

SEQ ID NO: 202154 - protein, 96 aa, Triticum aestivum
  unsure (1)..(96): unsure at all Xaa locations
  Clone ID: PAT_TA_96572.pep
FPFLAAAAASYPLEADPTMXXVDVDTEVAAGAQPKKRTFRKFSYRGVDLDALLDMSTDDLVQMFPARARRRFKRGLKRKPMALVKKLRKAKNDAPW

SEQ ID NO: 202155 - protein, 92 aa, Triticum aestivum
  unsure (1)..(92): unsure at all Xaa locations
  Clone ID: PAT_TA_96573.pep
MASXQANLXXXQLRQSYRXLWXTDLPXXIXADFPXCCLXLWCXPCVSXMLRXRALYXXMSRYVPVVYSNVGQGCWVEGGFWSLEGGWFLLNL

SEQ ID NO: 202156 - protein, 141 aa, Triticum aestivum
  unsure (1)..(141): unsure at all Xaa locations
  Clone ID: PAT_TA_96574.pep
MAGRKGGDRKKAVTRSVKAGLQFPVGRIGRYLKKGRYAQRVGSGAPVYLAAVLEYLAAEVXELAGNAXAXDNREGPRIIPXHXLLXVRXEQXAPGSLLAWXSHXPRVGVIPNXNXXXGSPXEXPPGXXAGKXEXKGRPKKE

SEQ ID NO: 202157 - protein, 98 aa, Triticum aestivum
  unsure (1)..(98): unsure at all Xaa locations
  Clone ID: PAT_TA_96575.pep
MSDTDEHHFESKADSGASKTYPQQAGAIRKGGHIVIKARPCKVVEVSTSKTGKHGHAKCHFVAIDIFNGKRKLEDIVPSSHNCDVPXVDRQDYQAELT

SEQ ID NO: 202158 - protein, 71 aa, Triticum aestivum
  unsure (1)..(71): unsure at all Xaa locations
  Clone ID: PAT_TA_96576.pep
XKPXXHXRSGXXRMDPTXQSPXEVYSVWALPPXPVRXRLRGLMVGLRXAHGGPPFXPHATVVGXVRMXRPR

SEQ ID NO: 202159 - protein, 53 aa, Triticum aestivum
  unsure (1)..(53): unsure at all Xaa locations
  Clone ID: PAT_TA_96577.pep
PRRRXTPPHXXAPPLTXKPRRKPLLXHDRAXQXHAGKVRKXCEEXELXGGDXX

SEQ ID NO: 202160 - protein, 71 aa, Triticum aestivum
  unsure (1)..(71): unsure at all Xaa locations
  Clone ID: PAT_TA_96578.pep
FXPTHRNIDPISQNPPSNPMLITXELMPPNFSLPVNDAPIRIGDEIDRNFPLSIFITHRSADEILPGRQIG

SEQ ID NO: 202161 - protein, 102 aa, Triticum aestivum
  unsure (1)..(102): unsure at all Xaa locations
  Clone ID: PAT_TA_96579.pep
TMSGRGKGWKGICXGXANLHXKVLRXXIQGITKPXIRXLARRGXVXRISGLIYXETRGXVLKIFLENVIRDAVTYTXHARRXTVTAMVRSSTPSKPHPSNFA

SEQ ID NO: 202162 - protein, 148 aa, Triticum aestivum
  unsure (1)..(148): unsure at all Xaa locations
  Clone ID: PAT_TA_96580.pep
SLRCDVNVSVRPIGQSEFSTKVEIKNMNSFSEISRAIXXEIAXQILLHXKSQADKIVQETRLWDESSQKTFTMRKKEGLADYRYFPEPDLPEVVLTXDYIDXFRNSMPELPXAKRXAYENMGLNKEDVIFLGNDHFVAQFFGSTLEQG

SEQ ID NO: 202163 - protein, 128 aa, Triticum aestivum
  unsure (1)..(128): unsure at all Xaa locations
  Clone ID: PAT_TA_96581.pep
MSPQXXXKAGVGFKAGVKDYKLTYYTPEYETKDTDILAAFRVSPXPGVPPXEAGAAVXAXSSXGTWTXVWTDGLTSLDRYXGRFYHIXXVAGEDXQWIXYVXYPLXLFXXGVPVXNXMFTSIVGXVFG

SEQ ID NO: 202164 - protein, 138 aa, Triticum aestivum
  unsure (1)..(138): unsure at all Xaa locations
  Clone ID: PAT_TA_96582.pep
SRXLLLEXXTXVXGINPPKKRXCSLGXPAXRSFPGKRLSSXXYRCNGXXXASXPGXDXPRRPXGSSRETGVXLXLMVGYDRIASKKGSSEKATGSSREAALCSVLMMRSXTWLGFKPGLVVGDVLSLXSAGAGGHKGA

SEQ ID NO: 202165 - protein, 108 aa, Triticum aestivum
  Clone ID: PAT_TA_96583.pep
MGKEKTHINIVVIGHVDSGKSTTTGHLIYKLGGIDKRVIERFEKEAAEMNKRSFKYAWVLDKLKAERERGINIDIALWKVRRPTSNWQPSPGSTDFNQRNNDPVPPKA

SEQ ID NO: 202166 - protein, 70 aa, Triticum aestivum
  unsure (1)..(70): unsure at all Xaa locations
  Clone ID: PAT_TA_96584.pep
XSMGISLKDARVEVEKIIGRGSGFVAVEIPFTPRAKRVLELSLEEARQLGHNYIGSEHLLLGLLREGEGV

SEQ ID NO: 202167 - protein, 125 aa, Triticum aestivum
  unsure (1)..(125): unsure at all Xaa locations
  Clone ID: PAT_TA_96585.pep
DEEDRGAVGENKTCERNNPLRWRQRFVLRRGKSAVTPLSDRRRFSGRPLQLPSRRSGGGCCQGLAMAEAHSASSPPPNHRVFLIIRTRVVDIFLKRGMNGLMKQKASSNHPGFXIGXQXEQSXKS

SEQ ID NO: 202168 - protein, 99 aa, Triticum aestivum
  unsure (1)..(99): unsure at all Xaa locations
  Clone ID: PAT_TA_96586.pep
HHPLVSRLWPTLKRRPQGGRRREGAFIARSHGSEIFLQSQDHGESERAPHNNDAFKKECDTRTRQHXRIRRGRKLDFFRXCXTTTCSYLAQPTINILLG

SEQ ID NO: 202169 - protein, 131 aa, Triticum aestivum
  unsure (1)..(131): unsure at all Xaa locations
  Clone ID: PAT_TA_96587.pep
MANPRVFFDMTVGGAPAGRIVMELYKDAVPRTVENFRALCTGEKGVGKSGKPLHYKGSAFHRVIPDFMCQGGDFTRGNGTGGESIYXEKFADEXKFVQKQTKPGXLSMXNAGANNNXSXFXNXXTVPCNWV

SEQ ID NO: 202170 - protein, 132 aa, Triticum aestivum
  unsure (1)..(132): unsure at all Xaa locations
  Clone ID: PAT_TA_96588.pep
MARTKQTARKSTGGKAPRKQLATKAARKSAPATGGVKKPHRFRPGTVALREIRKYQXKSTELLIRKLPFQRLVREIAQDFKTDLRFQSSAGVRAPRGPPRPTSWGCSKDNKLCANPTPKRVXNQCPKGHSPQ

SEQ ID NO: 202171 - protein, 101 aa, Triticum aestivum
  Clone ID: PAT_TA_96589.pep
MPRRAIEVRADGAAPKWCMSLLENTFTAFLKSPGADADAKAVFAEGSLFSPYLFGKFFDPADAFPMWEFESDVLLAALRRGARTTVDWAENDCEYCLKSPT

SEQ ID NO: 202172 - protein, 159 aa, Triticum aestivum
  unsure (1)..(159): unsure at all Xaa locations
  Clone ID: PAT_TA_96590.pep
XXGPXXXPXLGDAXPRXRRRAGLLPVXATTXIXXPTRRFSAGGRWFPQRAPAXRXLDAPQNERGRAAGNGDVVVVESLGYCKDDEEEAGGGECPLADQPDSIRARRRRLLLAHSQRQRRHLAVLVHGSSLLLRGVHGSNPSVAGRMWELLPRWLLVGCG

SEQ ID NO: 202173 - protein, 155 aa, Triticum aestivum
  unsure (1)..(155): unsure at all Xaa locations
  Clone ID: PAT_TA_96591.pep
RQVYLTGEKRREAKMSGRGKGGKGLGKGGAKRHRKVLRDNIQGITKPAIRRLARRGGVKRISGLIYEETRGVLKIFLENVIRDAVTYTEARPPARPSPPLDVVYALXRQGRTLYGFRRLGQPPPRLRGVWGFVVRLIVICKSAGGGPGYPKFRPY

SEQ ID NO: 202174 - protein, 44 aa, Triticum aestivum
  unsure (1)..(44): unsure at all Xaa locations
  Clone ID: PAT_TA_96592.pep
AEXXEREREREREREREXERERERERERERERERERERERERER

SEQ ID NO: 202175 - protein, 84 aa, Triticum aestivum
  unsure (1)..(84): unsure at all Xaa locations
  Clone ID: PAT_TA_96593.pep
SQARWCTSRTRXHGRTPSVSXSSLKXXXPGEXPTKRAKAGGSQTXXKVXIXITPQXXVFVXAEFNQQXXFHXQXIXXCLPXCWG

SEQ ID NO: 202176 - protein, 150 aa, Triticum aestivum
  unsure (1)..(150): unsure at all Xaa locations
  Clone ID: PAT_TA_96594.pep
PPPNPTRAAAPRGSSATMSGRGKGGKGLGKGGAKRHRKVLRDNIQGITKPAIRRLARRGGVKRISGLIYEETRGVLKIFLENVIRDAVTYTEARTXRKTVTAMDVVVRRSKRQGPEPSNGFRRRPLGPPPRVRQVFRPPTCFPFVPARFS

SEQ ID NO: 202177 - protein, 73 aa, Triticum aestivum
  Clone ID: PAT_TA_96595.pep
MDGHRRAPRQILVLEEAFKKCPHPDQTQVANLSRETGMEVHQIQYWFQTRRAQIKGSSSNTRPPTKGSSSPDP

SEQ ID NO: 202178 - protein, 42 aa, Triticum aestivum
  Clone ID: PAT_TA_96596.pep
ISSITGQPLGLPIQVNPFRQPIEENNSALYIPCYSNGFVFGM

SEQ ID NO: 202179 - protein, 108 aa, Triticum aestivum
  unsure (1)..(108): unsure at all Xaa locations
  Clone ID: PAT_TA_96597.pep
AGCPFVEPEFDCQKYGRPDKLYLKYRWRPASCELPRFDGRDFLSRWKGKKVLFVGDSISLNQWEXSLVCMXHAXAPASXDHLQAGATPSPPVTFQGXYGCXVAYYRST

SEQ ID NO: 202180 - protein, 108 aa, Triticum aestivum
  unsure (1)..(108): unsure at all Xaa locations
  Clone ID: PAT_TA_96598.pep
AAGARCSPTWRPPPAPPPWSCPPPPTRGAPAGSRRPGRPAAATAPPASAAPRAAAPAAAATEPAPRRPAGRGEHEDEXRTSKQAPSPPSSPPPSVSSPSRRMRSRGRA

SEQ ID NO: 202181 - protein, 72 aa, Triticum aestivum
  Clone ID: PAT_TA_96599.pep
ERTSLEFFFFFFFFFFFFFFFFFFFFQEIQLFATPWLQKQQHTTCTTLYLLKSQLIGISHSDFYLCPVSTGG

SEQ ID NO: 202182 - protein, 81 aa, Triticum aestivum
  unsure (1)..(81): unsure at all Xaa locations
  Clone ID: PAT_TA_96600.pep
PVXENEVGXEDGRGEXARARMRXVMHXXCRXTTRXPGTGXRPRWRPPPQPPCDAMRCAGEVALVGWWRDLEEYAVGGGREG

SEQ ID NO: 202183 - protein, 113 aa, Triticum aestivum
  unsure (1)..(113): unsure at all Xaa locations
  Clone ID: PAT_TA_96601.pep
GKGDGEKGGGGLTGPCRCAIVCARRSRGGAGARGGRGRRRDGDGVAMTTGDGVGSTMRRGRGQAGVAQRRGGRGGXGRRASTRRGRQRRASGRRGRQVCAPDLDPDRGEGESG

SEQ ID NO: 202184 - protein, 55 aa, Triticum aestivum
  unsure (1)..(55): unsure at all Xaa locations
  Clone ID: PAT_TA_96602.pep
RXRRARTXXGRANDAXXRWAXXMRASQLLXXAXGLLPLPXASPNPPSGSPNLRPI

SEQ ID NO: 202185 - protein, 44 aa, Triticum aestivum
  Clone ID: PAT_TA_96603.pep
FFFFFFFFFFFFFFFFFFFFFFEPKCLKKLCISISETSNRTNTI

SEQ ID NO: 202186 - protein, 139 aa, Triticum aestivum
  unsure (1)..(139): unsure at all Xaa locations
  Clone ID: PAT_TA_96604.pep
TVGGGDDAFNTFFSETGAGKHVPRAVFVXLEPTVIDEVRTGAYRQLFHPEQLISGKEDAXNNFARGHYTIXGKEIVDLCLDRIRKLSDNCTGLQGFLVFNAVGGGTGSGLGXSLLLEPLSVXRXEKXSXLXVYSXTHTP

SEQ ID NO: 202187 - protein, 44 aa, Triticum aestivum
  Clone ID: PAT_TA_96605.pep
CFLSTGIELAGHRLWMFLVIFCTQGVWVFVRARFSHRSLRLTPT

SEQ ID NO: 202188 - protein, 138 aa, Triticum aestivum
  unsure (1)..(138): unsure at all Xaa locations
  Clone ID: PAT_TA_96606.pep
ALGGGGRITMRKAAPKASASNSPWYGPDRVLYLGPLSGEPPSYLSGEFPGDYGWDTAGLSADPETFAKNRELEVIHCRWAMLGALGCVFPELXARNGVKFXXGNSGFGGLPSEGAGLRITFGPWVPRSKIFQGALPKF

SEQ ID NO: 202189 - protein, 61 aa, Triticum aestivum
  unsure (1)..(61): unsure at all Xaa locations
  Clone ID: PAT_TA_96607.pep
QXLAQXHTLTISHARLKVXIQSHHSTTXGTIIVRKERKTSICPSIKNLAXRWAPIAXINXG

SEQ ID NO: 202190 - protein, 86 aa, Triticum aestivum
  unsure (1)..(86): unsure at all Xaa locations
  Clone ID: PAT_TA_96608.pep
XASSVXKRGQVPPALXXMRXSTGAAERLDXGLGRXGGLLRXXDLLGGDGRXHRGRLLRXRGRRVLDISGGHCRRGCKKMPGVAEAG

SEQ ID NO: 202191 - protein, 100 aa, Triticum aestivum
  unsure (1)..(100): unsure at all Xaa locations
  Clone ID: PAT_TA_96609.pep
MTFKRRNGGRNKHGRGHVKYIRCSNCXKCCPKDKAIKRFLVRNIVEHAAVXDVXDACVXDGXVXXKXXXKVHXCVSWAIXASHCPWXAPVRNRXEXXSPR

SEQ ID NO: 202192 - protein, 52 aa, Triticum aestivum
  unsure (1)..(52): unsure at all Xaa locations
  Clone ID: PAT_TA_96610.pep
PPSQPHRERASKLQLXXXQXAAALXLRXPFSVXXVAPPVPXVAXAPXALILA

SEQ ID NO: 202193 - protein, 116 aa, Triticum aestivum
  unsure (1)..(116): unsure at all Xaa locations
  Clone ID: PAT_TA_96611.pep
MKGTKLAAILILQAVLVMGLLSHVNADFFPKCCNNCRSFSGVDVCDDAHPKCPQGCSACRVVSXSPXMWPCXRDMKSTVDGTCGGPLQVLDFIPGMMFRPKNIKKLKARMSVHPWP

SEQ ID NO: 202194 - protein, 79 aa, Triticum aestivum
  Clone ID: PAT_TA_96612.pep
GLKNYVIAEPDIQETQVNSDLEYLVLATDGLWDVVQNEDVISLMRATDGPEAAAVKLTEMAHSRHSSDNITCIVVRFHH

SEQ ID NO: 202195 - protein, 122 aa, Triticum aestivum
  unsure (1)..(122): unsure at all Xaa locations
  Clone ID: PAT_TA_96613.pep
MARGLKKHLKRLNAPSHWMLDKLGGAFAPKPSSGPHKARECLPLILILRNRLKYALTYREVQVYPYASVISWVDGKGXALTKNYPAGFMGHQXSFPKTGWKNYXAFXXENGARFPFNSVGKG

SEQ ID NO: 202196 - protein, 107 aa, Triticum aestivum
  unsure (1)..(107): unsure at all Xaa locations
  Clone ID: PAT_TA_96614.pep
MAPTVMASSATSVAPFQGLKSTAGLPVSRRSNGASLGSVSNGGRIRCMQVWPIEGIKKFETLSYLPPLXTEALLKQVDYXLIRSKWVPCLEFXKVGFIFRXQNASPG

SEQ ID NO: 202197 - protein, 139 aa, Triticum aestivum
  unsure (1)..(139): unsure at all Xaa locations
  Clone ID: PAT_TA_96615.pep
XGPAWPCFLXFLPXRTRASPEGDAPLDGDCRRLRPPQTTADISTSSGARGASLGGVCCRRGAREKEQQGSRRRWSSDSGEQGLRWGNWVGKATGRCAGPRGTHRWWGNGERGTASPESGIARGGGHGGDGRQGAPRARA

SEQ ID NO: 202198 - protein, 70 aa, Triticum aestivum
  Clone ID: PAT_TA_96616.pep
LYPRLSAAANSTLFLQFLSFNIEDCNSSTKKKKAGHQPIRSTSYIRLRNYSHTTLQRHNYNNICTIVICP

SEQ ID NO: 202199 - protein, 104 aa, Triticum aestivum
  unsure (1)..(104): unsure at all Xaa locations
  Clone ID: PAT_TA_96617.pep
MARLNSKAVAAAVVLAAVVLMMAGREASAALSCGQVDSKLAPCVAYVTGRASSIXKECCSGVQGXLTAWPRSSPGRKITQVASKNPNKHQSPNMGQGSPGRSPA

SEQ ID NO: 202200 - protein, 116 aa, Triticum aestivum
  Clone ID: PAT_TA_96618.pep
LGADDKKKVEDAIEGTISWLDANQLAEADEFEDKMKELEGICNPIIAKMYQGAAPDMGGGMGMDEDMPAGGGGAGPKDRGGGLSFCCSVGGLRSRCLNGVSFPMPPGGVKSVCPQS

SEQ ID NO: 202201 - protein, 59 aa, Triticum aestivum
  Clone ID: PAT_TA_96619.pep
NNNHVVRTGNSFYRINICLTLAADGQHYNTMTHNSRFIQKYKRKLRLQHNQTNLYIQVH

SEQ ID NO: 202202 - protein, 126 aa, Triticum aestivum
  unsure (1)..(126): unsure at all Xaa locations
  Clone ID: PAT_TA_96620.pep
MSGRGKGGKGLGKGGAKRHRKVLRDNIQGITKPAIRRLARRGGVKRISGLIYEETRGVLKIFLENVIRDAVTYTEHARRKTVTAMDVVYRSSAXAAPSXGFGRLGRPKWSSVLVPACKFRCFPRSQ

SEQ ID NO: 202203 - protein, 118 aa, Triticum aestivum
  unsure (1)..(118): unsure at all Xaa locations
  Clone ID: PAT_TA_96621.pep
RRRRPRWRSRSPPRRSRRRRKPPRRWRPKXRRLPPSRLRRPREEAPAAXXGKRRQXTPXQAACRXRNREGRXXPXXWSKTXEPKEGPLAXRQKXXRRXRRKKGKRPAPCPKGRTASRF

SEQ ID NO: 202204 - protein, 98 aa, Triticum aestivum
  unsure (1)..(98): unsure at all Xaa locations
  Clone ID: PAT_TA_96622.pep
MGKEKTHINIVVIGHVDSGKSTTTGHLIYKLGGIDKRVIERFEKEAAXMNKRSFKYAWVLDKLKAERERGITIDIALWXKFEDQQSYYWPVIDAPXQR

SEQ ID NO: 202205 - protein, 78 aa, Triticum aestivum
  Clone ID: PAT_TA_96623.pep
EAKDYFFICSYGYCYSGMKLAVTAKKGPASSSPDSGSSSSSSPAAKSSSKSAASPLAARNAAPLAAAVGAAAMLLRML

SEQ ID NO: 202206 - protein, 108 aa, Triticum aestivum
  Clone ID: PAT_TA_96624.pep
DNFQDRTTIFQISGLIHLCLPPVKGRKTTPGAKRSSSLAAARRRVGEKQWGAEQLRESAFLGLGGAAEAGIDGSSTAAEAGEHRRDRGGTARSRSRGAASRRDCGGTG

SEQ ID NO: 202207 - protein, 126 aa, Triticum aestivum
  unsure (1)..(126): unsure at all Xaa locations
  Clone ID: PAT_TA_96625.pep
MSGRGKGGKGLGKGGAKRHRKVLRDNIQGITKPAIRRLARRGGVKRISGLIYEETRGVLKIFLENVIRDAVTYTEHARRKXTVTAMDVLYALXRQGRTLXRLRKAKRGFRRLGGKPVIELCSPVVR

SEQ ID NO: 202208 - protein, 75 aa, Triticum aestivum
  Clone ID: PAT_TA_96626.pep
RLQLAMRLAGVMRVRCPALYVRVLCWHVDACMLVYVVLSPAPTASATSSGHERRRRCLFSVKKAWVCLGHIKLKK

SEQ ID NO: 202209 - protein, 105 aa, Triticum aestivum
  unsure (1)..(105): unsure at all Xaa locations
  Clone ID: PAT_TA_96627.pep
MADQLTDEQIAEFKEAFSLFDKDGDGCITTKELXTVMRSLGXNPTEAELQDMINEVDADGNGTIXDFPEFLNLMAKKMKDXDSGXKELKEXRFGVFXTRDXKGFI

SEQ ID NO: 202210 - protein, 94 aa, Triticum aestivum
  unsure (1)..(94): unsure at all Xaa locations
  Clone ID: PAT_TA_96628.pep
RXLXXFMVNGXXGMXFLXRKIFEXAXGSPSLDXXGDGFXTAPPXQAPDDRPWXCPWMLSRRXFXWXLAPPLPSPLPPLXRGEGRGGEEAEDGMV

SEQ ID NO: 202211 - protein, 140 aa, Triticum aestivum
  unsure (1)..(140): unsure at all Xaa locations
  Clone ID: PAT_TA_96629.pep
KVGDSPVXESXLWFXFXEXWRNQSXSXVXXEXNLXRQPGGCASFSFLLEDQHKRKKQEDFDKKRAARLDKGSDVPGSVHAAELTVEEDVPCGSDGTVVPVKKKIKKTAVRKLVVGEVTPRRSPRVSRLAEVVEDEGLGLG

SEQ ID NO: 202212 - protein, 89 aa, Triticum aestivum
  unsure (1)..(89): unsure at all Xaa locations
  Clone ID: PAT_TA_96630.pep
MAPKAEKKPAAKKPAEEEPAAEKAEKAPAAKKPKAEKRLPAGKTASKEGGEKKGKXKSKKSVETYKIYIFKVLKXVAPRHPASPPRAPT

SEQ ID NO: 202213 - protein, 71 aa, Triticum aestivum
  unsure (1)..(71): unsure at all Xaa locations
  Clone ID: PAT_TA_96631.pep
VHSLHXRXNEYTIMHIIIHPWXVXMRELRYMYXFXSVSQRSPPSAXAGRLXXHXGAXGQXRPGLWXXRDPX

SEQ ID NO: 202214 - protein, 89 aa, Triticum aestivum
  Clone ID: PAT_TA_96632.pep
GSGCKCGNGCGGCKMYPEMDEGVNTTSETLIMGVAPSKGTPSFEAAAETGAENGGCKCGPNCTCNPVHLQVIHQIVARQTDPEGALSSC

SEQ ID NO: 202215 - protein, 138 aa, Triticum aestivum
  unsure (1)..(138): unsure at all Xaa locations
  Clone ID: PAT_TA_96633.pep
MGRVIRAQRKGAGSVFKSHTHHRKGPARFRSLDFGERNGYLKGVVTDVIHDPGRGAXPLAKVTFRHPVQVQSTRRSSFVAAEGMYTGQVRLMAXRRAXALPXGKXPSRSASAEGEGRSIFKGQPTGGTGFSPGLRDTV

SEQ ID NO: 202216 - protein, 89 aa, Triticum aestivum; identical to SEQ ID NO: 130083
  Clone ID: PAT_TA_96634.pep

SEQ ID NO: 202217 - protein, 79 aa, Triticum aestivum
  Clone ID: PAT_TA_96635.pep
LEFFLQNASADGLASTPSVACRRPSGREVGRPGTVEERISPDLARLHSPGGREGLTCCPRPDYDELDISVPNEGAWRTA

SEQ ID NO: 202218 - protein, 125 aa, Triticum aestivum
  unsure (1)..(125): unsure at all Xaa locations
  Clone ID: PAT_TA_96636.pep
PDPTTRPPHCASPPPLSSLVPPVQPAPSESSPLSNPARDSDLPCAPKKPAAATLLARAQPPDHLGLSGPPFIFLPRSKQAAGPSFPVRFHGLQVVPPPPRRSGIKAKPGAGKGLGGXGCKVGFLF

SEQ ID NO: 202219 - protein, 124 aa, Triticum aestivum
  unsure (1)..(124): unsure at all Xaa locations
  Clone ID: PAT_TA_96637.pep
MAPTVMASSATSVAPFQGLKSTAGLPVSRRSNGASLGSVSNGGRIRCMQVWPIEGIKKFETLSYLPPLSTEALLKQVDYXIRSKWVPCLQFXKGGFIFRXQNXTPGXYEXRFWXXWXXPKFGCN

SEQ ID NO: 202220 - protein, 84 aa, Triticum aestivum
  unsure (1)..(84): unsure at all Xaa locations
  Clone ID: PAT_TA_96638.pep
PIPIRPXXXMHEKXRAGRRAXKEAXKXGPXXHXPMXTRXDIXAVXSXXRXXFXSCGASWVAXSXRKMVARERNRWSXPVCFYFL

SEQ ID NO: 202221 - protein, 124 aa, Triticum aestivum
  unsure (1)..(124): unsure at all Xaa locations
  Clone ID: PAT_TA_96639.pep
GXLTVEERXLLSVAYKNVIGARRASWRIISSIXQKEESRGNEAYVASIKEYRXXIETELSKICDGILKLLDSHLVPSATAXAESKVFYLKMKGDYHRYLXEFKAGAGXEKKXAEKHSFNSPKLG

SEQ ID NO: 202222 - protein, 91 aa, Triticum aestivum
  unsure (1)..(91): unsure at all Xaa locations
  Clone ID: PAT_TA_96640.pep
GLGRRVLXALSPRWLXARLRDAYVNAMLRLASSAAVGYGSAPFCAAPEPFARTRPLKEYXEKVLVEMYRSILAGRCHPSLRTPWWSDPPSL

SEQ ID NO: 202223 - protein, 95 aa, Triticum aestivum
  unsure (1)..(95): unsure at all Xaa locations
  Clone ID: PAT_TA_96641.pep
MAPKXEXKPXAKKPAXEEPAAEKAPAXKKPKGEKRLPAGNTSAGKEGXQXNXXKKXAKKSVETXKDHSRWLKAPISSQRMICSLLSGFFPPRGGK

SEQ ID NO: 202224 - protein, 90 aa, Triticum aestivum
  unsure (1)..(90): unsure at all Xaa locations
  Clone ID: PAT_TA_96642.pep
GLNPRPNQRRPTQDLTSGRRDSRGANGLSWIVYQLNKISHGDELITSVPDKKDSLCQXDDQSQGGDTSTSSGPDLPEDIWVPCTFTNAIV

SEQ ID NO: 202225 - protein, 140 aa, Triticum aestivum
  unsure (1)..(140): unsure at all Xaa locations
  Clone ID: PAT_TA_96643.pep
AIQFPTSPLXTLRRTTAPLPXEAXASDXPQGGEEAGXRGXDPCGGXDHXGEEAQGRXAVAEVHXRAAPXXXRRXXMXDVXTYKIYIFKVAEXGWHPGTSASPSXGHVNHELPSSNEXSSXKAXPGGSXPXXGPRXXXRXP

SEQ ID NO: 202226 - protein, 77 aa, Triticum aestivum
  unsure (1)..(77): unsure at all Xaa locations
  Clone ID: PAT_TA_96644.pep
HPGLYRKNNXGCPLPXNTQPPSASRATFMMAQRGHGLSLEPELKWHDSRKRRPRRGPVSTHVPCRRNMMARGDKTTI

SEQ ID NO: 202227 - protein, 52 aa, Triticum aestivum
  unsure (1)..(52): unsure at all Xaa locations
  Clone ID: PAT_TA_96645.pep
RXMRPTXKWRRXVTXXXHXXVPLXRPSWPSLFPLRRARTPRNAAVDGMRGTA

SEQ ID NO: 202228 - protein, 113 aa, Triticum aestivum
  unsure (1)..(113): unsure at all Xaa locations
  Clone ID: PAT_TA_96646.pep
MAEEKHHHHLFHHKKEGEDFQPAADGGVDMYGYSTETVVTATGNEGEYERITKEEKHHKHKXHLGEMGAAAAGAFALYEKHEGEEGTRXHPHKAQRFEGGKVGRPAVRPGSFL

SEQ ID NO: 202229 - protein, 53 aa, Triticum aestivum
  unsure (1)..(53): unsure at all Xaa locations
  Clone ID: PAT_TA_96647.pep
ILXPTVXXXRGHRXMXTPIVLCXXELXDAXXAQVIXSFELPTFLXXKXYVLLS

SEQ ID NO: 202230 - protein, 88 aa, Triticum aestivum
  unsure (1)..(88): unsure at all Xaa locations
  Clone ID: PAT_TA_96648.pep
AXPXKVXNYSWILFXVAMLERVGLLGEQHRXGCWGNTPRMGPXVXXVTQPWDRLLXPLRCAXIXXVGPPXXMPXSXFVCSLGXXLPXQ

SEQ ID NO: 202231 - protein, 75 aa, Triticum aestivum
  unsure (1)..(75): unsure at all Xaa locations
  Clone ID: PAT_TA_96649.pep
XTXEDGGLVDEGVERHGSGGKGREXWLLGXEVXLXXWGARRXDXXVEEYXRRGGXGLDGEVKEGRXRXCXWCSSP

SEQ ID NO: 202232 - protein, 76 aa, Triticum aestivum
  unsure (1)..(76): unsure at all Xaa locations
  Clone ID: PAT_TA_96650.pep
RTHTSERXXRRGKTTGECXDXWCTGRVXPRGWRKMXXTXLTPASXRPFXPALVXSKALXXARXSEAMVDGWMDELT

SEQ ID NO: 202233 - protein, 81 aa, Triticum aestivum
  unsure (1)..(81): unsure at all Xaa locations
  Clone ID: PAT_TA_96651.pep
MXDVDVXTEVAAGAQPKKRTFRKFSYRGVDLDALLXMSTDDLVQMFPARARXRFXRGXKRKXMALVKEXCRKXXKGXAPXG

SEQ ID NO: 202234 - protein, 77 aa, Triticum aestivum
  unsure (1)..(77): unsure at all Xaa locations
  Clone ID: PAT_TA_96652.pep
ARXXTDAXDEEAXVLDXIVXAXARLIXXCHXSPPWAXGPAPXRREPAXRAPYPWRLRRWSGGRFGEENGGRSGGGGV

SEQ ID NO: 202235 - protein, 111 aa, Triticum aestivum
  Clone ID: PAT_TA_96653.pep
MAGRKGGDRKKAVTRSVKAGLQFPVGRIGRYLKKGRYAQRVGSGAPVYLAAVLEYLAAEVLELAGNAVKDNKKTRIIPRHLLLAVRNDQEARAGLLAGVTIAQRRALIPQH

SEQ ID NO: 202236 - protein, 62 aa, Triticum aestivum
  unsure (1)..(62): unsure at all Xaa locations
  Clone ID: PAT_TA_96654.pep
MGXMPVXMKAVVYALSPFQQQVMPGLWKDITTXIHHIVSENWISATLLITPRRGLPSPLLVR

SEQ ID NO: 202237 - protein, 76 aa, Triticum aestivum
  unsure (1)..(76): unsure at all Xaa locations
  Clone ID: PAT_TA_96655.pep
GSNXXXXTVXMAHLYSLMLGPXXDXTDRVRXXGVRRXGSIPRAASQVEGGAXEPXEIRGXVXSVTCGCVSVPRXAS

SEQ ID NO: 202238 - protein, 107 aa, Triticum aestivum
  unsure (1)..(107): unsure at all Xaa locations
  Clone ID: PAT_TA_96656.pep
CIXDXNPXDPLVPEXAHMYKTDPXQVRDDSXQRGRRXMPWDXPXPMLVSTACMRKXVLLSREXXSGPLFSLITXLXACVSLXHVGSRRSQNINVSLPKSIMKLTYGY

SEQ ID NO: 202239 - protein, 106 aa, Triticum aestivum
  unsure (1)..(106): unsure at all Xaa locations
  Clone ID: PAT_TA_96657.pep
PRSPPPSSSHAPCTTPRSTNPPPPXAGQLPPRPLPPPVLLXTAPPSLVRPSPPETGDLDRVPHHPIAVDPCAPPTSRGCRGSGCGHRRLHLPSIPQPAPAGVGRPP

SEQ ID NO: 202240 - protein, 117 aa, Triticum aestivum
  Clone ID: PAT_TA_96658.pep
GILEWLAPMAHATVRWQAERSFEQRKTTSTSSTTDIARLPPRHGGGGGGNTFLLQTLQFADRDKVEAAVAELLVGLNYVWRFEKEMSCRALFAVHREFVERGGRPSDFDGGADSCRG

SEQ ID NO: 202241 - protein, 77 aa, Triticum aestivum
  unsure (1)..(77): unsure at all Xaa locations
  Clone ID: PAT_TA_96659.pep
STSPPPHATSQITTLPHPPPPPHPLELQXPIPWRXPSTPRPPPRPPRPSTXTPSSASLTPPXPXRPXFXVXGGLISR

SEQ ID NO: 202242 - protein, 141 aa, Triticum aestivum
  unsure (1)..(141): unsure at all Xaa locations
  Clone ID: PAT_TA_96660.pep
AKSTLPHPSLPCLLPSSALLLALQSPPPHAPPADHRPKSIHPPQSHRRARARRSEHKEAEWAARWAPSSAATPRPPPPAAPGETTPTTRAAAGARPAWALSGXTGGAATWPSSSSSPPSGSPMIGQLQASPSNGAQADNTS

SEQ ID NO: 202243 - protein, 100 aa, Triticum aestivum; identical to SEQ ID NO: 170998
  Clone ID: PAT_TA_96661.pep

SEQ ID NO: 202244 - protein, 104 aa, Triticum aestivum
  unsure (1)..(104): unsure at all Xaa locations
  Clone ID: PAT_TA_96662.pep
FFQXXKXLQXFXLXPXXXFGGFFXXKRXELXLPXXAFMTXILXNLXXVGFPXQALKIWXXDXXHSXLWCSPPNVGTTIFLVCSAQLPQXLVXVASXLENXSNYX
